United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 15

SEQ ID NO: 366 - DNA, 1041718 bp, Homo sapiens
atacacacatatatacatatatatgtgtgtgtatatatatacacatatatatatacgtatatatgtgtgtgtgtgtatatatatatattccattcattctgtccatctaaacaaccctgactaatgcagattgtggtaccagcagtagttctagaagaacagaatattaaggatggagttctttcattggttttgaggtttctggatttggctgcttaatatgactagaccccaaaatgctaaagactctacttctaatagtatggagagcattgatagtccttggcaggaactgtttagagagttatgcaaaataaatgcatttgacactcctgattcatcactcataagaggcaaggagtttagcgactctatacataataccattgaccatatgtcaagaaccaaggaacacaatgaagctggttggtccctcttaagttcagcggacaaagtgatgaaagaaaatgatgacctcagggattctatctcctgtcttcagaagcagatactgagcctcaaatctgctaagactgccctgagtgagagtcttacctcctggagagaaagagctaaaactgtggaaaaacagacacaaacttatcatgtgagtggctgacttgcaatgaaagctgcatgcacagccttgccaggtgtctactgttaaagtgagggcattgattggaaaagtatgggaccctgcaacttggaatagagacatgtgggaggaccctgatgaagctgggaacactgagctctgaattgaaataggattaaaagacggcccactgtgagcaagctggaaatgcctgatctcccttggtttactgtagagggagggatccaaaggcttaaagagattgggatgatggagtggattagtcactttagacctactcatttcagctgggagggccaagaagatatactcttgaccaaagccttgtgaaatagatttgtgagggcagcacctgcatcattgaagaaccctataattgcttttctctgtatgtgagatctaacagtgggaactgcagtcactcaactacaaaatttaaatacaatgagaataattggatcccaaggtggcagaagtcaagtggcagcactcaaccatccaaggcaagatggacagcagaggcaaagcaacaatcagaatagtctgactcatgtagggcactgacattggctaattaatcacagtgttcctagaagtgaaattgataggaagcctgctgcattccaatttaatttatataaacagaaaatgtctagcttaaatgtacaaaagactaatttgaattacagaaacagagaatcatagcccctcaatcaatttccagagttgagccagtttacagacccagaatcccttgaatgaaggagaggccaggtccccttgaggaagggccccactacattaccaacaatttatgcagtgaatctttctcccatccttccccagtgagaactccagccttttatcagggtaactgtgcaatggggaaagggaaatgatcagatatttcagggactactggaccctgcctctgagctgacgttgattttaggggacccaaaatgtcactgtggtcttccggttaaagtagaggcttattgaggtcagataattaatggagttttagctcaggtctgacttacagtgagtccagtgggtccctggactcatcctgtggtcattttcccagtgtgagaatgcagaattggcatagacatacttaacagctggcagaacccctgcaatgccttcctgactggtagggtgagagccaatatggtgggaaaagccaaatggaagcctttagagctgcctctacctagaaaaatagtgaatcaaaaacaatattgcatccctgcagggattgcagagattagtgccaccatcaaggacttgaaagatgcaggagtggtgatttccaccacatccccatttaactctcccatttggccggtgcagaagacagatggatcttggagaatgacagtgggttatcgtaagcttaaccaagtggtgactccaattgcagctgctgtaccagatgtggcttcattgcttgagcaaattaacacatctcctgatacctggtatgcagccactgacttggcaaatgcctttttctccattcttgtccattaggcccatcagaagcaatttgccttcagctggcaagaccagcaatattttttactgtcctatctcaggggtatatcaactctctggctttgtgtcgtaatcttattcggagagatcttgatcacttttcgcttccacaagatatcacaatggtccattacacagatgacattacgctgtctggatccagtgagcaagaagtagcaaacacactggacttattggtgagacatttgcatgccagaggataggaaataaatccgactaaaattcagggatcttctacctcagtaaaatttctagagtttcagtggtgtgcagactgttgagatattccttctaaggtgaagattaagttgctgcatgtggtccctcctacaaccaagaaagaaacacaatgcctagtggagctacttggattttgaaggcaacacatttctcatttaggtgtgttactctggcccatttatcaagttacccaaaaggctgccagttttgagtctggtccagaacaggagaaggctctgcaacaggtccaggctgctgtgcaagctgctctgccacttgggccatatgatccaacagatccaacggtgattgaggtgtcagtggcagatagggatactgtttggaccctttggtagacccccataggtgaatcacagtggagggctctaggatattggagcaaggccctgccatcttctgcagacaactactctccttttgagagacatctcttgacctgttactgggctttggtgggaactgaacgtttgactatgggtcatcaaatcaccatgccacctgaactccctattgtgaactgggtgctttctgacccatctagccataaagtcgctcatacacagcagcattccatcatcaaatggaagtgtatatgtgatccagcttgagcaggtcctgaaggcacaagtaagttacatgaggaagtggctcaaatgcccatggtctccattcctgccaccctgccttctctccctcagcctgtaccaatggcttcatgggcagttccctatgataagctggcagaagaagagaagactaggacctggttcacagatgattctgcacaatatgcaggcaccacctgaaagtggacagctatagcactacagcccctttctaggacatccctgaaggacagcagtgaagggcaatcttcccagtgggcagaattttgagcagtgtacctggttgtgcactttgcatggaaggagaaatggccagatgtgtgattgtatactgattcatgggctgtagccaatggtttggctggatggtcagggacttggaaaaagcatgattggaaaactgatgacgaagaaatttggggaagaggtatgtggatggatttctctgagtgggcaaaaattgtgaagatatttgtatccatgtgagtgctctccaacagggtgacctcagcagaggaggattttaataatcaagtggataggatgacctgttctgtggacgcctctttccccagtcacccctgccatcgcccaatgagcccatgaacaaagtggccatggtggcagggacggaggttacacatgggctcagcaacatggacttccactcaccatggctgacctggctatggccactgctgagtgcccaatttgccagcagcagagaccaacactgagcactcgatatggcaccgttcctcagggttagcagccagctacctggtggctggttgattatattgcacctcttccatcatgagaagggcagaggtttgtcctcatgggaacagacacttactctggatataggtttgcctatcctacatacaatgcttctgcctagactatcatctgtggcctcatgggatgccttatccactgtcatggtattccacacaacactgcccgtgaccaaggcactctctttacaggtaaagaagtgcagcagtgggctcatgctcatggaattcactgttcttaccatgttccccatcatcctgaagcagctggattgatagaatggtggaatggccttttgaagtcacaattataacaccaactaggtgacaatattttgcagagctggggcaaagttctccagaaggctgtgtatgctcagaagcagtgcccgctatatggtactgtttctcccatagccaggattcatgggtccaggattcaatgggtggaagtggaagtagcactaacaaaatgtttgcttcctgttcctacaacattacattctgctggcctagaggtcttagttccagaaggaggaatgctgccaccaggagacccaatgattccattaagctgaaagttaaaattcccatgtagacactttgggctcttcctacttttaagtcaatacgctaagaagggagttacagtgttagctggggtgactgacctggactgtcaagaagaaatcagtctactactccaccacgaaggtaaggaagagtatgcatgaaatacaggagatccattagagtgtctcttagtattaccatgccctgtgattaaggtcaatggaaagtacaacagcccaatccaaacaggactacgaatgaccagacccttcaggaatgaaggtttgcatcactctaccaggaaaaaaaaacaacacacacacatacacacacacacactcacacacacaccctgctaaggtgcttgctgaaggcaaagggaatacagaatggatagtagaagaaggcagtcatcaataccagctatgaccaggtgacctgctgcagctatggggactgtaattgtcatgagttatttcctccttcttttgttaaaaatatgtttgtgcttgtatacacttgtactaagaaaatatcttcattttatttcctttctcctttcccatgtgacataagagtttttgacttcacatgagcatttaagtgttgttaactttatgtaatagtgttcgggttggggattggtgggtttccgtttgtatgaaagatagctgtattatgttaggcataattatgaccttattactgtcattatttgaagattatgtatgatatcaggaaatgcatatgggttcaagttgacaaaggtagacttgtgatggttaatactgagtgtcaacttgattggatctaaggatacaaagtattgatcctgggtgtgtctgtgagggtgttgccaaaggagattaacatttcagtcagcgggttgggaaaggcagactcacccttaatctgggtagacacaatctaatcatctgccagcttggctagaatataagcaggcagaaaaatgcgaaaagtgagactgacctagcctcccagactgcatctctctcccatgctggatgctccctgcccttgaatatcagactccaagttcttcattgttggaactcggactggctctccttgctcctcagcttgcagacagcctattgtgggaccctgtgatcctgtgagttagtacttaataaactcccatatatatatatatatatatatatatatatatatatatatatatggcatatatataaaacatatatatataaaactcccatatatatataaatatatatatattccattagttctgtctctttagagagccctaatacagcattgctctaaaagtttaacttagttgatgcttactaaattctcccaaaaactctatatgtgcattattacccctcccattttataaataagaaaaccaaagcacaaagagctaagcaatttacctaagactacatagttgataaatggcagagcttggattatgaaactcaatgtctggctgcagagtccatgaacttaatagttaataacctggatacatgtttttggtctattgtcaagtgaaaaaaagcaggttaaaagatgttgtgcatgatatcaccctatttttgttagaaaatggtttgtataaaaatgacatcaattatctctggatggaagaattggtggctattttcatcttatatgccattaacatttaaaatatactatcattttcctaatcattatccaaacaagaaaaaaatccatgttaatataaaatatataatgtgtacaatgagtcaaataggttggttttgtgattgtaaagatgtgattattatgcatcctatgcctgtatcgaaatgtctcctgtaccccataaatatatacatctactatgtacccacaaaaatcttcaagagaactaatttttgctttcatgatttaaaataatgaatggaggcaataaaactcagtgaaattgtttagcagagttgcaacgccaagcttgagcttttggtgtagctgaagtgattgagtgttagcagtctgtaacccggttcactcagtggctgtgtgcctactgcattgcatgagttgttctgagagataaatgagataatagatctgaaacaaccttgaaaactactttaaaacagtacgggaaggtgaggcagatggaggtgtggaatgtgcagcacattttccccatagaaacaaggcaattcacaatacttatgtcaccatattagtcaacaaaaggtctaacaccttatatagcaaaacagtttatgaccttatttctaagtgaaaatgcaatcaacattcaaattggagacatctctctccttcacaaacgtctgtggaactgttgggattctctttttagtctcttctactaagacactcagttccaggaataatagaaaacagaataggaagtgcatagccacattaagttatagaattgcatctataactagggtgccctttcataagtcaggcattgcctatactgtatgtaaaggatgtgatgccaatttagagataaaatatgtgtgattattcttctaaatatttttgtcatcactttcgtatggaattctaaaagaatgacagggaagtatattgaaataaaggagtgtggtacagtagttcgaaaagcgaattttggtgtcttataatcatgcccttcaaattctaattctgccgccaagaacacgtgcacccgtgataaaaatatttgatttctctctgagtttgtatatctttagaatgtgcattgtatcaactcatgtgtttcctgtgaggaatgaatgagacgatgtaggtttagtacataaggcagtagttgcacatagtgaagtctcaacattgtttgtagttcacacttctgagaacactgtgccaatgacgtcagatgaggtataaaagcccctggagactgccttaggttgggattctcaagaggcaggctctgacacaaggatttgagtggtttatttcagaggtgatcccaggaagcagtggtatgaaagcagggagatgaggcatggaagggaaggaagccaattcagagcgcatgaatgagccagttactactgtggacacctagggctcaatctcggtggggaccttaatggtgtagactagaacatgtctgacggtttcccatatgaggattgaagaagctggggtatttatcctccaattcccatccattattgcgtgagggtagctcttagggctggaaccttattgttcagccaagcacctccaatggctagaaaacagactgtcccaagtgattacaaaaacgcaagcatggactgaaagggcacagtccaagaactatggtggggcactgctggagtcagctacagatagcattctgctttcctatacaacctaaagattactcaggctattgctggttgcagggaaacctctgcaggattacggagggatccatataaatgtgttgttcctatgattaatttgaggaggtaatagaatgcttttgacagtatggcagcagcttcttcaacagtcaattaacttacagctttctgtttggcaatgcaaaatacccatagccctagcaggtacaggacagctaacgtgtataaagacagaagagcaactaagagaaacattttccactagataactggcttcagttttaccaaaggttgtggaactattaccttccaggctttgcagtgcctaagagcacatattgggctcttgggaattttattaaacattgaaagacacttttcagaagaaaagcccctttacaaatgggtcgattaaaaccagacattctcattatagcaataaaatatctgtgctccataaatttaacaaagttaatccctttttggctccctaggactgacgaaacgtttctgaaaattcagtgccaggctctggagaatagtctctctgccctattcaatttatttgtatttagtcattctgatacgtcataatgtttattcaaaggaagcaatcattcgggatccttatttgtggttcccagcataactttatcctgtataaatgccatttttctcagtaggcgccaagttccagttgctacagagagctctctgcttgatgtggcttcgtcatcttaatctcttaagaagggtgctagggagctgtttgctatttagctccctaaaccatcctcttatcaatcgcgacacttcaccccaatgagtcagttcctcagtggatctcaacaaataatcttcacttcctggaaaagttaggattgctttccttagctgccagggctaaaaaggaaacttggtcctaaatatccacgccccaggggcagccacttgggccagcatgttgcgcccttcagctttccgcccgcaggtggcagcagcgggctccgaagcctgtctctgcaggtagcagccgcttcacagctttcaggccggtgctcagcggaggctggtgcatctccactaggaatccacacccagctgggactgctgtgaagctgaagtaactgagtattaaactagtctccgactctttagtattttaagtgaaaacaaacaacagtttgaagcagcaacagcaactcattgcatccctattccctccggttgctaatttttcccaactccagcagcaactcggtccccttccccaagcagggtcggctccgtagctctccgcgctccgacccttcagatcctcgggagcccaggggagccaggtgctgggcggtgcgtccggtgccgccgcgccccttctcgccacctctggcctctccgccactcgggctttccggccgctctggatgcctcggttgcacccctgttccatgaccccagcttccttccctaaccctcctcttggtcccttctcccccgagcgcgcgcgcacacacacactcggttcgctcccgcggagtggctctgggagcacgaccgacttcagctcagcaaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttggccccctgggagggggcggcagggagcaggatgaaggatttgttgtaggaggaggattcacacatctgggcgaagggaggggcagcgccgctgctgggacgcggcgcggacccgcatcattgcgcgcagcagccgctgcagcagccgccggggaccgcggagccgggacgcccccgctcggcccgcgccccgctccccgccccacccccgcccgccgggcccagcaacgcagggtgcctaggagccgcgggctgcgcagggaggcgggcagcggccctcgcgcgcttctgccgcccccggagccggcgcgcggcgagcgcagggcgagcgcgcgtcgggcggcggccgcgctggggggcgtgaggcgagcggcgcggagagcggcaggggcgaaacttcgcgggccagatgcccgagggcgcggcggcgctgccaggctgccgctgctgcccctgcgggccccgagcgcgcctccgcaggcggcactgcccgcggcgcggcgtgtgcaccgagcgagtgaaggtatgtgtggcgggcgcggctggagctgccgccgccgccgccgccgcgccagcaggtcctaatgcctgtcacttcccaggacgctggcagcagcagcagcccggagcccccgagccctcggcaggtttgcgtgtccttccccgcgatctgattggataaagtgggggctcgacggtggccgacgtgggacagtctggctgtggcaggggtctcggaaaccatgggttattgcagtggcaggtgcacgcttatctttatctgtggcatgcaactggtaagtgacacttgggtccccttattctgtaatgtgtctttgagatagtgggcaggggagtgcagcaaagggtctgccattgactagaatggacgaaaaagataaaagagaaggtgacagatatattgcctatattgaagatgatttcagggagacgcactctggggtacaggagaggtgagcctttccgttcccacctatttctgtcccttttaagacagtttggcaggtgcgggttaaacttgtctttaatttctttaggaaaagcaagatgtagctcttgttctttatgctttgcattcctattcatgtaacaacgtgattgtcacctacaatttaccgtacaggttgttaaacagaggaatacggaattttggacttttcttctctatactaattttgcagtatctttgtttcttcatagacatgttttttttctttttttaaggaaaatgttgtctttaagtataatgctctaaaaaaaccactgtttagggcacatggtatccttacaacagtctaatttagactgtttgagttttagccacattgagtttttaaagtatgcagattgaacaaaaatacttaggtgaactcagcaacaccattgtcatagacggaaccagtaacctttaaatcacaattaacacagacaattccaagaaaaactattctgtcttacattatgcatattattgctcctgaaatagatactgttgtctgatcctataggatggagaattctatgtactttttgaggaatgttgtacagttgcaaaggggcaaggaaccaataatggaaaacgtcatgtctctgaatttcaattccctaagggcaatggaaggagggtctgagtagagagttgagaggtgaaaaatacaccactctaagtggttaatttgaggtaggagctacttgctcacacttgtcattaaatatatttccttagaaagtataaattaactggaatagtcatgtccgttttcaacaactgtttcataaaggttgaagtgactacaaggcagaagatgtttaagtgtccaatcagtaaagtgttcaaaagagcaaggatttgccattgaaactggcagaggaattccttaagtgttcttgtttatcagttgtcgtgaagcccatgagtgttagttattgctgctttgtttaatatttagctgaaacagtgctttttgttgtgtgttgtcttaggatgtttttctttcccctgaaagttatctgatggtgtctattttgatctgtgatttatgcgcttatgcacttggttgtaagacaaagatggaactataaatgtaattttcagaatgtggtagtttctcaatgatgtgtaaaccagtttatttttctgtaccacagattcatataagttttgcaatgaaggatttttactcttaataataaagctaaccaaaacaatgagggagtttactttgttaaacaacccattaggctaagtctgccaaactgtataaaggttttcaaaacattcttatttttatatattattcagaaaaagaatacatttgctgattcactgtgtgaaagcataaaaatgtgagaatgagtgggtgtgtagatcattcttatgctcttttcgatttaaaatttgaaaaatgtgatttaacttctaatcatgtaatataatagggctttcttatggcaaatgtatgcactaggtctgtatgacattttgtgtgatgaatacaaactcctcaagaacttaattttagaaaaacataaatataccagtagggaagctatctattcaaagtagaatgataaagctaaaggttcctttgtgtttttatgtgctcacatatgtgtgtatgtacatatgctcttgagtacatgcatgcatccatacatacaatggtgtcttggagagttgcaccatcacttatgaaacagaaattctgaattataattaagttctctaacagaatagacgtagctgtaatacagaagagcacaatctaagtaagtgtacattggaatcctaaggagtttttatattatatgagaatcatgtgatttttcccattcagactttatgtgccaccaggctaatataattagcagccatgttaacgcagatgcagaacaaaaaacaaaggacaaagaaaatgcaattgttttgatagggtgaaatgatcacacctcaaaggacctcagagattcttggtaattgttgctttttggaaatacggtatttgattttaaataaaataattcttttgcaaattaatagttgcaaagccctgcactaaaaaataggtgggtgtgtatgttttccttttgctctcaatagatttttaaaaactttttatgtctttgcgctattatgagtagattgttttacaaataaaccaggtttctagactaagttatgactcatgtaccattgactgaaataaaagttaacccagttttgtttacttctcaagtgtttagtatgtgttcttgtaacatttgggcatcttttttttggtaactgtacaggaaaaaaggccaaagagactctaagttagaaactttattcagttgctttattatgtgacttgattaaggttctggaaacattaatctccagtcctcggagcaaagtatttgtattttaaataaatttaagggaatatttacatctgtaccaatttgcagctaatcttaggagaggatgaggtggcttttggtattgtggatatggtgatctcatttattaagttattatcagaccagacacggtgttttgaccatttaacaattgagggacagaggcagattcttcagagacatttacctgtcagaattctatatctgtgctttaaattagttaaatatacatttaatttaatgtttggcagactacaagtattgataaacatatactcttctcaaaaatcaggagatccgtttataaaacaagaaactagaattccataccatagagattcatacaaaacttccattttatgaaaaactgtttccatatatatcataaattaaaatctttgagttgtatggttatgccaacttcagattttagggtgattcctacgtaaaggagtatgatctctggaaacagatttattccatgtgcagaatccagagcttaagctcataatctcaagaaggtaattttctttttatcattgctgtccttaatactcagaaactgaagatttcagatagtaacaaaaatcatcactgcatttgcaatggtggatgtagtggtataggacaagaagtttttaacttcttatttactatttgtaactttcaacttgtgaaagttttggcatgttttccccaatgtttgattgaatcagagttcttttataaatgtggaaaaaattactctgatatctctcagtgtgaaaaaatacgttaaaatatgaaagaatataacttaatttagactgaaaggacagatttgttttcaagtaaggaaactcaaaatcccctattttgtactttagacttctgggtggcacaaaacatgtcataaactattgaaagaaagtttagatttacactccacagaataacacttgaaaaatgccactattgccatgggctgtatgaaatattgttaacttggagcaggtgcaactaacaattaggttagtacacattgtgtgtgcagctgtgtgaaggagtacatttgaaacttaattaagaatgatcagttactttctatcacaggattgctaaccattttcaaaggtacatattttttttccttaagatgttgtgagtgtagactaaattaaaaacaattttattataattatggaatatttcagtgatcatgattttatgcagtgttcataatcatgtgctattttattactttttagaaaataaagcgttgctgtgaagtagcttgaaaagtgcaggtagaatcttatgatattcctggtatacttctgacaagtttgacggtttttcagaagtttataactttatctgccacaaaacttcctggctcagagaattttaactttttaggattcagatgccattgatgataaaatcttgaagttgttaaccaaacttactcatgaagaagactgaaaatccccatacaatactttagaaacttatcatgtaaaaatatgttgagtttgctaagttgtaaaatgataactttcttctttttaaatgttttctatttatgcatcctgaatattgttgcacatggttttgtttttaatttattctcactgtaattcagcactactcttctctgccttatatataccaggagatacctagaaacttcttccagtgtccaactcttctttcttcgttcacaaagcaggtagcgacttattttcttgaatacagctaaagtttcaaaaagtcaacccatgtggagctgttctcctgctttctcaaataaaggcttggatgggcagcattttttctgcagagtgccagagtcatctctggcatggggcccgtatgtgggtaatgacccagaaatgcaaatgtgctttgctacctcctttccctctgatgctgctttactttgaggtcagattctctacttgcccagtcaggaatttcagagtggaagtcagggattccttaaaataggaagtctttattttttgttttttatttttaatatgtgtgtgcttgagagaaataaaatctgagagacagaaacatattttaacatttctatgttgatcctggaaatataaatacaaaagttaatggcaccaattgcattaaatattcgtatatacagataatgcctacaattccaaaggttgtatttcagttatgttatttggtagaatttcaaacagtgcagtatacttttttcataagcagttttgaaactaatattgctattaatggaaattaccctatttccaataacatacaaatgtcagaaatgaaacacacacataggaaaaatatttgtttcccattttttttctgatataatgaactcttctgatttttgttatttttttcccctcatggaaacttgattgttgtttattatcaatataataaaatacataagccatcaagatacaatgtatgtagggctaccttttttcatacaatgatagaataagtactctatttattcctaatttctataggatggaaataaaattatatgaagcatttgttcttaccattcccaagagattaaagcacatttaaaaattatgaaggaacaagataaacttctatatcattttctttctccaggttatggtagaaatgaagtttataacttggttttctcctcttttagtatttcaggagttcatattttgtaatactgctgtgcacatgtgcgcacgtaataaatttgttacgctttttcttttgttaaaaaatacttcagttgtgtttagatataaaatgcttaatatataaagaaattactagcttcatcttcctgaaataagtatttttctttttctttccttgaattataaaacaggcagtgggtctagcttataggaatattctaagatttaatcttatgcaggtatagactctttttgtttttccaacctgaaataagaataaggtgacttcaaaagcttatgatttttaccctttcagctagttgtggatcacatgctaacttgatccctgtaaaaactccttgaaatgctacatataaactgatttttaagtgcattttgaaataaattttttcatttcatacatttttaaataatttgttatgcatttaaaaatctagttttataaaataataatgaaaactattatttattggaagcttgttcttggctaaatatgtttttttttccccccactgaatcctctctggtaatcctatgaggcaggtaatagatattaatatcctcactttaccagggaggagatggaggccttgaaacgttaagctgtgtttttaagtcatcctcttagtaagtggagaagcttggattcaaacccgggtctgtctgaatctcagcctgactctgaacctgtgccacactgcatcccttccatgtaaaataaaactatagcagcctctcatgttttttttttcttaaagaaagtaagtacctacctactaattccttagtgacccattagtcaacacttaggtttagagaggtggggttgattgatgtcaggctcctgtccaaacctgaccgacttaggtaatcttggggtttgacaactatgagcagctggtgtatggactagagaataaaagggcagaaggggaatctcctcgctgcagagcaagtatccattgctgttctcatgcatttgggccaacttttgacagataaccatgaaatagggtcttggaaatttgatatgtaagcttaaaatgtattatatggaaagaaaaaatatattcttttttttttttaaatccagctctttttaaaaccactccttgatgaatggccagtgcacagtattgttatttgcctgttttttgtttgtttgtttgctcgtttgttttttacatgctccaaatcctaaattcatccagaccaccattgaccaataatatttgccataattattgtacttgggaagaaatagagtaaatatgttatttaaaatatgtgttgaatatgcttgaacacattttgaacctgagtgtgcatcagaatctcctgcaggatttttaaacatagatttttgggccctctcctagagtttctgactgcagaggcctgggctaggaccagagaatttgtattgctaaggaattcccagatgatactgatgttgatgatcaggcaccaaattttgagaactactggcctagaatatgtgtcttcacctaatggtgttacaagagaaagtgaacctgtttttgaaattcttcaatccaactagataattaactaaattcttcctatggccttctactgatatgagagaaaacttttcttcaggacctatttctgacttttagcttagttctattcagaagtttaaataggagaaatgcaaggtctttccagcgcgtttgtgtctttgtaatgtattgaaatatagaggaatctgaaagcaagcaccctcatgtctggtaatgctagaacagaattggatccttcacctgcctctctttactagcctagccactcattagggtaagcacagcgctggggtgggggttgtgggggggtgggggagagagggagagagaaagagagagagagagactgaaaaagtactgggctaagttagaagctggattttaatataccaaggagcttagtgcttctgtattgggtgactaaataactatgactttgcttgagacatttatatttctgggtgctgtttcctcatttgaaaaatagggcaaataattcctgacctatttaccctatagaataggagtatctaggggagataatatgctaaaagttaacatctttacagttttaatgttttaacctttcagaacagtccatctagtgagcccaggagtagttaaagggaagtttatggccaatggccctagttagaacaactagttttttttcatagaatcatttttttcttcacccacccataaattttgtgaggctttataaataattaaaacactaggtacaggtagtttgaactagataatatgctatgcgcctgatatacgtactttaagtattcattaaaatgaaacttggattttacaaacaagtcaacattgttcttcaggccagtatttctaaaactgtgttctgtggacactagttcagcaagacattctactgagcaagaactcttatgccccccaccgcccccaccctcaagggtcacagtgcatattagcatattagcagctacaggaagtcctgcactaaacctctgcttaattccatttaactcagcaaatatttacagagtgcttgcagtgaaccaagaaatgtctttttctgatatcccctattaatcttccatggaactagcattttcagcaatacttttcagtgaaatattactccaggctaatgatgcagtctacaagttaatattcagtgattgcctacacaatatttaaaggttaagaattcagtacagaaactcaactgattaagcagatatctaacaaataatgcataaagatatttaagaatatagaatattatcaagttattaaaacaaatgaatagaaacttgttttcagatgcttggctattttatattatatatgttcacttgagtttcttgaaattatgtttcggacactaaaatcaaaacccttaactgaagctcagtcaagtccaattgctgatgttgcaaagaggttgacatgttgcagtagttttggaacttctgatatttagaactccagaacaccttggagagggcatttgcagaagcactttcgttttaaggcagtggatgaggagcaatgtctgtatcctacatctctaggcaggctagcttttccagcatctcagcctacatatttgccttaggcgggggagtggtgaagaatcctcatactgacttttgttttttaatcaatgcattacactctaaaacagtaacacatttaaaacccccaacaatgttgcattctttggaaacaaatgagtcttagtttgaaatggaggaatcaaattggtacaccctactcttaacagaagtctttgtgtgcatctgtattattctaattacacaacagaataaggagatatttcaaatcctttaactgacagctgtgtatcaaatgatggaagggtctatgttacatgtgaactgttcggtggtagggaattcatagtatcctaacctacacgggcttgcagccataagagttatacaaggtggatcacccagagtgttatttgtattatagtctctgacaccacttggaaacaaaagttataagaacctctgcaagccacaatgagaagagaaaattatactggggtggagtgctgccttctgtggtcttggcctctggagaagggctgtgctgattgtcccgggattgagcacttcttttgttaatggcacctgcagtggtggaaggcaccttgatgctgggaatcataattcatcccggtgggcatagtgattctgacctcactctcttgttagtctataagctagcgatcaggtaccctataagagatggcatatgaaggttttacctgattgctttgaagtgcggggatgatattagggtttgtggatatgtttacccctagttattgggaactgttatagaattacatatttgaaggcttttagaaactattgtagatttggccaggtgtgatggctcatgcctgtaataccagcactttgggaggccgaggccggtagatcacctgaggtcaggagttcgagaccagactggccaacatagcaaaacgtcatctctactaaaaatacaaaaattagcggggcatggtgttgcgtgcctgtagtctcagctactctggaggctgaggcatgggaattgcttgaacctgggaggcagaggttgcagtgagccaagatcatgccactccagcctgggcaacagagcgaaatcccatctcaaaatgtagatttgatgatacataggtggtatataaagagctctggacctttttttttttttcgtctttttttctgtttaaataaaacttgctcacaactttagtgattagtgaacctatagcctgagattttctcaaatattggagcaatgtataggattatgtgtttcttacccttatcaacaggaattaatggagtttcatttttgaccatgttttataaaatgtggttccattttattcacccaaaagatagtaaattacagctgttcagtagtatttatgagtttgccttttctatgcacctggaattaaaggcttctttcattttcctacaaggcagggggtggagggatgggtggaactcctgaatgttcaaaagcaattaagtactattctacttaaaacaatgttttaacattcattgtgaattggaatccacaataaatcaaattaacgaatgaattcatagattaattttcttaagaacatatttctggttttatcaaaagcgttcttgggaagtttcacaggctcttagagatacggggcaatgcatttttagtttaccattttatagactgccctggaatagatttatttttattcagaaaagctgccttaaaaatcaggcaaatagggtaagttcagtttacatttagtaaatataaatcttgcaacaaaaatatgtggtgacatttaattatattcctcttttattataatcctaaaggtagacctgtggttttcactttcttttcgtaagaaagaggtgttaatgatcactctgttactgtgcctagctttactcacactctgttaagtaccttaaactcatgtcatattttttcccttacattgagagaaataaaccccaatgaatttttttttgaagtttacatagtgatttgatgcaaactttacacacaaactagggtcattgcatatttcctactggtaggcccatcttttaatttaatatttcataatgtgaataaaaatttacatgcaatggatgaagagccagacgtgcaggccctgccctggatgttgggagccgaagaccctggaaaacatttgcctggaatggttcttagcctgcagtgctgtgttgcagtcatgatcatttaaaagtgaatgaagtaatgaatgaatagtgggaggaaattaagtaattactaaatcagcttcatcaagtaggatttatgaaatgtccacatacgaatagcataatgaacatgtgctgaataaattgtgtgtttctaccctttggcaattaggatatgatgtaactgaaaagaacgtcaagccgtgtttctatcgtaaatctagtatctagtggttttaataattcaagattagtttaaattgcaacctgttctttatcatttatttatttattaagccatattacttacttacttatgctagaagctaaacatgctttactgtctttcattcattgtgtactataaaatcacatttatacttactgtaaataagatcaattttggtgagacataaatgtggatgtctgggtcattttgccccattttaaagtgttaattcatataagtttaattcatattatctagcatttgatgcacttgatgcaacattacttccaagagttttgttaaatcagaacgtaaataatgaagttaatattgtctttatttttcatatctctagagcagtagttttgaatgttttttgtttgtttttagcttgtttggcatggaatcttgcaaatctgaaaaaagctactaactctcttaccaggaaaatgggcttcaaaaacttgtgagctcaatctatgaaacttagatgaaaacccctagtataaattcttaattttttttgtctgccatttcatgaagagcttctgcttatcaacaattttgattcagttattttgagctcaggaaacatttaagagattatatacatacttgatatatacaattatatattgtaaagatatatgtatacacacacacgtatgtgtatatagtgtgcaagaatgtgtgtgtgtataatgcaaaatttgagaacccaggagtagagttggggaatagaaccaaactgacctctgtcaagcagattaaatgtggcatggtagatataccgttaatatagggcagcatgataagaacttaagataattaagaataaaatacaaaggaaatttatgggaaggattatttatctcctcataggttgatcaaacaatatatgtggtactagtatacgatagggaggatttctatagctagagattgcaaaaaagagtatcccaggtggaagaaatgatggtagtagaaaggtgagaatgaaagagaatatatgtgggacaatgaagggtccagatgaatggcaagtagggaagaattgtgaggtgacttagggaatggaagggataggagtctggtttagtctggttcatggttgaacttgagctccttggaaggagtttgggaccttatagaataggatataggtctataggtctctgtagatgttaatcatcaaggcgtatgtcccagtgccctacagtagaataagaaacaacacaatgtgagagtgaaggcttggggtttggagcaagccctgtggggaatgtgagggcaaagtagtaataaattaaaagattgctaaactgcttcaaagtccccggtgaaattaggtggcaagcatttgtaagagaaccaattatttctccgtcagcacccaactttctaagaattggaatgaaaaagcagaaaatggaagttgcagggcttgtgagggcttatgagagctctaagatgacagtgagaataaaatgtctgagcacaggtaggtgtgggtgggaaaccatgctgtcagaatgggaaggggtagttagatgattgaaatgccaggcaaacatttgagaataaggaggtgggtacagcagaagtgagacactagaagaggtgagaggtaaggtggtggtggtaagagacaagaacagaagtctagatcttgaagaggaacacttcatggatgacgcaaggcccttgattggccacctaattggtagagtgtctagttattgagaaggataggaggcaatgaagctcagctgttagaagaatcatcattgtacattttggttttattaaagatgcttggaaataagagacctaagaggaacacagtgaggagagaaaaagattgttctgggggttgtatatactggtgagagtttggggagagtttggtgtaagcagatgaaaggagctggaacagaatgatgtttagggaaagtctggagacaactggatggtgggggatgattttggaggaatagaaatgtttgtttaatgaatatgtgaatggagtgattatggaaagagtaaagtaggcttcaggcaaagcatttttctcaatgttcacaacattgccattttggaatgataatgataattatttgttatgaggagctgcattgtgtattataggatgtttagcaacatccctggcctttatacactagttggagtagcatacaccccgttttgacaaccaaagtgtctctagattttgtcagattgcaaaatagtccctttgtcgagatcctctgagctaatgtaaagagctggaaagagcacttagaaataacaggacactttcttcagaaagagtttgaattgtccagagggcagctgaggagattgtgaagggaaagaccagactggagcctgacggttgcagacctgtgagagtcatgctctttatcccgaggcccgtgtcagaatcatctggaattttcaaagatgtcaacaccagcgccccttcctccatccctttgacctatgaaaacggaatcttcagggaggcaacccagccatgtagccattttgaaaactccttagattattttggtatgtttctaagccagtggtaaatgaggagagcaggcacatgaatagtgggtatgaaggcatggggaaaaaacaggatgaaagtaaaagaagattggaaggtaggttgagacatacattaggaaaggggggtgctgaataagcatttgtgggagtattgactggagaggcaatgttgaatctagatttatttgaaagctactttttatggtcaattatgtactcaaccaagccttcagtattcttggctgttttactcagtttagtttgagccaggtggattttatctaagactcagtgaatgtcacctttcttttagtgccagtaaaaaccgctgatgaatatttgacacttttaatttgtcttctcccagatgcaatattctgttaaaatatgcatatagtatatgtttcttcatgaaatgtcttaaaaagatttaagataggaatgcatattaattttcagacatataattattgttgacatgcaggacaaacacgtatttctgaatgtagaagttttaggtccaagtatgagtttttaattcaataaaatatgtggataagagttaagaacaatgtgattgtaaatttaaaaattattttttagactctaacaaattttcagacttcttgtggaaacacacacacacacacacacacacacacacacacacacacacacacagaggaatcataaccaggaacttctgtttgaaataatattaagctattaacattttttaggtgatcccaaacccaagaaggttctgcaagaattttaatatttgatatcctaattcaccagaaggcccagttattgccaaagaagcataataaaacagcagagatttatctttttaaattatcctgctgtataattttgcttgatccaatttgatttccttcggtaacactttttggtggactctaatttgcatgcctggagaaaggggagtaaattacaagacttcttgaaggtccttttaacttgatggttttatgattaaatcttgcatcttaaattgcctttctctggaagaaccaggcatttccggcttcatttttgtgtagaggaaattcatatatcacctcatgtgtttttctgtaagaaagaaccagacaaaatagcagtaatagaggcaaaacaaacaaacaaaacgttataaacttagaactagatgtagatgaggcttatcttatttgcaattctgcaaggatgtacttgggtccactgaaagtgcaggtgagtggaaaggtgtgtgtttgtctgtgtgtgtgttaagtgggtgtaggatgtgtaggatgtgagcaaagggggaatgaaaatgataccgttcataggtgttaacttcgtcaggtgttctggctatatgtgagaagaggaaagtgggttaactcagaatacattctttatttcttagtatattgttcttctggatgtggtaggttttcaacaggtctcgttaatagataatctgcagtgctcagggtgaaaagcaggagtcttccatctgtatgcctcgggaatagtatcaatgcagaatgaaatacagacagagattggagaaagactactgtattcacttgaagccaatggaagtttaggtgggcccgattgcaattatcccccattggaaattagccaggacacacattagtgcatgctactttctgtctagcctaattaaaggattgttgagaactaacaaagttggctgacttgcaaaagtcagtgcttgctaaaatttgtaagttataagtgcttaacaatatgacctgatttttctgctggggtcatcttattaattaaagttttccaatcgtctaattagaaaatacagtctgaactgagtctggaggattccgagtcttacttgctaatttaaagaaaagtggaaggaagaagaacagctcccaattaaagcaacgcaacggaaagctggttctggacatgcccttggagatgccccataccagcagggtaattatttaggatgcacttccagtaaagagatgttaaagggacaccagtgagtagcttttaaaagtagaaatctgtgccagtccccaaattaactcttggactagaatgcaaagctggaaagcatgaccagcactacagatttatgagaaagagtttgttcattgcttcacaagttatgcttgatttttttcagctccaatagtactttcttaaaatagaggaacgaaaagagcagtttgataatgttggtatattttagatggtaacctgacactttaaaaaaggtagataaaattctctgtattttctaaagataaggtcctggaactgagatgtcacatttaagtccttaatagcctcgaatttagttatcatcagcgtccttgtaataataccaggctagagcagtactgcattcaaaataaaaatctttcaaaacaatccaatcaacatctgctatgtgccacccactggactaagcagaaagtattaaaagaaggacaaaaagggtgtggccaatgcaaaggatacattgattagtgtatatatggcagttcactagttactcagagtttctgattctcctgcttacatagctaaatgaactcttagtgtttatatataggcagtagaaaatacactactgggacagagaagaaaataaattatttctttatgatgaaattaaaaggacagaagataacttttaatttttgttggagatttttaaataagatgcctgtattataagtggccttgatcagttctgtagacacatgtttgtagatgcacttcccattaatgtggcagcaacagaggagggtgtggtggaaccagtatgctccctctgcctttccatgctgaccatccagatgctttacagatgaataagtcaagccaggatctaggtggttgtgccagaccagaatctctccttgccagccattctgtacatcatgagtggagatcacaggtttaccagaagtatatttatttatgtatcttgtaactgaattgaatttgttaaaatttgatacttgcttgaaattaattgggatattgttgccaacattttgctatttagccgtacccctcaatgcttttgattttgtttaaagcctataggaaaatgctacctaacttaaaacttgaaacttaaaatattactcttatccattcgtctgtaagagacttgcaaataagacatgtcaagttaaaattgcagttttaggcctcattcaagaaacaattagaatgaatatatcacaaaccatagcggggaaaacactttagctgtttcacaatgaattggcctcagaaacaaagcagctgatggtttacaccgaggacattgatcaggattcatttgggctgttgctattgtgttttaatgagtaacattacatgccagccaatcacatgtcactagatcattatacaaattgacagtttggaagagtataaaaaacgctgacctgaaaggggaattctgtagaagtgagacgtagccactggatatttacatcatttttcttgttgttgagaaattgaaataaccctttaatgaaaatggctccttcatattgtctctcactattttagatcaggcatcttatttttagtttggagaatgagaacagctggtgtcaggccaggtgctgatagtactaatgttgatgtaagatgctgctcaaatggacagtgcaaagggaatcattgtcccttgatttgatcatgctggctctaaaatttattttttgatttggcatttgactttgcattatactcagagagttggaaatcacaaagccgtgcagctgcagagtatatctagatatagaccctgtaacgttacctcataaacccagcactcagtattagcagtctttgtaaatggaagaattctgttctgtaacaaaaggtagtatttttctttatactgtgagggaggcctatagtttgaaaccactgtgggtgtgtagagggacaagcggggggcccgagggctggagcaaggagtgtggctgtgggaggatgagggagccgtgaagttcaaaaatactgttggcttttaaggtctccatgacccttgaatatgagtatgaataaagtgattttagaatctaagaagatgtcaaatatttttcttaaagctagtaagagtagcaggggatggattatctgaaaatcagaaaaatcagaagtcaattattatgcacacacagttaattgaatttgaacactttttcttttcagcatccatttttatattgatgacttttccctttagagtgagaaaatatgattcagattaaataatcacttaacataaattaactctttcaaaccttatgtggaattaagaactaaagaactattgcttaggaagtattaattttaggaagtattaatttgaactttgttgtcacgtttaatgagataatgtactatatccaggtaagtgatttacacaaatgccagaattctttgcactcggatgactgttaaaaaaaaaactcctagtgttctgacaactaattttttatgccttgtttgtgtactcttctctttgcatttcctaacattggacatttctgaaggcctagttctttatttgctattcgtctttaagttttgctattagaattatacattctggagttgataagccagttggttaataaatatttattggatacacacagtgggacatttacagagcctggtattgtggaatacaaggaaataagaaacaataaggagttttccatgtggttagcaatattagaatgcttagactatcttagggaggttcactgatgtggtcggtctagttgagtattaaaaaatgggtaacatttacatggtttaaatcagagtttagaagggagacatgagactgggtttatgagagacatgatcctcccattcagattgaagtatttttggaggtgtagtgggggttgtgaaaggatagagttgggtaagattatggttttttagagtataatgtttatgagagcttagctgctggaatctgattctcaaatcctgtctccaaaattcctgtaactttgcacaaattatttctctatgcctcaatttcttaatctgtaatgtatttacttcagagagctgttggaagaatttgagtagttaatgcatttaaaatgctcagaatggtcacttagaacttagcactctataaatgatattttttgacattatgaagagttttgaaatctagcaaaagagtttaaattttatgtgataagtaacgtacagccaggataaattccttattatatgttcaaagcagcatttaaggaaaagtaagtagaaaacagaggaccaattcaaatggaggaggctggggtgaggaagaccacctactaagctgtagtattcggaaatatcaggttttaagttaatgagaggctaggataatagctacaacaaatataatgattaataaaaccgaaacctgtattttctttacaaaacacttttgacataacagtacgtcctggatacaacagtatctctaatttggagacaaagaattggaaacttagtgctggcttctatcattgtggtaagagtgaaaataatggatacaaatcagatacctgaggatctttagagaagtaattgttgagatgtgttgacagatgggatagtttgacagagtggttgagagggtgctaggtcagttctcagagagggaggagtaaggaagtgacattactgttgggaggtaattgagttgggagagggaaaccagttaagtgagagtgataggaacttgttttgaattcttttgtacttgatgtgaccgtagcaaaggtgatggaaatgtacctagacagttgtagaatgtgtgtagaggtcaagcttatcaactcagtcttgggccttatcaacaagtgggaagcaagaagagggctgggactgtgtattcagaaatgccactcaggggatttgaagagaagaagaattattgaagagaaaagaagtaatttgagtagttggagaaggatcaggtagtgcatcatcaagagactcaagaagaggaaggagcaaaccagaagggtgaaacactgaagagaaattcaaggaagaggaggaagactgggaaagcatttggatttgaaattcagggagtttttgatagggtagtttcattagcattggaaaaatcaatgtgaaggacttaagaagaaataagtagttaggaatagatggaaaacacatagcatattctttaagaaattaaaaaatactgagctgggaagtaagatccttggggtttagctttagatttgccattaactgcatgacctttgatactttgtctgtaactaatagaatttatctgcatgtaactgaaagtacttatttttcatttaggaagcacttttgacctttttgacaatcttattatatatagaaatacaacacatagtcaggatcctgaaagtaagtggaagaggcccctgaggttccagacagacggatctcacaaagtccatgcactaacacttatgcaccctaccaataatcaccacccacaggctttcactgaaactgccttattcctagactgaactattatacatgaacatgattatctgtattgtaaagggcagcaagccatttgagaggacaaggtgaagaaagatctttctgggagctacactggtggcaataaaaattacattacctagtaaaaactaaaggtgcaaaaacccgtctagctacaattcaaaagagtagcagtttgaggacattttgggagggtaccatcagctcctatgcacctcacttgcctttgagggccttattatagaaagttggagtagtttacagtttaaaaattactatcccatagagcattaggacaaatacctaatgcatgcagggcttaaaacctagatgatgggttgataggtgcagcaaaccaccatggcacatgtatacctatgtaacaaacctacatgttctacacatgtatcccagaacttaaaattaaaaaaaaaaaagaaaaagaaaaaacaattactatcccattatccagtcagcaagggaagagttttaggtttaggatcagggctccctgtttggagggaggacaccaggcaacctttttgcttttctacctgatggaaaggttgggttcaatgtgctctgcttcagaaaaaagcaaggaagtacatgatgtgctttttgaaaggcttccaatctgtcttaacccatttgggctgctgtgacaaatggcatatcaaccacagaaatttatttctcacagttctagaggctgggaagttcaagatctcaccgggtgtctggtgaaagcctgatttctagttcataaatgtgggcactttctagctgtgccttcatgtggtggaagaggccaacaagctcccctgagtcttttttaaaatgacactaatcccattcatgagtgccctgccgtcatgacctcatcacctcacacaggccccagatcttaataccatcaccttagggttaggatttcaacacgtggattttgtggggacacagactttcagaccacagcacagtcattaagggtaaacaaaaaataattcctaaagaaatatgcttctattatctgggaagtagcatttgtattcaaaaggtgtttctagcttaagttgttgatactagttaattgataagttttattgaaaaatctgttttcagagtatcctaacacattgatacctatttggaacacaaagatatgtaccagtataatatcctaatcctgaaaggatgctacctcacccagccccacatttgccaactactgtatgccagcaaatggataatttactttttctcagacgccattaaaaggatcattagagtattcaggatggcttgaaatgggcatattcagctaccccaaagcaaattttcagactgagctttgttttgagaatcactgaaactgactcagctgtgcaattcagtaactgtggacatgtcaaaacacctcattttgtcatctattaaaatcccccactgtgtgtgtttagagatttcctttgctttaaaaacaatgataaaaaccctcatgcagcatttggtatgatacgtgttttcaaacagtagcccatctcatttcaagagatggaataagtatcattaaaatggtaactcaaatcagtcgaagcacttttctggaatacttagattaaaagtgattaagaactgctgtggtttgctgatagttactgttttgtattacattaatttctgcatttaaaaatagataactacttttagtgtcttaggataacatttagtatccactgaaattcatggatttagtggggtgatcccattctatggtattcttcggccggaaaagaatgagaacactgctgacagaagtcccagcaaggccactccatcagccccaccattaacagatgcatgacataaactctgggaaaagagagatttgtcagatttttgccttcagaatggccaaaagaaatctgaaatataaaaatataactagttgaacagtttccaaaacgccatgggttttttagttctattttttatgttttactttattaagacaagatctggagattcagcttttttaaattgttgtaaatcatacataacaaaatttactattttaaccatttttaaatgtacaattcagtgtcattaagtacattcatattgtggtgcaaccatcaccaccatccatctccagaactttttattttcccaaacggaaaccctttcccattgaacagtaactcaccattctccccttccctgagtacctggcactacccttctgcttctgtctctgtgaattttactgttctaaatatctcatataagtagaatcatatatcatctatccttttgagcctgacttatttcccttaatgtaatatcttcaaggttcatccattttgtagccttcttcagagttccatttctttttaagactgaataatactccattttgtttatccattcatccatcagtgaactcttgggttgcttctatcctttgaaaattgtaaataatactgctatgaatataggtgtacaagtatctgttcaagttcctgcttttagttcttttgggtgtatatccagaagtggaattgctagatcatatggcatttctatttgtaattttttgaagaactgccatgctgtttcccatagtggctgcacctttttacattcccaccagcagtgcataagggtttcagttcctctgcatcctggctgacacttattttctgttttttttgataatagtcatcctaaagtatgtgaagtggaatctcattgtggttctgatttccatttccctaatgtttagcgatgttgaatatcttttcatgtggttattggccattaatctatcttttatggagaaatgtctattcaagtccttttctattttttaatcaactttttgttgttcttgctgtcattgacaaaaacattgttctgaacagaagtagttagaagtatggtgttgaagtgtattaatgatcatggcaagagatcaggcaaattgaaccaatgaatttcctgtcctgatgtcttgatatacaggaaccctgctactttgcccccagaacaactctggaataactttgcagcttttatttatttgcttaatttaggcttcttctggactatttcttatacatgtaccacatgaaaaaattgaaaacaataaagttcaaatacttgatagattttgtttttattaaattcagcatcagccagtaagaagtatcaatttagccagtaatttggatatatatgtattattacttcgcacatcaaatctcttcaagaaatgtgatgtaaaagaaatattgagtatgtgaaaatattaactgtgtattttaacacagatatcatttgaatttgaacactttttatgaaatggtgctatgattaacatagtaaaactcagaaatatttaaaaatgttttccaagttgtttcaaattttgaaaaggtgtaagttagatctagagacaaaggtagggataaaggaagagaagaggaaacataaatagcattggctctgttaaaaaaaaaattacagagtagaattaggatttcaaaacatcacaggatagcagttcctctctctctctctctctctatatatatatatgtcatatatatatatgcaagttcctttgtctgacttaaaagacttttgtagaatcagcatacctattcaatgtgtattactttgtgtttgtcatgaaattttacttcccatttgcctttggttttccttttctttggaatagccttctgtcatgcactgcctgttaaattttgtttaacctttgtggtcctgctcaaatgccatttcccctgtgaagacttccctgaggcctccatccttcctctgcactcacatagtccttaggcttatcatgatttttctctccctgcctctaagcagtaagcttcttgagggcaagcacatgtcttatttgcctctgtattacctggtccagtcaacatttattaaatgaatgcacatttttggaattactggttaacctcgaggactgctgtaagatctccagcaacactgtgttaactgactaaagagtatttgtgtgaataatttatatgtgaagtgtgatactcaaataaataaaagttaagttaccaatagctcataaggcagtgtttggcattctggaaggtttcccttgaaaataatgttatgttggctggattattaagcaactcctaaaagcctatttaatatcacaaacctgaaatacagttctgatgttattctatgtcattcccctgcttaaaactaattatgtcttgttattgaagatagaggccaaaatccttcatatacagcctatatgatctgatctccacttaacttttgtgcctccctctcccccttaagacttgtcattcttccacttcctaaaatatctcaaacttcttctcatctcagaggttcatgctgtaccctctctcatctcaggagcttcatgctgtaccctcaaccagggattttcttacccccccttaccccagctggccttgcttctactaaactttcaggtttcagcttaaaggtcttctgggaagctctccctgaccttcaggccagatcaggttccctgttacaagctatcagagagatctttcttagaacttgagagatatttatgcattcatgtcctccaaactatgcctggcattctgtaggtgctcaataaatattcatggagtaaaaacaggaatatatgaaaactgcttaactgtcattgaatagataatgattccaatagagactggtacctgtttatctattacacctttacaactttaaaaggaaaataactatacttctgtacttgcatgtgtgaaatccctatctgctcttgagctaagattctttcttattctaactctactttctccttaagcaatcttgtccatactaacatttttttattatcaccgttactcagatgattctcaaattaaaattttccacccagagttctcccttgagctctaggtctaattatctaattgtctatctgacagcatcctgtgggtgtctcaaaggcttatcaaactctgtgtgtttgttaggatattcctagctgttgtatcggacatagccccaaattccattggtataacatgataaaacttgatttcttgctcatgtgacatcctgattcagggtttctagtcagcaagcagcttcctacatgatgagtcagggaagttaattctcaactttactttgtcttaaggcttgtggacttttgcttgtagactgcttatgcttcctggcccagaaatgctacatagtactcttgtccatactccattagtgaggaccaaccacagagtcccagctaaatgcagaggggtggggaggtttgggaagtatagttattggtagaacagctaatttctcataatgactcttcactgtgaaaagtcaagcactaatccttggctgataactagtcatctgtgacacattcaacgtaacgaaaagtcagccagtttcccaaaataagcaaagtaactaactaatcatgcagacaaacagaccagtaaaccctggccttctttcagtgttctttgttttggatgatgctacacttctgcataagctggggacatgtatattgttgttgacatcctcttacccttaacccttatatcaaagaagtctataatttgcctggcttctttaattaatgactaaaatcttggaaatgaaacaaccttaaatgttagggaaatgggactcaaaagccaaggaatcattcctgacttttctctcgccccgtgtgctgtcattatttggtcttgtgtagtttgcatcctaaaaatttattggctgggttcatctcttcttagtgacagtaacactgccatcctccttgcttagaccactaaatagcctaacttcacttccacatgtcctctggctcccctcttgtcttctttacacagcagccaaagtgagcatttaaaatgcattttaaatgcagatctaatcgcattatttccctgctgttaacacttcaaagccttcctgttgctctaggcgtaaaggcaaaactccttaacataatttacaaggacatgcctggcctaaccccttccctgtctcactcccctttgctaataaatttccccctgtttgagcctcactgtcttctggtattctccgtgctaccctctgccatatggcctcatctgcaaaattattttctcttgttctcacgtagtttacacttacatatccttgatatcaaagtaaaataagtttcactttctcaggaaagtttttgctgacccccctagtcaggtcaacttcacccactgaaaaatttagaaacaacttgtatttctcttttgtagcatttatgataaataaattctcacatttcttttgtgaatattgaataaataactgtgtctgccactggattttgtatattcagtaagcagggattgtgttttgctcaattttgtctgtccagcgtgtgtatcacagtacctggcaagggattggtgttaatttgttttgaatgaatgaatcaatcagtgactgacgaatgaatgattttgtatatcaggtggttctgtcatctggggaatgaactgctgttatctctgcaggtttgtagagatattaatttaggaaatcagaccagctctggtaaatctgtagctatcggcttttgtaagttgcatatttaaggttactttatggaacaatgcaagtcttgcaaaggtcagagcatgaagactaaaaatgaattagttctgcttagagatttacatcagatctttccatgcttgaaactttctttttttcttcttcttactgggtttcctagcaacatattttgccattaccatgggatattctgatagtgaaactgtagtgtctttgcatttatctatcctgaaataatatacttggcaattgcatttcctaactagctatctaattttatatatataatgtatatatatatgcatatttatgacatttgatgaaaatagtatgtatgcatattgtgtaatatttaaatcttttatatagccatgattctcaaaagtatccttggcaataggatttatttttaatttctgggaaaagttatctaagtgtctatatacttagttttaactcttttttttttttaagatagccacactggtttttttgtgttgttgttgttaatttaattatttttattaaagactttattttttacagcagttttaggttaataccaaaataaagagacaggtaagaggttttcccatacccctctgctgttaaatatgcatgttcttccacatcagagtggtacctttgttacagtttttttttttgttttttttttttgagacggagttttgctctgtcgcccaggctggagtgcagtggcatgatcttggctcactgcaagctccgcctcccgggttcatgccattctcctgcctcagcctcccaagtagctgggactacaggtgcctgctaccacgtcctgctaatttttgtatttttagtagagacggggtttcaccgtgttagccaggatggtcttgatctcctgacctcgtgatccgcccgcctcggccttgcaaagtgctgggattacaggcgtgagccaccatgcctggcctatagttgttgagcctgtattgacacattgtaatccctgaatccgttttcattagggttccctattgatgttatatattctgtggatttggacaaatgcatagtggccagtatccatcattatagtatcatgcagagtactttcactgccatgacaaacctctgtgctccatccattcatctctgcgccccagccaacccttgcaaccactgatctttttactgtctctgtaggttttccttttccagatatcatatagttggaatcatacaatatgtagccattttggattggcttctttcacttaataatacgcatttaaagttccttcatgtcttttcatggcctgatagctcatttctttttagctgaataatatttcattgtctgattatcacagtttatttatccattcacccaatgaaggacatctcagttgctctcatggtttggtaattatgaataagacagctatgaacatccatgagcaggtttttatgtgggtataagtttttgacacctttgagtaaatgccaagaagcgcaatttttgtattctatggtaagaatacatttaattttgtaagaaaccgctaaactgtcttccaaagtggctgtaccgtttcgcatttctacaaacaatgaatgagagttcttactgcttcacatcctcaccagcatttggtattgttagtgttgcagattttggacattctgacaggcatgtagaagtatctcattcttgttttaatatgcatttccaggtgatatatgatgtggagcattttcttgtatgcttatttgacatctgtatattttctttgttgaggtgtctattaaagtttctgacccacttttaaattatgttgtttgttttcatattgttcacttttaaatgttctttgtatattttgggtaatagtcttttatcaaatgtcttttgcaaatattgttgcccagtctttggcttgtcttcatattctcttgaaatttgcttttaatttagtgaagtctaccttatcgatttattttttatggatcatctctttggggttttgtctaaaatataaataccataaccaagttatctagattttcttctgtgtcatctcataggagcttatagttttgtgttttacatttaaatctctcttttgtgttgattttgtgaaaggtgtaaggtttgtgtctagagtcacttttttttgcatctggatgtccagttgttctaccatttgtagaaaagactatccttgctccattgtactgactttcctcctttatcaaaaatcattgactatatctgtgtaggtctttctgtgctattttgttccactgatttatctgtctgttctttaggcaataccatatttttttgatgattgtagctttatgggcagtactgaagctgggtggtgtcagtcctctcatcttcaatattgtgttgactattttgggttttttgcctttccatataagctttagaatcaatttgttgatatgtataaaataagtttctgggattttgatttagatttcattgaagctatagatcaagttgggaaaacctgacatcttgacattgtttcctattcctattcatgaaaagtatttttcaatgtatgtacttctttgattttgtttttgtagttttcctcacacggattttgtatatcttttatagatttgtacctgattttattttgggttgttcttaagcaaaaggtaattttttttcctgtgtgtgtgtgtgtgtgtgtgtgtgtgtgtgtgtttcctgtggatttttttttttttttgagtctcgctttgttgcccaggctggagtacagtggcacgatctcggctcactgcaacctccacttcccgggttcaagcaattctcctggctcagcctcctgagtagctggtattacaggtgtgcgccaccatgcctggctactttttgtatttttagtagaatcggggtttcaccatgtttgtcaggctggtctcaaacacccgacctcttgatccacccgcctcagcctcccaaagtcctgggattacaggtttgagccaccgcgcctggccagtattgtgtttttaatatgaaattccacttgttcatagctggtatgtaagaaggtgattgactttggtatattacccttgtatcctgcaactttgcaataattccatattagttctaagagttttttatttagttagttatttttggagatggagtcttgctctgttgcccaggctggcgtgcaatgacgtgatctcagctcactgccacctctgcctcccgggttcaagtgagtctcctgcctcagcttcctgaatagctgggattacaggcgtgtgccaccaagccttgttaatttttgtatttttagtagagacggggtttcaccatgttggccaggctggtcttgaactcctgacctcaggtgagccacctgcctcagcctcccaacgtgctgggattacaggtatgagccaccacacctggctgttccaggagtttttttgtcaattcttctatattttctacatagacaatcatgtcaccagtgaaaaagactattttattcttccttcccaatctgtgtattttaattcattttctttatcttattgaattagctagtacttctagtatgatgttgaaaagtggtatcaaagagggagcatcataaccttgtttttatcttaatagaaaagctttgactttctcgccattaagtatactagctgtaggattttttgtagatatgatttagtaagttgaggttccccactatacctagtttactgagagattttatgatgaatgggcattggattttgtcagatgctttttttttgcgtgtactgatatgatcatttgatttttatttattagcttgttgatgtaatggactacatgagttggtatttgcatgttgaaccagccttacatacatgtgataaatcccacttggttgtggtgtataattctttttatacgttgttggatttgatttgctactgctctgttgaggatttctatatctatgttcatgagagatcttagtcttttgttttcttgtattgtctgtatctggtttgggtattagcacagttctagccttttagaaggaatgagaagtattctctgcttctatcctcattttagctggataaatgaaaaaataatgtgtttacttaaatttagtaaccatttcaccgacatctccttgtatccagtttcattcaatcagttgccattactattgaattatatcacaaaaatagaggagcatttgaaattccacccacccatgtttgttaatcagactgatcagtttattcatgtttaggttctcagcctaagtttttctgtgtgcgttcttgtttttggtacgtggctatcaaagtattctgtacatagttgtcattttttaaaaaataggaaaagagataaatctatttacaatctatctgcccatctattcatgcataagtaaaggttatttatgttttgattatgcctttctctcatgactaaagagtaatcttgttttgttctttttcatagatattttcttgagtacataaagcaaagcaagtgtggtgtttactcttcaattttggaagagactctctatgtgcagacacagagagacatcacattgcataaatgagtgaattctttattttgtggttatgatcttatagctgtttttcagcttgtatttaatggaatgtatgcacctcttctcttcaaaacaattgtgttgtcttgggctgctactgcctagaattctgtagaaatgctttatcgcgtgaaatgttaccttattataattttttgtattcttctgtccacactacttagtgttttcttctccggctccccctgaggttcatggttggacagtacactgtggttcctgcttaccccagtctctgttgtgagttgtatacatttataagcattaaatcaaatactcacctgtaaaacgttcattaaaatacaccttctctacaatattattggaaagtcaaaatggaatatttcaaaaattgaaataatacaaaaataaaaatactatgatacaaaaataaaaatactgtaaaaccaaaataaaacaaatatccatgagttcatattagtattaatacatgatcaaataacaaatggtggagaagggataatgcctcattatataaaaatattactatctttagaactcgctactctggaaggtgaatcttaattccctacccttgagtagggaattaagggaattgagtaggctggacaaagtgacttatttccaaaaggtaatatatgaaaagggaaaaacagaagtaaatttacttttgagaatcttggcagtaagaaccttaaccaaatgacaaagattaatattaccacgagaaattttgttgatatcatgtaccccttgatatgatgtgatgagaagtgcactgcacttctgtggcattcttccccaaaatctatagctgcagtctcatcatgagaaaaacaggaggtaaaaccaaacggagggacctcacaatacctgaacagttgtcttaaaaactgccaaggtcacaaaaaattaggtaagatgaggaaccgtcacaatttggaatgaagctaaggaaaatggtgactaaatgaaatatggtgtcctggctttcatcctggaccaaaaaaaaaaggtgacattagtggaaaacacggtgaaatctgaattatgtctgtagtttagttcattgtaatgtactaatgttaattgtttgcttttgagaaaagtacaaatggttatgtaaaaatgttaacattaggggaagtgtggtgaaggttacacaggaactctactgtctttgcaacctttttgtaaatctaaaattatcaaaattaatgtttatcaaaaaataaaatattatgagtacctcaaaacactcctctccgacttatttctcattccccacaaacgatgcacattaaaataaccttgatcaacaaatgagtgaatgttgacatattagaatatgctctgatgttacataaatccgaggtgtttgttacattcattcatattgtaaaagtagcatatgctcattataagtatcagaagaaatgaaatcacccatattttgttttaccatccaggaataactactcttaactgtttatacttaaaaatcactttacaaatgtatggttggtattttatatagcatttgatttatgctgcatgttttattttatacctgacttttttttttcatttagaaatgtgttattacaccattctcggagaaagtgacttttaagattgtgtaagcaaacctgctatgtcaaataggatttccaattattgtcttccagctccataggtcctacaaccctctatcataccccatttgagttagtgggattctgtccttccagttgttagcaaaaatggtactcatccttgacaactcttgtttctcttccacccacatttaatctatcaagacattgtgttgattctacctttaaaatatatccagaatccaactacttctcacttactcttttacccctcaggtccaagctcatcatctttcccttttgtaactgtttgatttttacgaatgtaacacagtttattctcaatgtaatagtctgagtgattgtgttaacaaaaattcatgtctttcctccactcaaaaattttccttggcctatcttaccactcagagtaaaaccgaagtccttactatgctctgacattctttctgatttttttttctgatttcattgtctagcttagtgttgggctatttcttatttagagggaatctgagacagttttcatttctgttttactgtggaacattccatcttgtggaaagtgatgtgaaaattacctttcaatatattatttccaagatgtccttgtgcatggaattagttgcacagattgtgggaagttttgtagagggaacttgactttgctctgagaaaggacagtgtgtataaaacagagttatgcaagtataaagtataccttggtagtaggatcttgcagaagaaacaagactttgaagtggtggaccataataggagaaaaagttagccctaaataggattttccaggaaagaatggcagagtacctaatacaatattcttagaaaatatacaccaaaagtttgtttcaggaatgcaacaatgattttaaattttctctttttttctgaaatcaagagaactgaaataagacaaatacgatgttttaataagtgaataaccataagccaaagtccttaagtcaaccttttagtttctaatatacatggaaacttaaccgaaagggttttgaaagctacttcataaattctctccgttatgaatctatattttgctgcttttattacctcataaattctggagaatgatttatataataatgagtgtccttgtctctccattgctgatcaagagagcaataaaccagtttttatataaaagttataatatttattctgctactgtctgaagtagtttttacttgagttatgtcaaatttccactcttaggaaggttttcgattttacatttggaaaaaaagtgatactgtaaaatgccgtttgatgaaaaatacctaatatattgattttgtttcacataaggaatcaaaataaatgtgcttcaggcaaaagagtctatctacagacacgcataaagtaaacacaactcttggagggatcattatgttaaagcagtgtgttttattacctttctactcaagggggtcaggggaccagcgcatctttttaaatgagtaattgccatttaaacgtgcatttgaaatcaagtgtctttcaaaaaagtgtgagatttcaccctgtatgctagaaaaaggcaatttacctcctaaggttagattagaaaatctattctttctccctttgcccacttaaggatgctgctagcaatgtgttttctcgcatatggataatgactctctctcacaatttaacctgcagaattgctagtcatacttagctttcagctccatctgcaccgtagctatcctgccctgcttcaagtccaggaagcagaacagctcaagaacagagggcagcagctagtttatgctgcttagggggagagggactctgtgtgtcctgtttggttagcacagaaggctggcagaacagagcatatccttcccacttgaacttgcagaaggaaaaaggatctcgaaggtcattaaggtacttctaaacctaaacactccaaaaaaaaaaaaaaaattggagtcaatttcagagtaacttttacaagtcgtaaactttgtaattaatataatttttagtactttaagaaaaatactgtaaagttatttaaaaatgacttatagtctcctcatctgtaaaagttattttaatttgatttgatttatggaaatgtgattagcagacaatctttagatgcttaagtgtgtctataaagaatatgtactccaatcctattctttctgttgagttactcctaaacaacacaaaataagcatttcgttttgttttgtttcattaaaaaaaatgttcttagagagtttgtagttccctttaatagcccaatctttttctaactttacgaatttcttttcactttggctgttaactaccctctctcccacctactttttcttttgcaacactacagcaaaattgaggttagctagtagcatactgttagtcattaattctgcttttaaataactgaatggttatatgttatttccagtctcctttttgattcatgggtatttatctagggattattaatagagagaatataggaatgattatgacagaagatgttcctatgctcaaaatgtcgctcttcaaaatcagaagcctcttgaaggatataagcaaatgttacagaaaacatgcttcaaatgtcaagaaaacaatatacaaagcaaaactcttaacagcaataaatggatcattaaaaaactttccctgcaggtggatatgattaaaaataaattgatttctaacagtttttgttttccacattttcaatttcatggatgttatttttggcctaatattttagataaaataataatcaccttgaaagctttttttcttccacagtttataacctttagtattcataagtatggcaggaacagtaattgacaaatgctttatgtttatgtgcatgtgttagtctgtatgtttgtgtgtatttaattactactgttatccagagtacttaggcaaattctgtattcttcgtatatgattatataatgttctaaaaacattcacttttttaaactataaaagtcatattcagaagatttacgtataaatttatatctcttctgccaaaaaattatacaaccatagggaaaaaatgaaacacagtttttccttttaatcaaagatgatttttaagcttgcaaaactatcagcaaaaactcacatatttgtacctaaagagatgttagattgaaggaaaacttgtaattgtctaacctgattatttttatgatttacattgaagaaaaacaataataatttttaacttcgttatatttttatgattttaagtaattgcttatgtaggtattgcaattctgaaaggacaaaatagtcatggatgtcaaacatctaagatctttttgaggtacttgtcctgtcttgaaatacacaagaatttatagtgcttagaaaaatgaaaatgcattattcagtttttattgtactctggcttttggggatcaaaaagcagaaaatagtacaataagactacatttcattatcctgggatttgtatgtattagaaagaacactttcattaattacacttgatatttttatagtttatatactatttatatatgtttcctgtagggatgttagaaaacttttcaaagtgtagtctagataggattttacagctttctgtaaaaggaaaacaaattgtttctttgaggccatcaaaattattacttttctttctatttcacaattgcttaaggttgcaaaccagtaggacttctttcctctgtgttttttaaatgcaatgtagatctgatacaaatgtccaaactcaggtacttttgaactatagcacaactgttattctatacctgcactaagcaaattgcctagtctagaaagtgtgaatagggcggtatatgtacacaaatagaagaagaaaaagaagcttaaacatcttcttttttcttttgcaccgtatctttgggaactttaacatagctctctcattggaaccaatttgtaggtatgattaactgctaacaagtacttgagatattcttaattcaattatcttggatgaggtccaaagtaaactggcctaacatctataatcagtgttacaatcgtgagatgtcagagtatagtatatgtgttttcaaggcatagtaattaaatatggagacataaggctgaaaggagtgacttgctttataacactatatattacagtccctttgaaaagtaagcagaccactgcccttatcactgcagggacaaattcagttgtgatggtaatttacacctcataactttcttttatgacatccatccatcatcaacaggaagtctgtacacagtctaaggaagtttcccagatatgacattctgggtagggctcccagtctcctgaagagagtaatgcaaccaatggtcacgggaaccacttcaccttaacagctgctgagtcggccctacataaccctcaacgtccaggatgctatggatttttaaaacatttcaatcattttcatcagcaaaaggaaaaccaacaaagctaacagtagcaatagtcaagggatcctccatcatcattaagactgtggcttaagttttcttggatcagttattgtataaccttgtcagtcaagcaactataggatgacttacaggatgacaggtgtaggatggttttcaaaagtcgcattgagagctccattttatgcactactaaactgttggatactgttagtagataatgggaagattccatagtagatgaagtggaaaggttaattagcccattgtgattttaggagtatctgtctaccaacatcagtagacatctgatttttctttgttgtttccctagctccaaggtggtaaaataatgctaacaagacaatttattcaaattacttggagacattatacacaaaaataaatttgtggcacgtattagtctgcttgggctgccaaaacaaaataccacacactgggtggcttaaacagcagatatgtatttctcacaactgtggcagctgagaaatccaagatcaaagtgccagataattcagttcctggtgagggctctcttcctggcttgtagatgggcaccttcttaatatccttatgtggtggagtaaaagtactctcatgcctttttcttttcttataaggacactagacctatcagattagagccctatccttatgaccttgtttaacctttatcatctcctcagaggccctatatacaaatatagtcttgttgggggttaggacttcaacatatgaatcttgaggagacacaaccatttagtccataacagtatataaataataagattgatatattctattgcacttcttaagaactttacaacttcagcaagtggaatctttggcaatgatgactgatttgactcttgtctatgtttttgttttttttttccctaatttaacgtccacttagaggattagctctgcccaatgctatgggatcattcttgttctgaaactaggaacagctaaagaccccatgctagttaatgcttagtctgagtgtctgtagtttttgctctgaatttctactcaagctctacgagtgaggctccttcctcttatctggtccagttctttatgtgaactcaagtaactagatcctggtcttatctattcagtgctgtaatacataccttcagggtggctgatttactcagccactcaaacccattgtgggataggggtacacaggtgagcaagtgcacgagctggggcaagtgcctttgggtgctggcaggaatgaaccctgtaccggcctgcgacaatatctagggttgtccatgacctctggagccccagagggtgtgtggtacaaacaattctcttttagctttgccactgcacacagcttaagcgttaaacactcagtgaagactcagtgtgacagactttttgggttcccgcacccagtgtgtcccgaattcttgtccagaatccaggaagaatcaggtcacacaaatggattgaagggtggtgtatgcagagagttttattgagcaatggcagtgactcttaataggatggggagctggaaaggggatggagcaagaagataatcttcccctggagtttggctggggatgaaccatagtccccaatgttcagctgcctcttctcctctcaatgttcagatgcttcttctctccttctctgccgagccactctgcccctttgccaggggagcttggggtttttatgggtacagggcaaggtgtgtggagggccagggtggttttggaaaaggtatcttttggtcgggacaacaggaatgcatatttttatttagggctgtgagtccaggcttgagggtggagccctcaccagtgacctcgccctcttctacccagtatttccctgcatcctgtccttatcatcacgaaatatgagacttaagaaagggtaagattattgaaacttatataggatcagagctacagaaagaacaggggtttggggcttctgacgggtggtggcgacgcaagttatgggagggtaatgggggaagtgtatgggtgaacaaaggttgtcttatgatgcagctaaagtctctcaggtaataaaagttttctaggaacaaccctaagaagaataggtgatagcctgtgacaaagtccgggcatgattttgacctcgatctctgctcctgtgatacactcttccctggttcatgagattcccgtaatggggattaatgacaaaatgacagataagttccgctttggaggttctgtcatcaggtaggtaagagaacttatgagaaggcctctgccctgcccttttggggagaaagatgggtgagagacaggagggcaagagaaggtcggagaagctttggttctcctttaattcaaagcactcagcatgccaaagtgccatactttgcagtgtcattctctgaaccccaaccgtgtcctaaagataaagaggagttagataagtgttgggaggaaagcgattctggcagagggaaccagacgtacagagcattttgaagaaggtagtgtttagctaaagcatagattatgagagaggaattagttttactttgttttcactaacatttttcaggtattggaatttagatattcaatcccatttttgtaggtttatttccttctgctccctgcctctattgctcacatcccctttaactgctgacatcccctttaaatagcatcccctttaaccaaatctctgttactcgtctccccttaatgatctcttagtagctaacctatacacatgttttctgaccagatgaaataactttcaggccatctaaacttcagttcacaccaggacagatctatgaggaagaggaggcagagcctaatcatactacatggatacatatgtgcttcttcacaaatgctgttgtctaaagaaagtaaccaatccagattgatggcagagtttatcttaccatctgatttaaatcctgctgtacaaggctaacagatgtgacaattcctgaggtcctattttatgttccttctacatcaccatatggcaaccatatttatatggtcagtattagacatatactcttcatcaagaattatttccaatttagaatgatttgaggagatttgctattgtatgcaggcctatggctaaatctcaacaagtaaagccaaacaaaattacttagtttgagtgacaaagggaatactgaacaaaagaatttaacattatctgagaagaaatttgttttaagatgttaattggaaaacaaccttaaacaccaattgaacagaagtgttttgacttttcaaggggtcattgtagacttttgagacaaatagatgttgaagtgcaatattctgattataggtttatacgcttggagtgaatcaatatatgtacttctatttgctggtagcttgctacacttctgaattagagtacaaatactataaaatgtgatatcttctatggcaaagaacagtttaataatatgaagaatccagtcatctgcaatagtttaaaaatggcatagaattcaaatagctcacaagtcttttgacataaataaaatgtaataactttcaaacatttcataggtagacatgcagtcatcaaaaagaataatacaaaagtgacatgacaaatagagatttaacaatttttgctcatgtgatgcgttttccttttatacttaacaccaaatcctgtgttatcacaagtgaattgtataatttgggtttctcttcacctttctgatttttattatacagttgactcatgaacaacacaaatttgaactctgtgggcccacccataatcaggttttttcagccaaatgtggattgcaaatacagtattttctggatgtgaaatccatgtaataaggaaggctgacttttatatatgtgggttttgtaggtccgactgtaggacttcagtgagtctgcatggattttggtatacacaggaggtcctggaactaatcccccacggatactgagtaatgactgtataccttatatttctgatagttacagagaagagaaaaccaagatcagtgatgctaaagcgttccaagtgaaaatgccagttggacaaacttgtaggaaatttgagtttctattattcatctaacatatatacaaattacttccctttttttcttccagcatctttaaatactctatatttttattacatgaacactttaccgggtctctctgactcatcccaatctctcttttctttgaattctacccattctaattttataactatgcttttggaagcttacatttttatatgaatgttttatatgcatcttctttttctaaccatgcaggagctatatttttgccctattaaagtgttaaacttggagcagcactcagtgtgtatatgctgagtcgttattaggctttcaaccctatcatttctaggtgtgtgtaaacctcaatgtggtaggaaagtttgggaagctggcctgaatgaatggcttttcttacttatttagttaagtcctcataggctaaggatttttccccttcctgccactccaaataggttgtgcttttgcctcagttcttaaaaagtgaaccctgaacttgcttctagtcttaccagaacattgagccaagtaaaggagagatgcaaatagctatgggctgtttttatttaaaatctctaccccatgggtgtttcttgaaattggctagtctaacttgtaaacatctgttgcttagacttcttagtctttgcagttgatgttttgcattttagaggtgatattatctcagttgtgatgaactaagtgggatgttaataggaagaaaaaatgatttttatagcaacattgcatcaagtaaaactaggttgatagagaatgtgagaacagtaaaattcttcagataaaagaaatagcaagcagtatatgcacgtggtcttcttgtcatttcaatattcttcaaacccaggcttcctgatgagggcgctaatgaagaatactgttggaattatcttttctaaaggcattttcattctattaccaccccccacgccaccgccacacacacgcacgcgcgcacacacacacacacacataacacatgtctcttatttcctctttcattcacaaatatccactctattccaggcactgtactggagatggagataaacggatgaacatgtccttatcgcacattcagtccagtactatgtaagatggctaagagcagaggaaaattgttgactaggaatacattctttatttcagaattttatgtcttggttgaaaggctaataaattctaagtgtgcttttatctcttcctaaatcagcctgtgtcatctgtcaatacatacatatccacagtagtgaacacgtgtatatttttaatgaacatgtaccaaaggaaacatattctgccatctctgaagacatttttatcacaagctgactttggggaattctgaatatatgcagtgccaatatcctgaaaggtggtggaaagggattagatcttatagcagtaatggcttcattttccttagctcatattaaatctttcagccaaacagaaaaaaaagtaacatatacaaataattgtattgctcagcaaagggatctgaaggatgctgtattttgattcatcaaaccaagtggcatgtatcccggcggatggaactttctgcttggaattagaagactagtgttctgaggcctttgggaagaaaagaagaagaaatggaagatggatgtcttattctactgcttattattatgaacttgagtatattacataacatttgaaggatttgtttccttttctttaagacgattaaaataaataccagttttgtctcatgaggatcccatttgtgagaataactcataaacagatgagaatgatacagctctatctttgtttttaactattggccaaatattacctaaaacttttcattttaattttaaaattgctgtatctaaaatccaggcctatcagtctgaagtggtgaaactttatactggctgcagtttataattacctaaaaaatcttaaaaaaatgctgtggccttggtaattgggatggtacggagcttgagaatcttctgtctttaaatctctccttgggatccactgtgcagtcaggttgaaaattgttggtttaaagtcaagtacttcaaacatgagcacctttatatatcaagcagcagcgttctagctcctagagcagtaaatgctatctgtagctaagaattaaataggagatattctttatcgaaaagccatcataaaggtggacactgttaagtgaggaaagtggaaatacttcctcaaagagtatgacactatagtgactaaactgtatacatttactgttatcgtgtggctgaaagacaaaagatgctttagaaacctgtactggagcctagagctttgattgataaatagccatacccagcaatgagagaccaaggatgaagggatgaagaatctgtagaccactgccaactaccgtatgattctaaagtgtgaatatttgcatgctacctgatatggtttagctgtgtccccacccaaatctcatcttgaattgtagtttccataatccccatgtgtcgtgggagggacccggtaggaggtaattgaataatggagatggttgtcctcatgctggtctcataatagtcagtgagttctcacaagatctgatggttttataagggacttttcaccctttgcttggaatttctctctcctgctgccatgtgaagaaggagatgtttgcttccccttccaccacaattgtaagttgtacaggcctgtgcaactgtgagtcaattcaacctctttcctttataatttacccagacttaggcagttcattatagcagtgtgagaatggactgatacactgccacagtctgtttaaggactggggatgatttgactgagccaaagggtgtgtgcttactttcagagtgcacccgtactttagaatagacagaattctgggtcattggtgatatctctttaatatatttcataccagcattcagatttggagagaaagagctgaaaaacacagcatgtctgccagttttaaagagttcccactactacatccacaaaagatagaaaagttctaggacttagtgatatttctgccaaattatttaagctaaactttaaaaatcatatgacatggtcctccctacttaaaacatttctataattctcagttttctattgaataagctataagcccattatcttgacactcaaagcctttggagattttggcaaccagatttcccttaactttgctgtacttgctccgggaatcctacactgatcctgatactatattagtttctcttttgaactcttgtactactttgtacaacttttagataaactgattcactcatctttatattattttccgtcacttttagttataatagaattaatactaataacagctgtcttctttcagaagctgaccttgaggtaattcatgtaaaaatgatagacgaggaagtgttcctaggaaaaaaccagtagcagagttgggaagtagacatggaatggcaggaagccaagcaatggtgagagatcctgtaaaatcccaggaggaggtgggtgtaatgtaacttagttctgcaaggtagctctgcagatagtctgaggctcaccttagagtcccacttaggaagccagggggatagagtctttgtacgtccctacccctgttagtcattagctacaggcagaagtctgggaggtggcatgaactccctgcactttcctatctctgtgggtgtaggcaaagcagtttcggcagtctgcaggcaactttgcgacaaggagctacagaggctgggggtgggtgccagtgtgcttgtagctggagtgcaggaagctggtaaggggagacaaggtaatatgggcagggtggccaaatattcttttaacttctgtgttaaattacttcttggattggaagctgcttggaagcagatatgtatccctaattcttataataccttatctaaaatattaaaaataatgctttcataagtattcagtgattagatgagtcagtgtttattattatttacaattttctttaaaaaaatttttttgagacatggtttcactctgtaactcaggctggttttttttttttgtttgtttgttttttttttaactttctgtggagatgaggtctctctttgttgcccaggctggtctccaactcctgggcttaagcagtcctcctgcctcagtcttccaaaattctgggattacaagcgagagcccgcatgccgagctgctttttttctttaaatgtttctaactgtagaacatgtgcactgataatcctttgggatgtgatcagatctctctcctggtgctcatttcagaacattctcctgagctcaaacagcaatgattgaggaaccccaaattagctgttacacagagagctgacctaagatacctcagagtagaagggactggatcacatttccccgcctaactggctgataacacttgcaagctgctgaaaaaaaaaaaaaatatatatatatatatacacacacacacacgtatatatttttttcccctccaagctaagggctactggtgggtctaccagtcaatgttatcaacaaagagaagcagttagaattgaggcaatgagtaatccaacgacattttatctatgttcttgtgggaacaatttttatgtgtttagtaggctaatttagtagaaggtcttctttaccagagttcacttctaactttgtttcactttgtaattttattttaaatgtagttttaattgacaaataaacattgcatttatttattatgtacaacttattttgaaatatgcagttgctaaattgagcgaatgaacgtatgcattacttcacacgcttatttttttgtggtgggaacacataaaatctactgtctcagcaattttcaggaatacagattgttattaactgtagtcaccatgttgtacaataggtttcttgaacttagtcctcataatgaaatttcgtatcttagaccaacatctcctgagccactggtaactactctctatttctattagttcaactttttagattccatatataagtgagatcatgtggtatttgtttttctgtgcctggcttatttcacttaacagtgttctccagttacatatttttttcgtaaataataggatttctttcttttttaaggctgaattgtattccattgcgtatagatatcatattttctttttccagtcatcatccattgatggacacttaggttgattccatattatggctattgtgaatagtgctgcagtgaacatggaagtgcaaatgtctcttcaacatactgatttcatttcctttggatatatactcagtagggggattgctggatcatatggtggttctatttttttttttttttttttttttgagacagagtctggctctgtctctcaggctggagtgcaatggtgcaatctcggctcactacaacctccgcctcctaggttcaagcagtcctcctgcctcagcctcctgagtagctgggattacaggcatgcgccaccatgcctggctaagttttgtattttttagtcaagatggggtttcaccatgttggccaggctggtcttgagctcctaacctcaggtgattctcccacgtcagcctaccaaagtgttgagattacagttatgagccaccacgcccagctgttttttattttttgaggagctttgatactgttttccataatagccttactaatttgcagtaccaacagtttacaagtgtttccttgtctccacatcctcaccaagacttgttagtttcatcttttttatttatctgatgattagtgatgtcgagctttttaaaaaaatatacttgttggccatttgtacgtcatcttttgcgaaatgtctattcaagccctttgcctatttttaagtcttgcgatagagttctttgagatccttatttattttggacattaattgattttctgatgtatggcttgccaatattttatcccattccatagactgtcacttcagtctgtttattttttaattttcattttatttttattttttttgctgtgcagagattttgaaattcacataatccatttgtctgtttatacttttgttgcttatgcttttgggatcatatcaaaaaaattattgcccagaccagtgtcatgaagctttagccatatgttttcttccagaagttttagtttcagtttttacactgaagtttttacctcattttgaattgctttttgtccaatgttataagggtccaatttcatttttctgcatgtggacatccaccagtcccagcaccacttattgaagcgacaacatgatcttttgatatatgtatacattgtagaatggctaaatcaagttaattaacatatgcagtacttcacaaacttctttttttttgtgatgagcacttaaaatctactctcttagcaaatttcaagtacacagtatattgctattgactattgcacctctgatatacaataggtctcttgaattttttcttcctgttcaactgaaattttgcatccttcagctaacaccttcccagtctccccaacctccactgttttactctctaactactacatgatccagcaatccccttaactgagtatatattcaaaggaaataaaatcagtatgttggagggatatctgcagtcctgtgttcattgcagcattattcacaatagccataatgtggaattaacctaagtgcccatcaatggatgatgactggataaagaaaacgtggaaaatactattcagcctttaaaaagaaggaaatcctatcatttgcaacaacatagatgaacgtggagaacattatgttatgtaaaataggccaggcacagaaagacagatactatataatctcacttatatgtggaaatcaaattcttcttatcccttcctgaactttactataaacacacattgccacagaaaatccaaaaagaggtgttgttgtgtagagtagatgtggtgctccgtggaaatctttggaatcaagagaataaggcaaatatgtgctattatgtggcattaattaaatgtttctaaatgttgtaccatgttttacagatgctagtgtgatagccccaagcattctgtagactttatcatcatgttgagtatcatcattgatgtttcctaaataagcactatgattcagagtcctcatgtcttgatactgtgtgccacagagtacagtaaagatatatgttttaatgtgaagagcaagaatctttttttggatcagtttcctataactgtttagctttatcttggaggaaaaaaatgacttgtattatgacagtagaaatttagtaattacccctaagaaaaaagatctttcttctttcaccttaagcttactcagtgtaagtggataaatgccaaagttctgtaaagtgcaatgcattttctatacataattcacaaatctacaatagaaaaattgaatggtctctttggcgtgcagcccaagtagacagtgaaaacctatgggaaatgtaatattaataaaaaagcagagaattagacctgacatttcggtcattcattctacaaacatttattatattataatgaaatattagttattgcattatcagataagcagaaacaaagcactgtgttagaaacactagccttttcattgtatttatgaaaacataagaaaaaaagaaatacaagtgacattcaggtacatggagtaatgacaaaaaggaggagaatattcaggaggaatattcaggaggaatgacaaaaaggggggatgatatagaaaaatcagactagcaaaataattcatttatgtgatttctaatatttatctgcagtttacatttgaatgaaattgtaaaagataaatttccttttttttttttttgagatagaatttcactcttgttgcccaagctggagtgcagtggcgctatctcagctcactgcaacctccacctcctgggttcaagcaattctcctgcctcagcctcctgagtagctgggactacaggtgcccaccaccacacccggctaattttggtatttttagttgagacggggtttcaccatgttggtcaggctggtcttgaactcctgacctcaggtgctccgcctgccttggcctcccaaagtgcagggattacaggcatgagccaccacacccgcccgataaattttctttccttactcatatattcctcttagtacaaggtaaagggtttaaagatgaaccatgagggaaatttaatttcaaagatatatgggaatcggtgctttcaaaacaaaatttgaaatatactttgttatgcctttttcatgctgtacaaaatccatcatttataaagatactgattctgtcagtgcctcttttcaacacaggacataaggcagagcaatcaaaagacattttaatttttaaaatgcactcatctgcttttccattgcctttggtagcttatacaattttagaacatatgctgcatgccaagttgtctggctttatcttatctgtagaggaaaaatgtcaccacgataatgtttgactgtttgctggaaatggagattttccatgaatcaaacttattatgggtattaaaacattaacaatttttattattagttaaataatacattaatgctacacttaagtacttttatatgccaggtgctgtgccaaatgtttcacatacgttattacattttatcttccaagcaaccctacaaagttctcatcaatatccaaatttacagacaagtaagattagccttagagtacataagtaacttgtgcaaggcccttcatcttaattgagaagagctcaaggcccaagcaggaaggtgaagctctgtagtctggagggtgggtgccctcactgaacttttctgtgatggaatcagaaggtcattaactttattaggtcttcaggtttttcctagaaggatgctgaacactgaggtggatctaaaggaactttggtcttctgcgtctttccttggctgagacaggacaccagtgactattctttttctcctggcattatcactgaaatgaaatgattctcttcactgtctttggagcagcattcatacctctactctgtccgaatgtcattatattctaatgtcaaagtcagttggacagctatgagtttgaaaagtgataaataaaatagcatacaagaaaatagtataaatgtattcctttacataaacagatttaatataatatatgaaatttgcattgttggaaatcagttctttgccatgggttttaaatttatcgcatttatgaattttcctaatggaatttcatctctaatttttataaattaaaatattgtgaacaaatattattatccttctgttgcaatacatatgactgaggcaaacagtgaaaaatattcttggctgttttaagtctgacatttagaacccgggtggcacataaaaaaatactgtcaatgtgacatcatatttcccactgattccggaaactaatttaaatagcaaacacttaaacttgtattttatatgaatgtcattttaagaagactttgattattgcaaattgacccagaagtgatgagtgtaaagagatattatctagtactgattctttgtggttgggtgtctccatacttgtcagagcaccatatttgccacccagctttgttgccagactattatagaccagccacggttactgcagttttctgtcagccacccttatgtgctgcacatgccatgtctggggataatggaaatgagacagatatgctggtgtttttgcattaaggaggcagttcctgagtgacaaggctatttgtgtatcctgcatataaaaattgcctcacaatgtctgagttcacatggattcaccatagaaaacttgcataaatgccagaaaattaattgcactgctgagacgtatggtagaactattaaaatgatggctatgttttgaggaatactaggttggccttattacttgtaccctgcagggtgtaaatgcagttttagcaattatcagggtgatatcattttgaagtttacaattaaaagcactgtaccctcccacaatatcttttaagattttatagtttcaaattatccatagtttaaaaacaccaaactgggaataatggttaagatgttgcctatatccttgatttcttttgatttcttactttttcacttatcataatgagctgtcaaatttgtatggcctgtttattttagaccttgcaataaaaccccttcctttttttcctcctagacatgtagaactaaagaatgtttgagaattaactagaagtctcataactttcctgacagctttttgatcctataactccaacattatggatatgttaagaatgttattgttaagccgagaaactgtctcggaatatagaataaatttttatatttaaccctcagtcttgtaatatttgtaatgtaactttgtgattatttggttttcacttattcctattttagtgaacagtagttaataaaatggcttctgaaattatcatttgatatactgaaaattattaaaagtagccattggcatataaatgtttctctttctttggatttactctatatcgtaaagttggtaagagctttagttgttgctttttggaaaaaatgccaataaacagaatcttgcctcagggatatctagtttacagattacaacaaactatttaaagataaatttgtaatggattggaagaaatgaagtgtttctcactaggggttctgttgaccacctatatctgtgacaccccatgtgcttgttaaacattcagatttggggctccaccacagccctacagaatttgtgggaggtggagccggcctctctactataacaaacccccaggttgttgagcctgctcaagtttgagaattgcttgtgtcttttaataccttcctctcctaattaaatcaatttaatcacataaacaataaaaataactttctgattgatttctggtaccaaaagcatacaaacaaacaacaacataagacacagtggggttgctaattttccttttctgactacaataatcaaatctcaatttaattgtttatctttttttctcatgtttttattcctcatagttgaagtataatactcttaatcttttatttattttgatatggaagtataatggactgctttaacagtctgggaaagctatgaaacctctgtccagaaaaatgcctgtcacatttttacatacagtgtcaggggtttatggaacccctggagttcatcatggaccctaaaataagaaaccctgtaccagcaggacctcatcatttaaaacaagcctgtgatttagattttttttttttttgcatatgtgatgattattggacagtgcgaccaggggcttttcaatgtgtatattatttacttggtagtctgtaatggttcctaaggggctataagcttgtaaagttgtaattatggaattaaaaacaatctatacagtttttcagatggttcataatagcaccaatgtgtataaacatgcaactatgtttttttacagttatatttaagcaataggccataataattgaaaatttttattttttaagttcgtagaagattaaacgtggagaaaaaattatgtaaaaccagagcccattgtcttaccttatgtgatgttaagacaaaattttacatgagaagacactttttattctcagaaattcatttaatgcagaacaaaacacatttatttaagatagctcttctggcagttcaacatgcttaataaagacatgtttaaataactgatttcttaggaaaaaagaccatacatattgaagcagaacactatcgattgtattcatcaggcacactgcaggccagaagatcaaagcttatgctttcataatatcatttaacctctccaaaatgtagtcagctgccccatatgtcagtgcaattgtatttgaagagtgagaatgacacagattattggcctgacaaggctaacctcctaaacaaagacatatcagatttatctgttgacttggagagatagtgtgaatgtgttctttcttctgcagtttagagagtatattagggagatatgaaactgataaaactatccactcctgggaagaaaggaatttaaatattttcacatactatgtgtggaactatccttcctaacattattattattatttttttttttttgagagggatactcgctctgtcgcccagactggagtgcagtggcgtgatctcagctcactgcaacctccgcgtcccgggttcaagcgattctcctgcctcagcctcccaagtagttgggattacaggtgcccaccaccacacctggctaatttttgtatttttagtagagacagagtttcgtcatgttagtcaggctggtctcaaactcccgacctcaggtgatctgcccgcctcggcctcccaaagtgctgggattacaggcgtgagtcactgtgcccatcctctaacattgtctttttaattttcaaaacctgttttatagatgaggaatttgagggagagactatataggggaaaaataatttttccaaatacatatttacatttaagggacaggataacatggagttatagaggaatacaggatagaggtcattaaagcagaaagtactgcctttagagctatgcaaatagttctttctttagtagtagaacttggatgagattctaggctgatggacttcaggtcagactgtgtggatcagaatcacagccatattgggccaccatcaaaatcagagtcatattgagtgggaaataagttcagcacattattgaagcgtcagttttgtggaagcagctgaggtcagtactgggaagttcttgaaaacagtgagtgtgatgccagaagatttaattgagaccagtcctgggtaagcagctatggtgatgggaatggatctgaggacaccaaatgctaagacaggtgaactcattttttttagtcattcttatacaaaggataagattttggacatatcttctttataagcacatatattgacatatgtgtgtttcattatatatgtgcatatgtataacttaaacatatatatgtacataaattactagaatttatattgttttaaaggaagaattaccacacagcatatgactgcacaatttagtatacaactaataattaattaatgactacacaattagctcctttttttggaatgacataagaaattcaatcacaaatagaagctattcttttgaattgctattagaattcactgatgctgtgaacagattccatgtgatcagtacatttttccatatagatagactgtatggaaagcaaatcatatcagtgatatgtgggaagcaaaattataatcaaaagattatgtgatgagttgggtgaatcaatgaggctggtcatggcagtgataacagtcatattgcaatgagaccattggagtatttctgttccctccacagtgtttctgttttcttctgttatagacacaccgagaatacattttccctggacttgtaagttgcaagatgttattttaaagaggcagccaattcaggacttgacagatttctctaaatcttgtgcagtagcatcctcaagagcattttgagaaggaccattttagcatgtggtccatccattggtcctgttatctaccccctgtttcatctgtaacactctcacattcatcatgttagaacagggatcatctaggtatctgcctatttacttttttttgtttgtttttgagatggagtctcgctcttgtcacccaggctgtagtgcagtggcacgatcttggctcattgcaacctccacctcccgggttcaagtgattcccctacttcagtctcctgagtagctgggattacaggcacatgccacaatgcctggctaatttttgtatttttagtagaaacggagttttgccatgttggccaggctggcctcaaactcctgacctcaagtgatccacccgcctcagcctccaaaagtgctgggattacagtcgtaagccaccccgcctggccctgttcgcttttgagaagcaaatttgcttgtcaaaaatgtccccttttagttagttagcactaaggataaatcagatgtgataaggaaagtcaatgccacagtggaagcacttctacttgaagcactgaaaacacatctactctctaaaagtacaagatgttgaggagatggtgtctggccccaagaatttcaccaaacatcagcagagcatttactcacccacaggctgaggcaggagagaaatacagatggaagaaaagatgcacccatctccctcctgccaattttttgttaaaaaaaatgctgggaattatttaaaaagtatattatctccagaaacagtaattataaggctggggatgtggatttgattgaaaaccaactgcaccaatgtgttcctagcgtttaaagtaatagtgtatgtattattattatctgagacaggatgtcactctgtcagccaggctggagtgcaatggctctgtcatggctcactgcagtctcaacctcctgggctcaagtgatcctcacacctcagcctcctgagtagctgggactaaaggcacatgccaccatacccagctaatttttgtattacttgtagagatgtgatttcaccatgttgcccaggctgtcctgaaactcctgggcccaagtattctgtcccccttggcctccaaagggctaggattacaagtgtgagccaccatgcgtggcaatagtgtatatattaatctctactgaatttattgaagctttttatatatgaaaaattatttccctctcttctgaccacctctcacatacttttctccctctctgttttgcacttctcatgtcatgtctccttgcctctaattcactcccactcagtgtttgcccctttgagaaagcctaccagaaatatcaactccattttcagaatgcccgcagtatgccagttgtgtgcccaggtatcttcccaacatctctcctccatgccccagcattgccactcaggtgttcttcacaggtatcctgtaggaacagcagaggattagagacactaggtgggtccacatcgatgggctcccaaatctgtgttcttcctataccatgtcacctcctgtgctattaaatgatgtattaggggcagataatggcttccaatgagtgcttagttcacaattaccacagagcctttaagatttctgtctacttgtaataaatacttctaataaatcctgaccaaaagaggctaagtaaatgtaaattgaagccagaaacaaataagaggaagtctatttcattttagtagcatattttagaggtcagaagcaaagctttctaaatatctgctcacagtctaatattatattgtctgtgtgtccaaaattaattcagtctataaaggtcaataatgtaaaatgtattcatgtgttcaggtaaaaatttatgatgtgctataatgtgatgatgtttgactagtttacagtcctggtgatacaccattggaagacatttggaagtgataaaataagggcagatttttgtcgtttctttatagaaacagtaacctgaaagtcatactaaattttattgagagtccatccctaggtaacattaaaataagtgttcgtctctctaattctgtcattttcgggagaaaatctagaaaatatgccaattaatcatgtagttagataattcattttattatcttcatccgtgtagaaaacaccagagtgtgaaatgtaacctgcaagttttattttttattttttcctagattgtcctctaaactggactttaagcatagttatattttacattcttggttaaatttcccctctggtttaattttcctttaatttattttgatacctgttgtatcaaaatgttatttgtactgtaatattgccagttagctggagatgaggaaaattaaataaggttaatagattaaacatacatgcatatgataatttgatgtcaattaatttgtatatctgggaacaaacaggatgaaaaatatattttcgttatcattattattactaccactgacattcttctaaaggctataatataatcaagaagttttcaatctagattccagctttgtcacttactacagttcaaattgaccattttctcaaatcctctgtttcttcatgtataaaatgggagaattgtttattaatttgttatagtggggaatgaatgccagaaaatatatgaagcatttatggggttgcctcatgctccctcatgtcactgaagttcactatctcagaggtgtcattaaaatgtccttctccagtgaccctgcagccaatcctttgcaaactcagttttttagtttttgactctatcttagttttattgctcttgcccatgttatcattttcattccagatctttatcacagcttacatggactatagtagctgcatcctgatgagccactctgtctcctcacttcatcatccaaaaaggttaaacgcagtaacacccttacctggttcatattctttcttataccccttttgctgattgaactcaaatgtagcatcttagcatccccggccaactacagtatggtctctcagttcattccctactgctccatagtttataccctgtgatctaataaactgaactttttattcctatgcatttttccttatgccttacttttgctcatactgttctttctgcccacaatatccattgttactatccatttctcataacctgtctccatgttggcacccacaaacgcacacagcattgttttacactggactctcagagcccttgactttccttctcttatggcatatatcttatctttttctacgtatatgactgtcagtcatgtatctgtcattttcctcctactgtacggtaaagtctttgttgggtaaagatttagtcttatttaccactgagtccctgggagcatccagtgcagtatacatagcaggtagccaatgagtaattgtcttattgaatagctgcatctcaaagagctttattttcctgttattagacctgtaggattctctaggtgtaaagatcacaatattcagagcataagctttaaaaacagctattctctcttgccaactggcctctggaggaagcatcagagccacagataaggacagagccctgtggaggcagagggggaaacatttatgttgaaagagcttttaggatagaagtagatattaaaattaaatgatatagattttagttttataactggattgtaataatttggtaaatgtagagtctgtcagaagtaatccacatttgttctaattaggtttatagataactgtaacaattaataacttaatctggacttcagttttacttacctattcccctcactcttcattgttacttccaaatgaagttttatgttttaccaccttatcttttatacacaatatctatgaacttttctttatgccagcaaattagataattaacgtgtagagggatgaaatagtcttctcagcccttcttggagtttccatcggatcattacttaagttgtgatcagatgatctcacttctgagaaaactgtttgtggctttagtgataattggcaggaaagatgattactattcaggccctcttggcctgtgggcaccattgggagtagagttggtacaccttggtgccttccatactaaagttcctcctggacttacaacaccagcacctaggcccatatgctgctcttaggacaacaatgcagtttgctgagggtaaaaattcttctctcatcttataaatttgggtctcctcttcctctcctgtccactttgaccctttccatctcagcaaggctagtttaccaaagctcatttttttttctgccataacaataatgctatgttataaatccagttatatggctgtcatggaaggtatacttaatgaagaaaaaaggagttcagatttaacacttggtatgcatctttccttctttcagctataaagatcaaaataatcaaagaacatgataatcttttaaagacagatactactacttcctctagcctcaggttgtgttttcttttttgttgattgcttgcttgcttgttttgtttttctttatttcctgttgttgaaagcatgagaaagctataaaaaaacattttgggatctgccagctagtgtctcccagatttctatagcctgttttaaacattgtaagaagtagttagactgaaattgattctagtgttgtgagcttatattgtaaataaataggcaggatgacgtggataacttacagagtaaaattcaatgatctcgactcctctgtttcaatgtcaaataaatcatctttccatctttggactgtaaatgtaagatttattcattgagtagatgtttattgactttattcctcctaccaagtactgttgtctgagctgaagatacagaagtgaacaaaactgagtccctattcttatgaagctaacatccttgtgtagcagacagaccataaacaaatatataacatggcaagaggatagttagagatgtggatgtgggaaggtacattttcatttagagcggtcaaggaaagtatttgtggtaaggtgacatttgagcaaatctgaattaaatgagcgagggaaccatgtagataactggagggaagaacattttgggcagagggaacaataaatgcaaagccctgaggtagaagtgagcttggctaagttaaaattttaaaatatattaagaataaaaattcaataaattgagtgtaatcactattcaagtgttctatatttgcctctaaagctaaaaagtgtgctaactgaatctcagttaacctcctagaaattaattggttatttagaacaattagcaaaaacattatatcaagctttaatcattaaaattttacacagaaatatcttggttaattatctgtgcttttgttgaggttttattgcatttttatagtcatctgtgctccaagaatatgttcacattttttctctaatccttctaattaagttaaaaccactgtccttagaaaagaccattcttttagtctaggacccttttagtaaaaaaagaagaaagtattctttagaatctcttaaaattgtcaataggtctaacacagcttctttcaatgtgagcaatacattgctactgacaaattaatatataaaaagcctattgtattatttatgaaacaagtctcttggatattttggtaattttatcctggtgcttgaatttttttcaaagagataaatattattaatagtttttggacagttgttcaatattaacaaaaagctatatctgatactatattggtgcaaaatatctttatttttaattcattctagaagagtcttgatgtaaagacaactctaaaatggcatctattccagtaagcagtatttttacattctctattgaactatatggaaatctttacctcttttttcaattatttctcataatcctcctttattttttatgattgattcaaaacaagaaattaaatatcgttatatttcacttatttttgttatatgttttattctatgtgtaaactaaaatatttccaaatctttaatgcagttatttcacagcctgcttttaaaaataacatatcaatattcttggaaataaacttcagaattccagatggtttaatatgtactagttaagtaacccctcagggaccatgtggttccatgagtctatgtcaagccattgccattacaccaaaatcaatggtggttggaacaatcaaagagaagaatggctttgttgaatattgtgaaaacaaaaaaatgcatgaataatttgtaatgagagaaaaagacagagtgtgcaaataattggaaacacataaatatataaggcaagattttcaaaaatttgaattgtacaatgtaacaaaatgtattttctcatatgttttaattaggcaaataacctagctctctttgtgaaatgatagaaaatgcgtcacttccaagggtacccatgaaggataccataggtagttttggagtctatctccctagtataaaccataatgtgatttattacttaagtaaagctgacttttccccatggcagttgcaaccagaggtaaacgtctctcatgcatttcactcagtgccgttggttatttagttttctctcccctgtacctttaacatctcttcttgtatttactctttttccctctccttttgacaactccatcctcatctgactattacactgcctgtctcctatccttgacagccacatttcttaaaagagtaattacattcattgtttttacttcttcaagtcccacaccttcttcaacctattataatctccttcctaggcatttcgaaggttctaaggaaacaagctaggattttcattagcaaacataatacacttttttttttcttttttgagacggagtctcgctctgtcgtccaggctggagtgcggtggtgcgatctcggctcactgcaagctccgcctcctggattcaagccattctactgcctcagcctcccgagtagctgggactacagacgcccgccaccaagcccggccaattttttgtatttttagtagagatggagtttcaccgcgttagccaggatggtctcgaactcctgacctggtgatccacccatctcggccttccaaagtgctgggattacaggcgtgagccaccgcgcccggcccacagttttacatttgcttctcttattgtcagcagcatttgaccatgtaatcctcctgttaaaacctgtctaatcccttagttatgatagccttactttctcttatttgctctccctctctggattgctcttttcctctttcctcagaaaccccataaacttggtatttttagggttctgtttatacagtctcccttccctcattctaaaattctcgtgttctcccatagtgactttatttgtaactgtgccttatttaattaatgctgcttacataaatgacttctcattcctaaacagaccttccttctgacctccactattatctgtctgttcccaagcaaagcctgggagatgtttcaatattctttctaaccatccgtatctaatcagctactaagtcttcagtttacctcctgaagatctcttgacattaggtatctctcatcttttatctccactggtgccattagtcatatctactttccactggaatagaataatttctgtaacatatgtaatgccctgtcttaaaaatttgtcagtagccacttatgccattaagaacaagtacatgttcctcagcagagtattatatcatttttggctatgtttatattcttttgtcactttacttttattagccttaagaaagtctgttatattggttgattcgttaaaagttatgaaatcagattactggagctcaagtctaaattctgtatgaattgcacaagttatatagttctcctctttgtttcctactaaaaataccatgagaataaaagtatttacttcacaatattgttgtattaaatgaatgcttgttaatattcttggcaaataaatagggactcaaaaatgttggctattgccaattatatgtggtttccatgctgttttatactatttcaaaatgtgtgtctttgcataaaccatttccctcatgcaagaatgtactttgacacctttgtttcatcattcaagatttacctcaaacatttcctcttctctgaatctttctcaaagcacacctcatcccagctccttcccctttactcagattgctattgaaatgaaagcttttatgatatttgagcatcagtcaattattcactgttgtactgggttcattttttttttttttttttttgtttcagacagagtcttgctctgtcgcccaggctggagtgcagtggcgtgatctctgctcactgcaagctctgcctcccaggttcatgccattctcctgcctcagcctcccgagtagctgggactacaggcgcacaccaccacacccggctaattttttgtatttttagtagagacagggtttcactgtgttagccaggatggtcttgatctcctgaccttgtgatctgcccaccttggcctcccaaagtgctgggattacaggcgtgagccactgtgcccagcctgtactgggttctaattgtggacttccttcagtctcctgcatgaggctctaagctccctggaggcatggctatgtcatatgcatgtctaacccatcaccattgctcaggtgagagtaagactgagactaagtagattctcaaaagaatttgaagtaaaatgaccaaataaattaatgaaaggctgggacatatgtatgcataaattaagcttcacaggaccatttttccataatagtttgccataagaagagtttttgtacgtattaattgatttttaaaaattttcaaactgcttgtggtatttttctgaatgctgaaattgacagttaatccattcttcctgactaccaataagatatagtctccagctgagtttctcagtaatacatgaatagagagtgtgctagtaatatcactgatttgatgaatatgaatatacaaatagtatggtttagaaattaatcaaatttcaaaattatttacaaatctctgcctttactttgtattacctgaatataggcaaagagagaaaagttgattacaaactaaattgccccattggcttcctcatttaacatcttacacattttgtgtagaaataattactttaccacatgaccaactgtaccttgtactcagaactctgcataatattaggaaacattaatattgatatgataattatagaaatcatctgatcagttcttgtttatattttagagatggtgaatacttttttaaaaagaaagaggataagcagaaaaggaagaaaatgacctacatattaatgaagtctgtacattcatcaggaagaattttcatgtcccaaataaagtctgtgattgattggtcatctttaaatcctaaaacatccgaagaactggaagatcctgaagagttatttagttctaaatataaagtgctttaaagacaaattgagaaagacataggcttttaacaaaagggaaaataaacactttggaaaatgaaatttactttgagtagctttatttgtcattaaactcagttactccataaaataggcccacacttattctttcctagacctaattgacctcttatcagaaagtgttcagtatgtttgagatgaaaaagtaatctctaagcttattgcattggtcattagctcttttacagctataaaaccagaagagattatagattttcatcttttataccaaccagcaacagaatgagtgggtttccttctgcagctctcatactcccttcaagagctctcagcccatgcaactgtgaattgatttgaaagctaaattattaactcattatacttgcatccatcctgagttagagtttgttcacagaaaaaataagaacaccatgattcgcctgtcattaaatggcaactgaacaaattgcatagttcagcatctacagggacacgtttgaagtcattcaattggattcatatcaatttcttgaataactgtaaatagcagtgctttctgctggtagggctttgggagaacatatgtgtttctatttagtttacttaaatgaaactctcccaacaaagatattgttctctgtccatgatacccacttaggacaacaaggcatttacttatggttggttatcagtaaaagtaaatactttaaaggatagccctggagaaagcaaagataagtttacaaattttaaggcagtcttaaaagccattctttacataggaaaaaataggctgtctaaatggacttgtgcctgattttccacaaaagtctttcctccatgctgtctttttgtaagttgaaaatattttatcaaaacatgataatctctgcagcattatataacgaataactagagttgggaatgtaacatggtggtgaagagctcagattctaaatctgtaattgtcagtaaacttgacaattatttttttactctgtgtgccagatggtcatttgagcactgggggtataacaggtaagagacaaaaattcttgctcttattgagtttacatttaggtgataaggcagacaatagacaatataaataaatatggtatttcaaatggtgaagtactatggagaaaagcagcctgggagaagggaaagctggtgtgtgttggggggagttggggaaggaggaagtgattcatttcaactctgattgatttctgttttaaatagagtggtcagagaaattcttctaagatgggaggatttgttcaaagacctgaagaagtaggattgcaagccatttagatttctggtgaacaagcattcccaccagagagaacaaaaatcttagtgctgtcactttctgtgtatgagactgagcaacgattgatgttctctaagctttagttttctgctgtgtaatatgtggaccatcctaatgcccgcctcaaaggaatactgtgaaaattaataatgctgttatatatgtagtggagatatatattaaacactgaataaatgttaggtattatattgttatttgggaatttagagtttttctttcatgtcactttattcaactccttcacctattcattagtgcccggtacgattccttgtttgaaataggcagctatagtgaaaaatattctactgttttcagtggcaaatacatgttgagtgcttaagtgctgaaatattagataggagaaaaattgctcaagctcttctttctctgtttttaatgttttgctttactaaagttatatatatagagtgtatatatatgtctttttttaatataatctcctctctactcccattttccaatcgtcagaagcacctcttcaactcttcagctatttttcttgatatttgctccatatacttcagtggcatgcttacattgctgattcttgattttttcaattttacacattacctattcatttcccacaacaagaactggggatttggcttctttctgccatcatatatgtccagtttcgatgtccctatcttaccaatacaattatgtcatactttttgttagatcagtattgtgtggtcatgttgtgactataaagtactcttcacagctgtaccatacatattttttgtttctctttggctttggttcccttttgttaataatgatcttttttattattgatttatttgttcaccacttcatccccaaaattctcccttaggagtataaatttcgctgaaatatgttccaacttcagtgtcctcttagttgctgcttcttggagatgccttgctggagcatttcaattagccatagtctgacctgactgctccccaggtctgcttcagagctagccttcatcaccgtcacctcctagagaccctctttgcctcctccccccagttgaatgctgtttgtatatcccatatatttcttattcttgctttattctcttgttttaatagtgtacatatccaggagcttccagaaaaagggggcataggagatatatttggacacttttcacatctgaatgtctgttccacttacaattagttgcctggatatagacttctcgtatggaagtgatttctccctagggttttgaaggaatttcttttctgtgctttagcttctaatgttgctgttcaaatgtctgctgccattcttatgtttaaaaagttaaacattttatttaatttaaaacatataaatattcattcattgactggtattttagttgtaaagtcaagtttatttctttgaatatgaatccccgattgaatttccttataatctcacatgaaaaacacctgtaatgcatcatctataatttgtgtttcctgttctttaaagagcagtggattctagatttttcatttattgacatgccccttccaattttgacatccttttaagctgatcattttattcctcactgcttacccagtgttgtgctgttctggtagcatcaccaaaaattacaattatgtttattattattaatttttttcatattttattttgcttctattatttgtcttaggttgaattatttggaagtagaacctgaggtgaggattcaagtaaaagcaatttattaggaagtgttcccaattaaaactgctaggaaaatgagaaagtggtcctgaaaaggaagaagttcacatatgagtgtaatatcaaggataatgccctgaggaagctttggagacagtgcagaacacaccttagaattattcggtttactagcagcagccaggttgtttacaaccgtgtgcattttagtcactgggtaatggtgccctgggagggcataaattcccaggctcccaggggtctggggcaagatgggatccagcagcttgaggtacctctctatggaaagccttgagtgctggtgttggactgaaggcacagcaggtactggtgttcatgatgatggttgaggaatttgaggatatatgagcagaccactgaatgaatttgctacattattttataaaaattagctaataagaacccagagttctcatgaacacactacggctcacacaaagatgagttgataatcaccaagaatgctgaaagcaagattactttggtctcagtcaggcactcattgctcttaaatcacttggctcctaatttagattatggggaataaaacaaaccaagagatgtttttaaatgcttgatacattattaaaattgtctaaaaggtaagtgtgattgattatggaactctaatatttttagctctccaggaaattaatccttataacacctaaaattattattggtcaatcctacattctggtatcacacacgttttaagaacaccctattaaatttttcaaaaagtgtttgttgaggacttacttgtgctaggcactatttttgttgttggagttaaaactttgagcaagatggacaaggtctctactctgatggaacataaattctagtgggttgagaccatgaacaaataatgattaatagaaatatgagatagtgataaatactgtaaagaaaacaaaatggaatgaagtattatagagtatgttcaaggaggacccccacccccacccgccatggaagagctaatatatataatctaaggcatgaatgatatgaaagagccaagcatgggaaaacctgaggaaaaattactccaaggacagggaactctggtgcaaagagagggatgaggttgttgttagaaaatctgaaagaaatttatgtatttggagtgtcagggcaaaaagaaaagatgaggttcaaagttattcagggccaaataatgaaaatccttgtaggccatgggaaagaattgtgtgtttctttcactttgttttaagagtcatgggaagctatgagaattttaagcagtgcactgacgtgatctttatatttttgaaggtttctctgaagtgtgtatgcaaaatgcaggcgagaggagagaaaggggaactttataggagggcatttctttagaatgaggcatgatactggagtcaaagagaagtaggcagattctgaaaattatgtggaggtagaattgacaggttatatttatggagaatagataagggactgaggaaagagtgaactcacagattcctaggtgattgtcaggagagactggatggatggttggaccattttctgatctttcgttatgcctataattatcaagtacaattgatttgaagcagcattgctgtactctttattgtatgtagagtttaactataggtaaatgcacgctgttcattcagacctttgtgctttgtgatgatgatttttgcccttttcctgtttgtttatttatttatttattgttaaaacaatgttttgacatacaggaggagcaagaaaaaatatctgctcatattatgccatctgctcctttttaatttctttcaaggaaattctccaagggagtatcttgtctcattgatgcccatttcattgtcagagaccattacatcccaggttttaaccctgacctgtcctgtggctgtcagaactggcttactggagacatttttttccaccatggagagcacttagctgtgcatcctgccggacttctaggaaggagatggtttccttccctcttctgctgaattcaggctgaattcctaaattctggtttgtgacaccattgtgttatattgtatttgtaactcagtagattcattaattatttctgattttaaaaaatcacatgagaaacattccaaattttctggttaatctaagtaatctcttgtctttgactgctagaccctgatctcagaagcatgccggcttgtttacagccctgactgggaaaaggcatgagtagggggaaatggatattgcacaccatcattattgaatacattttagcagccatgtgaattagagtagctcttaataaagagcttgaaggagcttattttggcactaagtgaaataattccttagaaaacaaaatactaatgcaattttaaaatataattcacttctctagaaatatatatttttcagaatattggctcttattaaaatgagatgcaaaaatattatgtgaaaaagggttcataaaaattgaattggcctataaaatatttttatcacttcttctgattataaaaatatgtctattgtagaaaattgaaaaaattataaagtcataaagaagaaaataaaaacaacttgtaatcccactgtcagaagacaactgtggttaccattattggataattctttgatcttttctcgctattcctacatacatacatacatacatacatatatatatgtgtgtgtgtgtgtacatacacctatataaaggatatgaatattttaaactatatagagattttaatgatttgagctcatactgtttgtactattttatacgacttttccatattattataggtgcattggaaaatttaatgactgcattatattttatataccataatatatttgtcctgtttttccatttggggacatttaggttgtttccattatttttagaaactcagatttttcttttatagtaaataacactgaaacgaatagttttctaaacacttttttttacaggttttctcactgtttccttagcataaattcctaaaatggagttatttggttaaaacgtatgaacatgtaaaggttctttttatttattagcaaataacttactatatgcataaaagtatgatatgccttgttaatttttgccaacttgatttttaaaaaatgtaatttgcttgtttccttttgccttactttgattattggtgaggttaaacatttactcatacatttatttaccattcatatttattctacgaaatgccattcatgtttttacacatgcttcttattagtgtttttgtggggtatctatattttaatgattgatttgtaaggtaggtatcgtactcatatttgttttaagtatgttttctaatcggacttttcttaaattttttacaaaacgttattgatatagagaggttttaaggtttatataattaaacctatttgccttttcttttgtagttttatcccatatttcagtgcttagagacattaagctggaaaatatctacttgtcttctatagctttacttaaaattttaatcaatatagaatttatttgatttacaattttggatatgctaaaatagaattttatttataatttttattaaacttccctaccttcatttgttgactaatttgatcctttgtgaaatttcctttacaaaattgtttttgttattattattattactatgtattagtacatatcaagttcatatataccccaggaagtttcagggcagtctctcagttctgctattctgtcagtctttcgtatgaccacattgttataattgtttcaatatgtgtatatacacacccaagtcattttttggtgtgtttagctatttttttgtttatttagactaccagataaaatagttctgagaccctatttatttctttcactggaatttcattaaattttactggtaatttgctatagtctcagaagtctgtctgctcatacatatctgcaaccgaaaaatatacaatatttctccattctttcaaaattatttttatgtttctctataaaattatgttttatacatagatgtatcccatcatgttgtgctcgaatattttaggttgtttatgatttttcagctatttagattataagttgatttttgctttaaccagctttgcatatacatagctgtatttagtagggattttccagagaacagaaccaataggatatgtatacacaaacggtcatatatatacatacacacacacacaagattttataaaggatttgctcacgtgtttatggcagctgagaagtcccacaatttgctgtctgcaagctagagacccaggaaagccagtggtgtagtttaaaagcctaagaactgatgagctgttggtagggagtccagtgccagtctgaaggcctgaaaacaaggagcatggagggtagcagaagactgatactttcagctcaagcagtcaagcagagagtgaattgaaccttctccctttttattctattcaagtcctccagggattggatgctgcccacccacattggggagggccatctgcttttctcagtccactaattcaaatgccaatcttttctggaaagattctcatagacatactcagaaataatgtttaatctgtggcccagtctagttggcacataaaattaactgtcataattgcataaacattaattattataatttaaacttttatcctgtcttattgatttaaatatataacttttttcacttgtttttcaggcacaaaaattaccccaaaatattgataatgttatcttctcatttctaatactttttgctatttcatgtctgatactgttggctaaaatttctagaaaattataataacaattagaaatgtgtttttcttttggtccagattttattagaaatctatcttttgtttttacttttgatattctgtgggcctaatattatttaacatataaattattctgtttttattttcccaggaagtgcatttaaaatcaagtgtgcatattaagatttattaaatgcctttttagtttctattaaatttgtcactttttctttgacctgttattatgcaacatttgctacgtagatttctgaatcttaaaccatccttgtattattggggtattccttaccagatcataatagctgaagcttttaatgtattaatgaatttagaatacttatattttatgacacatattcatctgtaattggaattttagatgggcatatggaatgtatgggaaatagatttcaagccaactacaatccttcagtggtaacaagcattactatgttgagaattactgtgaagttgcaggttcagtcccatgcactctaggtaatgatggaatgtgctaagtggtgactgaatgccctgtagacagaagtctgtatttgtatgcttttatctttcaagtctgcctcctcctgttcctgcccctgttctttagtgctattttgagaaaatgttgatgttgggagtggagttatgcttcattaaattaattagctaagtttttgaacacataatcaaattatgtagtatggcctttaaaactctgagaagtttttagtaaactttattttctgggatggttttcgaaagtaacttttaattataatttttgataattattttactgtatttctttgtgatttgttcaatttcgttagttaattttagcttttaataaattgtaattatcgccgggtgtggtggcctacgcctgtaatcccagcactttgggaggctgtggggggcagatcacctgaggccgggagttcaagatcagcctgaccaacatggagaaaccctgcctttacttaaaatccaaaattagccaggcttggtggtgcatgcctgtaatcccagctactcagtaggctgatgcaggagaattgcttgaacccgggaggcggaggttgtggtgagctgagattgcaccattgcagtccaccctggactacaagagtgaaactccatctcaaaaaaaaaaattgtaattatccagattttctagaaaaatacataatattttctgaggtaatttttcccttataactttaaataactttcatatgtacacttttccatttcttactgaattagtcatttccttccttttattaggttcaactattctattattttttaaagatgtcagaacctttgttcagtcagttgtcaagacctgtcattgtcaaccttttaattttgtccggacttctatttttatttttattgccattgatttcttcaggcttgctttttcttttcttgctttcctttttttggtttacattaccagaaccttttaaaacccttttcctgcaggctatactccatgttgtgttcagaataatttttcaaactccaaatatgataatatattcattatttaaatttttgaattattgtttatcttcggggtaaacttcaagtgctgtaacatggttccacccactactgatgctctgaatgctgcctgcctttcaactgtttcctttctttctgtactctatattttggcattgctggacctgtaatgcccatctctccactgcctctccttcgttctcccttccaacctccccctcctccctgcaccactcatagccttgcctacctggtggcaaactactactcagaagttcactccaaaatgacttctgcatggttgattttcttgcccttactctcagagatagtactttttcctacattctgcactctgcctttttttccaatactgaaaatgagtggctttaattttttttagaagactctgttttctttaaaaagcatcttaacctctaaggcttagaaaagaaatagtatgtactatgacatgcaaataattgcattgagagttctcatgattgtattccttttctaggcattgtcatgcttcttgggagctgagtcgaactgttggggctagaaagtcatcacagctatgccctcagttcaagatcaaatggaacttgatataaataacccaaatgctttttgtgaatatgcttcatgtctgctgctcagatgtgtctatttatgtagtatggttatcttgtctccaataggtaaatctaaaggatatagttgatccataatgcagaatttcatattctgtcctgtatgtcctggcccaccccattttgtattggggtgaaggctaagttgctataacaaagaaatctggaatacagtggcttttaagaacatatcaattctcattgctcatgtaatattcttgaaattagtgctccaggttattgacacagctctgctcctggtgatcattcaggagctcaggttctttctaccttgtctttccactgtcacctaatgacatgttcacaactaggacacaagcacctcagtgttctagctaataggaaggaggagcatctgttttgagagcccccagctaaattggggtaccagtaccagagtgactggcaaccctgccttaaagagaaataaaggggagctggacagacatggctgtttccagtgtacctttcacaggatacttctttcacatagtggacagcctgatgcctatttgtccaacttgtgaccaggggatccttcacacagacaacttgttaatattggcagatgcccttatgactcttgtctgacctgtgttcagtttatacttgcctgacattgctctggtgctgggagcctgagctcatgttctccctggtgtcttgggggaagcccaggctggggagtccctggttcttcagatggatagagcaaattcaatatactactgcagtaggaaacaagttcaaaggtttttacttacagatcctgggcgagaagggcacaatgatttgggtagagctgagaagagtcagtcagggagagaagagcacgaggcattttgcagtatatgtaagggactagagcatggatcattaagttctcactattaaaggataaagcaggaaagtagggatcccagtttgttaggtgggagagaagttatctctgtccactggcttgtgccatttgggtgtggcatagaactggaaatatgtcaaggtctagtgagccctgctgctgatagaagaaagttaaatttctattccaaatgaatgccaaagctacataaaattataagaattcactacaggatcccaggcccagaaatggcacatgtcacttctgcttgaattcatttaaagagaccttagttgcacggaaatacctgcatgggaggcttaaaaacatagcttggcagctgtagcaccattactggttaaggagagaatggatggtccactagccactgccatcacacatctctatttcaagaactgcgtatttgaaaataatagtttgggccttaatgtattaaaaggaactctaaaagatggaagcacagaatgtattattgcctttattttaaaactaccagttagttagaacttatcagaataaaaatattgcttatttaatgtatctcaatatgctttgattgagtcactttggtgtaatgcaaggttgaagtaatggttttcagaccgtataaccataaaaaataaaggtgtttaaaatttttcatcttcaattcctatgcaactgtaaaaagctatctttgatagagtggcaaatatttctctaaaagcaactaattcagagatattctttagtcagctttagtgtgaatgaaaagaattagcaaatataattctgtagattttcaccaaagttatattacagggtgggcaaggctgtgagcaagaaaaaagcttaacaggaaccacaaatggtgtactgagttaggtgtgactagggattttgtcacctaggctgttgggcagtagcaccatcttggctaactgcaaccgccacctccccggttcaagcgattctcctgcttcagcctcccgagtagctaggattataggcggccaccaccacacgcagctattttttgtacttttagtagagacgggatttcaccatgttggccaggctggtctcgaactcctgacctcaggtgatccgcccacctcggcctcccaaagtgctgggattacaaacatgagtcaccatgcccggacactagggattttattctaaagaattagtcagaaaaatagaaacaagtttgtaaatagcaagaatggcttcttctcttccaactgaatgagaatccaaggagggcagaaggacaagcaatacagtatgttaaatgaaatgcagtttacagtgaaaaccgatggagtgcatctagtgtcataatttggattgctcagtaaggaactagtttggtgtcacttctataaagatgtattagccaatggatcgcatagaaaatgcattatcttccattcttaaggaactgtttttagagtctgttttgtgtttatgcccattttaaaatgttttctatttgtggatttcatatataatgatttatcatagtaataaaaaagatgggagttcaaagcatgaaatcatattaggatagctctctgatgactgatatgacagaaagatgagactgatgtttcattctgtaaagcactatcatgacttagctatgaaacaaactcataaatatgttagattgtgtgtggacattctttcatacatgaatatgacacttttagtcatattctgtagatctttaacatggtgcattacctaaaattcaatattattatttttaaatttcaatataccgtattactaaaatagaagggtgccgtatcttaaaatctggattagcttgtatttgattcattgtgtttgaactcacataatggataaactaaaaatctatgaatatttttgagaaattaaagagattgttaaaatttttcatgtcactaatcagtaatttccactgtctgttaggaccaacctccgcatattactcacttttatgttgtgttttaaatttttgcacaataaaatatatcaaatatatatttaaaataaacatatgtatatgtagtcataacttggataaacctaggtacaagacattcagggactttggccattaattatgaaaaaaaatcactgctttagatataaggttgaaaaagatggcatgagtcgctttacatcccatttttaattatgagatcaacttatcactaatgtcctttcaaaccaccctaaaatggggacaattatttcatcttgatttccaatgattgtttttaagtctttatgtaaaattaatagaaggaggtaatttacaggtcctgttaatgaatttgaatgcaaaatactgtgtgtattattgttaattgactttaataatagtgtcatacattatttaaattgaatttatattttatttcatatatgtgtatgtttgggggacatttttaataacttacatttgagtgaaaatgcaaaaatatttcttccaataaaaatgttgccagttttctactgtgtcactgctgtcattgtgtaaagatttgataactggaattttacagcacaaatttgtagtccattaattatgatgatttattcaatatttaataagagcatcccagaaccttataaaagttgaaatgaaaagaccaattgtttaaggagaagaaaaacaaaacaaaacaaaatatgtagatgtagttggttccacataactgtttctcatcatgttcagtaaattcacagaacaccacaatcagccagaaactaagctggtgaaacggtgagccttcttgtttggtctggggtgtgtgtgtgtgtgtgtacgtacatgtgtgtgtttgtattatacacgcattgatatggtttgtgtccttgcccaaatctcatgtcaaattgtaatccccagtgttggaagaggggcttggtgggaggtggttagatcatggggttgatttctcctttgctgttctcctaatagtgagtgaattattattatttttttgagacggagtcttgctctgtcgcccaggctggagtacagtggcgtgaactcggctcactgcaagctccgcctcctgggttcatgccattctcctgcctcagcctcccaagtagctgggactataggcacccgccaccacccctggctaatttttttgtatttttagtagagacagggtttcaccgtgttagccaggatggtctcgatctcctgacctcgtgattcacccgcctcggcctcccaaagtgctgggattacaggcgtgagccactgcacccggcgtgagtgagttcttgtgagatcttgttttttaaaaagtgtgtagcgcctcttccttctctctctctttttcctgctccagccatgtaagatgtgcctgtttccccttcaccttctgccatgattgtacgttcctgaggcgtccccagtcatgctccttgtaagccttcagaaccactagccaattaaacctcttttttaaaaaaaaattttttttaaaattttaaaaaacctctttaaaaaaaaaaattaccggccaggcaatttaaaaaagaggtacattttaaaaaaatgtacctcttttttaaaaaaaattggtgtcaggcgcctgtagtcccagctactcgggaagctggggcaggagaattgcgtgaacctgggaggcagagcttgcagtgaaacgagatcgcgccactgcactccagcctgggcgacagagcgagactctgtctcaaaaaaaaaaaaaaaaaaaaaaattacctagtctcaggtattacagttttttaaattattattatttttaacttttattttaagttcaggggtacaagtgcaggtttgttacatagataaacttgtgtcttggggatttgttgtacatattatttcatcacccaagtattaagcctagtacccattaggtgtttttcctgatcctctccctcctcccaccctccatcctctgaaaggccccagtgtgtgttgtttccctctatgtgtccatgtgctctcttcatttagctcccccttataagtgagaacatatggtacttggttttctgttcctgttgtaatggataatggactccagctccatccagtccgtgcaaagaacatatttcattcatttttgtagctgtatagtattccatggtgcatatgtaccccattttctttatccagtctatctctttatagcagtgcaagaacagactaacacacacacatttttgttccttttaaggaaacaaacataggaataaagtagtaattggaaagactgaagtagtaactgaaagattttgctaagctctctgcgtatgtgggtgggtgtgtgtgtttcttgaagtaatctcttacacttctaattacccctaacaccatagattagtttaattaatcctctaataatttggcctaagagaaatttagcaatgataaggtagtgacaaaaattggttatgatttctacatttttgtatttctgataatttgtttagatattttttaggttaacagtttacagacagtaaaataattcattacaaacattacaaacacttcatgtccactggtcatgatactagataaaactttcattcaacatgctgagatgaccaagtctgtgacaaataaaaatagtactctattttaccctagattactatttcagctgagcaacaacgtcttgattatacctcgatcatttcagtcattttaacagtgtctatatttttagttaattgattgtagtaaatatagctaattctgttgattatttatcactgttctatatgcctattagagttctcattatctcaggtgcagttttaggaggcagttttaacctattaaattcacaaggtttggtccagttttaagagacagaaagaagtaataatatactcacaaattagacttttaaaatactttacctgatttggggccttttaatatatttaatcatttagcaatgtattaacatttttgtatgcatatttatccctaagtcatgtattctggatgcctttgtcttctttctgaacaatgtcaaatagttccagtgtgatttccctttttaattaggctgcaaggacagttggcccctgataggattacgggatggctttgtataaaatttgcttctgattagcagctccaagactttgacatcctacagttttgatctttatctcttatcagttgttctgatagctcctctacaataactgtatttcagccatttctaatgcattggtattgaaaaaggaaaaaagatgtttaggtaggaatttttgtcattgatcagattttgtatgtttttgtttccttaaaaatttttatattggaaatagttcatatttagcttgaaaatattctggcataaataattaacatgataggaaaatgatcgtggataatggagttttaagagcagttaggaattaccctaaattttaaatttgagacaaatgtgttttccgtgatgcaagaactgctgccagtctaaggaagtacaagaaagagatttttgaattagtgagctatataaaattgtcctcacattgattttctaaagtagcctgccaatcagaggtcatttttagttcaccattgcctcttacttagtatgaattttccattttgcacacaaatataagaaatacaatttaaaaaatggtacattaggaaagctaaagtactttacttgactcttagtttacattgccttagtgacaccagccaatgaggaatgaaaaatccaggtgagttagagcaatgatcaaaagaaaaaaaaaaaaagaacaagagtccccccaactagaagaatacaattaaaaaaagaggcagtacacatggttaataaacagatgaaaaaattaaaattcacttgtactataagacaggcagattaaattatttttacctatcaaattaaccagaacaaaggcatgcactttagtgaggatgaggaacatacagattcactggtgaaagtaaatgtacacacaacctttcaagttgatagtttggcagaagttgctaaaaacatttaaagctttcatactttttgataaggctttttattttagaaaacatataaataaaaaagaagaaatacacacaatgatttctttataagtatatattcatagagtattatattacttccacatgatggcatattttgcaggcattaaagtgatattgaagaatagtaaagaagcacacccagtacatagtgttaaataaacaaggacaccaaatatatataccttagtatctaagtcctgtaaaaatatgtgtttacataggaaaaaacttagaaggaaaatgcagaatgcatcaagtctgtgttttcatctggaactatgaatttcctacaacaagcatgttaattatactgaactaatgaaaattgctgattaaacaaagaagtgaatgctaaactcaagccaatatataactgcttttctatgtagaacatgttaacggaaaggggaagcatataaagttaatttttgatggaaatgttcacaaaagtagccaatcaatttaataaaaagaaaaatcaatcagttggtcagttctttcagaacagtaaaacattttgtcagttgccccaactacaattattcctcaattgactgtattgataagctgctttgaagttgtttagacgcgtttttggagaaaaaaatattgttgaaaaatacttagtgaaacttaataacagggcacagtgggagatcattaaaatgaatcctcttgcttggttgaggcaatgtattggaatgcagatcttactgatttactgcaaatatctgtatgaaagtgagcccatatattaaaatctgtgtattatagaagccagaatacaagcctgtttgatgtagttgtgatgaacaacaaagttaattagactattttgtagttagtgggtcatctttagatttctttcgagcattacaaacaaattcattaactaatgacattaactattttatgtccctagtgggcacttagaagaagaattgacagttcagtactttgcctctaagctgctggtaatgatgagtctgtatttgtgacatctagtggaaatagattatccattcacgaggtctacactcagatatgacatgctattgttcttcatggttaagaggcatactttttccagctttcactttattgcgtgacttattcacaaagtttctttacagtaacactgttttagcacacttatctttacatattgcagccattttccacagtaaaaccagatggaaaaatcagggataattggtggcaagctgtatcaattaaagggtattaaatctaaagcaggtcgagctgtgtccttttctgtgtaccttcaattcttggtaccttcagttcctgcacacccagtttttggcaccctgttgctcatgctctcaaccattgtaaatacattgaaggtgaaaagctctaaattatagaatattagaggaagatgagatcttaccaaagatcttccattttcctaatgagacatcagaagtccagaaaatttatggaaattgcctaaggtcagatgtagttagtgacaaaattagaattagacttttgttctgttgccctattatctatcatttccttctgctttgagagactgcagatgactcctttcaatagaatggtgattaagaccatgggctggggagcctcattttcttggttcacattagagccctattccttactagctctgtcactttgggcaatttacttaaccttgctgttcatcagtttgttttgtacaatgatgatgagaatactactcgtattggtaattgtgaagattaaatgacctaatatttgtaaagtgtataaaatagtgcttggtataaattaaatgctctatataaatataaatatctagagtaaattaaatgctctttaaaatataaatatctagagtaaaaacaatctagacaaagaggacacattatctcttatgtatagaatgttgtttttaatattgcagccaaaatgtgctttaatattactaatttaatataaaggaaacataggcaccatatcacatgagttctaaagattaatggaagtcatatgtgatatctttggttaacatcttcagctcttacattttcaaacacacccttcactttcctattgcttagaatgctttttacttgggcctcttttgaattgatggtttttaaaatgcacttttagataacaaaggtaacattttaagtcttagaaaatgtacagaaggagcataagggagaaaatactgagctatgtctaaaacttaataatgcttaagtttggtgtcttataaatcagcctctgttaatattgtatttttggtcttttgtctcttgccacaataatccctgaatattgtcattctacaaacaatatcaaatcaatattaaagttcctatagaatatcttaaatttaagaatatattcctttgttcgcatttttttaaaaagcaactggtctttgttttctttggttttagtactacatttctacctagtcagcggccaaataatccctatatatttattcctttcaaatgacctccatttgcagagaatattttaggggtaagttttaactatttctcttagggactgtccatacttgagaaaaacagcctgaggcttaacattttctgtgtatgtttgaaatggcaactgcaccgtcatgcaggcttcattcttgagctattttcagctctggctgcttttaaaaccaagtggagagtgaagcagcagctacagcagggcgagctgtatcatgtactttcaagtgtagacctagccttaaagaacaatctactgaatggcattgaaaggataagacccagaagagatattattttctctattttaatgctttctgagtgccttgaaagtgatgcttgacctgtgtatcataaatccaaaccagaacattttagaagagtcatttatatctcagcttttcatgcttccattgcagcccatgatagtgcatttcatcatattattagttagactaagtgcctcctagggggcattgtgacttgacatatgcggagctggttgatctgaatggcatattctaagtgagatgtcctgcttaagtcactaagaatggtttcagggagggcagtatattttgcccttttctaccccagaatgacctgaaatgacagctgggttcattctgctgacagtgaacctcttgctctgcccgaacttaggtttcttagaggaaaggaaagaagaatcggttttgtaactcatttgctactggtgacatgacaggctgactccatgtgaatacacgattcagagaatgcaaggaagaagaggaaaacaagcattttgggccagtggggaaagagtatcaccctacattttaaatgagtgtccaacttacttcatataaaagagactcagagaaaaggtttatttcaggccttttgttgaagtaatagtttacacaaaggagaacatggttaaataaagcactgattgagtcactgagttttgagtaagcttatagctactcatgaaattcaggatgttattagaagttagggagcatataattcataccttctcacctttatgttttcacctgtcttaaaagagtttctgtttcttccttgaatttaaaaataaaaccagaacatttaatcagtggtcgaaatattttaattttctcttaatttgggggttggtttttaattttttagttatttgtaagccacaatgatggcagaagatgacataatttgtatgtaaggattgccactcatctgcatgtgttcagtgagaagaacctaccactcatctttggttcacctcattttcttattcatatttgaagtcccctgcaatggtcacagaggaattaggatgcttttgttatctcatactggcttaaaaaatagagcagtttattacctcatgtaaaaagacatccactggtggagtagactccttggttggatgattttgcattcattatatcatcaaagattctgattttcccccctttcttccctgtcatctttggagtttcagtcttgtcctcaggctccttcctcttttagttataagactactcaagcagaaaactaggacagcacattctctatttatagtagtggaggatgaggtggaaggaaaaaaggacatctttcaagtccttaaacatctttccttttgtctgattgactccatcctggaccaaaatcagtaatggggaatactatgagccaatttgctaagtagcatcaccaccgagagctggtaatgcaattgataacaaaatgaaatgggttctttagaaaagaggaaagaagaaatgcatgttgggtaagtagccatcagtgtttatttcaatccgaggccttatgtgaaaaatagtacaaaccattttatatccattaggatggctattattaacaaaacaaaacaaaaaatacagcaaacccagaaagtatcaagtgtgggctagcatggggagaaattggaacactcatgcattgctgatgagaatatgaaagggatagttactatggaaagcagtttggcagtttctcaaacagttaaacatagaattaccatgtgatccagcaattccccttctagatatatacttataagaattgaaaacagggactcaaacaaatacctatataccaatgttcatagtaggtaaaatagctactcacaatagctaaattttgggaacagccccagttgccatcaacagatgatggatggacaaacaaaatgtggtgtatgcatacaatgggatgccatttaaccctaaaaaggaatgaaattttcttacatgctacaacatggatgaaccttgaatacatttgccaagtgaaaaaaatccagacacagaaggacaaatgtatgatttcactttatagagtgactggaataggcaaattaatagagggacagaaaatagaatggaggttaccagagactgtggggttgggcaaattgagagttgtttaatgggtacagagtttctcctggagatcatgaaaaagttcaggaaatattggggatgatgatacaacactgtgaatgtacttactgctattaaagtgtaaacataaatggttaagatggtatatcttacgtctattttaccacacacaaaaagcaatgtagagccaacgggatatcatgtgttggtaacatcacgagcttggaaataagatacaagaatcaataaattagtgtctcttcactcttttttttccttactcctgcataccaagggaaagtggaactgaatgtggactgtgggttgaatgctgttcagcaatacttagtgctctaacttccaaagaccagtgcccaaacattggtgcttattccccataggaaacatggtctctttagctgtgtaaagttgtgataaaccaactgactgcagccattcttttaaaacaaaatgtaatcgcaattataagctttagcaataaacagagggcaaaatgatctacgtcgttctatgtgtttctagtcttcatatttattctcagattttctcgtcaacaaaccaataagctaaaggttggagtataatgccaaatttctatttcttgctttactttttttgaaagaaataaagaatagatactaaaatagagatgaaaatagccttattattggttgtcaagcactttctccatgaagcagggctctgataaactacataaaagagtgaggctcatacctaaaacctagttatgcttttatctcctttggagcagatctgtggatgaggccagtttttcaggacaaatttaatcagtctcacatattcagtctcagagaacctggaagagagagaaaatggtgttttttattttctcagagaaagaaaaaatggggaggtcctccccaggtgtgcctaaaagtaaaagaaagtgagggctccattacacctgaacacaggcaggtcaaactgcattacatacttggccccagccacaaatgtgcagtgccctttaacatatgaatctagatcatctgctaacaaaacatgattcaatgactgtattagtccattctcacgctgctgtgaagaaatacacaagactgggtaatttataaagaaaagaggtttaattgactcagttccacatgtctggggaggcctcagggaaattacaatcatggtggaaggcacctcttcacagggcggcaggagagagaatgagtgcaagcaggggaaatgccagatgcctataaaaacatcagctctcatgagactcgctatcatgagaacagcatgggggaaaccacccccatgatccaattacctccacctagtcccaaccttgacacgtggggattattataattcaaaatgagatttgggtggggacacagacccaaaccgtatcaatgactatcaggttttctgcaatcagattagctgctcctccttccttagggaggaaggaacatactttttaaatattcatggagtgaggatggaaacaaatgtagatttgtatctaacagttaaatgcatactttgtgggaagtggtcatacagactagcatgtacagatgctagtcagtctggtgaaggggctctccaccccaatctgtattcttgttcggcactgtcctaagggtgaaggtcagatgccatatacctcaaatttcttgccttgatattgattgagctcaatcatcacgtatttttttctgaaataaagttgggcaacaagcagaaggcaaaataaactgaagttctgtgatgctaactagaaagtaactaaatgaattttaaacctttctgttggatataggacattcttgcgtctgttttcaaataattgttatataaaatttttagctcttactgctctttcactgaaactcattaatataggatgatgacttgctccacgaacttctttcagttcatacttctttttccttattgtgttgaaaactcaaaggaatgtataatattatagaatatatatattttttaagaccaggtctcaccctgtcacctaggttggagtacagtggtgggatcatatttcattgtagccttgaattgctggactcacatcatcctcctgtctcagcctcccaagtagctaggactgcaggttcttgccactgtgcctggctaattaaaaacaaaaattcttttttagagatggggtcttgctaccttgcccaggctggtctagaacttatggcctcaagcaatccttcatccttgccctcctataatggtaggattaaagtcttgagccactactcctagcctaatatagaatcttaaagctctaaaagataaaaactctctggtcttgttgatccactcattttaaaggattaggccattgaggcaattgatgcctgcagcttgtaagtgacatgttcagtgtcctgtggctatatagtggtagagcaaagctcagggcttaggttatttgtccttttaaattagaatttatttaaatattcaaataaaaggcagctatgaagccttaaaagtacagatctataatgtgaaaagatcacccccaacccttggctttcatgcccattttatccctgtaagatgtctggcagggattattccagggggaggaggcctatttggccagggcctcagttcacagaaggcccagtatcttaaatttagacttttgagcttctctctataggaggttccttagtcccagggattaactgatggatttagagaagatttagagaagaatttaggttcatttatcttaaaattttaaactcaagtttcttctgaattttataattttgtttgggtactacaagtatatgtcctgttgtttttaaattaaaagtgttaatgtgtttaaatgtagacatataacatttatttacatttttaaacctctgtttggcatttttttcagtttttttatgtttttcaggtgtctcaaaaatggacagtgctgggatatctcttgagccctgagctgtcctgttcatggctggtgactgcaaagcctgcttggccaggcagaagctgttcactgtgggtcagcgagtgccactgtttgatagctgtcattgttggaaatttcagctgttcagatcctagccttctgaatccttataggcttttggaattatttgggactcaagaataactcaacgaaatctagaaaccattatgttgatagagaaacagaggaaacaaatggcagagaagagcacagattgtgaaggttagagaaggtgtatggatggggcatagattagctgtcgatgttttcaaaggatctgtaaaacctgagaagcattcaaggaaggagatgaggtagaagctaccagaaaaagcaaagcagagggaaaaaaaggaagagtgggcaaggaagagcaccagtcatggagaaagagaatgagtgagagggacagctcttgggggactttccaggagatgaaaccgagaatcttggatcattagtcatttatatcccaggattctctaaaggaaactcatgtgtctacaatgagtatgtgaatgcggggaaggggcaggggatgaaggaggagattcccctgaactcaacctctaagggcaatcaaaagccatggcaaccgtagcagctcagcacactacacaaggggaatttggctgttttgataccattataatatatcagtcaggctaaattgattgaaagaaaagatcctctcaagttacctcgggaaaaagatgtattttaaagaaatacagaccggaagtggatctatagcgccctagaggctcaaggcatttatagggattgatgggtttctcttgctccagttccttctcctcccctacaccccttttttttttgccctttcctgcccctctgtcctactgttctgctgcctcctccttcttacaaactctccttccctttcttctctctttcctcagttctctctttctttctgtctctctctgtctctctcacacagacacacacacacacacacaagaacacacacacacatacacacagcaacagcagcagcagcagcagcagcagctctgcttgtggttctctttgcccatagatttcattgtttttttactgccagctgactacatcctccttctttccatgtctttttgggtccctccaaattttgtattacacatggcattatttcaccattaggttactactgactggcatagtttcttgttttttcccttgatatattttgaaaacaaagaatccagctagcttagcttactctttcagatctacctataaagtacatcctatgctatgaatcagctgtccatccatctagtgctgattcttggtctacttacctagggacaggttagggtcacaggaacatgaaatgtggatgcttagacaaagaagactgtaactagggtggggagttagccagaagagatcctttgacagctctaatgcaaacgtaagtttaaaagtattatgagatagtagatgcaaatgcagtgaacagagctgtgttgtagaatatggtgtggtacaacacagattccagacttcatttataaaagacaaggccagacgcataagaaagttatgttagctataagagaacaaacagacattggactcgagaggttgatgaatcgctataacattcgttcgtctcccttatatgatatcaaatcttagaaaggcagctgttcacaatttttttgtgtgtctggtaaatcatctcaagctgctgcagattcagtatcatgcatatgacaaaattaggcaagtcaactgtgtgttacatgagtggttcatttcgcctgatgttctattacatttgcagctgcatctgcatctcagacacgtaacattaactgatgttcataatgataaccctgagtcattaaggaaatgttgtattatgtctggtacagtacacttgagaagtaaagagatgaaatggagaaagaactgagacttactgaatgcttgctgtattgcagatactgagagagatgagctacttatgttactgcccttaacaacagaatcctgtgacataggtacagttaccttcattttacaactgagaaaaaaacatgttcagataaggatattttccatatttgaattaggaatccaaatccatcttattctagaatttttgctctccctttatatcaccaacctgtttaattttttttaaaagacatattcaagtcagtatttaaatgagatagccttaggtagtcagtgttagctagtcaaagactcaaactcaaaatattcacaaaagaaagaagagaactaatatttgagcacatgaccattcatgatgatttattccctgtgaactatgtgttattatccccaagttataagttaaggaaattcattaaggcaaagtgacttgtccaaggttgctcattgagagagatgtggctttaatgtgtttttgtttgtttgttttgcaggcttcttttgtcaatccactatgtaaatgttagttttcttaagtcagtcctgagctccctcattttcttctccttcagtttccttttgtaggatagtttcagatgtaagaattctgaaatttataactttagatcccaccttgctctcaagttccctacataacttagatacttttttcatataccgtgaaacactgaaactcaaaagatataattttttcatttcaacagtctccaagtatacctgcaaccccacatttcttgtctaagtgaatgaccccaattactcaagcaagaaatctatgtatcaccctacttgactcagtaggtgctgactggccacctcttgttgtccttgatatgaatctctttcttcctcttcctctaccacttctctaatttaagccagtcctaaacaattgtagtagctatatcagtctgcatttctcaatgccattagagtgaacttcctattgaataattttaatcatatcactttcttgctcttaattcttcagtgatccccatagccaaaagcaaagcatccatactgctttgcacagtagtactcataacccctcatgacctggtctctgtttgctacttattcccaccttcatggtgatatagcaattttgacatacttatggctccctggacacaccgaacactgtcaaagttttctaactttgcctgtttccttcacctgctggtttaccacactattcgtcaagcatcctctcaaatgctttttgattattaagtctttccatctgtttttcagggctgctatgactctttattcacacttcaaatacagcaggtgtcttagtgtactgtaatcacatgtggatttttgctccttggactgataacactgggctgagatgcagtgtgcactgggatggacatactgccctttgtggctggcatgctttctgattaattatatatctgttatgagtggttggtgtttatggcaagcagttgttcaatatcttgaatgtcatctcctgcttactaccaagcaatgtctggcatagagagggtgctcataaatacctgttgattcttgaattaggaatgaatgaatgccgagttatggctggcttcaacttaccctcttcccttcactgcctctggctgtactacactgagctggtcgggtttctgtgacatatctacctgggctggttctgtactgtagcaaaacaaagaataaatgtattttgtgaagagctttcacatatgtgcagaaagtttgcatgtcccattgaggcttcattcctaacaaacaaaatatcctcacttttatcaatgattttcagagacttcttactgctcgtagatgtcctctaatcatacaaatttatacttacagcacaagaatgagaactaagaataataatccagatatgatctcatcattgcaggatgaattatgatgattggatcctgtgagttggaaggccactggcggacactgatacaggcttaatgacatggacttccttcacagccatatcatcttgagcttgtgctcacttgaagtccaggattttactttactttttccacatgagctgccatcacatcagatatgtcctggcccattaaaaaaataaatttgtacttctgattatctcattctgtatacccctttgaccctcattctggtttaggattttctgcagtttgacaattgtgcttttgacatctttcttacaaattatggatgaaaatacataagcagcagagcaaatttcagaatcccatgttacaccacttttcctccagcttcagactgattcattaatcaacattgtttgggtgcaaaatgtccagatatcgattcctggctccaggggtgtttttttttttttttttatttccttctatctaattccgtgctttgtccacaagatataattagaaacctgaatggctcacttaaattaatgagtaccaggcctgtatagtttatttaatctattaatttccagcccttattaggaagtcatcatcatcatcactgtcatcattcatctgttgaaatcaatttaccaaagtaaattcctgtctttggtattagctggaccccagtcctatgtcttggcaacttttaacttagactcacctccagtaccatggcctggaagggcgagattctccccaggcttcctcctgagtcatagggcttcccctgttagcctctctgcctctgtcttctctcaactgccttcataacctcagccacaaactgaagacttttttctggtgaaaaccattcagactaagccttctgtgagtttttcaggtcctgtaaagatggatgtgcacagaggtgggtcaaatcacttattgtgtagacttctgtctctttgttggctctttaagggactttaggccatatgaataaatctgtatctgtatgataggtattgatctcattttgcatatagtgttgctaaactgaagcttaggcagataaattggctttggccaagatccatgactactgagttgtgagggtgaaattttaatacaggtttaaggctcagaggctcacacttgagccattaaattaactcatcctgttgtcttgtgagcacagatttccttccttccttccctcttttcttcctctgtattcccttcattttctttccttttcttttgtgctcaccttatctcctgtctcccttctctctttctccctgacctcatcctccctctatttttttctttttagaattcatgatcacagtaaagttctttcagtccctgggatgctatttattttaacttaggattgataatttacctcacaagccaacttggatttgtcgagaaaactagtccttttattttatgtatagcagatgtaatcttcacgcacctcatgcactggtaaatggaaggaaaaacactacctacaggtcaaatcgatctcaagtttagtctgtctcatgatgtaagcagccccttctgaaatgacaggctctcagatagctttctcttttcttgcttctctccctcaaggatgtcctggtctaggagaggtggggattgtgacttgtgtgtctttacaacactgggagttggggtcttaggcccttgttcagcatatacctgttgaacacacacacacagggtgcagccctagcctctgtagggtcacctgatcccttcagtatgagtcctgggcagggaacactgtcagcttggaatttgcacttcactagaactgagccgagcacgggagtgtcagccaagcatctctctctgaccatgatgctcgacctgcttagcgaggctgggcttacctgttggcctggaaccctcaacccaatggtccctctcacagtgctaggtgtcatgtataggaaagaggcccctggcctaggttcacccgttgtacaccaaagccctcaaattagaaatcggaacatatgttgtctcaccttttttcatataccttccaataaatcttacacgatgaaaaacaggatggatgcggtggctcatgtctgtaatcccagcactttgggaggctgaggcgggcggatcatgaggtcaggagatcgagaccatcctgtccaacatggtgaaaccccgtctctactaaaaatacaaaaaatattagctaggcacggtggcacgtgcctgtagtcccagctacttgggaggctgaggtcggacaatcgcttgaacccgggaggcggaggttgcagtgagccaagatcgcgccactctactccagcctggtgacagagcgagactctgtctcaaaaaataataataataaaagaaaaaagaaaaacgggcaaggttttctgtctccagattagtttttttttttttttttttttttttttttttttttttggtgacttcagacaaacattagtggtagaaggggatattttcctacaatctggttaaccccccgagctggcgtcttcaagcttagtttttgacatacaaaaggaggcaatgaagaaatttggagaatagtttctctagagattgactttaaaagcttttggcttgttgtctaatcatatttttatgtcagaagctgaccatttcttcagcttttctctttgcaggacacctaaaacaaatcttaatcagttccttgggacatggctacctcagacttgttaggatcagcaaaagaagattaaaaatatttaaaatagcccccttaagtaaaagatgggatatatttacagtgtttacttttgcatttgatttaatttgagattttctttgagaagatggaaggaataaagagcagttgagatgttacacttttgatttaccctgcgtatcattccattgtcctctgacccatgtctttagcctattgcatcctcggttgtcttcttctaaaagttgtcttttgtgttgatattattgtccttagtattttaaaataagtcttagttcactttgaactataatctccatagaagaaccaccagcttctaattttatttgtttgttctttgttttgtgctcctgtccctttcttggccatattttcatactaagttttttagaaagcagccagtgaagtagcactgtttctgtttgttgttattcttgttttagtgatatcatttttttctctttaggattatttttaattaaatatttatatttgaggtcttagaaacacttcactatatttgtcttagagcctcaatggcaggatccagtttaatatttcttgatgtttttgaaatatttcataaattccagaataagtgacttagtataccaagcgtttcctttgctttttgtttgtttccctttaatttcaacatggaatgatattattattctaagattcctgtcactgccacaaaaatgaaacaatgtttccttatgggtcagaagtaaatttatggtagacatttcccttccggctccctctgcatatcagtcatttttctgcaaagaaagtgaaaatttattgcatgagaaactttgaaacatcactcagttctcttgtttgtggtcatattttatggctttgagtggggacttctgttcattcccatattatgaacaacagactgttattgtaactcatctgacacaagagtttccacaataaaattaattggaaatttcagagaattgagaaagtatagcttaaattgatctttagttaggtacaatttcttctttaccctgagacatgaagactttaaaatgaagacttaaaaaaaaatgaggctgatacttatttttgtaatatggtgctagttatgtaaaataaagttttgttttaatgggttgttagacaaattttaacgaaataaaaataatgcagaataatctgtctctgtagaagcatagcctcagatttatggtccagaaatctaggagggtggcatgtaatttaaatattgaagggcataacttatcaaatgatatgtcaagtacaaaaatggccttgtaaaaagatgactttattaggggaggaagtaaggcatatagtgaacatactacatagactcacattttggaatcggtatgactacagaaaaccaccttacttggactggatggatttgatagtggaaatgagtggcctgtgaggatggaagtttttgtatttatacaggtttatgcatcagaagttggcactgtctaaaaaatccaaaataaaaaaggctaaaaaaagtttcattttattttgctttaaaacaaaaattcctacatctagtgtgatgttggtggtacagctacttcagtatctacatgttgacattaaaagttgcatgactattttcatattaaatgttatccagaaagtatgacccacctaatattgttattgaaacaccatttccagtcgtgcaattaatcctaattaaacattagcacaaaatttggaagatcagaaagttgttagtaccatcttgaatctcatgattgcagaattaatttaacaaccctgtttgggcataatacattccaaaaaaatatttaaagaagcatcgatttattcagaaggtttatatttgcttcatatgcattcttcagtggtattcaggaaacagctgtcagataaattataaaaatacgtgataaacaaaaccaactcatctttttaattgattttaatctagcttcatctaggcagcataatgctcttcactgatagtagagtgaataatatgaatgcaattacttagcaattcaccatgacttaaaaatatacagagccttaatctattactaatatagtgtaatgtccaaagcagcaaattattggtgggaactattgaagatcagctggtagttagtcatactgctttgttcaaatttaatttcaagaaacaaagaaggagacatgattactggtagtaacagcaatgaattatgggaaactaccactgaatcatttattgattgatagtgagtgaaagtcgttatcctctgatggctgtttgaacagctaatatgaaacgatgcagctgatgtctgtcacgaaacctttgccatattagctgtttcctaattgtcgcttttattttttgcagcagaaattggagcatgggggaagagccgtgaatctaaatttgttttttgttgttgttgtttttttgctgatggagaaagtgcttcttggttttaaattcctaccaaaataagagggaaggaattttatttagttacctgaagtaatgctagatattaaatgatgaagactatcaagattcctccattttatggtatgctttataatattcaacatcaaaggttagcacagccttttgtatattcaagtagataggaatggccctgggtgttactatctaccggatagagcaagagaaagttgactctggcaactgtcattaccatttatttctctcttttccaaacttagcccccttttttctccatagcaattggctagagtcctcttgaagtctgtattgccaaccataagttgtcaggtgtacagtaagttttcaagataggatttgtaaggtagacctaattatcttcttattttggatattgggaatatgcaaaggctatgaccaaaatttagtaatattatttgcctaattattatttaacttggttaataagccctgatttagttacactatcgataggatgaaaacccttgccttgaaaattggcagctgttgtttttaccattgaactgtacaaagctcttccagtctattatacgcattttttttttttctaaagaaaacaagaaatgattggccgggcgtggtggctcacgcctgtaatcacagcactttgggaggccaaggtgggcagatcacctgaggtcgggagtttgagaccagcctgaccaacaagaagaaaccccgtctctactaaaaatacaaaaaaattcagccagacgtggtggtgcatgcctgtaatctcagctacttgggagactgaggcaggcgaattgcttgaacctgggaggcggaggttgtggtgagccaagatcgcaccactgcactccagcctgggcaacaagagtgaaactctgcttaaaaaaaaaagaaaaaagaaagaaaaaaaagaaatgaccaattaagtgtatctgatttaggaaccgaatgttgataacttgttttcagattcagtccataatggaagtctataaaaatgtcaaccagttatcagggcataatgccaggtcatctatgtgttcttatcatcttcaaacagatcagatgtctatcatcttcctgctttgtgcacagatctgggccactatgataatcataatacattagatttacctaatggttgtttcccgggttaccctctcagacttttgcaatgttcagccttgctttaatggtttcttacaatgcacaagtacacttaaattgcagcactggatgtttttctccaaaagtgttatacatggaaggggaagggggtgagaaagatcctgtaattgaatagttaataggcttttcactcaatgaacatgtccatgaacctgatacatacttgttttgacgtctaaaaatgatattcgagatggcttaacttggttgttgattagcaagtctccatctaacattttcagtcaaatatttctctccctcgcttggatgtaagcctagctagctgagctgggggtgagaaggacagaacgagttggtgtgggcagcctggtctgagttctttttggattgcgtgttgtaaatcttcatcctctgggctcaaatgaccaatattatatttttcagaaatcaataatcatgaaattcatcactgttcatttataggtgaataattacacactgaagaggctaattgctattctataatattttgaaaaactagaaaatggaaaattgctaagaaaatttatccattccctttgcaaaaaaagttgggttttgtcaagaatgtgaaaagtctgaaatttttctctactttcaggctaacaatttatttagccttccacagtttcatggcagatgctggcagaagacatgatactcctagatcagagacaaagacttcattacagcacagcaagcaaaacgaactcccttgtccctccaagtgctttggggttgacatagaggggcctcggtgggtactgtgcaattagtgggtttgcatcacagctgaggaatcctaagtttaggaatcctgaatgttttgtaagggatgacaaatgaatctgcctgaactttgctcggaagagaaccactatctttattatattgggccataaacaaagctgcccctaccatctgtttccatgggagacactaactctatattcccagcctgtttactatcaaaacattattgaaaagagttcagaacaaaagcatagttagtatctttgctctcaatatgtacagaaatgtgagagacctatagaggtctagttctaatgtacctaatgtacactgtggactgtgatagcttatgggtaaaatgatgaaaggaccgaaaagcctattgatgagcttgcataatgtatatatttctgactcagataaaaaaaaagagaatatctgggaaacactaccaatggggatggaagtgaaccagttttaccaataaaatcttctaaatagtgtaactaagacaggaatctcattagtcctagattgaattaatgcatgctgtgacacatcaagctgaaaagtactattaatctttgactctatataaaatatgtattttgacataatagtgttagtttagtgtgtatgtcatatatataggtaccagattaagatggattttggaattgttttgtgccttttcaagcagtataatttttaaaaacaaattcttgatacaggtagttgtgattttcttttaacattccatgttaagatgaaaaatactggaattaaaaacccattatgagaaagagtaaatttgaatatttctccattatatagtaataaatgtttgtaaaatcttccttgatctcatgtttccaggttactgttttggaatttgtttggcctttgcataatccttgattgactttggtaaattatatcctagtggaattatccactttcattagcaccactttcttcttcttcttcttctacttttttttttttccttttcagtcagggtcttactcttttcacaggctggagtacagtggtgcgatcatggctcactggctcactgcggtctcgacttcctgggctcagataattctcccacctctgcctcctgagtagctgggactacaggcatgcgccatcacatccagctaatttttttctagtttttgtagagacagggtttctccatgttgcccaggctggtcttgaattccttggctcaagcaatctgcttgcctcagcctcccaaggtgctgggattacaggcatgagccaccatgcccagcctgttagtaccactttctaagcacaagataaaaagcttatctttgcctaaaatatcttcattaccatatttctttaataagacctttatcatctcctgtagtatctgtctgtgttatatgaagttttacagtaaaatttcatatatgccatttggtgggttactatggaaaattttatctgatgttaaagttgtccatcaaactacttgacaataacatctcatttataaacatcattcagatttattggatgatgtattattactcaggttaaataagcattctagtaaactgaaaattgttaatacatacataccacaacatttactataacgttcataacaaattttcaaatgactcaaagacaagtacttttttaagctaaagttgcaatcaaactagtttgatctttgattaatgctagtggagctagaggccttctgttgtatctgatctcctgtgaacagtggcaatttctaaatagttctgaagatgtaatatttgaccaaatctgcccttatctggggttttatttactgcttggcttttctactatcagtatggttactgtcatgtttcacttttaaaagcctgaatacaaaattcataggaaaaaaacgctaattatttctattttgttttttttagagtgtcaaatgcagtgaaccaagttttcctatatattttttcagataaattgaaaatagtaaaatgtaataaaaatataaaatgtctcatttttaaaatgtgaagttcttttagatctaacatttgatagctataatagacttatcataatatcataaaactagaatcccttagtaataatctagcccatcatctttattttacaggtgaggaaattggggctcaaataagttaacagacagactcatgatttcccagattattatgtaaatatatgggactggaaccccagttttccatgtgttaattcattgctcttccataaccaaattaccctgaaactaatatgacattaattttaagttgtaccattacttatatatcactaagaaataagaaagacttctaataaattatgatagtttcattaatgatagcctctcaccccccactgctgccccagcccaatgcatgaatccatcccctcattccctcattgctttgagacattttaaaatctattctgagagtttgggcaagactttccccccttcatcttcactgagttgcatgtcgggaaatccttttgcacaaatagcagtaacaaaatacaacacagctacatatgtttgtgggtatctttctcgtgtttcataggacactttgttgatttgcatgaaaatcagtaattgtcattcctccaatgaagactgttttactcagaccaaatttatgccctgtattttgttgccatgtattcatataaacaatatatttatgtttcagtgatgagaaggtgttttaagtggcaattaacatgtgttgtagcaacaatgcccatagcttagtcaggagaaagagttcgattatctatgtccaagaacaggtaattgcaacttcataatgagtttcccttgcatttatctttgcagtctttgtaagaaaatatcttgcaagagatctcttgatttcagagatgttgacatttaaaataataataataataaaaatctgagtctcagaattggtgaaatatacctccttaagatttgctagaagtctgcttcagaatgtttcttgttgaataatatttttacagaatactatgattatttacttaaaaaaggctcttcagctcttgctagcacatccaaacagagaaataaatctgggactcttgattgcatgcatatcctattctatttttaagctttttcaaatcgaatagattgcttagtaaatgctctttaatacacatgttcaaagttctaactttgtgtttggtgggatgctcttatattacaaaacttagttacaagtagtgaatgtcaaacatgaccatgaacttctaaaattcagagtggtttattcttcattaattttcaaaattgaaatacattttaaaaggacatggtttcaaaatcattaaactcctcaaaggagttcccacttacgtactgtttatctgactcatgtagttgaatattcagtaatacagagtttgattagcgtttttaaattttttactttttggaaaaaataatcttggtttggaatatactgagtctatacagaggacaggaatttaatttcaaataagttttcagattgcttctagctccccatgtcataattactattttgacagttatgtctcatagacatttattttaattgcatatgttagcaattcattttggcatgacactctctaccattgttgtgttgccgaattatgcttacagaaactatgtcagaaattcagcatgtggagaacagtaattaacctgactcatcaattagcttttgtgaatacagatgtcctatgaatatattccagtcattttttttcttttttaattaagtaaaatctcactaccctgattctctccgcaccttctacttctaacctgtctctgagtcttcttcacttaccacctgtatgttttgaatctgtgccctatctaccatcaatagcctgcatatattaacattgtctctcttctgtgttttgcctatttagcctctgtctcccacacacactcttgtcccctctaattcattctcacccttgcaagtagaggaatatttataaaattcaagtcacgtcttgctgcacccacctgctgggtgtgtggaatgattctgggactacttcacaggaaaaaacgaatatccttgagagaggctacaaggctctacaccatcagtcctgccaccctctctgagtctcgccatgtgtgagtctctgtgtctgcttgccacatggacctacattccgtcccttgaaggtagacaccatgcttcttcctctatagggactttgcacatgcaattgtttcttctacctagagcattcttcccacccaacccagcttctcttggccagctccttcatttttcacatcaatagtcacttcaaacattgccttgtctggccacccagacctaatctagggcctctttatgtgttccactggaaatatgaacaggacttttatgattcttatcacagagtacaaagaaatatgcatttattttaatagggtgtgtgtgctggaccacggtgggtttcacagggtaggaattctgtttattcactgcagtatccacaaccatttgcacagcaattagcacgtaagtgtgcaatagttacttgcttaaaaaatgagtaactctactacaatgaaatgggtgattattaaatctaggctgaagtgaaatttatattttcaaagaaaagtctgccataaaaaaaaaaatgtaaccgtaacagtggtccattttaaatggcttttaaagagatttagaatacatggtttggaaatgcacttaataaaaaatatgtcttatcattagagagtcacatatcttatatatttggttaggcacttccacttcccagctgtgcaaataattatctttctgcatctgcttcctgctctacctgctctaaatatgtctccggcttgttgtaaagagaaagcaagtggggtggggtgtgaactataaaacactgtatgtacagtttaactatttaagtatgccatgcagattctttgttagccattgacttgatttttacaacacccttgaaaataatttctgaaatgtctctaacatgttctacattttagattttccactaattaatactgacttttcttttaagtagtctaaattatcatgtatttttagatatcttatgcatttgtttcataaactaacatttgttttgaggacattacctgcaatgcatgtttttttttttttttttttttttgagatggggtctcgctctttcaccaggctggagtatagtggctcaatctcagctcattgcaacctccgcctctcaggttcaagcaattctcctgcctcagcctcctgagtagctgggactatacaggcacgcacaaccatgcccagctaatttttgtttttttagtagagatgaggtttcatcatgttggccaggatggtctcgatctcttgacctcgtgatctgcccgccttagcctcccaaagtgctgggattacagttgtgagccaccacacccggccaatgcatgcttttaaatttagaagtttcacctcatcctgaagaagagctcatatgaatatgattacaagaaaataacatttagattgagcctttattttttctgatgtcatgcaaaatccgtaactatactttttagctctttctcttagccaaagggtagtcaattatgttagtagatgagaggatattattcaactaagtgcaatgaccattttaataatatttatattcacctgaaatgttgatcagacttttacctaggttgctatattctcattttatatacataggtctggcatatagacattttcatatctacctctaactacaaggaatatgtatatacttttttaaaaactgaaattcttttgaaacccttcttctaattctgtctcagtcagttgtgttgctataaaggaatacctgaggttggataatttttaaagaaaaaagatttatttggctcatgcttctgcaggctgtacaagaaacatggtgtcagcatctacttctggtgagggcctcaggaagcttccactcatagtggaaggtgaaagggagtggacatcacatggtgagagaggaagcaagagagagaggaggaggtgccagactcttcaacaaccagctctcaggggagctctcaaggacactaagagtgagaactcactcactcccttgaaaatggcaccaagccattcatgagggatccatccctatgatccaaatacctcccatcaggccccaccttcaacactggggatcagatttcaaaaagagacttggtaggaccaaacaaaccatatccaaagggtagcactatccatgccatgccattattttatatacaaatctggagaagaagcatttgaaatgcaattgtcaaacctatatttgataaattaatctttatttacagcaataagtattgtcttacatctgtattaatataaaatagtcgtatatatacatacatacatatatatatatatatatgtatatatatatacacacacacacacacacacacacacacacacacacacacacacacatatcaattccccccaacccccaagggcatattttcaaactgggcatcaaccaaccaattttacaggtatttttcactgaattcagtctatgttttggactaaagtttatggtccaaattatgtaatgataaattagataagtctaaccattatctttacctctcagatggtctggaataatggcagctcaataaatcctttccctgaaatacagagaggtagatacttgtcttgcttagtacaccaatttccatgttttaccttcaattataataattaaagtgattaaagggtttttattattgacatgaatcatgtgagtcatcttttcccaatgtcaacaatattcttgaacgaaatatatgactaatgactggatttcagctgtaacatgtaatattatcatgtattaaaaatctaatatgataatttatgtattttataataaataatgtatatatttacatattttgtaatttgtatgtatgtaattaatttatggcacactttagtcaatgatagcatttaaatctgagtccatttcaatttgagttgcactaccagcagatttccagcctacattttatatttgaaatgtatttgctttacttcaaattaggtgtatttcttgttttgttaagatactgagttcaaatttatctcttttaaatgacactgtattgacctttgcacattgtctgttgtaaatgtgtaattttatgtgtcaatacagtatcatttgcaaatcagaaaaagaatctggcacctcctcctctctctcttgcttcctctcttgccaggtgatgcctactccccttcaccttctgctgttagtggaagcttagcttcctgaggccctcaccagaagtagatgctggcaccatgtttcttgtacagcctgcaggggcaccagccaaataaatcccttttttaaataaattattcagcctcaggtattcctttatagcaatataactgattgagacagaatcattgcaatatcatttgcaacatcattgcaaattctattaaagaatccattaaatattgtgatttagtgaaagctacttagtaaaaaggttatgttctatttatttgtagtatccctaaggcgaaacctgtaggcttcttagacataccattgaaggctactgaaattattgaattcaatattatagtatctgctagtgcaggccaatatgcgtaggtcaatacccaatcatgatggttaatttcatgagaatattgttgcagaatgttgggtttgagggaacctcccatgttcactgaggttaaaatacatccaaactcatccaacataatttcctaacatgccaagagtgattgggaaagggatacatttttgggatagattaaaataaaaaaagtgataaaacatgaaaacaaatagggcctaaaatcagctaattaattcaaaagtgatcagagaataaaagttctgcaaataaaggttagaatggaactcaaaggaagcaagtaatgctcaccttccctagagagctctaataagaatgtcacattaggtcatgaccatcttctccttatcatgctgctgttctctggctctgttttgatattactgctggttgcaaagtgctttatagtatttagaaataatcagacccttcttactacaaaaaacctcagttctctttattacctagatgtattgtgtaggcaactgccctttggtattcattttgaaggtttagaatgaccctttcagaagatgttaattacatattttgttagggctaagtatggtctctaagaggtagcttcttctttctttatacaaatattatttgtatcctgagatttatatcaaacttttacctaattaccagattttaatattcttattgaccatattggagataattcagagaacattttgttttttttacaagtagttactgaaagaaaagagaaaataactttatattgattttttcatatgattatagattaatcctcaggcaatataattaatatcataattcttcccatcttttaaatgaagagtttacaaaacatatagtatttgttaacacttaatatttactatgtgcctggtgccattctatgtgcttttacatatattacctcatttcatctttacaatagctctctgtattagtcagcttggaatgttataataaaataccacagactggctggcttaaacaacagaaatttattttctcaaggttctggaggctggaagtccaagatgagagtgttacatggttagtctggtgagggccctctttctctcttaccagtaactgtcttctcactatgtgctcataagacctcttctttgtgtatgacgagagagagagagacagacagacagacagagagacagagacagagacacacagagagagacagagacagtcagagagagggagagagggagggagaaagagggagaaaagatgagagagagggaaaaagacatgtcgggaggaagccagggagggagggagaaggagagagtgtgcaggaatgagcacaagtgctttctggagtctcttcttataatgatactaatcctatcagatcagggacccaccattatggctttatttaaccttacttccttagaggccccatttcaaatacagccacacaaagggttggagcttcaacgtacaaaccttcagttcataacaccctccaagctaagttctaatcattcccagtttacagaagaggcaattgagacactgagggtttggtgatttgctggatgttacccactagcaagctttagggctaggattcataccccggctgtctcactcaggtctctctctgcccttaactgcattagccagagatcacagagaaaaggcaaaaagagtagagatattttatgatacggataagagatgagaaagggaacttaaaagattcacattttctacttaaaagcaaagttacaaagcctgtggaattgctctgacttagaaagaacttgatcatgcttttggagtctctatgtgttctctctctgttggttagttttaaatcagcctgcctcacaagggagcctgcatttgattcccaagcccacctcacatttactgaatcaaagtctctgggaaggtggcagtctgagactgtgcatttttaaagagttctccaaataatttgtatgtgttctaaggtttaaaattcacagcttctcgaagaggtgtccagctcaggttaggagatataattggaggtgatacaattatgtttgggccaagcactgggccatgtgtaagctcttgctcaacgcaaaaatctgatatgcaccaaatcctttaaaaacagctctccaaggaaaatttaggtaacctattcatactgctggcatgtgctcctcctgtttccaccctcgtttattttggatatttttccagtcctggaaatcatcttccattttggcaccatttcttgattgccatcttgataggacttttgtctgcccactcccccacaacaaccattcctgtctcccactcactttaccacccaactccctttcttgtctattcctggatgcaggacaccacatagtactttctaactttgatattgcctatgacctagagagtggtaagtcatccatgtgacttggtttgagaggcactgacaggctgagtgactcaacgttgtttcaaagtctagttcctatggtgtgttgctcaggcgcaatttacatcgtatggagcacttactccaagatatacacgagagaaaattctacaattggttttgattgggaaatacttcaaattgatctataagttgtagataaacaagttcttcagggcaggatgtgaaaagcacatgcacgaattctcttgtgtgtctccgtgtatgtaagatttggtaaaagtttagagctgtatatttttcacattttcctaaatgtttattaaataaacatttaatagacacttgtcatagtaaaagttctgaaaagagaaaaactaattctatgtatttcaacacatcaacctccaaatttatttgatcacagaacccatattttctgcataggtgttttgattttctgaggacctaatgttttatgcactagtgtattggttcatttcttgaggcttaatttcccaaagctctttttaaaaacacaaaacacttacctggggcagagagtatggatgatctctgaacacttctagaaaattttacaacagagatttgaaaagataaggatgtagagagtgcaggacaaagataagttaatctagggcacatgcactttgagataagagggtatcatgaaagaattttaatggaaattttgggtataactggggtgattagggatgttctgagttaactccaatattttattttattgattgagacagagtctcattctgtcacccaggctggagtgcagtggtgcaatctcggcacactgcaacctccacctccctggttcaaacgattctcctgcctcagcctcccaagtaggtgggattaaaggtgggattaaagccatcatcatacctggctaattttttttgtatttttagtagagatgaggttttaccatgttggccaggctctccttgaacccctgacctcaagggatctgcctgcctcggcctcccaagtggtggaattacaggtgtgagccaccatgccctacctccagtatactttggagggaacatgaatgtaagatgcagaagaacgaagaagatgatgaaagaaaaggtggatatgaaggtgggagatttgaaagcagattttatgcccttcacagatttttagatgccaaacctgtcaagaagtttgagaattgagatgtagatatatatgtgtgtgtgtgtgtgtgtatctctatgtatctatcttatctatgtatctatgtatctatctatgtatctgtgtatctatgtatctatctatctatttatctatctatcctacctacctacctatctgtcatctacctacctacctacctacctctctctgtatcaagagaactttacatttctaaaactaattatctcaggtctctaaagttaagacctgatgtcaatgtcaaaagtcagtcctcttcaaaacattttaaatttgtgatgttcctgaacaacagaaggcttaacatcctgctgtgtgtgaagataggcgcaccaccataaattagaacatgtggagcttttgtttttcctttgactttcaagtccatcatttttattagtgttcttagaacccctttctctgaagacagactttgcaactttctctaaagtttttaaagagacaaccactttgataaattgaaggaaagcaagaacagagagcttggattttatctgtttttttttttatttttccattagcataaatataacatacaaggaaaattcatgtgtgccttaggtcatgactgtaatgcttgcatcttctctaggaagaagccgtttttttgaagttggtataaaagtatgtgtcaagaacactaccttgaattttaccttgaagtcataagccatccacagaatgtgtacgtttaggcaaaaatgctcattaaataaacttacattctgtctaaaagtttgttgtaaaacttatcaattgaaatttctcaatatttgcaactatgtcgtagcaatgtatagccacatatgaagggccaggtgtaacctgcattttcagtttggcacattgcccttctgtgatattctgctcttgggcctttccttttccgcttgtattccttttctacatcccttcctatgtccccatactgtcactctgttcatcaaagcctgccttcaggagaggagctcacagacgaattcataataagtattaataactgataaggctgaacacattacaggaagatttcattatattttattaatgttaatccctaataccaagtgaattaagttctctttgtaaaattttatccgccagcaatgtttaggaaaagtaaactgcagtggtttgtggagccgctggaccagcttacaggagctaattgttaaaattttaggaatttttgtaagctgggagttaaacatagccaccgttgttaaatatgaaattatataaacttgtaattaagtagatcatattgaaaacgattatactcaaaaattatgtccttattatatgactatattttaatactatccatgctcttgagtacattcttgtttattgtatttgtgggatatataattgcatatttcatccctactccactccagagacatattgttagcttgaaattagtcatagtagatgtatttacattatggaaattaccaaatattacaaataggggtatgttttatcgttttgctgattggcaagacttgagatagtactggagaacatgttgttaataatgcagattaaacttaaaagtacaacatagctatatgctttacattgtttaatatcacaaaaattgaggaaatactctcttagtatttgaaaagtattatccagtttagcataaaatgtcactgttaacattctgacacatatttccttcatttcactctgttagtgttatttaaggtaagagaaaatatcaaccgcatggcagaaatgcccttttcatcaattgcaaccaggttggtggctactgtgttggttaattttatgtgtcaaaaaagctagtccatggcacccaggtatttgagcagacattattctagatatttctgttaaggtgtttttatgagattaatatttaaatcactggactgagtaaatcagattacccttcattctgtgagtgggcctcatccaatcagttgaaggccttactagagaaagactggccttccttataatgcctgcatcctctttaggcaaatgtagttttttgaataagtgtaattcactatatatctcattagacataatgagatataaaagtatgtatcaagaatgcttccttgaattttagcttaaaatcacaaaccgtgtttacttctaggtaaaaactctaagtaaatacatttgcattctatctaaaagtttattgtaaaattgagcaattgaaattctgctagctgactgactcttctttctctctctctgtctctctgtctctctctctctctcagagatatttatgtgtatcctgttggttatgtttctctggagaaccctgacttaatacgaacttggcaaaaaccaacaaaagaattatgtgcaaatgaattggctttagggaatttgtaataaacaatattgtatgttttataattatttgtgaattgtgtgctgtacattctttatatcagtaacatatatcataaacatatatatacatatgcacatttttcttctacagggcaggatgtgaaaagcaagtgcatggtttcttttgtttgtgtacgtaagatttgagaaaagtttagagctgtttatttttcacattttcccaaatgtttattaaatatatttaatatagacaaagaaaaactgcatatattattcttaacattaattgaaagacagaaaagaaatttttattttctaaatatagaacagttactattaactgcaatgtatcttttgaagtgaaattccaaaagtaattagctgttgtttaataaatataatattttcacaaacagtgccattgggatagttctactgcaaaggcaaggttcatgtgtgaataactgcaggtgttcagttttcaaagcctctgaaaacccttgaacattgaaacctacatggtgtgttatctccttaaaggagatatagtttgagtggattccatggttatttgaagtgtgtagttttataatgccccagcatttgaaattcaagatttaataatctctcacctaccaaatcatcaaatggcctttcataacaggatgctgtaccattcatttcaatggcagccatgggataatatgttctgaagccatgatattgataaagagcctggctaccatgaggaaaaagaaaaagaaagattctgcttggacttaatatgtttttgctctttcaaaaggcaggataatgttaactttaatttattcagttatgcatttttcaacttgcagcattaaagaatgtagaaaatagagtaaaagaaacagatatgcaaaagagtagaaggccctttgtatgaaaagtgcctccttagtgttcagttattgattttttttcatgacttggctttgcaatgaatatgatggaaagacaaaatcaatatgaaataaaatttatgtaagtactgttccatgcgatgcagattttatacatttctggagtataagtttgttcttgcaaagtggttttaaaagaagtacatgaaatcagtggcagtaacaacgctggcaaaataagcactttatttctagaatgctggtaatggagtcctggtttctaattggtactttatagcactgacagattttaaattgggctgatttttggtgcacactcctttatgcctggattttaaactcatacttagatttagtgctacttgctatttgtatgtggcaatatgaacaaaatattttcattactatttcattttcagaagcacaaaaacctaggatgcggagaggttaaatagctcccacccttccatattttccatgtgagaaatctagtatagaatgataaatgtcaggtctgaaactaaggtttcttaattctcagtttcaccccagccacccagtccacaccatcattgttttgtccactatatcacagccaagattaggagaataatttagcttcttcaagtctccatataatacctacattcacattttggctacatctgttcaattgtgacaacttcagataggaccaaaaattttgacttcattggccctctgcatctatcaagatgattgtaatggacaaaaacaagaaatgaatcatatctgcatcattactcaaagaattatcttcataagtcaaaaagtgtgctagtatcattgcaaaagatgtcagacaagaatacgtgcatacagacacatgcccgcacacacataaggatgttgtttgtaatctaagagcactttggttcttttccactcctgttcaccaggaattgggatatgactgtggggtggagtggcaaaattaaatgaataagccctgatgaattattctgttgtaatagtattttctcacagtggacaatggaaataagagtggaatatcaaggcagagggaaaattcacaaattactgtcctaaatggagaaatgagagaacgcaatagtgaatcttaaagaggaaatcacagcaacacaggaacttttaaaagtcagccagtttgtttgcccatctgaaaggcagtcccttctcagatatccaagtgaaattctgcctttagagacaggctttttccgttgtcgaacaattataatttataaactatatgttaaagcaaaactctgccttactatagcttaaactaaattctgtgattctggaataattttctggctctggaaataatcagcaaatgatttgtgcattaatttattcattccctcagtcatagagtaaatatttaacgagtacctataacgtattaggcattgtgccagatgttcaatgtatctaactctttcttcttccatatgaaattccttcaaatattggaagtcctgtagtcctgaagttgttttagcgttcattactcagagggcgtaattctgtgtttttcactgttctggtctctctcttctacttgcattcaactgtcaaatggaaagaagatgaccattggagatatttaattaaaggaaaagcatttcttatttcattaattatgatatggcttcaggagaacatatagtgtacatcacttatgagaaactcaaaaactggtgttagcactttgtgaccaccattctattattttgtgttttaaaaatttgccgctactcaggaggctgaggcaggagaatggcatgaaccaaggaggcggagcttgcagtgagctgagattgcaccactgcactccagcccgggcaacagagtgagactctgtctccaaaaaaaaaaaaatgcctaatgttgatgaactttagagagtgataaattgttcagcatttttatttcaaggtgtatgactacgatgctgtgcccattaatttagctcaggatttctgaccttacattcttcattagagagacacatgtctaaatgtttccttttctaaaaatcagaacacttgtccagcagccaaatgttcttccatttctcagaagagtcgttattcaaaaaaccagtatttttggttgataggcaacttatttaaatagttaagcaagtttctaaacttctcagctattgagcattattttatttttaaattaatgctatgtagcctctaagaaggaaatatctatggaaatgagaattggagagcttgtattgaaaataaatcctcacctggattaagtttcatctgtatgtgctgtgaactattggggaatgaaatgttttacatatgaaaattctgttgggttgtaataacttcttggtgcctatttattcttatagaaatctgtcctgatgtgaaaatcacatggacagtaaacttttagatgaatattgtaagtttcttataactttttcagtcttctttttgttgcttgcctaattctagcatttccctgtatatagattttggtcagttttggggtggggaaagggcaacccaaattttagaattatgtgcaacagttataaaatatagtgtctggctgagggtcgatgggactcaattttctcaatgtgcatggattgtacttacaaaggaatcttggtgtctccattgtttgctcagttatatttctcagttgtttccttgtatatgtattggatataagaggtaggaggtaattagaaagctaatattttaatgaattggcctcttcttactttattgaaagataaaacataatttactttttaatttttaacatggggaaagttactgtgctgtcattagaactcacgcaggttactgtgaatttcagatgaaatacatgtaattatttttgtagctagtatataacttgagaggagttacagctttgtagttacatttgtgggctctagagtcagactgctgtggagtaagctcaggcaagttgtttaacttccttgcatttcattttcttcttctgttactggggcctgtaatagtaactacttcatagagtttttcaagggattaccaaaaaaaacaaaaaaaagacaaaaaaaacccacaaacacctaaaacatgtaaatagccatggtaatgccagctaccatattactttgaggaaacaacttattgacttcactcacttattttgcttgtgaatgaaattaaagcagataattctgacaaaatattctatgaatggtttgatggtttgtttagtttgtattaaagttgacatctgtaacttttcactataagctttttttttttggcaggagtgggggattgattatattagagtttgtaaagaaagcctttgttgcatttcgcagaggcatgggatttgtaatgtccattcatggtggaaagacatatccttatacatctgaccataatttgaaagaattttggcactattcacaatagcaaagacttggaaccaacccaaatgtccaacaatgatagactggattaagaaagtgtggcacatatacaccatggaatactatgcagccataaaaaatgatgagttcatgtcctttgtagggacatggatgaaattggaaaccattattctcagtaaactatcgcaagaacaaaaaaccaaacaccgcatattctcactcataggtgggaattgaacaatgagatcacatggacacaggaaggggaacatcacattctggggactgttgtggggtggggggaggggggagggatagcattgggagatatacctaatgctagatgacgagttagtgggtgcagcacaccagcatggcacatgtatatgtatgtaactaacctgcacaatgtgcacatgtaccctaaaacttaaagtataataataataaaaataaaaaaaattaaaaaaattaaaaaaaggattttggcaaagcaggtaacatgttgaatttcaatattaggaatctttaaaaatatgaataatattttaatggtttaaatatagaagtacctaatattaactatagttttagaaatttaaaattttattgtcaaagaattttctattcttttcagttgaattgaagaaatgcatttggcaattatttagcctattgggtaggtgatatcacttctgaggacagtctgaaagtaagcacaactcacctagtaaaattccatctgggtggcagtaatgccggtgagtctttggtctctgccctgatttcagttccacagttcgctggtataagcagccattttaatttcaaatctcacatatatatgtatagaatgttagaaacaatttggaattcacgatttgtgtgactttaaatcatttagctattctaaacctcagtttcctcatctgtaacaaagaaagaatctttctattatcacacctcatgaattttatggtagagatcatagctttataatctatacagaattatatgtttataagctattctgtggaatttgtattcttctgcagaatttatggcccatggacttattttttactataatagaagtttagaattacagtagaaagagaacagggatgggactaaaaagacctggatcgttcagttcagctttctgtggctccatttcttcatctatgtaacgagtggactggactcaatgatatctaaaaattcttcctagccctaaattttaactataatataatttcatgatatcattattattttacaggaattatttcctgtgtaaattcacaaaatggaggaaatagttttgctttcccttcagatgtcaagaatgaaactaggagataatgtgtgagatccttataagtatttgtaatattatatatacatataaaatataggcacacacatgcttatgtttggttacatgtttgaataaaatatcatgattatattattttgtgtattttataattgaaaaaatataactaaaaccaaaaacgtgtttatgtaccagaatacaatatttcagctacttttcatccagaatggaattttttttgttgcttgaattacttgtccaagtggccatggtttctattataggtactacaatgaatgtgcttatatgaagtacacattttcttcataagtatagtgtatatttgttaaatgagtgaaaaatatgacctgcagtaaaaagaagtaaaatagcttgtgttttttatacccaatgctaagtttgaatataaaacattgtgtataaataatttctattcaaggaaaggacctcaggattaagctccaaataaaaaggcactggatctggaaacactagcagtatttttgaaatgtccaagggctataaaacaaagtggatttgactagaactgttttcaatttgcacttgcctcctgggtatctgttaaaacctgcttatgaatagactctgactgatttgtgaagggggtttggcttttgtttcatagctgtgtgaatcattcatgtataagccacaccacttccctgttttgttatacattacactacaagttgtcctctgtaatttaaaaaaacagtcatttcatgatgaaacacaaactagtgtatgttgctttggttaggtctgcatgtgaaatagttctgaaatcgttactctgactacattattgagggtgcaggggactttttggtgaacttcattctgctcataacatttctacattgtctttgaaagtctccaactgatcccttagttttcctcactgatttttctttttgctcttcttccaagacctggcatttcacatattatttatttgtcttaatttgttcaggttgctataacaaagtaccataaactagatagcttatataaacaacataaatgaatttaatataattctggtggatgagaagtccaggatcaaggtgctgacagattcggtgtctgttgagggcttactttctggttcatagatggtgccttctcactgtgtcctcacatggtggaagggactagctagctctttgtggtctcttgtctaaaggcactaatccaatccataagggctataacctcatggcctactcatctctcagaagccaacagcctaatatcattacattgttgatgagatttcaacatatgaatttgggaggagggggtcacaaacagtgaataatccttcattctctctgctttttgctctgttcttctcaggtatgctaatgattgtaaccacagctctatgaatcaccagctccaagtctttgtggatatcaggaaaatatttacagctgtcttctggacactactacttgaataatccacatttacctttaagtaccctgtcttaaacctaagtcttcacttctgcagattcctgtggcagtgttccccagattcccgctgcagtgttccccagatgcccactgctccgttccccagattgctgctgcagtgttccccagattcctactgcagtgttccccagatgcccgctgcagtgttccccagatgcccgctgcagtgttttccagattcctgctgcagcgctacttttcttctccccacctgcctcgcaacactcttttcattctctctagagatattgcataagttttgctccccctcatcttgattttaatagtcattggttttttcagactgtgttaatattttccttatctaaatgagtagtctgctaagagctctccttaccactggttcatctctagtcaacctttggacatgcaaccagattagttgtaaccttactgcttaaacagtttgtatggtcacttagtgtttaaagtccttcataacctgacccaaattaatttttgatattcatttttcccctttcttggactcctcatttatcttaatttggaagaagctgctgctaagtctaccaaaatctactttattcttcttcctaggaacaaggcaaggctagggattctttacagttaagatatggcaatataattaacttgctgataatgaaatgagagaaagtgctgtgttacacctctggggttataagctgagacatcaggtatattttcccgcatttgcttcctactgactggaatccaaggcaaccatgtggccatggagaagatgacagtgggagcaatttaaatcccttagtaactaaatgggatggagctgtccccatcagtatttaatctttaccttggtatgattttatggaagcaaagtagaatctttttctttaagccactaagttttttgtagtctcatgcttctaattaatatttcttaatttttcatataaacattctgttttgttcctaggaattccatatcttggcagaatggtgataaccaaaaagcctcatgttagtcaatgaaaccttctccaagaatagcaaatatctttctgtagatatactgcttatcttatattctggcattagagataacctctactgccatcgtaggggaattaaaactataagctggtccctggattgctggaatatgtccgatgcctccaattctagcttccatatgttaggatataacttaagttgttttaacagaccaaaagagaaagtggcttaaacaagaaaggtgcttatttctctagtgaccgtcccaaacagtcctatacagggggatagagcaattgtattctacaagatgcttcttcagtcttgtagttctgctattcttggatatattgccattgttcacatggcaaacatgtgtcttcaatgctacattcccttttcagttagtaagaggggaggagaaggaggagggtccaactattcatattaaggttctatgacctgtaacttgcagatgtaacttctgtccagattccattgttcagaacttgatgtcctggtcagatctacctacagtggtggctgggaagtgtactcattgattattaataaagaaccatgagcccagttcaagcttggttggtttcataactaaaaggaaaaagagataatgagtttcgggggaaactagtggtacatatataccatggcatactatgcagccacaaaaaagcacagaataatgtcctgtagtggaaacataaatgcagctgaaagccattatcctaagccattactaatgcagaaacaaaaaaccaaatactgcatgttctcacttaccagtgggagctaaacattgagtactcatggacataaagatgagaacagcagacacggggaactactagaggaaacaatgtgaggtgagtgcaaggactgaaaaactatctattgggtactatgctcactgcctgggtgatggaatcaattgtaccctaaacctcagcatcatacaatatacccatttggtaagcctgcacatataccccctgaatctaaaataaaagttgaaaattttaaaaaatgaaataaagtgtgacgatcctttatgttgtatagataatgatgtagacactggattgcgtcttttacatttatttggttatttatttctcacctctatttggacaaaaagtcctccagagaaaattctatttcttagcctattttcagcctcagaagttaacatggtttctggaatatagtaggtatgcaatacatgcctctttaaagatctaagaatattctcttaaatatttctagtagaagagtgaattgtttaaccactttgtaaaaacaatctggcagtgtttacatagtctactgtatgaatcagtaatttcatttctagtcatatatcagacataaatgcatcagcatgtgtgcccagagtcatggatgaaaacgtccatggcaacattgtttatagcagctgaagaatgaggaatgaagcacaaatttctatcaatattataatggatagattgtggtgtattaatgcaatagaattctgtacagttatagaaatgaacaaactatagcttaatgaaataacttggataaatatgtcctccaccaaaaagagcagaaacattaaaaaactccacactacatgttcctacctgggttatgttccatcctatgttagaaattaggattgtggtttccttgggagatgaaggaaagggtagtaaccaggaaggataatgaagatgaggttctgatgtactgactgtgtttcatttattgatttattagttgcatgtatatattgtgataaataattgaattttgtgttttatacttcagcaaataatgttaataaattagtaactgcatgattgatatgctcagtgaaaaaggatctagaacaggtcagttataaattgttgccatggctttttggatgggtgtcctgggataaatactcaacctccctgagtctctcttcctacctcttctcacagaggagaaagaagatttgtctgtgatttccaaagtttattccagatctggcattctatgcagaaatcagaaagagatgaaatgactctgtttcatatctttttttgagactgccttacacagtagctcagggcaaattaaaagaaaagaaaatctaactttttgcatgttcatgcttaaaccaagtcaatgttctgagacaccgataacaggcagcctaaatgataaatctattatgaagtatttacattactattactttgaatatactgtagtttttccagttggcatagtgaaaaggtgcatcactcaccataatacgtagagcaaacatcatgttgtagttctcaatctttggggttttacatttcagtatcccttatctgaaatgctggggaccagaagtatttcagatttcagatttttttaggggaatgtttgcattatattacccagctgagcatccctaatccaaaaattcgaaatccaaaatgttccaatgagcatttcctttgaacatcatgtgggcactcaaaaaattcagattttggagcattttggatttcaaattttcagagaatggatactcaacctatagtgagaatttaccataaatagaaatcagcagcctcaataatttcagtccatgaaacatttaaaaccaagaccaatgtacaactcttggtcttgtacaatgttggtgttgtacaatgtacaacaaaaccaatgtacaactcttcaaaataaaaatgaaagtcctgtaatgatgacagtcagcacttaaatcattcccaagtaccagcttatacttttaaataaaatgcaaattgatattgttttactgataattaagggcaaagcttcaattattgggctttttaaaaaatccattttcagctagagttgtttgtacattttatggtgtagatatagccagagtaggatttagttggaatttttcagattacataattatttaatctacttttgtccaactttgctttgtctttatagaactaacagtagcattggtgatagaacatatgataatcttgcctttcttgattatactgcatatggagttattagtcctgactctgctcctgtaatctagaatataagttaaaggaaaatgttttggaaattcctgacaactagtgagatgaaaaatcacctttaaatatgaagtatgtattttgaattctacaaacattactgctatggtaccttgttttgtacaagttatatattagatacacaatttaatagtataacaaatcccctagaatagtagaggagagaggaatcttcccctgatatgtttttgtaatacttcttcctcctcttcagtcaatagggaaatgtttgttgaaagactactttgcagacatttagaaagatacagagtaagtgtaagatgtccctccttgtccttgaggagtctctagtcaggcacaggtaggactaaatgaaaaacaactacagaactaagtagaagagtgtacaataatatggggaatgtggaacaagttatacgattaatagaaattcagaaagaaggatgattattctggacagtcataatctcaggtgatttcaggaggaaaatgagctcttaaaaataactaactgtgttttgcctgcgatgaaggcggggcaggtgttcaggcagtgcaaatacatggagtcagtcagaagtcctattgatcttttctttgtagaggctctcatagatgttcttaccttctttctcagtaggtgaggttacctcttaactcaccgagaccatcaaagctttctggcctgagttccctcatctgaaacagttcaatattgtctcttcttctcatttacatagctctatagtttcctgtgttcttttctctctcctgctggtctttgaggaagcggtatcagtatttaattcttggtccctttttttaccctttctgacactgtccctgagtaacctttccagattcttccatttcttactctccactgaaaaatgtatgtggtactcttgaaagttaagaaataaaaataaagatttggcttatttatttcttcattttattatgatatttgctggattctgcttgatagttaacagtggaactgtaagtatatcccctactctaaactcactgagggcagcacatgtattttttatccttattttctctcattgtaccatgcacatagcagatgagtaatattggataaataagagactatacatttcttcatgcttcatcattttttttctttcatcctttcttccattcatttatctgtcctttgaatagtcaaaggattttaggtagtctatgaaaataatctaaaaagtaagagaacaataaaaacataaatactcattttaaatgttttttcatttatcttgaataaatttcatttgatctactaaccctactcacctctcttctatattacttcactctgcccaaccaatgcacatcttaaaaatgagcagtacccttgcagccttcattttatcatcacccactcaatcttgaaactctctagtttgacaatatctgaaaagctactctcctgaaattgcttcctccaaggtcactcaagaatatatacttaaaaattcaaaacacttttatcatttttcactctctgctttgtggcatacaacagtattctactcgtttcttaaatgcgttatcttccagcttaccctccctgagggttgctgtcatagctctctgcataagtttggctgctccatctccatcacaagtactggctgctcttttcccccggcttcctaagctttggtaagtgattaagacttaggcatttgtgacttgccttctctctcttctctttccttcagagattttatttaattccagtgagaccctcaatgtccataatgacagccagatttccattcacttctcctgcagcatccagtaggtcaatgaagaattactcttcaatgactctgttccatttacaaatcaacatgtgtggagtagagaagtttggccttttctgtctttcttttttttttttttttttttttttttttgagaaagagtcttgttcttttgcccaggctggagtgcagtggtgcaatcttggctcactgcaagctccgcctcccgggttcacgccattctcctgcctcagcctcctgagtagctgggactacaggtgtccgccaacctgcccggctaattttttctattttttagtagagacggggtttcaccgtgttagccaggatggtcccgatctcctgaccttgtgatctgcccgcctcggcctcccaaagtgctgggattacaggcgtgagccaccgcgcccagcctttctttcttgatagcattgttagccagtcatcgaggttttaacgtttggggacttttttttttttttaatttctccctttcattttcctttcattttgcatcaccagtgctttcattagattttcttttcctctgattattttctttctcctgtcttccctttgcaccactctggtgaaggtcttcattcctcaccagtctgctatgaacatttccaacagatctccctacatttattttacttacttccatcaggcctctatgaattaaaccccacgacatacctatctcctcaaaatactttactgtctgtctgttaccaacatcagcaattcttagccctgatcatcgcaattatctgtcagggccagctgcataatttgcagggcccagtgaagaatgaaaatatgggaccccttgttcaaaagcagaaaaaagtatcattaaaggaactagaaaatttaaactttcctgattttccatggcctttcactcaacttgtcatgatgttttatttcaaatttgtatttaatgttgcattaagaaaaatttaaattttaaattgttaacatatattttactgttcatctctatattttgcagtgaccattctaaatgcaaataagaccatttaacttatttgcataaacagtaatgttacacagtatatagtttgtagcttatatgtacatatatatttctctcttgtcagaacagtggaaatgtggcacaaaactatctcaactgatttaactttttgctttggtctcatttaccaacagtttaacttatcttacagatgaataaagaagactgaaaagcaaagaaactacgggttcctttgtctttctctttccttctctgttattttcagttggctaatacagaaaagtagcgtgagcaagaaaggatatgacaaggttctttggtcatttctatcacctagaatgccattgcttcctttctaccctcaaagcaattctggttcaagcagaaagcttggccttttgggggctgtcagcacccccatttacccagtcataggcgtagcccttaccttgtactcactttgagtcttgctgaactcccacttattttgagctccctggaattcagtgctcacgggtcattttgtactctacatgtgaatggagtaagaaggaatggcagcagacaaaattactgataaaattattaagaatttcatgacagctacaggagagtattaagccaaacatggggctttgggagatggcacagtctgaatgcccatgaagccactactgtttgtatggatcctttaaaaaatagtctccagcctcagcctctgttaatcacagtctccagggaggggtctagacatatgtatctgaaatcaacaacaactactgcaacaacttcacaagtgattttatgagctgatataaaagtctgtaatctcttaggctagcattagaagatctttataatcaattccttaactacttgcttaattttatcacattactgtctactttgagcccttgcctatgactccatagaattatttgatgtctctggttatattttgtgttttggtccaccctgtgatgctcatgccattatcctcaatctcagtgctcattctctccttactacttatgggaattatgctatcatttctcttaaacacatatcaaagcctaagtcctctctaaaaccttcccccactactccagcccacagtgaatcctccttttcctcagtttttataggacttaggttctagccatttattttatgcacattattctgtagtgtgccattacttattcttttatgtgcatgttctttcttcctcactagactcagggtttctttagtacttggtattctgttgaggcttaaaatggccatgctaggatctaagagttatgatagttcctagaaaatcttaaggaataaataactctaaaaaataagctggcttctatttcctaatttgattggaccacagtacttttcaggaaggaatttacattcaaaatgtatttttggccagtcaccgtgacagtgcttttaaaattatttaatttctgaaatttaaataaaattagtaaaattcatctgaaatgtgatgccttagctgtgctgttacaagtctctagaaaagttgtaaaatctattttctacattttttccctttccaaatgagtagtttgagtagttttcctaaaagacagaattttcaaacaaaattaagaaactgtcttcaatgaataaaaaggtaactttatcagactgacatctgtaaacttaatttggagccagaaagaacagatataattgaaatatatattatatatatatttctatatatatatttggaatatatagatatttcatatatatattgaaataaatatgttaaatatatatttattgaaaaatatattaaatacatatatttaaaaataaatatattaaataaataaatatatttatatatttacttaatctttcttgttttttggtgaaaacaagtggcaatgtagtgtgaccttatacaaagatatctttcttggggaggtgtgaaattatgaggtggtatccaagtgtttggcttagaatgtctgtcatgactgtcaaagccattaatttataaagtgaaattagaaagtaatgtgtttctcccaaacacaccaatgtgcatgcatgtgatattcttacaatacattaattaacatcatcacttttttttataaactatcagtatatctagataatttataaggccctcttccagcttcaaatgttattttataaatttttgaatgtgttaagtttaagagtgtatttgattaaggcttagtgctaatggaaatcttattaaatgttattagaaaaaagatttctttaaaaagataaatatgttccaatactatactaattttagaaaaataaatttaatctttttatatcagttatctaatgtcatttaatcatatagataaaaggtctttaagttctaacagagttaatacaggatcgtcatctaattcaaatattaaaatttaattttccaaccatggaaactgtgctacatttatattaataatcactggaagtattctggaggttcttttgtgcttttttcttaggcatttaaggagactggtgaatagccatacttgccatggctatttttttgttcactctttctttagggaaaaaaatagacaagaaaaagcataaaagaataaaaagaaatgcatccttgctgtggtgtttcatgacatttctgcacttgaacatctggaaagcctagtgtgacagtgacaaccgaattgacaaagttgctgactgcatccactattacaaaaaaatatgggcactaaaagcgccactttaattctgaaaagctcaatacagtgtctcttcattttggccttgaagatagaaagagaaaccacatttattttgaagatgcattctgagcattgtgcatcgcacacattggaaaacaacagctccaaagaaaggaacatgcattataggaaaagagaagagagcagctgtggaactcggtctaattgcggaccctagatgggtttgataatcaaatgactattctgcataaactagaagtaaaatggcaaaacattaattactcctattattgcttttatatattgagatgtgggacaaaatgcataatacattttaagaacagaatctaaaggaaaagaaaaatttctacatggaaatatctgcagtgtcaaagaaaagatgccacaggaagaaagcagccctaaaataaaatgccgacaggcataaaacaaaagttatatatctataatatgctataatttaacgaagatacaaaatgaagaggagtaataatataaagataatgtattaagtctttaaatgaagacaaaatgtacattgaaatattttggttaactggcaggaactaaacaagacttttgatgttagggctgattatgctgaagtgttgttatttgtgtgccactaaattttatgatttacctccacaaattgcatgagcaatttatggaactatcatccagtgaacaaaagacaggataacaaaatgaattaatattacagtacatggtgttcaatactattattctagtgggaatactctcggtctgaactgatccagcagtttttgtgaaatgtaaacctcttcaatacaaatgggcattcattactgaaatctggccataagtaaaaactgaaacctaattattccctgttaagttctagagaaaaaacaatcaggtctgtgactactgtactctgtcacacttcaaaaatagcggccagctccaaaaatctaggagcagcaaaccaccaccaccaccacaaaatgatttgctgttctgctattaggtttttggaaatgtgtgttattaaggatattttaacataataggtatatgagccttaagaagcccaagtctagtctctgcctcatacctcaggaatcacctcttctactctggaaagttaaaaccatgctttgagttagagtaaatttatcactaaattcaacttaactcattggatgtgtcttgatttctagaaaagattttgatttgttcaggacttctctgttcataagcagcacaattggaaatggactccaggtatctctatgccaagtacagtcatcttccatttactcttctaattaaatttgaatgctttcttttaaaacttgagattgagcccatgcattgacacttatttgctccagtttatataataaaaacattgagagtgtacgactgcgtgtgaaaagaagaacaacgttttctataaattgcttcatcattacttacggatcaataaatatgtgctgataaattacacattaaggactcaaccatttatgaaaaataatagtaaatatctgcatttctctgagccattgactacatagctagggacggcctgcagtggtaagctctgctaattcgtgacttgatgcccattttccctgccctcattcttaatagagcccaatttgtttggggtatcaatgtgagcagcacaagcaatgaactgttatctagctcagttaatcttgacagtacttttcctcaatttcacagccttctttgtagctgtagatgtccatgtgctcccttcaagctgctccaagagtttcttgaagagtgtttgttttcattatgaatggggtcagttgtagccagcagtgtcctttctcctcccttgctcctcttgggccttgaacatacacgaaaaggtcaagaatccctgaaatctcagtcctgatatgtttgagttgctgaaccgctgatagcagccacctacctccatccagtcttctttggtgagaaaaacaaaactctatttgttcaagctactgctagctgaattttctgtcacttgcagtctaatgcattgctaaataagatttcatggcttagaattgaataagctcattttaaacactaggggaagagattttaaaaagggaagggcagatgccatgaaaacatacttaaaaagttattttgacttcttagaagtttatttgaacacttcatgtttcactgtgattgtctttacaattcttcagtcaagtggccagagatagaacaatttgcaattgccgtgaaaccagaactcatttgcaagggttatatatatatatatatatatatatatatatatatatatatatatatatatatatacacacacacacacacgcatattatacataatatataatatatatttatatataatatattatatatatttatatattatattttttatatattatatatttatatatttttatatattatatatatttatatagtttttatatattatatatatttttatatattatatatattttatatattatatataattttttccctatggcagactcagagaatggcctgcatttattgactattgcaatcctacttgatactaaaaatatgggagaaagagtccatctatagaatcatggaaagttagactggtaactgtcttaacctagccagactctgttgaatatattaggaattaagcagtatatgtttgtgaaggaacagtggacattgctatgcagaactcatccatatggtgggttagttcttaagcaacagtcattaatcttgcctagaatattcaaagagcatggtaaagtccagccctatctctcaggaaataaaattttggtgactaagataaggcaaagggaggttttaagaatcaggcaatgattctgggatgtcaggagacattatagctgtagttgattttcagaacagattacgagtcagactttagaagtataagtaaaaggatctagaaaatggaagcaagagtttgcaaggatctagacacaatgttaagactccaaccaagaggcttggggttctgaataagtctctaattttaatgaagtcatagagtgccaatcaggaaactgaactggagcccaaaaataaagatagttgcagagagtgcaggggtggcacttagcacacaggggctcagtgttcaatatacataccaagtgttagtctgcgcaggtaaactaatgccttaccccgcacactcttcaagttgagatttgtaacaccagtggacccatttacatatcctcataacccatttactctgggcagcacattccacaaaacagagatactaactagcaatacttatggtagtttctgcttaagctgctgactttcattcattgtaaaatgtgactcatggatagatacatatgtatgaccaccaatacataaattataaatgaagaaaaaatcatatggccagtagtttactgggaataatgcactctgatattttctatcatattcaattttttactattacttactgaaaacaaaaaaaaagttgtgattgacaaaactgatttttgacccattaataagtagatcagaacctacagtttgaaaatgctgccttagttcctatgaagatgaattcttcgttcccaattgtgctattccatctccagtttttcaagtcatgattcttccagccacactttttttttccagttattgcaagtgtgtgttgtcccagcggtgctctccataatgacagaattcttctaccaatgctaaactccttgaagattgttacttaatttttattcaaccatttgcaagaagaaacctggagccttcttaacataggcatgctgaaacccagtgataggcagtttctttgtgttttctggtagcaggtctagcctctatttgtcagtcatttatgggcccagagtgcttaattagtggcagaaagggacataatagtgagagaagcatacattaaaaaattacttgacccaggataaggatgtggaacactgttggctgagagtgctaggaatctgctgctcgtgagacaaaattccagtttagttggccaggctaaccaccattggctagaatcatacaaaaacacttaaagcacaaaaaaatcacgtaagctgtgctctgaatgccctacacttacatgtattttatgtgtgtgtttggtttgtgtgtgtgtgtgtgtgtgtgcctgtgtgtgtatatatatatatgtgtatgtgtatgtgtgtatatgtatatatatagatacacacacacacacacagtcatgcatcatttaatgacagggattgagaaatgtgttgtgacatgattttgtcattgtgtgaacatcatagagagtacttacacaaacctagatggtacagcctactacacatctagggcatatgatatagcattttgctcccaggctacaagcctgtatagcatgttactatattgtaggcacttgtaacacaaagataagtatgtatgtatcctgtatccaaacatatctaaacacagaaaagctacaggtaaaaatgtgatataaaagatttaaaatggtacatctgtatagagcatttgccatgaatggagcttgtaggactggacgttgctttgagtgagtgagtgagtcacggtgagtgaatgcgaaggcctaggacattactgtacactaagattttataaacactgtacacttaggctgcactaaatttatttaaaaaatttttcattcttcaataataaattaaccttagcttgctgtaatatttttactttataaaatttttcatttttaaacttttgattcttttgtaataaagtttagcttaaaatacacattgtacagctctacgaattttttatttctttatgtccttaatttataagcgttttgctattttaaaatttttattttattttttactttttaaacttttttggttaaaaacgaagacacaaacccacacattagcctaggcctctccagggtcaaggccaccaatagcactgtcctccacctttatatcttacaccactggaaggtcttcaggggcaataacatgtagagctgataacaagtctgccctgataacatttcgttccgggattcttcctgaaggactgcttgatgctgttttatacttaatattttttttttattagtggaaggggtacactctaaaattacaataaattatattataataattaggtaaaccagtcatatagtcatttattatcataatcaagtgttatatatactgtacataattgtatttgttgtatttttgtcccatggcagcacagatttgtataccgcagtgttaccacaaacacatgagtaatgcctctcaccgctatgttatgatggtgttgatagaaatttttcagccccattataatcttacgagatcaccatcatatatataagtcgttgacttaaacatcattttatggtgcacgactatgtatataaatatataaagaaggtacttcaaacacaaatattataatcagcacagcagcatcaagcaaaacaattcatctgccctgctgttacatgcatagcttccaggaatagcatttccaagaatctgttgctctgcttcggggttcagaaagaagcctggataaaagatgtatgagaaattccccatgattggcttttgtatctatggcgtcaattcttccctttcctgtcatactttaggcatgcacccataaattgttgctgtgtgccacctcttttttttaccaatcccttccctgcagattctatccttggacttcagcttcagtttgacttgactttatactctgtggttctgcaatccacccccaaagcatcagaaatagctgtaaaatagctagtatgtagcactctaaagatgcagcattattaaatagctagttgacttttgctaacatcatcattttatgtgtctaaaattagatcactttattttttacgtattgctgatgagtcctaagaacagttgtcccaatggtttcatagtctaaaatttgttactgaggagcacatgagaaattattttttcatttatgaaatggaatgaaaattgagcatattggaacagaatgttcatttacattttaagtcagcagaataggaataatcaaatgaatgactaatactaatagaataatacgtaatactgatatttaataattaaataaaagagttaaagagttaaagagttttcctgcttatagttgtagacattgaagaatttgtttaagagcatgataaaattaaaataaaccctttttaaaaaattgtccctggagtaaagttctgcattacactaatgaggtactgttggagattttatattcttaagttacattcattgatttttacttttgacgcaagactaaattttaccctggagctcagtattattttctgccatgtgttaatttcttgcatgaatgccttatttaccttcatttagactatgctgcaggtggaatgcgagcagtacttattgctgatatttttgttggccaaagctgaaggacatctcagggtcttgaatagctctagggtttcatgactatgaaggcgatttcaaggtttgacttgtcatcgtggaagactggcttcttaaacataatcctatgagccatgatttaaattaacaaaccttatcaatagcttcacaacagttggcatctgttttaaaggactcactttttatttaagattgcattgtaaccacaactcagttcatcctgtaggagtgctcattgatacaataattgagtcaagtactcttactaaacgattattaggttttagctgctgtgttataagctatattttctctcttaaagcagtcagtttatagcatattattcaatcccatgtgcattacaaaacttatggccataaaatttacagtgtggtttgttttaattcaaatgcatttacgttgatagttttaataattacacgtttctatcaagagtagttggaaaggaatacagttgataaactattataatagttaacagccactgggcttataaaagaacctatggttatctctgagctataattggtaagtgtgtacaatacaaccagatttttctaaggtgcttatcacctattaaatatgcctattattctttcctcaaatacttgaatattgggacagatatatacagcttgttttcaccctaaatagtaagttactgtttcaaaacattttcttgtgacttgtgttattatctgactcctttaggaaaactgtcattgcaaagatatgataaaatcatctttaagaatcctagtattctcctggaggtgattctttgtccccttgtggaaaggggacagtgctttggcataggcaatcttggattcagctcctgactatgcttcttaaaagcagcctcagtcagtcttccagtttttaaaatagaaataagtacccatgtcaatgggttgttggaaagattttaggagataacatatgaagtatctgactcatagtcattgcactgtactgctagtctttttctatgaaaagtcaccttgagcttaatagttatcaccacttcattgaaaatagactttaatgtatactcaacctccttgggtattccattgttctaggtattcagctgaactactggaagagcaaatttggagatattttataagggtcagaacactttagtttaataataccattttaatttgccaaatggttagtgatattgtaataatgttaaaaaccaagcaaacacaagcactttgttcacagagttgtgttattggtcctcactgaatttaagtatttaccaatcatatatccttgagtgaaattttagataaatattatttgcaggcattaattgattccaaagggagtctttgatgttctctctatagtcctagggaataactctggtttctttaaaagattgctggacctaaaggaaggaaaaaagacatgtcagtcctttgttcttcttcaatacttataccttcccctggtttttcacttctggagtgcctttcttagtttctgatgcaagcagcaaaactagatagccttgtcatcagccttcattccagttctgccatcccaacctggtaggaattaggataaaaatcacttcttcaaatggcagatcctgtggcttagactatgaagattatgagattcccactttaacccctaatcagacttcagacctagtctcactttctcaaaggaaaccctaacccagctttccccttgactccccacctttgtcttttagtaccctatccccacctcatgtgtagccttctattttggtcccacattcctcaactagttcaggaagtttcatggaatcatgtgctcgtgtttggaaatccttactgacaagccctccttgggctaaatatcatccagataattgtagccttattccacatcctgtgtttactgatgcctaaaaaaagaaacataatctcttcttggtgacaaacactttgataaggaaaaatataaaacttgagaaaaaacttgagaaactttagaaatatatctcttgtttaattagagagtttactttgggatcaagaaaaaggatgcagcaatgacttggactttttttttattcagtagcaacttccaagcattatttcccattcttttgaaaactctttcactgaacttcttaggttaaggtcatagctctcgatatggatagcatttcaccttaccctgtgggggattgatatcttatctaagggataagagcagtattgaatgtgttttagaaaccatcacgttacccacccccaacacacatgcacacacagacatatgtagattttatgtatggaaacttgcagatataggaatattttatatatttgcacaaagttataaagtcagggaaaaatagaggtagttcataaattgaagctattattaatgctgaagatgataaggcactcacattgaactctaatattttcttccctacttattaataatggtgtttatgacagtattttaaacctagcacagggtgcatctttttcatcaatgtcttcaagttcctgtttctgggtttaccaaagcctctaactggtcaagattagtccagctacttccaatgttgaggctctggtgcattagaaaatgaagaaatgtctaatattcttatgaaggatgtggtatattaagaattttaatatgaacactgctttcaatttgtcatgtcagtgtgtctgtgactgtgtggtaaaattcagatagagacaacattaaaatttaaatctaagggcctttaagaaggtgagatccaggctgcattgccctctaaagttcctcaaaattaggcctggcaccttcttcctcaatgactgagtgactatgaacatgtactctgtggtcccagcaggtgtttcttaaatctggcagtaatgctgaagtcagcttggcagcttcaccaggaccactgtcacttggcatgtcctgctttaatgtgtgaagctgacttactcccttctcctttttgtgttttagcaagcagaacttcatgacttgtgttgccatgagttacccttggaagtgtaccatttctacataacaattggatttctgagaaattcgtcaattgtgtcaaattgcaactttcaatcagatataattcaagtgagattaaactatatttagaacgtttaaccctgattcctgttgggtaagacataaagaaatccactatggatgactgagccttcagcacaatttcacccttaaattattagactgtaatttatggtaacatctgtttctgacactgtatcatttccttaaacttaacgttttccttatgtcaatatcaagttcattccatttttattatggcattggagaataatgtataattagtaacagttatttgaaaatctgtaaccacctgtatagtcttatttgcataataaaaagggagggttatcagctgcacaacaatgctgctctagtctgctaggttaatgaggaattcagttggtgagcagagtgaagtatttatcttaaaattaaaaagagccttacatttaagtaaatgattttcagaatgaacgtcttcaatttaggtggcacacatcattaatttctctgaaattgttttgtacatttgtttcttaaatgttgactatataaaatgccattaaatatatttatttgaagtaatatgctctagtaggcatgatgaggtaaatgtgatttaactgaaatttatacttggatttttaaatctaattttacatggagcttcaaaattctcactgtgttaatgaaattatcaccatggaaattttacaacatgtttcccttaaggaatttgaagtcttttcaccattttcagatgatttgctttttaaaaaaatcagctgtcagattatgttggatgattatatcattgattgtattacacaaaagaaaactggaattgaggaggcaaccctgctgatttgctgctacctctacagaacaagatctgatattgtaatactgtgatagagtaaaacctataaattctgtaagcctaattgtttagatttctagggttgattttccttctttccccctgcctttttattttggaaattgtaaaagtttaagacagctgcaccactgccctgggcatccaaaagagagttctctgccacatgggggcctgtggtgacagtggagcatcaccccatgaacagacatcaggcagaggcatcaatcaaagccattgattggcagtccctccctactgggaaacgatcattcaaggacaaaccttggaggttctaattgttgttatacccaggaaggaagacctttcctgctggagtctttattgagctcttgtatgtctgacttctccaagcttggcttcctacattcaggaacaggatgggagtcgtactgtggcggtcacctttcttctgtgggaaccacagtgcctttagggattagtgatacaattgatgtgaaaaaagataaatggctgcataatgcagttattctagccctttgtcttcagatcaggtctgtgttctgggaagcttgttatcactaatagatatcaaagtttacacaatacttggactttttctagatctgactatgaactcatacagcttaacctgaacatatgtttccttgtttttccacaaaaagccaggctatgtgaaaagaagttaaggagagagaaaatgccatttcaaatattatatttgtgtaaaattaacttgtattctttcatctcaaagcctctatgttgtttctttttcttcccttcactcccctatactgtataccaccagaatatatcctgtgttgcagaaagctttgatccaaagtcctgttagggccttaaaagcatgtgtctgaactgcctactttttttaagccatagccagagaaccacagacatgggctttaaaggctttgtgttttaaagtttttttattgatacaaatatttgtacctatttatggggtacaggtgatattttgttgcatgcatagactgtgcagtgattaagtcatgatattttgggtacctatcatctcgagcatttatcatttctatatgctgggaacatttcaagtcctctgttacagcttttttgaaatatacaatagattgttgttaactatagtcaccctactctgctatcaaacattaaaacctattccttctgtctaactgtgtatgtgtacccattaaccaaattctctataattctcacaagctctcaccatctacacacccttttcagcctctggtatctcttattgtctacctccatgaaatcaactttttttagattccatatatgagtgagaacatatggtatttgtctttctatgcctggcttatttcacttaacataatattttccagttttgtccatatttctgcaaaggacaacatgatttcattcttttcttatggctgaatagtgtttcattatgtatatgtagcacattttctttatccatttgtctattgatggacacttaggttgcttttatatatttgctattgtgaacagtgctgcaataaacatgggagtgcaggtatccatttgataaactgatttcttttccattggataaaaatgaagtagtgggatagctgaatcatatggtagttctatttttagctttttgagaaatttccatactcttttccataattgctgtactaatttacatttccaccaatggaaattagtggatttctcagcatcctctccagcatctcttattttgctgtctttttaataaaataattttaactagagtaagatgatatctcattgtggttttgatttgcatttccctgatgattagtgatgttgaacattttttcatatacctgttggctgtcatctgagaaatctctatacaaatcgtttccccatcttaaatgggattttttttttttttttttttttttttttttttgctgttgagttccttgtgtattctggatattagtcttttgttggaagagtagtttacagatattttctcccattgagcagattttctctttctctgttgattgtttgctctgctgtgcagaagctttttagtttaatatagtcctctttgactatttttgcttctgttgcctgtgcttttcaggtcttagcgataaaatgtttgcctagtacaatgtcctgaagtgtttcccttatgttttattttagtagttgtattgttttaggtctcacatttaagtctttaattcatcttgagttggttttcggatatagcaagagaaaggagtccagtttgttcttctgcatgtggatatccaattttctcagcaccatttattgaagagggtatcctttccacaatgtatgttcttgatgcctttatcaaaaatcagttggctataaacacattgatttatttctgtattttccattctgttccattggtctatatgcctgtttttatacaaataccatcctgttttggttactatagctttgcaatatattttcaaaaagaataaagatgcaggcatcatactacctgacttgagtaaggtagtagtgggaggcctccagctttgttctttttgctcaggatttctttggctatgcagggtctttttggtttcatatgaatagtagtagtattttttctatgtctgtgaaaaacggcattggtaatttaatagagatttcattgaatctgtagattgctttgggcaggatggtcattttaacaattttaatccttctgatccgtgagcatagtatggctttccatttgttcctgtcctcttcagtaactttcatgagtatcttatagttttccttatagaggtctttcacccactttgttgaatttattcctacgtatttggttcattttgtaactattgtaaatgagattgccttcttgattttttctcagctagttcattattgatgtataaaaatgctactgatttttatatgtttattttgtatcctgcaactttactgacttatttatcggtttaagatttttttggtgaaatctttaggcttttccagatacaagtttatatcatctgcaaggaaggacaaattgacttattcttcttcaattttgatgctttttctttctttctcttgcttgattgctccagccagaactttcagtactgtattgaataagagtggtgaaagtgggcatgcttattttgttccagatgttagaggaaagactttcagcttttccacattcaatatgttagctgtgggttgtcatatgtagtcttcactaagttgaggtatgttctttcattgcctagtttgtagagagtttttatcatgaagggatattgaattttatcaaatttttttgcatctattgagatatttgtggttttgttcctcatcctgttgatgtgatgcatcatgttgattgattttcatatgtagaaccatccttgcatcactgggataaatcccacttgatcatggtgtattatcgttttaatgtgctgttggatgtggtttgcttgtattttgttgagaatttttgcatctatgttcagcagggatattgacctgtagttttaatttgtgtgtgtgtgcgtgtgtgtgtgcttttctcgttttgataccacagtaaaactggcctcttcaaatgacttagagagaatttcctcctttccaattttttaaaacagtttgagaattggtgctagttcttctttgaaagtttggtagaatttggcattgaagcaatctggtcttagacttttatttgtgggaagtttattttttattactgacagtctaattactcatttctcattattgatctactcaggttttctatttctttctgaaatataaattcctctgtcaaagaatttatccactttctctaggttttctagtttgtcactgtgtagttgtttataatagtctcgatgatcttttgtatttgtatggtatcagttgtaatggctcctttttcatttctgattttgtttgagtcttcttttttccttggttcgactagctccaagtttttcaattttgtttatcttttcaaaaaaccagcttttcatttgattgttcctttgtgttgttttttagtccaatttcatttagttctgctctgatttttattattcttttgcttctactaatttggggtttggattgttctggcttttgtagttccttgaagggtatattagattatttatttggaatctttctacttttctgatgtaagtgtttattgttataaattttccttttagcactgcacttgtatctcatagatttttgtgtgttatgctttggtttttatttatgtcaagaaattttttcatccagtggtcatttaggagcatgttgtttaacttccatctatttatacaatttccaatgttcctcttattgatttctagttttattttattgtgttctgagaagatacttgttatgattttgattttttaaacatttgttaagaattgttctgtggcttaacatgattgatcatggagaatgtcttatgtgctaatgagaaaaatgtgtgttctgtggctgttgggtgaaatgttctgtaaatgtctgttaggttcacttggtctgatgtacagtttaaattcaatatttctttgttaattttccatgtaaatgatctatctaatactaagagtgaagtgttgatttcttcaattattattgtattagagtttctctttccttttacgtctagtaatgtttgctttatatatctaggttctccagtgtgggtgcataatatttagaatcattatatcctcttgctgaattgatccctttatcactatataatgaccctctttttcgctttttaccatttttgacttaaagtctgttttatgtaatgtaagtatagttactcctctttgcttttgattttggttgttcagtatcttcttccatccgtttactttcattcagtctatattttttttaacaggtgagatgagttttctttttttgtaggcagcatactacagttgggtcacttttttagtctattcagccaatatgtatcttttaagtggaaaatataacctattaatatttcttaagtataacctattaatattcattaatattgtttttaatatgtaaggttttattcctatacttttattaattgttgatttatggttattttatgtttctttccttccttttctttctttctttttttccttcccatttttctatctgtacagtctggcggttttctatagtggtaacatttgaaattttttcttctttgtttgtgtgtttgctctacctttggtttctatcttcttctgtgttttcatgatggtacatatcattcttttgcttcttcatgtaggacttcgttaagcatttcttgtaggtacagtctagtggtgatgaataatcttacgttttgcttgtctgggatagactatatttctccctcatttatgatgtatacatttgcagggcttaatcccctttgttaaaaaatttttctttcagcactttgaatatatcatctcattctctcctggcctgtagaatttctgctgagaaatcccctgttagtctgattggggtttctttataaatgactggatgtgtttctttttctgttattaggaatctctctttttctttgacttttgacagtttgtctatagtatgccacagagaaagttgcattgtatatttttggggatctctgagattcttatatgtctaagtctcttgctggatttggaaagtttacaacgattttattaaataggttttctaaccctttcagtttttctttgcctttggtgaaacctcaaatttgaatatattgttgttttatggtgtcacacatgtcacataggctttgttcattctttttaaaacattctttttaatttgtatctgcctgggttatatcaacaaaagcctgtattcaagttctgaaattatttcttctgcttgatttagtctattgttgttgaagcttttgaatatatttttattctatttactgaatttttcagtttcataatttctatttggttgtttcttatgatatctctttgggaaatttttaattcatatcctgaattgttcctatttttttgtattgttctctgatatctcactgagcttttaaaatatttctatttgaaattttttccaggatttcatgtatttctgtttgattagaaaccgttgttggagagtcactgtattactttggaggtaacatatttccctgctttttcctgttgcttgtatccttacattgatatctccataggtgataacaattacttctttcaatattctgaatttacttttgtagaagatgacattttgctgaagttatgtctatggtattggttgggtagggcactttggctttgattctgggtgcatgcagtagtgtagtgttcttatcattcctttggttgttatctgcaccagtcctgtctgtgacttcctcagtggcttaaggtgtggttgttagtggaggttgtggtgaagttatgctgcagatgggacacaggtgggcctgtccttgggctccagaagtagcagcagggggacaagtctgcttctccttaggccccagggtggcgtatgttggcactggtattagtgaattcaggcaggctgatttttgggcctccaggtggctcgctcagatttcagtagttcagccgtgggccaggcagtttggtgggttttcaggcccctgggcagtaggcaagtgaaggcaatggcagtaataatggtagaaataacttctgggtcccaagtggtccatggtggtgttgttagtggctgtgatgggctgggtggaccagtcctcggacctatagatggtttgtgcatatgtgtgcccactgtggtagtagcagcgggttgggtgggcccaacttcaggcccctggttggagtactcaggagccactgttggtagactgggctgggtggcccctagaaccccagtcagcatgtttggacacctttgagttggagccaggcctagtagaccttttgtcaggtcccatggtggtgcttgcaggcactggttatggtaggcagggatggatgatccccaagcccaaggcagaatgctcaggtaggagcagcagcgactgcactacattcttgctactgaggagggcaggtttgctttcaatggcagcaggagtatacaggtggctagggagtgtgcactttgcttgtgctttggccccaactgttgtagcccactgcagcagcaactacaggtgtgggagtttgcacttaaagtgcttgaatatgcataacagctttgctgcctggggcaactgggcctggcaaaggtgtcctatgtggaagtggcccatgctccaatgactcacgctttaaccttggaggcagcagccagctgcagcagttactgtaggcaaggcatgccagagggttccagatatgtggagatgcaagggctgttttgtgtcctgggcaggatgtagtctggtgagggccaggctttttcaatacggtgccttgctgtagctatttaggactcggggtgtgtgtgggatacagcgtgagctccctctctggagcagtgccttcctatggtcttcaggcagatccctgtatttgttttggggccatcagggcctaggggctttcccatggctaggatatagaagtccacagtaggatggtggactataggggttcactcttgtcctttccccacattggggagctccccccaaatcccagacaatcatgactgaagaggctgcttcactttcctctccttccttgtgttaggtgttttgtgtcacctctgcgtaggattccagtgttttctcttagatgattgtatttgaagtatgattacctactcactattttggtttttctttgtggaagggatgaataccagctgctgctagccagccatcttggagacccaaaggatttttaaggcataaagagtaactttatctacctccacctattctcttactctgtccctcagaaccttgagatgctgagtgaagggtctccagatcctttctctggcttgtttattgttgggtatcacactgccttctccctttgctgaccttcagctcaggttttgagtcttttggtacctagggggtcacctttctgactagagaacagagaaaggagagtgtgttaagacttttccagtgaaggaagctgtcagcagagaagaaatcagtgatttaggggaagcctgatccaggacatgtaatttgcagggtgtactgagctgggggtaaagcacagaaggggaggaggggagaaggggatgggtaggtaaaaagagagaaatagggataaaggagagagataactagatagaggtgattaaatataccaatatttattcttccagaaactttaagcaaatattcatttattgcatgagacatcagtggtcataggatagaagagtatataactgattctcaaggagatacagaaaaaccaaaaaaaaaaaaaaaagaaaaagaaaaaagaaagaagaaaagccaaagacttagtttggccatgacactatagaaccaattgtaggaattattgagaactgtttatcattaatggctgatcatgatgccacagactaataattatgaaaattgtgaatgtacattatttgattgttacagcacacggttagtatatagtcactctaatctttaactttcatgttcaattgcttagaatttaaatatttaggtaactttgcatgagacactattcattccacaaattctttgttactaaaacaattaggtacagagtactgaagaaaattgcaaaaaatcaaatgtgcagttgtgtcaccccttaacatttactgtggggctacatttaaacattttttattttattttattttattttattttattttattttattttattttttgagacagggtcttgctcagtcacccaagctggagtgcagtgtgatacaatcatagctcaatgcaacctcgaactcctggtctcaagccattctcacacctcattctcctgagtatctgggactgcaagcgtatgccatcacacctgaataacttaaattttatttggagagaaggggggtcttcctatgttttccagactggtctcaaattcctgacctccagcagtcctcctgccttggcctcccaaaatgccgggattataggagtgagctaccatgccgagctacatttaaacattaatatttaaaagcagtatttcattcttaaactttatgtaattacgtgtaaaatgctggatgcattattttaaaaatgcatggatgcttaacttgggagaatctgagctaccatgccgaactacatttaaacatcaatatttaaaagcagtatttcattcttaaactttacgtaattacatgtaaaatgctggatgcattattttaaaaatacatggatgcttgacttgggagaatagaaggaaaaaaggaaggaaaaaaggaaaaccggtatctatttcttatttcatgagtgataacatctgttctgaaagatctgcattatggactgaattgtatccgtgaaaattcatatgttgaagccctaacttccaatgtgactgtatttggaaacagaaccttaaaaatgtaattaagattaaataaggtcataagggtgggaccctaacccaataggactggagtccttatgagagaaggaagaaacaccagcgcacactctctctacgtgtgcacacatagaggaatggctgtgtaaggagtagcaagtagtcccctctgcaagctgaggagggaggtctcaccagcaaccaaccctgctggcaccttgaccttggacttccaacctccacaactttggaaaaataaatttctgcatttaagccaccccatctgtggtattttgttatggcagcctgagctgatgaataaaacaggtgagtatgtggggatatcccctccattgttgtgtcttcattccagttctgagtcaggagattctcggaatttcctgggagtaacagttccatccaagttacaagttgcgttaggagaaagaaaaggctacacctcagaaatgatatagcatttgttgcaagagctcaagctagcctctctgtgaatcagtgcaaagagaataaaagtaaattcaattaaagacttctgtgatcctattgccaagtttctgtacaaaatcaattattattatttattaacttttaagttcaggagtacacgggcagatttgttataaaggtaagctcatgtcatgggggtttatggtacagactatttcatgcctcagacgttaagcctagtacccattagttatttctcccgatcttctccatcatcatcctccaccatctggtaggccccagtgtctgttgttcacctgtatgtgtccatgtgttctcatcataaaatcaatcattttttatgcgtataaattggggtcagattaggctatgaaagcacagcatagtatacaaaaatattttcagcctatagaaaaatattgttagttaaaacacctcactgatacttaacttaaaaataagtaaatcatcattatactgaatcaccacctcttctttatcttttcaaaaatggtcacactaaagtgacttccttagcagatgtctgggtctttatttttgtatcatcagcatctagcacagcactagttacattataggaattaaataaaatatattcgttgaatacatgaatgcaattaaatggtgtatgtctagatttttcaatatatagggtattttcaattattgttaacagatctagatcaaacaaattaattttgaaaaagtctttacttgtaagaaatgattatatatctaattattttcaaggttcttcaactcaaccgccagctcttattttcctaacacaatctttgttttcaatttagatgtttacaaatatattaatccagcactggcttgttacacaataggaatgatctactttctgctataatttattcctagaagaggtgtgtctttattatgccttattaaattaatgtattacccaaaaaatctttgtttcttaaagtaattaataagaggataaaaaagaggttaaaatacaatttgaaaaattaaatttcttttttacattaaaccttagtgtttttattacatgatacattttactgaaattccagtcaatcacaatatttaatgtgggcatgctgctcttatggttaggttggattgactatgttttatggaaagaaaatataaagataatattactaattacattatgatactggtagtaattttagggggagaaggcatatttgctgctagtgtgtcttctgttaatcatatctattgtccacccaagctctggccctgaaaaggcagaaagaagagcagttttagggtctctgccctccaatagctaggacaccgaccagtgtaggaaggtatctttaggcccttttgagttctcctgtacgtgtgactttggaaactgaaagagaatttttgaaggaaaaaaaaaaattgcaaatcatcagaaatcatcaggaaaagaaacaggtttaccaaatctgaaaccatatactgtcccatgcattagccttatccccatgaaggcacctgtgaggcaggatgccccagggacagcagtgtctgctccgtcacctctgtgcacatggagccatctgttacacctggccaccagtgccttcatggagtagttaatgtttgagtctccctgaattttggattcatgtgtcctcacatggtggacaggcaaaggggcaaacaaattccctcaagcctcttttaaaaggacgctaatctcattcttgaggggtctggcctcatggccttgtcacctcccaaaggccccaccttttaatacttgcacattggtaattaaatttcaacatatgaattttggaaggacacaaacactcagaccgtaatagcaagcacttaccactggctattacatatttcctcatctatgtatttgtcttgatgtaagattcttgaaaggcggggcctaggctgaatcgctacgtcaacctcagagcttacaacagtaatcagtgcaccaataaacatttgtttaacagatgagtgaaagaatgaatgcttattctttatagaccaggaagaaaagaaaatgttactgttacaaatgagaaaacaaattccaaatggctaatagtttccttggcaattataggccattggtagcttacattattgaggacttttctttgaaaccaatcccagggaagctttcatccctaagtgggtgatttattcaagttatcagtgtgagtatttggcggctaaggaccgggagaagatgacagaggaaagagagtttgtgagaggggtttatatatgtggtaggtctgtgggtctagaaaatgagtcaggttttgccaggtgtctacttggtagaagaattagaggatagcattctccctttggaaccatttaatccgttgaagttgcaaggtgctgagtctgctgtggtctaaagagtgaatctgcttctataaatgcctctttaatatcatggagccatgtggagctctttgccctgtagcacacagtggatcagaaagcactgggccagtggtccatggcttcctgcattgtggcggcctactctgccaggagtccttcaggcaactaggcaagaaagaagtgagaaacatagatttaacactggcaaccactgtactcgctttacaatgcttatttttggaaagtggttgttgtaaaaacaattctttatgtgtccttgaacatgatacttcttcagtttccattgtgattgccaaaggggtatattcatacccttttgaaatgaagaaatggattctctattgggtttggcttttgtgtttcttaaacctgttagcatcatgcatagagcagaaatatattaattgaactctatgaaaatacttcctaactcatagtctaactcaggtttcaaatgactacagtggctagggaagttagaattttttttccctagaagacatgtctcatgatcttttcctctctctctctcatatatatatatgagggctgtatatgggggtggggggtacaattgcatttgttactttttttcggggattatcagcctaggcaacagtgcaagttcttccggagtcagagcagaaggaaatatgtcttccatatatgtgtgtgtgtgtgtgtgtgtgtgtgtgtgtgtgtgtgtgtgtgtgtaacaccattcacacttgaaagttgtgggaatttaggaaatgagaacttttgcctatctaaagaggtaaacactggaagttccagctgatttgtcatgtgggtttgctgtgatgcaagtttgtataattgttaaaataaagctgaaaatattatgtaaaaattctatattgaatattggcatctagttctactttctaaaaaaaattgccagccaacactgtgcagcatactgttcaaattaaagacacgtgtaagctgtgattggctaatggccatcaggttgcggtctctggttaaatgctaacgggcatccatctccacatttccaccattgcatttgtgcccagtaagcccttgctgttgtcatcacttgctttgtggagggacctcttctcctctagattttctctatgttctctccaggatgtactcagtgtctacaccaccaagcaggctttgaagctctgagtttctatccagagagcttctttttccatgtgctgtcagctggatctctcaaggacacatagtggctctgcctcaggtgtagacctccttgagccattcttgaaggaaagtcttcacatggtttcaactctgcagccctcctaagatggccttttcaatagctcttcacctccccactcccatctcttcatgtgccatagccttgcccctctgcttgagccacaggcactaacgtgtatttattaggtggaagcaggcccccagccttgcaaggcaaatgtttgtatgtggtagagggtctatattaggtgtagaccctctttctgtatgaacatgtcttagactctcttcctatatgaatgagaacgtaatgatggacctctgatacacggtgtagagtaagggagtgggggctacaattgcacttgttactttttttcggggattagcatcctaggcaacaatgcaagttcttctggagtcagagcagacggaaatatgtcttccattctgattcatgtttcaaaaatgaaaaaaaatatatgaatagactcccttcttttccaaaagaatactgccctggtattaaaggcaactactgtgacagatgcaaagcaggagatgcctatgtgtgtctttccccttgttcaattctatagtctgcaattgtaactgttgctctcagtgactagaattgcaggttggcaaccataaatctggaagtgacattctagtaaagaagacaaagcagaaaaaaaaaagtgccataaatgcattgagttctctcctgtgtctcattttctacaacaacaaaaaataagccctaaaactgtacctaaagcctttcttgctgtatactacgattattcctgattcattaaatacttttgcagctgtaatcaaacttgtttaaagctcacgtgttcatgggctagaaaaacactttagaaaaaatgtgaacaatcaaagcacaattgccagcatattattattggtatttttcagcataatgcagtttccgttctagtccactccactttttgaacattttatgtctgtaggcatatgcaaatacaaatccctaatagagttcttattgtgtcagtgcttgagttatatttacttgccagaatattcataatactaggtgcctgtgaaaaccattgaatttttgtggctaaggttgtattggagagataatggcttgaaccgaaaatgaccactgctactttgcatttgtgaaatgacataatctattttctctttttgataatagtgtagggcacatttttaacacctgggaatgaagcttttccccctttctgtaacttcttacgttgttaatgttaatttgagcaccattactcacaaacttttggtgactacagatttgaatattaagactatataatcagagattaaattataacatagtggaaatatcagagataaatttatagcatagtgggaacatgacagtaggtctttattgaaattactgctttagagagaggaaacggtaattaaaaagagaaagctattttattgcttcatcaaatagtttagatgttcatcttgttattttgtcactttctatactggatgttaatttttttaagatgaaattattttatatgcaatcgaaccatcttaaaattaatcttaagaaaactggaaaataaacatttatttctccaaatgaaaacctataacagtattataccaaacaaaaactttgcatgtattttcaaatcctatttactctggaagaatcctaggtttttcatttgggcattttgaaacatacgttggtctaatggcatatttcatatggagtcccaccagtcatcagcaatctagaatcagtgtctgaagaagattctcaaatggaggcattagtgaagtttggaagggcacattggactatcatcatttcaaagatggacacgattctatttccttatctgcttgcagagctatttaagaatcaatgtcttatttttcctgagtcctttataaccctattcatattttcaattgctgatgcctctttgagctacgagttctactttgtgcataacgttgaggaatttctacgtttactgtttctccttacttcactcatctccttcattaatggctggcaagtcaccgaatttcacttttctttacacaggtgtaaggaaaattgcactttagtcatgagtaggctgaggcagccttccagtgcagcatgactcagcggatttgcagcacaggtgcacaaccccacacattatgtaaccacgccacgtgaggcacattaggtgatcatccacgtgagcttgtgcttggctcagagccattattgcctgttaaaagttatgattaccctgctaacgctgtacgtacagcttgcgcctaggcttactcctgcccagagcgagagtaaagccatgtcaaaactgtctgcagttcctcaagtgtttttccagccacctgccactcacccaccaactccccttggacctcagtaagaacctgacaataggtcagctcactgttattttattattggtggttaaagcttgtggtggtgggtggtcctgacttcattcaggaagacattgtacaagagttgtagaagaggagaaaaactaataatttggctaatgttgtggaaacctcgaaactcatacagtcaccttatgtaacactaacctcatcagggcctaggatttgcatagcagactgagcagattgctagacccattctttaggctgcctttttatgattcagcattgttttctaggcaatttttaatgtttttggagtgatgaaataaaagagggaaaggtgaactagagaacaaaagataaaactcttcccttcattgcctcacgagaaaaattaaagtgtcttttttaaatgagtgatgattccacctctggacacagctcaaacgccattggaatgcttcccctattacagggaagtgttgagagaaaaagcaattgtccagagagttgatgtagtgtagtagtgtggatcctgtttttgaattctggctataactgtgtgaccttaggcaagttgcctaacatctctcaattataaaatgaacataaaaattgcaccaatattatggtattgttatgaagattaaatacattaatacttacacaatagttagaagagaaattgcaacatagtaaacattaggtatatcaaacatacatgtgaacagaaagcgtaaaagaaagcagatattcaaggagacttccagcatgccaattttcgagttcaaatactatctttccaaaacaatccgtctgaagtccgagaacacactcaatattgttgattaaatgtttaaataatatttattatagctagcatgttcatttttagacaggttaaatttatgaggcagcaaagttataatattatgtgtggtcgctacaatttatggtgcattttggtccctgtataatcaacatgcactgttcatgtatgcccattttataggactaggagtataatgatgatattttaaattattatagaggccaaacattgttctatctttgcctttatagcatattgttgatcatatctcaaattcatttgaaaaatgaatccttgttcaggaacacaacatccaattacaaaattactcctaggggaaaatacaagctgttttatggtgtgatttccaggaatgcattgtggtgtgaagtagaaattacctacatcaattttgttttctttatttatttcaagactatctctccctacaagttttacctgctttgttccagtagtttataatttggtaaataagtcagcatttcatttttcttatacagctccctgttcatcccctgatttctgtgttgcctttgcctgaacctcctctagtttcattaaatttaattagtatcaattgccagtgtcagcacgttgaattgctttataaggctgtataaatggcctctgatggcttcagtgtaaatcctagtcatctggatcaggtatataaaaacttcccttaaaagtggtctctgctatgcaaactaagttccttctcatctctatatcatctcatttctatatcatattatttcctcattttcctacagaaaggacttggggatatagaaagggcgtatgtaagagttctaaaaattattaaaggtttgagaaataatttttaagagaaaatgtcaaacggttttggagtgttgcccagccactttcctgtactcacattcacccagcatctatctagtcttcctaaccccatctggaagctcagctccactcctgttcctggaggaaggccagcctatgttcaaaactaaattagccttgcatccatttcttacctcatgattcgagctaagcatgtttcctggttccatcatctgggctctcattttattccttttgctcatgttctcaccttgtacctatcaccagttccctttttgccctctttaagtcctattttgccctatttaagcccttgcttaaattgattgcccaggtaaacatttttcctggattttattatttattttatgagatccctgttttctgccatcgatcttccttttacccagaatgtctgtgtctttagcttccatttcattcagtgttcagaatgtcttcatagcatgagtgccctttttttgagacatccatccaccccctggcactgaaactttctgatgggagatcctacccatgcccatccttgttagctctgtagttacggaacctagaagagtccacagataaccagaggtgccagaaatcaacgctggactctggtaactcaaatttacttattaaaaaatagagacaatttgtttgccagtaatatatgccttttaatttttggtgaaatgcaagattagaaatgttcttagagcatttagagatcaagtttgattaagggattagaatgggaaatttaggcttaggagtcatcacacttatcctatcatgttaatccccctctctccatggtcaaaaactgctgttgcctcccattgttgtcaacattacactcacagtccttattagagtggttaagaccctgtgatctgtattcattcctttaaacccacatatgcttgattctcctactcatatcctgcgatctaaccaaactagactactgctttatttccaaaaccccacacaatagccatcttggaccttttgtttattctgttgcctgtaggtggaattatccccttatccctatcagaatactatctagctttcaaggcagatttcaaatgccactttatccacgattaatttcctcttttctccaatcagatgggatcccttcctcctttgaattcacaacttaatttgttttggcatctcttattgaatctattcttaaattctgtcttgtattactggtatacaataaaacccagtctaattaattagagggactcaaaacatttttaaatgcttaaaatgttagcacacattattgggaggctgataaaataagcgtaggcaagtctgtgtagctagctggcctgtcgttcccaaggaaaggctggctgctaagatcaacccttctaaatcttggctatagtttggtgacacccactggacagggtccataaaaacttacatttcagtgggcatgattccgcctgctgtttttggctggaactgccaggacgatggtagcaatttcaggaatcttctctttggtgattcctcttttgtcagctggatccagggaatactggctgagagaagtttaggaatgcagggatactcttctgcttttccattttctaaaactcagttgcttgccatcttctgtcaaccttgccttccctcctgcatttactcaatcatcctcagaagatacgagctttaattctaatcatgtccttcccccagtattttgaggaaggagtctaggcagcacataagagccaattgccaattatttcatgccctaatttgctttactgccaaggcacctttttataggatttttgctatatatatgtattaaaggctttagcagggcaggggactatctttgtaatccatcacaatgcgtagatacactttgtgctcagtagttttagaaattagattgaagctgagactaaactttccaaggaaaagagcttacaaatggattttgttaagaagtggtaggaaaaaacagtgatgtcaaagaagcaagatgccacagttcatttgctggtgtagcaaaaacaccagacaaagttgagcaagtcatataactctgagctcaagattatcatctttaaaatgctgatattatgtctactgtatactactactgctgcaggctatttttcactcaacaaatactgttcacgtgtcagatgccaagtgctgggtgttaggaatacatcactgaaaatcacagacatggttccagctctcatgacatttccaatctaaagtagtgttgctattttatgctttaactatgaaactattaaggacatagttaacataaacattataaaaatctcccgagtcctaaagattaaaacaacctcctggggtttcagaaatgattaatttagagatatctatacttacagtccccttcattagatcccaaagataactagacacaggactgctctttaagtgtaaccggaataggcaacacttttgctatgtttctagaagcactgggcactttccttgtaatttcctcaaatacctgccttatcttcttggtctgttagctcaggctttatcagaaatacatttgtgggagtgggtgtgcacatgtgtatgttttaagccattgagactccgagagttttctttgaaattgcaaatactcttcaggggataaaacacattcagttatcatcagttgtcagtataattggtttttctgattcttttcttcatggcatctagccgagttcactgggaagccagctaataatgtgctgagtactgggccaagcaccatttctgtagttagacttacaacttgccccccttttgactctgctactctctattgtttgttatcttatcctaccaataattgcagcttttcatgtcctcatcatatttcccatacactgggccagaactggtgctagaagaatcttccctgtggttttccacccccaactgaaggttggtgtagagcacagaagtccaacaaagccaatgtaacatcacccaatgtgaactgacacattatgtgaaaaaaaagggggggagtgtgtgtatatatacacatactcacaactacatagatatagtatacatttgaagaaagtattggttcttacactttctccttttaagtatagagtgagggttcttttctccttctttgttcctccacttcgattatgtacaaactcccttaaggtattaaaggtgccctgaggagccagtgtgctcgctctctgtggtatctcaacacttaactaatcgtgcctataaagtgacgctctaagggctcacttaagaagaggagaagagggttcaggtgcctctcaggatgtaaaatgatgagttctggatgcatatttctaacagatggacacggcattaagaaagcagccacagaaggcagcaggtggagcaggcagctggaaagcgcagccacttgcaggagcacttgacattaattacacctgttggaattctcgcccaactttttgctttcaaatgtgttctcagtataatcactgtgaggcagggggaaaagaaaagcagctgagggctggaaacaggaaatggagcacttgcactgagagcaaagagaaagaggtgggccagggggacggcttttctggctcatgcccttcaattaatcacatgtccaaaataggagccacgggtgctattacttatagtggtccagatgattccatcttggggctgaagaggacaatttaaaaacaattaaacaaatgttcaaagcagtaaaagcaggagtatgcattcagtcctttagaaattaaacatgttgctctgtatctgaagagattaaatatatacatttaatgttttgtatcatctgagctcatttcaaaactttcttgggccatgtagtgattttccaaatctctgagattcttcatttatttctgcctgtacaatgggatcctagctttctctaagctgtgtcctagttatcagcacaacttgcatcttctgctactctatggctcacagtgtggctcctttcatgataaacttatatcattgcctgaagctgtgtggatgttctagtctgcttccgctattctttctctctggaatgcccctgttagccttacaaatttctgctcaccattaattgtgaactcaagggttaaatgtgtaataaagccttcagtgattgtcccaggcagacctgagccttcaccctcctcagagtcacaggacctttcccattcattttcaaagtgtggagcaccttgctgtgctgggctggcctggaccccctcctctgggccatgagctctgtgaggagagctccatttctactcttctgtagtttcctccttccccccagctcatagtcccccactttatagttctgactaaatgtgatttgaatataagttgcctttacctggaggtataggtcccaccactgaaaaataattttaacccaatctcagtatctcctgagaaaaaataagatgcggctttcaaaactatcaattgtcttcaggtttttgctcactttccagtgagacttaccctgactaccactgtattacaaaatggcaagcgccttaggtattaatgtgtgatgggatttttgctcattatggtatgaaatgatgtgaggtaaaacatatatttttataaggaataaggatggagttaaaaaggtctgttgaagtgaagtaaagaggaaatggaaataaacatgattgtgaagagatggctgcggtttaacaatgcatccagctgaagaataaatctacctctgctaataatagaggttgatttttctcaccaagatgactggcacacatttatgtagacctaaatgaagggaccgttgcactagctcagtaatgccggagccagaatctgtgtagtaagacttttttgtttttctctcatggtttcaagatgcctgccagagcttcaaatagcatgcctattttcaaaaggaatggagaagagagttgcacagagacctttaacacatttatcaggaaagcaaaagcttcaacagaatccactctggatacagttgccagtgtctagatgggcaatgccttgatgtcacttagcttcccctaggacagagtaaagaaaggaaggattttactttcccagcctctgtcctggagctgggagagaggaaaagggatttggaatgatctctgggttacccaaccagcagtgtctgccgcaaaaataactagtagataaaatgaattggccaaaataagtaaattgaaagaagacattcacttatagtggatatataagtaaaatgaataattcaatcaaaggataaaataatatgtcttaggacaaatgcataaactagatgtatgtatcaaatacataattttaaaaacaagatatgagagcagaattgtacaatattatactactcatgtcattaaaacacacaaaatactgattattaaatggatatatatatatatatgtataaatgtttaaaaacataaactggaagatacacatcaaattcagcctagtagttgccttctttgtggaagaagagggtaatagggaagaggaacaaaaggaacttcattttattttgcaaagtttcactcctgtcacaaaatcaaatggtaaggctggtatgtatatgagagtttggtgagaaaaacaactagaagaaatagtaagagtttaaatttagttctatcactgaaaataaatttaaaggagcataaaatgaaaacacagatgggattctaattgccacgaaagcctaagaaatagagacataatttaccacgggaaatagtactgaatgaggaagaagccccagaatcagcctttgactttggttctgaacttactcactttgaactttagctttctgacttgaaagatgaggatttttgtttttattttttcattgttctttagaaatatttatcgtttggctgggtgtggtggctcatgtctgtaatcctagcactttgggaggccaaggagggcagattgcctgagctcaggagtttgagaccagcctgggtaacacggtgaaaccccatttctactaaaaaaatacaaaaaattagccaggcatggtggtgcgtgcctgtaatcgcagctacttaggaggctgaggcaggagaattgcttgaacccaggaggcggaggttgctgtgagctgagatcgcgccactgcactccagcctggtcgacgaagtgaatctctgtctcaagaaaaaaaagaaaaaaagaaatatttattttttaagaatattaactattttgtaataaggcatgctttaaaacaatctttgcaatttaagtcataaactgtggtggtcctgtaaaacatcaaaattgttcatttatttgatttatatttattgaaagcttactatatgctggaagcctaggaaatagggcataaatcaatcaaaagttctagtgctaatgaaaatgatagtctgactggggccagagatagtaagtacatacttagtatataaggaagcccatgaagcaaaatgtagcaggatcagagagtactcagggccaggtgacagtggaactaatgctctagtagctagattaggtttctcttacaaggcactatttagcctagaaagaatgtaaaagtcaaatatctttcacaagtaacatttgctatgagtaatttaaattatatattatataaaatatattaatatagtaattataactgccttgtattttaatacggatttgtatgtgcttcaaggggttttgttctttctttttgcacacatactgctttttatcatagcactcccatccagacaagaagtatacattctctgctttgtagtcaatctctttgtgtcagtttggatggaaacctgactttgtgtcagtttggatggtttgattcctacacatctaatatcttgagcggatattcctggatgaataatggtaaagttatctcccttaggaaagcttgttgtccccatcatgtctgtgttacacagccattggatatacaacattggctggagtggggaaggtttgggggattttcttatcagctgtcttctgctcttagttagtgaaatctaacaagcacccagaccgataacatgtgagtttccatttgaaagtttggctcttgtttataaatattaatacggttgaaagttaatatattttgaaaaatgctttaagatgttttaaaaaaggcttttaaagtttcatattctgcaagagtctggacaagtaaaatacaattggcctttgaacaacatgggtttgaaccacacaagcttacttatgctcagatttcttctgcctctgccacccctgaaacagtaagaccaagctttccccttccccaaccattcaacatgaagatgacaaggatgaagagaggattccatttccacttaatgaatagtaaatatattttctctttcttatgcttctcttaacattgttttctctagcttactttatggtgagaatacagtacataatacatagaatacacaaaatatgtgttcatcaatggtttatgttatcagtatgacttcctgtcaacagtaggttattagtagttaagtttttggaaagccaaaagttactgtgtgaggggttggcacccataacctccatattgttcaagggtcaaccatacattatttagatttgatcaaactggatttttagtatgtttttgattttaggtcatcacagaactcaagggatttctgagacaaatagcctaatggaagattaaacgcaaactgaaaaagatcttaatttactgagaaaactggagataggaactaaggtttaaaatctgagtagctgagaagctgccacttattccagtgtctgaaacatggatatattgaaagattgaaagaaaatcttataattgaacagtgagcgtctttggatattgtgtaaaaagctctataaaagataagagcctgatgttagcttggagaaagtcccccttgccttattaatgttggtaaaactttgttactactcaaaaaatagccatcaactttaaaaccaacaaacattttcataagccactaatattgaccatgccatttagttctaccttatttattctttgacttccaggaatagattccctttcctcctctggagatcatgggattggaaattttggccaatggtagataaatacaaagttgttgtgaggtctgcatgtgtgctggaatatacatactgtggttagaaaagtgcctgatacatagtaaaaacaccatatccataaaattaatataatcaaataaaccagaaagttaatactatcaaaattaaagagtagtatattttgtaacttttatatttgctgccagattttctttgttccagttgccaaaacaaatattggctgatgaaaaacctaacttaaacattgacccaggaaaatttgggtttcatctctaagcaatcttctctgtgctgtagtgccaggcagagggctgttctctccctaatatatcattcctgctggaaaccaggaaagtctaatgtcaccattagaatttatttttttctgtcttggcttgcagattaaactatacatgtctctgaaagctaacagcttattattaacagttagagcagaggttaaagaaaacattcctaaaagaatgagaactagggtaggatttggagctatgaagtgaatttagtgagggaaagaaatggggaaagataacaggagaggaaagtgaagctcaaaggcgaggtggaaaggcatagaaccttttatagcttacatcttacttgtgtctggagcaggccctggcctgtctatatagaggagaaaaaaggttacctgttaaccaatggatgatttcagttgaagattcctagacttcacattcaagggtaaaaagcagaatgtatcaccataccaggactcgtagtttcctgctattcaaaactccaaattcatagtcctcattcctggaatactatttaggttggtgcaaaagtaactgtagttttgacattgaaagtaatggcaaaaactgcaattacttttgcaccaacctaaatcgtgtagttgtttcaccatgtatatgaatccagttattctgttagatttggggccaaaaaagatttgaagaattgctaaaggatagaacttttctgatatagctcaatgttgtgataaatacatgctctgaaaaatgaaggaaagctatttagaatagagaatttgttccaacgtaaaacaaatttaatggaaggagaattatcctaataatcgattatgaaagaaaaatactcctctggaattttgtatataatggctcaaagacacgaaacttttatattttaagaagaaagaaaagtgaaaataaaagtgctttcatataaatgatgaaaatgaatctgtaatacctgttcattcatctacagagaatgttattagatcagaatgagaacatcctaataaagaaaggaaattgaataggtaggttatgaagcattacaggatgcacaagaaacagtttgtaccctcgatagccacctgaggtgtgtgccattatactttccaaaattagtgaaattctaattcttttagaaaggatattttccattaaagattagaaaaatcaagaaataagttctttttgatgaaactttgaagttaggatagcagcaggctttatttcagttcctgccgtgtttctttttcctttagaattaaactatgtatgttccaggagaaatgattgtatcagttaaaataaaaattaccacggttcttctaagcatcctcttttagtgtatttgatagagaccatgaagttttcaagggagactgtagtctctgcacataggagtatcagattctgtgaataacaagagacaaaaacccaatgtcaaaatgtgagcctgctgtattggcacattggtttgagtgttctgcttgtgcgggcaaaaggttgaccattgaattgaagaatgtgcttttcagagtaataagttcttaccatagaaaggtcagctaacacagagggaagattatgcaactgagatcgagcgtgtcaacggggaccctcaaaagggaattgatattatggcagacattatcttctgttttctaagttctaacggaacattttaatggaactcagagaagactaaatttgttgtctgcacaactcttattaacattttgtcttgctccacagagagtgcgtcctgcagtaggtgagacatgataaagtatttccaacgcttacaataatgaaatgttagcatgcttgacctctgcagctatccatcattaaagaattaattttctggacctgaatccatttatttcctcattttagcgtatgtttggttattaaggggaagggagagtaaaactttatagatagaaggagaaaataaagttattaacctgtcttgccaacaacccattttatgtaataggggaaatgttgaactactcattagctattctttctctaaggttaaacaggtaaaataaaataacccactactaagagataacaaatgttgaataaactgggtttgaaagaaatattataattcgtttttaaagggaagaaaaatgctcaggaaattctcaatttttattttcctttttccacttgaatgtgaaaaaaattatagaattatctattttcaggtggataagaaactgcataattgaattatacaaaaactgaaggattttcatgcacaaggagaggattctgaagcactataacttaattacagatttaaaatcatttaaagaaattctttttagaaaagttacttgtctataaactatgtattggggttctccagagaaacagaactatcttaatccacttggactgctgtaacaaaatatcataaactgggtggcttataaacaacaaaaatgtattccttacatttctggagtctgggaagtccaagatcaaggcaatcgtagattgagtgtctggtgagggccaacttcctcataagtggcaccttcttgctgtgtcttcacatagcaaaagaagagagtctcttagccctttataaaggcaccaatcccattcatgagggctccacactcatgacataataacctcccaaaggccctacctcctttcaccgtaatatcaataatcaggtttcagcatgcatattttggtggggacatgatatggttaggctgtatccccacccaaatctcatcttgaattgtagctcacacaattcctacatgtcgcgggagggaccccgtgggaggtaattgaatcatgtggggatcatgggggcgggtcttttccatgctgttctgatgatggtgaataagtctcacaagatctgatggttttataagagggagttcccctgcacatgctttcttgtctgccaccatgtcccacgtgccttttgccttctaccatgattgtgaggcctccccagccacgtggaactgtgagttcattaaacctctttttctttataaattacccagtcttgggtatgtctttatcagcagcatgaaaatggattaatacaagacacaaacgtccagacaatagcaagaacatatatatatatatatgtttccatatatatgtttccatatatatgtttccatatatatgtttccatatatatatatgttcccatatatatatatgttcccatatatatatatatatatattcccatatatatatatatatatatatatatatatatatatatatatatggaaagagagagagaaagaagtatagtactggctcatgtgattgtggggactaaaaaattcaaaatcctcagcatgggctggcaggctggaaaccccagagaaccaatggtgcagtttgctagagaattccctcttgatttggaaggccagcatttttgttcaactgaaaggatgaggcccatccacataatggaggacagtctgctttatccagagttcactgatttaaatgataatctctttcaaacacaccctgcaagttaacatataaaattaactatcatgcatcatatatttacaaatggccaagaattaggatttactacctttatatgcaactgaattggaagcaaaatgttctacaaaaagaactagttaaaaataaagtgtatacagtgtacaaaattgtgaactttttactctttcatcatttcagtgtcattaccagtatatttccttctctgaagatttagaagaataggtaagaaagtggcacggataatagtaatgttcactgtccttaatgcacctgataattttatccaggtctaattttatccagttttgaacaatcaaaaaagaaatgtgggatattaatagtccgcttattgcctgggctggagtgcaatggcacaatcatggccttttgggctcaggtgatcctcccaactaagcctctggaatagctgggaccacaggcatgtgtgaccacacccagataattttcttttaattttttgtagagacagcgtctcactatgctacccaggctggtcttgaactccttaacattaacagtaatattgactttaaatcagtatactaagctctctgttagtgatttaaaaatttaaaaggtggtgtgtgcctgtatgcctagctacttgggaagctgaggcaagaggatcacttgaacacaggaatttgaggcttcagtgagctgtgatcatgctgctgcactccagcctgagcaacagagtgaaaccttgactttaaaaacaagcaaacaaaaagctacttagttcaggcttatgaggaaggtttgattaaaatgtaaagcttacattttaatcaaatggttatcaaatgattctctttgttgagaggagggctgtaactcagtagtagagttgtgagatatatctcatttaggaacaaatatgctaataggtgagaataatttccttattaattacttgtgtcttatccggagccctttctctggcagttaatttactgaatgccagagatccttgcttctgtagtcctgaacatgtttgcacttcagacattcttgggcagtcagaacaggactaataatggcttatgcagatatttttcataaatttagactgtacatcctttgcatagaataaaaattgcatcacttgtatttctctgtcttgattcatttgttctccttttatcttaactttcatggatgaaagcacgtattcatacaaaccctcaaattttacagatggacaacatgttgtagggagatttttaaagagtgtagctcatgtcttattgaggaggaagatacaaagctagatgagcatgaagaacaaatacaaaaatgtgtgcatcaagaattttgaatagtaaaattctgcttttaacttaatacttatcatgtttatgcacctttaagaaacactcctttccattactaaattttcactttattttaaaagcttaattttttggaattaaggcattttgtttgcattaaatgcttactgaataaaatcatagatttatttgtccagttgcagttggactctgttagttttctcatgttacattcagataaaaaaagtgagacgtctcagaggaatgctggactacaaagaatttgtctttcaaaggtaattaaagtataatttaaacttattgctgctgtgtgtaccactttcccttttgaattatgagtctataaagacatggaagtttgcaactttaaatcactctgcagttgtcaattaaatgtcatactttggggcagaatataaatggagtatagcctgttaacaattattaatatagtatcagtgcaaattcatacatcaaaagagtcagtgataatcctaaccacctgtgctgatacatagtgtgaaatgtacaactactctttctcgtagtctcctagtctcccagaaaaatgaatgcgttgttgaacagcttaattaaaaacaaaagaataaagtaacacaacacagagggttttaaaatttggttttaatttctgaatttcacaattgtgtgtgtgtgtgtatgggtgagtaaacacacacacacatattagacactcacatatatcttgttaaggcttattttcaactggttgacttgcttctaccatgcaaagtatattgtcaataaattcaagaattcaatatttatcaggcgaattagcttcatggttaaatagttatggactgactaccttcttaatcaaaggtgatgcttttcttttttaagtttatcacaaagcagatttatgcaactgattaggacattaccctgtagtttcggagatcattgcatttaagaaagggtttgaatgtgatctgaactgcaacccttcctaaagagatagccttagataaaacaaatataactatcatttcctagcataaattctgagcaattatgtttgtgactattgcctaatattatcaaataagaagttcatttacattcttcatctttttttgttttccaagacaaatcagaaatcaatctgatttgatctgggcaatgtgtaactcttaaaatagcttatataatttttaaagaaatattttaatgtcaatttaaaaccttggaattagaaaacaataattttaaattttgttttgtaggtcctagtaaggcagtaacattcgttattacatgattgtgctccttctcatagggcagtgggtgtgcacagcatgggtataaggatgtgcacaaacattgtgtatttctggcctatttatcttccctatttcaggactggttctaagagttcttggacatcaccagtatgctgagcaatttggacaatttcagttccattaggcattaaatgaagtcagggcccaaattccctgttaatgcaacagtttatgccatccagcatcccagagaagtatctctgtagccatttatttggttttcgatttaagaagacccgcacctgactggaacccaatacaactatcattaaaaaataaaatcccattgcccaggattgttttgttcttcatgtgtacttcatatcaagttattgtcctaattgcctcatgccttttagaaagttcagttaattcaaagagatgaattaaggaatgaagtttaagttctctgtgtctccttaaaacatttctgagctcaactctcatttgaataggtaatgaggacaagacaataaaatctgagtagagtctctagctcttgtttgtgtctaccttgtttttttctctctctctctccagttaaatgccatccaattatctcctgcaaatatctacagaattgttcgttagtcaacattatgatacaggttgattatgatattagatgattatgatattagacagtgattggtttaattagtttgtgaacatttgcatatatagagagctcttaataaattgggaatatatttgaatttgatcttcatatagacattttctaaccttggggatgcctttataattgctgttgttttctttgtgtttcattatagaagccagaattcttcttgctaataatgacatgtagataaataccttattagtgtagtaacacttccaagaggaaagcacattttctaagcatctcctgaaataaatgtcttttttgaagactggaggctctgaagctgctaatgagatatggaagggacattctgtaaaagtgacaagttattttaatcaaaaaggtcatgcatgtcagatagtattattgttttctgaagtggcttgactcagcccaagtcagtgagaattaagatttcaattatacattactaatggctgggacacagggttagtgaggtagaggtttaaaacctaagtgttgctgaaacgtcgtcttgatttactggtatcactgctaagtactctgtaaatgccagcagtttataccatgtcactaaagcccaagagtaatgtcactttagaattacaaaacagaaggcattctgtgattcaggcagcacagctaacttccaaacaagatttgaatactaaaatgaatgtcttatctttgagaagcaaaggcttttgaatgttcaagtcagatgtgtttaattatttaaaggatacttagtagatacttgttttctgtaagatttctgatcccttaactgactttcataatgttgaattgggatccaagaagaatggaataagagagagatcttgggattaagtgggggtgttctatgctttttttcacttatcctttttttttttttgagatggagtcttgctctgttgccaggctggagtgcagtggtgcgatctctgctcactgcaacctccacctcccaggttcaagctattcccctgcctcagcctcccgagtaggtaggactacaggcacgcaccaccatgcccggctattttttgtattttagtagagacggggtttcaccatgttggccaggatggtctcaatctcctgaccttgtgatttgcccacctcggcctctcaaaatgctgggattgcaggcgtgagccaccacgcccaggcctcagttatctttttggcttgcttattcttcttttcatatctctgtccatacaaggagtagttgctacatgaagagggtactgtctttgaaggtaaagaaagctttttcatgtgagtctgataataggtatgcatatactttaatttatgtaaatagtttaaccagtgctggaaaaaaaaagcatcatacctccaatggaatagttctgattattcagagaacctttcagacgaggaaaaacagaacattttccagggagttcttgtacatctgcatgccccacggtgctaaattttggctttgcatagatcccctgtgaatgcagaccttcccattagccactctctgtttccagtcgctttcattccatcacatatgaagatcaagcttaatgttctcaaagagggagagcaagaccaagcacaccctgcagaatggcctgtggagtttcagctcttgatagacttgtctgcgacaatttggtccatgctgcttcaaatggcaggaagagtaacatcacaggagggtaaaatattttccaaatctgatttaatgataagacactgagtgttgagagagcaccgaattcaatgaagaaggttaagtgcaaaacaccatgattttcttgagatgtgagtgtgttgagggagggggatggagagggagagcaggcaaagggagcagaagctggagaggggaggttgacgggatccagatcagcatatcttactaggttagtatttaatgaactggccagtatcagagtgatttggaggtgccaattaaaatgtgaggagcactgcaattttgtgtccagggttaagttaaaactatgtaatctttttataagcttgaaacattttctgtaggttaagtctagcaaaaatattaatgccatgtaacctaacttttttttcatagaaaaaatgtccagatttctttccaccaagaagcctgatatttgtagagttgttgttgttgactctgatctggatgctggagatgaaaagatacatgcgaggcagacccatgtcaaccttcagaggagccatattctagggatttcttgacagtgtgcttgtactaatattgtatttattgctttcaaactaaaatgaatactataatagacttaacacaattgtgaagacacgcaaagagggcaaggcttcttaattctgaaagtgtcaaagaaggatttattataaagaaaggtgactttaggttagatgttaaggagagatttaactgcatagggcttagatgaggaggaattggttatgatatttcagtttttgaacacagaatgaagaaaggtgacaaggatacccatttcattatattgtgcctttgtgtgattttagtgcatatgagagtaggaaaaggattgggtttgagcttccagaagatggaaacataaaaccgtaccaagtgtaggattttaagggcctaagttaaggagtttaaacaatatttataaataatgagaggcattaaatatattttttaattagaggtgactgttactgcaaaaaaaggatactctacaagaaatataaatttgatagcaagataacaattttgagatgagaatgaatagtgaacaggtggcaaaagacaagttaaaaggatattgcaataatctaataaacagaagtgtttgtccaagggttatcaatatgagatgcaaaagaaacaatgaagttgggcctcaattcaacctcacaattgaaagacactccctccttcccattttccccttctctctccattccctattccttccttctttcctccattctttccttaccacccccacccccgcccccaacctttttcctttacatgttattcagtgcctgctatgtgctaggctgtgggagtgaggaagagagtggatcaaaggtaatgccagaaggtctagcttggcagagtagtagggctattaactatgacagggaacattttaggaaaggagcagttttgcagcaaggaataaaatgactttgaatttggacaaattgatttggaaatacctgtgggactttcttattgagatgtccagcaaagagctgaaagagctctctgacattactgcagctgagtctggaacaaacaggctgcctggtgagcagtgtattcctatcactaggaggggataagactcggtcagatggccttgggtcagatgtgttagatggaactctgatgagggattattagcactcttgaaccaaacaggatacagtgcccttccagccatacaattctatgtctgcagacatctgtgcaagagaaacagagggagagagctagaaagagacttatgtttttcatctgtaaccacaactattaacataagcattaatatatctgttgacattttccatattaccatttttagcttcttaacctgtaaagtaaatgatgggtggactactaaggattgtctaatacccactatttccacactacccccccacctcttgtctgattatcaaatattcatggtatttgctgcaacttaaatattatttgatactttctgttctcaaccaagttatggtatatatatatattttttttttctagtaataatattaagtgtttagaatattctcttataaattaaactcaggaaattttatgcagttgttcttcatggttttattctatttttataaatttgctgctagtaagaaataaaggcaagctaatgttttatcacaaactctccattatttatttattttttttgagatggagatttcctcttgttgcccaggctagagtacaatggcacaatctcggctcactgcaacatccacctcccaggttcaagcggttctcctgcctcagcctcccgagtagctggggttacaggcatgtgccaccacacccggctaattttgtatttttagtagagacagagtttcaccatgttggtcagtctggtctcaaactcttgacctcaggtgatccgcccatctcagcctcccaaagttctgggattacaggcgtgagtcaccgcgcccggccagactctccattctttaaagtgaaggcttagttcaaattattattaaaattgctgttgttactattcttaattttttagttcctgattttttttattaatagcagtaagtatactcaatttttgcatatacttttatggatatccaaggctttgaaaaatgtgtgaaatggaaggctatttataacttcaacacatgtataagtacaacttacatatgattctaaaatgtagcactgaccaatactgtaatatcagtaatatcaaaacagtatattactgttttaccaatacagtaatatactgtaatatcaaaaagaaaaaagatatagaacctaccttcttattttcatttgtatgtgtacttctgaaactgcctcctacatatgaaaattgatcatacctcttgtgagctttttctctgtattaagttcatgataagcaatgtaaatcctcagaaaagatgttaccaccgtttagttatcttttatcaactcaatagatgagttaagatttaaaacatttgcctagggaagtattttgcactggtcaattctcacagttttgtgagatgaatcactttggtcattatcaaatgatacatagcagttgagacatgtattgattaaggtaaatataaatgactttttataataaataaaagaaatataagatttaacattcaataagcaaaattatgacataaaaattaaaataacacttcagatggaagcatacactggaaaataatttggagaaaatctggcaaaatgtgttaaatttataattttaaatcctctgatttagtgaccccatctgaaggactctaagcaaataaacgtacaggtgagcaatgatgtatgtacaaggttcttgattgagcataaattctactggtaaaaaattgtatcaggccaagagcggtggctcacccctgtaataccagcactttgggaggctgaggaggggtgggtcacctgaggtcaggagtttgagaccagctggccaacatgatgaaaccccgtttctactaaaaacacgtaaaattagttgggcgtggtggtgggtgcctgtaatcccagctactcgggaggctgaggcaggagaattgcttaaacctgggaggcagaggttgcagtgagccaagatcacaccattacactccagcctgggcaacaagagcaaaactttgtatcaaaataattgtttaatacagtagagtacaaacaaacaaacaaaaatcaattctataaagttaaggaacaagatgggtctacatgtactgtcctggaaagacacatgacatgctgttgagtgaagataaacacaatatatatgcaattctgtttataaatatatgcattcaaagtctgaaaagattcacagatacacaccactctattagcattctttcatccagtaagtactaagtgagtcccaattattcactaggcacacaacatagtggcaaagagacctatgaaacagctaaaatatattgtgacggcttatggtatgtttggtttcaattgagggtgcaagagttgcatatgggcaggaaaatcctagcctagacttcttggaagacatttctgagaaatcgatgttttcactgaaactagaaagagaaggaatacttaaccagggaaaaatgatttaatgtagaaaagcagagacaacagcatctaaaaaagcctagaagcaggaaagagatgtaatgtattcaagaactgaaaaagttaggtatgactggatagtgtgtaagaggggatattgttatctttgggactgggattatacttgcaaatttacttacaattttataaatttctctttttgttaatgaagatattcctattaacatgaaaataatttaaaaactagctaaaattctaacaaagaaaaaataaggaaacactttaaacatgctacagaaaaataataagaaaagacaaaaggggctagaattataaagttgaagtctaatacaacagagtagcattatatattgagccaaattgaaagagacaaatacagtgattttagaaaatgaagatacttcttttatataggctatttaaggagcattaaataaagcagtagtgcacatcttttaaaattagactgctatcgtagaagggcccacaggaatatttgtaccaatacagctgtaaaacacttatcagactttttcagctatttttcttttgcctcagttgcccaggtatatatactggggcaaaaagcaagatctggtaaatgactgttggtgtttttctttcctgtttattacagtgtagttaataatctttgcaattccttccaaaggtatgagccgactctgtatctgtggttctccaccttggctctatgttacactcaacttgggagattttttaaaaaatttatgctcaggccccacttcaggccaattagattattaccgctggcattaggacccaggcattaaatattttcatattcccaggtaattcccattcacatctaagactgaaaaacatcactgctctaggaaggtttagcctatttaacaccttcaatgtataagtcaagttgcctagcagaaaaatcaggtacggtttcactcaaatggatgactccaaagatttgagtcaagaactcagaatgagagatctcattcatggactggtttggtgttgaggttgcctgggtgtttgaagagtgttatgtgctgaatgaagatggaatccttggtgtgggtacactttagcgatatataggaggactataacgtgaatatcttaaacacattgaagttgaccttaaattcatacggctctcagttttctcatgagtgagatgagaatgtaactaccacattacgaagttgtgaaagttaaatgaggtgatatttatataagaaatgtgcacagtatacttcactcatagttcaaaagcttcaaaaataagaaatagagaagtaagagatgagtctctttcatatctaatttgagtattagacatttgagtattatagcttcagttttggtttccacattagttatttttttaaggtgggttttctttcacagtagaaagccaaaaatgttagatagaaaaagtatgtattgtcttgaaaaggtgaacagttggacattacgttttgaaggtattgaaatttttctaatgatctgtttttggaatgtgtatgtattggatttatcttgctgtatcataagctaccacaaatttagtgtcttcaaatacctgtttattaggttgcagttttgtaggtaagaagcttgggccgatgtgggaggtttttctgctcagtgtcttacaagtctgaaatcaaggcatttgctgagctacattattatctggaactcaagggcctcttctgagctcatgtgattgtagcagaattcagtgccttgcatttgtaagtctaaggttctcctttccttcctggctgttagttggagctgatgtcagcttttagaaacaacctgaattccttgccatgtggctcctccatcttcacagccagtgacagagaatttcccacactttgaatcaatctcccactctccccctcccccttcttctctcatattagataagcaccaccgaagataattctgttatcttttagagccagccatatcacagaacttaatcatgggagcactggcccatcatattcataggtgtctttcacgccaagtatggagatgattatacaaaggtgtgggtcattgggatgatcttagaattctgactactccagtatatgagacaggtgaatggactatatgtcagatgttactgggattttaaagcaaggaatgagaagactattactgcctcacgttttatatgcatttcttttcatttgatatgatgtttaaaattattgattggagatgggagatcagctgtgattgattccctacaggaaatatagaaaaaaagtatagaaagatatcaataaggaatgtaaaccttttgcatatgacttttgtgtctgggaaagacaatgtactcttattttctcccttttttattcttaataagtaaattttctcatacaatttaatttcattacaaatacatgccaaagacatgaacaaaaataagtcttcataaaggaaggacattccacaaataaaaattggcacacgtttattgtttttatggggattgggggaagttgtgttgttccacagaagaggccaacagcagcttgttggtactctcagatacggtgagtgcagtagtttccgtcagttccacagatttaccacggaacaaggaacgacccaggaataaggaatgccccagcttgcagcctcttaaagctgtaaaactactcagcacttgcttctggtagttgactgctatcttaataattccctgtacctcttaaagacatgatagtgttcatagccaggaaatgtttaggtttgatctacttttctatttgtcagaacccaatgaaggaaatcaatctatttgtttttcaagcataaatggatgaattcttggttgttgctaataatacagtgtcttatttggctaataccattttgtttagaaaataaaagaaatcataacattctttttaaggtcctttagtagtttgtagtaaaactgaattagttgctgtagatatttgaaccttaagagtgtgtgtgtgtgtgtgtgtgtgtgtgtgtgtatgtgagtgtgtatttgctgctgatgatcaatcagaagatccttaggagaagatcttttgtttaaaggtgtttaatttcgatctattctgtgctctgttatacttattactatacttttaggagaattgaacacatataaatgtaatataaaagggccattatgctactgtgtagtggattttaaactggagcgtgaatatccctggggttatgtgaggatgttccattggcatatgaactcagagctttgaggatacaataaaacaataatttgtttggctaattgacaaatcgaatggctctgataactgggtaacagatccattttcaaatcaggtggtttacaattctctactttaagcaaaatttcagagaggcctaattgagttgtcagccaatatatgattaaaataatttttgatggaaaatcattgacttttggcatataattgagaagtagttcaaggacttgagcgacattgttataatggaaagagtttcttccatttccatctatttatttgtgtgaacaaagaaccttaacagttatagcaataaaaacaataaacagaactcttgctgggtcttttctccttttaacagcaagtattagtcatccatagcatgtataaaataaatgggaaaaagccatttcattaagagattcatttctgatcattgcaatctttgtctaataattacttgtcacagttttaagtttttgctttgataattatgctcttttaataattttaatggtaactcaacccaaaagaaattttttttacacctagagttatatggtcacagggaattttttttaaaaccatctttagatacaattccttgttgcagagaaatatgatcaatacaaagactttcaagcataaaatttattatgtaggataaaaatcagtggggatagaaatatgagttcaaaaagaaatatgacttaagtaaaatttccagcaataaataagatcttgttcatggaatgtattagttcattctcacacagctatgaagaagtacttgagactgggtaatttttaaaggaaagagatttaattgactcacagttctgcatggctagggaggcctcaggaaacttacaatcatggagggaaggcaaataataagcaggtactttcttcacagaatggcaggatggagtgagtgcaagcaggataaatgccagacactatttataaaaccatcggatcttgtgagactcactcactatcatgagaacagcatgggggaaaccacccccgtgatccagttacctctacctggtcccaccctcgacacgtggggattataaggattatggggattacaattcaagatgagattttgggtggggacccagcaaaacgtgtagtttgtgctagtattttaattagtctggattctttaaaagaattatgtaccagttttattctaaaatatccatatttttagtatgctacaacttatattctttgctatttacacttaccaggaaaataaattgttgacctcaaaatgttttagaggtacatggttttataaaaccagattaggaggttacattacgttgtaagactagtgctgttgtggaaaggactatccacgaaaccactggcttttcctatgttgcaataaggggtttggtttaggggctaaggacccagctggctctgacactgacagtggttcaccttcctctgaacttctatggctctcattaatcatctgaaacatttgacactttgcatatgtctggtggtgctgttgatttggaatctaaaccataaccactacttagtagttgaaaagttaagaatttacccccattgttgatactctaattttcatgtaatcagaaatgttacctttgcgataaggagttcctgtactgctctctctgccccatattttctagtgtgaccagtttgtcaccaaaggttgggtcatatagatttttgccacaatttgagcaagctcctattacatcattaagagtatgtcacagttagtttcaatgaaataattagccaattggatttcaaatagtaaaataacacattttattatatgtaaataccttatcttccaaaggcataaatttaaggtaatgataattgatatccagaatgcttctgtgtacatacatgttatatgtttcaattactaagtcaaaatatgtggtagaaatagtaaggaacgcagagtttcttttcttcttaaggaaataaaaagattgacttgagccaatttttatctgaggaatgttaatttgttttatttaatgcagcttaaaactctacaattaccctttctatgaacagatacttaatgagtacataaacacttggttcctgtatttcctgaaatgttccacactttagagctggttctgctgatgaaagttgaagtcatgggcaggcatgagatggggtaggcaaagagtatactgtgaaaagagaaatgagggcctctgatattaaatattgcccagggagaggaaaaaaagtttggaaggatcctgagtaggacaattataaaagagaacctggagcttgcggggagttcaaagcaacagcaagagtctgtgccatgtaatacttagcaatttagtaaagtaaggaatcaaaaatgcccactggaattttaatataaaatatttttggctgggcacggtggctcatgcctgtaatcccagcactttgggaggcctaggtgggtggataacaaggtcaggagatggagaccatcctggctaacacggtgaaaccacatctcaactaaaaatacaaaaaattagccaggcatggtggtgggcgcctgtagtcccagctactcaggaggctgaggcaggtgaatggtgtgaacccaggaggcggagcttgcagtgagctgagatcgcaccactgcactccacagcctgggcgacatagcgagactctgtctcaaatgtgtgtgtgtgtatatatatacatatatatattttaaggacattaaaaaaatcaagggagaggaaaaagtctcattttcttctataggttggctaggttaaaaaaaaagtttcagggtggtcttttgtagtcagttttgttcttatatgtgatatttctagtgagaaagcaataacaaaaacaacaaagaaactaaatttttttgaatggtaactagtatgagcagtatctttctgggctggcagtggaggctgtagaggcatggaaggcaggatagtagggaaccatttgctttggtttccttctcgcttcaaccaggagagagaatgatgttcaagagagagaaaggaaaacatagcttccatggcaaaagaattacacttgcattcctttgataactggaggaaagaggaaggaatggataaaggtctaggcagtattgtgtggctggaagtttgctgtaatgtctaatgaagtaaaaggaaattttgctgaaaatgaaggtggtggtggtggtccatgatatcagaagttaaatacaatagagaattttgaaaaacaaacaaacaaacaaacgaaacggaatatttcagggttgctagaatgaatggatgaaagtattaaagtgtaaaattgagtcctcttgaaggcgaaggtaaagtaacataaaggaatatactaacatccaatcaaattagaataacaaatatttactgagttaagacattattgaatgtgatgaatttgaagggacaagatataaacctataaaaaggtacataacagaaatcacattaattgcttctataaagctggctgactaggaagtgtttaatgcaaactggaactggagaaaccaaagctgggatgatccaatcggagtaattcaatggccaactaaaatggcctttattagtgggagttaagtggagttacttccagatactttcactgtcccttgtttctgcgttgttcccttgtggtacccactaaaatccgtttacttttacctgcctctaaaaatagctatatgtcaaaactactaaaggcccataaacttagtcatattatcatagtttgaagcccaggtctaccacttaccagttctgagaacctggacaaattgtataaaccctctaaacctttttattcctatctggtaaaacaatgaaaatgataacctatgtcatgggtgttgtgaggattaaatagactaaactatataacaaccttagcatactctatggcatataaaaacctactcgatagttgtaccatgttattgttattaactttcttaatagaattcttaaggcaaaagggtattgacatatctctgtctacatcatttattgtcattgttataagtgctagttagtctaattcatttcattataattagtaagtggtaatatagctggagaatgaaactcattttgatccttataagggaatcaaaatgatatcagcttttcatttcagcagcctgattatcattagatgaacatcaatatcaatttataaaatttacaattttataaaacatgttatagttaattttttgtttgtttagatgttgaaaaggacactttcttttcaggtctcaagatacatatgggcataagccataaaatctatatttaattgacatcccatttccttctttaccatctttgaaataaaacatttaaaggttgactctggctgtgtacagtatcaataccgtggaatcagtgagagcccaatagttagttattttgacaatcagtgtttctagggtgatccatatccagtgtgcattctcctcagggttacattgcttataaattttatttatggttcatataaagttttatgttccagtatttttccaaagaacatcttttatgtccatgtgccttccctcagttatactgataactgtccattttgtattaagaatcacactggaagtagcttttatgatatttctgaattatgaaagaattccattccatttccaatagaaccatgctacaactaaaatatatcatggctgtgctgtaagctaattgtaataaaaaccataatttgggcgaccttctgtagcattgtaatggcttctgaaactcactttgtcttggtcaagtgaagatttcaggtatagagccagattgaccacagccatcactgcttcttccccagagagaactcagattattggaaagttttctactgagagtagaatactcttgtccttgggcaatagtagctcagaatttagttattctgcccacaggcctccctaaaatgaatctcagtttggagaaaagagagaaacaaagaaactaggatttttttttttttttttagattctgagatagcatccaccaacctgctacgcttactctggggaccttgaacggtgcatagaaaggctgttttgtttttgtttgttttataaatcaatttatttttgaacttcctcaaatatttacaactgtgggtggaaggaaataattttccctctcaattctgccttggagaggacacatttctgtgccctttccagcccaaaaggaagagtaggattagaaagtctgatgtagacaggatttaccactttatcataggtcatgtgcagctgctccgtaagcaaatagtaaggctctcaggactttttccctgggagttagaagtctctccccttcttcaagtgagaaaagcataatctagtagttacagtaactggtgcccttgcatatgcttctccaccccctccaataagcttcacccaagtcagctccaggtggctttcctcttcctcatagtatctgcctgtatttaaacagcaaggtttttttaattcattaaagtttgatttactgttaaacgtattaaatgtgatatccctccatacatattacaaatgcacgtcttttataaacctgtatgtgtttttatgtcgattgttattatatgaataatttaaaagcagtgaattgcagtagtcctctttggcatcataacaacatcccaggaaactttgtgctctgctgttaccttgtattatggcatatatgagggggagctcaatgttctgtccactttttgaggtgaaaatcaaacataatgaaagactaacttggtaaagcaacgttaaattctgagttttagctctctaaaggaaaagcataaggtgagggaagggaatttggttagttctattgacatttgatgactgtttaccatgggccaggctctgccagcagggttgggaactcacaggagagaaacacgagaattgcatcctcaggacattacaatatactgggggagatgaattcaaaagattttgataaatgacagatataggcattatagacatcaaggatgaggacgagccttgttggtgacaaaaggtgacaaggcagttctaggaaaaatataccaaaaacgagagagaatagtaacagaggacctggcctttacagacagatggaatccctttttcatggttgaaccatgagataaacttgcacatgctttaagtaaaagtaggaaaaagcaaagttaacatttcttgcttacctaagggatttctagtagaataatgtatataaggcaccaacctggttatgtggagttgctcaaaaaagagtaaattctctttcatccacttgcactggcctcttactagacaactcactattttaaagatgagacaatttaaatgtggtcagaaattaaggtgtagtcagatgaattggtctttttaaaatatgaagtcagctccatcaggtaaaagtccaaaataactttctttgctgtaaaataaaggtgttaaaacattggtaacatttttgtaaatttcagaaagattttgtttgtaaatctcttttgagaattttcttggctagatgctgtaatagttactaaatatttcacaagttcactatgaaagagaagttgaaagcctccaacagaacgaactgactgaaatattatgtctgtcattcattattattattactgtcattgttattattttaacaaagcattaataaaatttatggttagaggcaagtaccacccatactcaaataaatttattttgatttttcaacaaattggtttgcaatcttgatagatgggaatgtttcatttttattacaatcctcatgaatcacagtaaaatctaggtatgaagtctaaaagcttgtatcttgacaacatttaacacaaaggaagggtatttgagaaaggaaaacagtaatgttaatataaagatgctttttattaaaaagtcagttatttttaatccttccttgctttcttcttcctttccttttctcctacattgccttgtgtttctttttactgagtgatggaataaatgtcaggtctattaatgagggtaaatagtaaagcttttaaaagattatttattttagtaagggtctcacaatttgctcattaatgttgtctgcagcccaccattcccaaaacatttcaaatactataaataatatgtgattgtactcccaaataactaggttattgtccaatcaagaaaatagtttccttgatagttggaaattgaaagttagctaccaagcttgtgataagtcatattcatattaaaaactacaaaaaggagctcatgatggcaaattttacattctaacttcaatactgaaagtttgagaataacattttattaaagaatttcaaattaactagtaaaatagtatttaatacataatctttaccatatttcagtgataatgcctttgccttatttatattttggacatctgaacatactttattcttgttgacataatagattgtttctctttaaatctaaattccttgattatttgttgaaataagcacatgtggaaaatgttttttagaatgtgtatcttgaaactttttcttcttaaaagaagaaaacttactctaagggacactttgaattttgtttcagcatatgtctgcttaatttgacagataattttaccgtgctaaaatggtaaaatgcaattgaacattttttttgaatggaaaaataacattttagttgtgaatactttttgatatcatcatttgaaagagttgtttagaaaaatagacctgtatgttgttccaaattatagattttgtccttaaaataatattggcaatttgatataattgagctatgtatatcttatgtgtaacaactttcagcacacaacaactattttgtcaaccatgtcagtagatctagtacaacgtgtgatcagaagataaaggtgttaagaaatttgaatacatttctatttattttaggctgatatgtttttaataactctagcttcatagatatcttgcattaaatacaatctgtttcaagcaatttctcttgcaatattctggtgactgttctctataaacatggccaactagcctataaaacatgttttatttaattcattgctacccgtttatggctgcaccatgtggtaggaatccagaagcatcaggtctactgttcttataacgttcaagtggcctccaggtgataggcacagccagctgtcttggaccagtgccaactcacaatggtcttatcaaccagcaacacttaggaaatcactgagacagccaacagtcatttgtggaacaagaaaggacgtggcagtttggctattttttaaatttttccatctgaagcaggaattatcactaactggagtttattcttttttttttttttttttttttttgagacagagtctcgctctgttgcccaggctggagtgcagtggcgtgatcttggctcactgcaagctccgccttccaggttcacaccattctcctgcctcagcctcccgagtggctgggactacaggcgcctgccaccacgcccggctaattttttgtatttttagtagaggcagggtttcaccgtgttagccaggatggtctcgatcttctgacctcgtgatcctcccgcctcggcctcccaaagtgctgggattacaggtgtgagccaccgtgcctggccaagtttattgttatttgttaaaagaatgtttgctttttggtgtcttcaggtattttcaaatagaatgaataaaaccattgtgtgctggtctcctagtccttcatctcatttccctccatactccatgactcaattagtttctggggttgggattaagtgcaccttatgctaattagaactataggttttactccttaaataactcccattggcctagctttgattctttaatgtaacaaagatagatgtgggaaaaaagtgacctatcaaaatatataactcagaaagctttttgggataaacatatttaatacaggatttctcagttatatattctttttttacttagataaaacccccaagggaaaaataggtatctaatgatatatcctccattcaaaactgtgtattgctattgagaagttttatgtactattttaaataataattattaataaacatatacaagcaatgccaaataataaaaaatgtctgtctttttcctgtggagatactcagctcatgccaatttggttccctaaacaactagaactggagaaagctgtgctgtgacgtttgaaatcgaaaacctgaaaaatgtaagcttcttatcaacttccaaatttggggcaaatctggatcctaaaatcaagacatctttcgtaagattagtatccaacaagacaagaatattggctattgtgaagaatgctgctgtgaacaggggagtactactataatcttgtcttattatgattcacaatagtcaagatatggaaacaccctaactgtccattgacagataaatggataaagaaattgttgtttctctctctctctctgtgtgtgtgtgtgtgtgtgtgtgtgtgtgtgtggaaaatatatatatatagggtgatggtatatacatatatatatatatatatatggtgatggtatcaaaaagataaaatgactgctctacaattattctcattttgaatttcattttaatttacagttttcaaaactaaatgccacctgtcttttgacactgttttcattattgaaggttttatagctttaattttatattaataaaattaattatgtaaacatttgcttgcttttaggagcaaagcataggctactaaagtaaatagttcattaatttttatgtcagtcttggtgctatttacatgcatagaaatgaaactaaacgaccccagggaacttacagagggttggtttcaaatccatgaattaatgcaaatggtaaggttacatcatttgggtataaggtgtatgctttggagaatggaaaataagcaatcaaggtaaagtagccctagtgcctacattattcatgaaaatgagatcctgacattatattctaaggtgatgttgtagaagatagagctaactatttgtgcaggtacactataaggtcagtgtgtgtctggggtcagcttgccatgtgggcagaaaaactcttctgctgcatctttatttagaggaaatccacagagctttcacttggcctactgtattgctaatgtttattgccaccgtaactgaaattcctacaagttgagagcaattgtatttcatccattttaagctctcatcagttaaaatatgcattatatttattttacctctaagaaaagtacttctgatttaagtataacttttcacaaacttaagttttatcctgattttaataatgctaaaatgtgaaaaataaaaagccaccttaaagttgttgaaatatagtactgcttttattttattaagagtgctgctggcttggaggtaaagcttaaatattatttttggaaggctgtttcaggttgacacagacatttcctgcggggaatgagaggtcagagactatatccctcccattagcacattagagagagaaatgtcagaatattagacttaatttggcagggtccttgggatttctgcctctgtttctttgtcttcctatatttagttgctgtcaatgagttttggtatgtacaaatagatttaagaacatacatcagtgtctcatatattcattattattttgttaatatagtatttctttaattctaaatttatttaaattaagcagtgaatttgaaaccaaccccctataattcttgtagattgctgtactaaaatgtatttctagaaacctggttatcaaacaaaacaaccaaatactctgttcttaacatttcatcgtcttccaaaacgacactttcttagcaacttcaaagtggcaactgatggtttggtaacgatataataacaaggaataactcctatattcttaagagactcagaatttcaattcttaccacatatacatctattttcttaattaaaacaaaaagtcccagataaagtgtaatgcccagaacttgaattttaatgaatgcaaatgagcccaaagtgagaataatcagctgaagttctaggatggaatatttgtcttgtatttaccttggaagccactagcttttactcaactataaaagaagcctcaggagtgaatataaaaagaaaaaaaaattatagtaagagtttgagaactaaccaatatacttcattaatacattgaattttagtgtgaggaacaatataaatttcatgaagccggatgaaaaaagaagagatccttgttatctcttctgccttttattttaactctgtggataattttttccctatacgtctagaaacctgggttcttaaattatctccaaaaatatactctgtagggtttatagcctttaaatgtaagggtagctagagagcatgttactctcactaggtaatggggtacatctttttaacagaaacatccttgaattgctaacacatatcttccactctggtagactaaattctgttattttctgttgtttgttgagaagatagttcaaaatcacaccaaaaaaggcagtgccattattgtaagtgtcattggcatagatgtttttaatctcactgtagcgtgattctttggttaattgtctctctgctgcactagtctgtaaaagcagtacgtgtaaaagcttgttcaccattgacgtgaatggtagatcaccaacactcaccacaaagcttgacacatattacattatattaaaatattgaaatatcctgtgacttgacctcagtggaattggaatgtgaaaaaccatcttttcagaaagttgtagaaaaccaaatttggggtaccatccaatggtgctgagaaactgactttataatctgtttttatttttttgcttttggagtgactttagtttgtaaactttttttttttggctctttaaagggaatagcttttgaatgttagattagaaatcagactatgtacagagctattcagctctgaaaactgtgataacttgctaaagctatgtttacaaggagaaagtaaaaaacaacatgaatgattttatagtatatgtgggctggtaaggacaattatagaacatttcagttatccagaactataaagatttaacttctaattttcatataaataatttcaaaaatagcaaagaggaaaaagtaacattgtttaaaattgatatctgtctgcataacagagtatcatacaccacatttcatttacatagacctctggtttttaaaaaaatcataatgaatcatgtgtttcctaaaatactccattaatgttacaactaaataaataaatgtagacataggagtgactactattaggaagtgaaagaaaatttatttaggtgccaaattgacagttttttaaataattgttttgtttagaaaggtcacataacataaaaacaagtggattctataagaaatcaattactattcagtgtttatacaactttttaaatagaaaaagaagttctcttagttctaaatatatatatatatatatatatatatatatatgcaagcataaatgtgcattgcacaagagggttagttactcaaaggaggaacattatttgccatgcgttaattatcataattttgccatttccacattgaatcataatcattgttaatttaaatacaatggtatgtaacttattcattcaacaaacatttattcaatcccaggaatgcactagagtgctatacaacagtgatacagagacgaattcatatgctgaagcaaattctagttgaaaaaggaaatatcttcatatttggctttcaataaaaatgttaatatattaaaattataaccaagttctattgatatttctcctgcattccacctctgataataaataaactcatccttcgggcactctctgagttggatgctcccggtatatctaatgcctggatattatcagacattctcagataatacgtggttggggatagagggaaaacattaaaaatggtaataatataaggtagcatatgttaagagtgaaatgaatggttaatgaataaatagagaaaaccttattctgggtgctgaatcactgaggaaattacaaagaactaagtcctcatgctttttgctttttaaaatttgttttcctatctgtccctttttttttcccccttaccaatctcctacttcattttctttctgagttatttcaaatgtctccttgggtattatcctgaccagtaatccaccctgcatattatcaccaaatgagtcattcatagactgctttggccatagactatgatctccaccttctttactctatttaaggtagttggaaacctggcctggcgatggcactcattctcatttaacttgctccattcaaaagaaagtgctaactttcttttacgcctttattgcaaaaaagaatgagagaaaagagtaatcttgaaaaatataatttagtgagaaagagctgacaacccttgcagtattatactgtacttgaattcacaaacgctgagcatgtgctttgcatggtttataaatagactttggcaagctttgaactgcccacactgtgttctgagctttgagcaaagctctgctggcatgctgaaccaacttaagttctaatgtgagttataaaaacacaaggatgactggctccatttggagcattgtgttagccaagcaggtaaaataaattcatggttagacctcccctcccacggcatccctttcattcctcagaagataattctgatatctcttcttaaccagagcagacaatgcaactattcctctttacagatacgatgttttataagttaaaagaacaaaatgaacaaaaagaacacaacattcattttattgttagtcatctaccagaaagtggtaacattggggatggagataaaaatctggagtcacattttcatagacttacacattagtgacattgtttagacacttaccatgtgcattattttttctaaaaagcattcctggtaatgtgggaccatcttacatattttaatattaggtaccatactctttccatggctatatatgcatacagatcgttaaactcaacatgaaagaacccatatttcacctctgatggtaccatcatcttttaccatttcatgtcctcatctttggtaatgccaaacttgttcagaacttgttgatggaatgcaaattcttcaccaaatgcttttgaatggagtgcctaatatgtgtctggtactgttttaccaactggatgttttaattctgggggcattaataagacatggaattttgtacacataatacagagctggtatggcaaagtgagtgggagtgacctaaaatgtaacatataaggccaagccaatgaggttttgggggaacagagttgcctgtaaccactgcctgttgacatcagagctacagaggggaggaagacagtgaacaaagggcactgcattctcagggcagcaaaacagctgcaggggctcaagatggggcagcagggatctcaacaggtgaatggaggtctgcaatgggaaatacagagtacatgcttaaatatcagtggcgcaaggatcagtatcaggccagattgccagactttaaagacagaatgcagacactagactagaaattgacataggaaattataatactgactagagctaaaagtgcacaaagagaacatttggatttttgtgtgcatgttccataatttgtctggactaaaatatcgagctaattccaaagcaagtaatagcatgtgctaattattttcttagtcactaactttattgaatgaatgattttccaaacttggatatgaaccacttttaatatcttgggaaaaagtatctgaatgctattctgatctcaagtctggttttagggtttattgtagtagccatttagataaaatatctgtggtacggttcatttggattaagaacacatcagaatcagatcctttcattcaaaaatatttgtttacaggatagatcttcagtaaagagaatgcagcctgaatcattcaaatatatttatgagaaagaatataacttacctgagtaattcctggccagtcataaaatgctgaggagagaagttcagaagaaaagagggagggtggggaaggaagagggaagccagacaggaaaggggagaggaaatgaaataactgaaaccgatcaactgctttgtttcaaaggtgaacttaaagattaaaaaaattttcagtttgctgagaatgatggtttccagtttcatccaaccatcattctcagcaaactatcacaaagacagaaaaccaaacactgcatgttctccctcatagatgggaattgaacaatgagaacacttggacacagggtggggaacatcacacaccggggcctgtcaggtggtggggggatgggggaggtatagcattaggagaaatacctaaggtaaatgatgagttaatgggtgcaacaaaccaacatggcacatgtatacctatgtatcaaacctgcacgttgtgcacatgtaccctagaacttaaggtgtaattaaaaaaaaaaaagtaataataacaacaaaaaaagaaagtaaaaaaaaaaaaagaatcttcaggtaaaagaaaggaaaacctggctgggtgcagtgacacatgtctgtaatcccagtactttgggaggcagaggcaggtgactcacttgagttcaggagtttgagaccagcttggtcaagatagtgaaaccctgtctttactaaaaatacaaaaattagccacacgtggtggtgcacacctgtaatcccagctacttgggaggctgaggtgggagaatcacttgaatctgggaggtggaggttgcagtgagccgagatctcgccattgtactccagcctgagcaacagagtgagactccatctcaaaaaacaaaacaaaacgaaacaaaacagaaaggaaaaccctatcatttccaattcttatgtaattcaaacagatgaattcttccctacttttttgttaatattgttcctaaaaatgtttgcaatgactcttgcaaatatttgcatataccccaaacatactactgtaaattaatttttagaaccagttaatacatttctctctgtttaaatatatacttatatgtgtatcatataatatatatgtatgccatatgccatattatagtctcttattgtagtacatcccctaggtttgaaataataaatctgcatgttcatatctcaaatattattgccctttttatgtattattttatactaattcatgcaaagtgcctactttatttggcaataacaaagttattaacataataaaaataaagacacagatctgtatgtttctattgctaactccaaccatttgtttccttgaaggaaatttgtaatttagtgtccatcagcatatgaaattttagttttgacagtctggtatggttatatcagggtgacagtggtacaagattcagagctggtttttgctactatatcttttttaagccatctgaaccacttggtcaatctatcactaaccttgtcaattccccctgcttcttatatctattcattcttctcatttctactgtcactttttgagacaggcccttgtcatttcactgtaggattcctgtgacagacttctaactagtcctctgtctctgacttgccctgctcattcatccttacagcacaaaaaagttaatctgtacaaaatgctgttgttatgctatttgcgtagggtttgctttaaacagtacttatgtctatataccataaaagcctcaccgtgtttgaggaggaaattgaagttctcaggagaggagcgatggttgagaagacttgagaaatgagatgcactttctatagcgtctttagaaccagaatttacacaggaacatatatcctaaggaaaagcaacaagagcaaggtttcaacactcatggctttttcaagcaatggtgagcaaactgagattgaggtcccagcatttgtgagagataaaatagttgagtggcttcaatttatgttttactggaaaaaagctggtatgccaaattggaatttcattttataagcctcaggggttaggataagggcgagatgcattagttagcactctttcagtttctagtgatagaaacacacctcaaatctagcttatgcggtgcatgtgacataaatgtttcagggtattactgccattaggttatcctgaggcaaaatgactacatgagaacattagacatcaaactgtctttctccttttctctactcctcttttctctgtgacccagtagagttatgcccttagtgcctgcacttctagtgctcttgtctactaattgttctagcaatagttctggggttgcctctgattggaccaggcaggatgctgtactctggtggttgtttgcagaaacctgactctgggattggggtcagggacatctcaaccacatggactattaggggagcaactctggctccctgaaagaagaaaggtctattatcagaagagtggtgtggcctgttgaagtaaacaaaagtaatttcattttaggtttctcagctgaatgctgtgaatgaaatagcttttgtgactgacctaaggaaatttagccatttagtaatacagtcatacattacttaaggacaggagtacattctgagaaatgcatccttaagcaattttgtcattgtgcaaacatcatacagtgtacttacaaaaacctcaatggaattgcctactacacacctaggctatatggtatggcctagtgctaccaggctacagatctgtacagcatgttactgtgctgaatattgtaggaaattgtagcacaaatgtaagtatttgtgtatctaaacatatctaaacatagacaaggtgcaatacaaatacggtattatagtctatgggaccacctttatatatgaggtccctcattgaccaaaacatctttatgtggcacataactgtagttagattcttctgatacatttctctagcctccagtggtcagagataagtagattttatgtccccaactccacaatgttgagattgccaccaatgagtgtgtacagtgaaagcaacacccatcctaaattttgctaaagtatgaatatttttgtcaagtcatcacaaaattttcatgcagtctcttctcatagctcagggatggctaaactttctgctcacaggctagtgttttatattgaaaatttgctctgaaccaaatgcagcaacattcttaaggcaggattaagggaacttctagttgggtcaggtgtcaaagtcattgttgaagtagaaggatgtacagtggggtgctagacctcaaccctacactaatgttattacatgcggatctcccaaatcattttaaccaacgacttacattgaacaccactgatttcgccaataaaatatgatactttgcatcccttagactcactggtgcacattttaataatgatatttgaagtaattagtttattatcctaggatttattccttttcaggaatgtgtccatttcactgagccacactctatgctgccaattgcatgatctcatggttccttgagttttggggttacaggcaaaaaggcaaagaagtgagcaaggggataacagatcaaaagtgagttgtgcagctgataattcagcaaagaacaaagagacaatggcatgggaccgtgtcctgtttagagcctacagctactgtctcttgctggccttgctgacccagtgatgaccgaggaggagtcaggccagggcagagtacatggccagggtaaagaatactaggttttgttgtttgtttaaacctgagctctccgatcgcgctgctttggtcagatacttccagtggtgtcacaaagggaaatgtgatcttttgtcttgcctttcctcctctgcctgccagggaaaaatatatttacatatgttagtttttattttcctagcaacgaaagagtagaactattttacaaaccaaacacaatgtaaacacttttgttcaaggggaaccagataatcataggtcatgacttctttagtaaaaacagaactgtatattatgtacaactcattagtcatgagttccataagtatgtgcaagtgctatgcatcttttattccctaaagaactcagtcttacccagagcacccttggtaaaaggaaatggcatgtgtgaagcagttccagagaatcagaactaatgccattgtgaggcctccgagaagaccagccttgaggcagtaagttaaaattagcagggactttggcaacaggtgtttgtttagatgcgtgtttatgaaaatccttgctgatcttcttgcttctaaaggaaatgttcaatgactagaatatgggtcaagctttaaccctcctgtttgtcatcgtgataagtgactctgataaagggctgtcttggcgacaggcaacacaataaaactgacacttgaccagccatatcaagtaaacttgttaatgcagcctagatggacagtagcatagtttttccttctatagatgctttgagggcctaaaccaatatgtgtaactgctaacaaacagtagaattgtgtgttgccagtagctgtgactattattggagaaaaggtgataaacctctcatgagatttgggcatgtactttaagacggtattccataagtctttacattttatattacaattaaaaagaaatgaaatagatcactgggctctatttgatgtataaattaacactgatcaccataaatttacactgtacaactgtaatcctgaatgtaaagctttgttctttcccctcttgctgtaatttgaggagcctgttcctcatactctactttcattaggagggctgtctctctctctgtttggtctctctctgtctgtctctatctttctgttgcttgccttctctctgaagaggaaggctgcctgatgtagtcatttatctagccaccttgctgtgtcatattttcaattgatattgagaacttatgttttatgagcatgaacggtaagcagtcattagagctatcattgtattctaaagaagatgctaagtcttaggtagtctgctttattgcttgccctaccaagtatttagcattcccttcacaaatacgtgaaaataatgctgggtggcggcttacgatgtggcagctccttgcactgcataccctacaatgtcttgtccccctccctcagcattgagagctgctgagtgttcacgttccaaatgggtacttctgagtttcactgtttatacttctatacttgccttcatgcctctgaaaacagaaatcagtttctgggtacttctagtcactttatgtgcagactttcctaattctaaggcttattatcttattcttcataaaataaataggaacattgtgaatgaatctagacaatgcatggtgctgagtagactttaacaatgattcctaacggtttttagaaagtgtccattttgtcacctgcagtcaccccatatacatatgagatttatggacaaagactcccattttatatgcgtatgtatatgtgtataaaatgtgtatatatatttatgtgtacataatatatgtatgtatatatgtgtgtgtgtgtatgtatgtataaaatgggagccttcgttcataaatctttcactctgctttcctaacaagatgagtatttaaagtagcatgatcttggtttgaaatgaatatcttcagcctcttacagggccccaagtccaaaatctgttcctttaaaattttaaggaagagcaatgtctttggtgagagacagacattttcctctgatccagggtggaccactcccatttctaattgagaggttgctgtctgagaattgaagatatcaaagggaatttgtaataagacttcactttcccctgagcacagatcaaagtggcccctgggcattttttaactgataagggtctacactactcttgatactggtggtcaaagttatagaaagtgtgtaatagtaactgcgtgatcatcacttcactagttcatagctatggacttggtgaatttttaatctctttcttccatggatactttaacattgtagataacataataattttgtatgctttcattgcaaatttacaagaggatctcagggacaaatcattgagaaagttgagtgtgtcatactagattcctttagagtcatatttatgccctaatgtcatagctaggagtgtgacctgggctcaaacactggcttatcagctgtgggtaagtacttaacctttctttactgccattctctcacctgtaaaatagagataatagtagtttgtatgcagtgtgggcttttgaagattaaattgtgtgtgtgtgcatgtggaaggttagactgaaacataataagggctcagtcaaattagctactttggttattgctgtagtggtaacatttacacatttactatcttatgattcttcttatttttagaaactgtgtggtggtgatttttaaaaaggaaaatggcaaggactggggttttgttttctgttttctttctcacagttaatttcagcaatgatcaatacaatttttctctttacccttatatcatttttattgatttggctactgacaagttttgaagcggtagtctctaatcactatctccacttttttttctttaactctaattcactggttaaactcattttgaccagattctgctcataagattctatagaagatgcccttactctatgttttaatatccaactatttgcagaatccaaacaactttagttcatgaccatttgacttctttctggccactattagtaaactcttccttcttttgttctccttctgactctctgagtcctccttgttagtgctggaaggattctttttctccattcacacctcactctctatccttgatattttttacatgcccaactgtagtcatctttcatttctgttttacacattctacctgagtatcgtcatccattcttttattttgaactatcataaagtgcatattcccaagtcagcaattcctgttctttttttttttttagcctgagacgcatttccaactgttagtctctatctgaatatcatttatgcagtacatagtcaacttatccaaaacctaaatcattaccttccttcctaaaaattatttgataataatacttcttttatacctctgtcttggttaatggcatcatcatatattgagcctcccaaacttggttcatcttttatccatcactctccaaatgccttcacacgtaaaatgtcattgattcttatagaacaactttttatacgttatggctatatttcaaattggccttttcctctcttttttattggcccttagccagtaaaggcctaagcctttgtagcttaggcctacatcaaattttaattcaagaactgttgtgccttcctaactagtatattcctgccacgagacccttgccattcaagttcataatccatcctgtttgcttcaggggatagtcctccatgtttttgatcagttcactcccatgattatgaacatcaatgggcttttcatgataaataggacagaattcaaatctgcaataagtcataggtcaatctgaggtcttgtttacctgtccagcttcatcacctactcttccttgctcttcatgtaaacagtctattgtaaaaaattatggaggaataattgacatgaaataaaatgcatataattaaagtacaccatgttgatatattcttatgtatgtatatagcatgaaatcattaccataatcaagataaaaaatacccatcacccccaaatttatttatgcccctttgttttactgacctcacatctctccatccccacccccagataatgactgataatgcttctaccactatagattgattcccattctaggattttatataaatagaagcactctttattttgcatggcttctttcactctacatgatttttttttttttttttttgagacagagtcttgctctctcacccaggctggagttcaatggtgcgatctcggctcactgcaagctccgcctcccaggttcaagcaattctcctgcctcagcctcctaagtagctgggactacaggcgcctgccaccacgcctggctaatttttgtatttttagtagagacggggtttcaccatattggccagactggtctcgaactcctgaccttgtgatccgcccacctcggcctcccaaagtgctaggattataggcatactctacatgattttgagagctattcttcttacatgcattaaaaattcattgctttttctcgatgagttgtattccattttatggatgtaccacattttgtctatcctttcacctgttaatagacacttgggttgtttctagtttggagatgtttttacaaaattagctactgtaaatatttatgtgaaattctttctatggatgttgctttcctttctctaaattaaagacctagaagtggaagtgtagatcatttataaggtatatgttttgctttttaggaaactaccagactgtttttcaaaacagttgtttcattttacatttccaccagtagttcatgtgaattccaaatatcctacctccccgccaacatttgatatgctcagtctccttaattttagccatttaataggtattaataggtaccttattgtagtttaatttccatttccttaataactaacgatgatgaacatcttttatgtgttatttgctatatgactttcctggtaaattgtttgtacaaataatttgcccattttaaattggacattttgttttattattctagaattttgaattttttaaatatactggatacaatctttatcaaatatgtgtttgaaagtattatctctgtactttctttctctgagtagtgtttatgaagaacagaatcatttaatttgatgaagtaaattttatcaatctttatagagtgtgtttttgttgtactattgaagaaatctttgccgagcccaaagtcacaaaggtttatactaggttttcatctgtatgttttacaattttaaaatttacatagataggcatgtcatttctcaaatcactgttaagatatgagaaatataaggtgaggtgacataaggagttaatgaatgagttttctttgcaagtttcagttttatttgtaaagaccatatttataataggcagtcatgataatctgtgtggtaaatagaatactggtccgcaaaagatgtctacgacctaatccccaaaatctgtgcatatgttaccctttatggcaaaagagacttgcagatatgatcagggttgttaaacatgagggggaaagattatccaggtgggcccagtttaatcacacgtgtctgtaaatgcagaaactctttcccaactgaggtcagaaagcaatgcaatcacagaaaaagggttagagagatgtggcctttctggctttgaaaagggtagaaggttcacaagccaatgaatacaggtggcttttggaagcaggaaaaaataaggaaatggattcttccatagaatctccagaaaggaatgcaacggtaccagcacctaggttttagtctaggggtgattactgaacttctgatctatagaactataggataataaacttatgttctttaagccactaggtgtgtaataatttgctgtagcagcaacaggaaactaatgtataatatacgtatccccctttaaattcattgttccttccattaaacaagcaatgttttctttcatttgcattgtttcttgtcaatgagtaatagaaagcttttcaatgaatatttattgtatgaaaattgaataaaaaagataaaaacttaaacaatagattccatggatatactaccacctagggataatgtccacctacaaatatatacttgcatttggtttttgattttttaacaaaacaaaaataacagtatcttgactatacaatattgtaactggccattagtcttcagtatgttggcagcatctttctatgtcaatatatatatttctacaaagtaattttacaagttgttgtttttttcattttatatgtttatacaaatgtcctcaataagacctctagtcttggacattgacagtgtttccagtatgttcttgttctcaatatattatggtattataaaaatatctaaactcattgcttttactatctaggagtctatgcttttctgtttctgcctccctttctttcttcacagacttagtttttctttttacctaattaaaaatatttacttattaaaatactcttgaaaataaagataagtataaataataaaataatagttacctcatgctgttgttaatatcttgctgccaaacattttgggattttttgctttagtacttttatttacattaaaagttttagcatgattgtttaacaagctatcatcaatattcttaaaaatcatctttttgaaaggctacatattattcaccatgtgaacatttattacttgtttaacgtatctccctctaatggacacattttttccatttttgagattatatattcctgatatagttttatacatacactcttacacactgtctctgattagtttttatgatgacgtttttagggatggatgttctaatccaaagggatgtgtaatttgaaggacatattaccaaattgtcttcaaggaactttaattcagatcacaactagtagagtgtaaagggcatgtgctactgcctgtccaaataccatttctctcattttctttgcatatagaatgcatattatatttatatttcaacaagtcaaggaaagggatgctttctctttcttgggagtaaattctgattggtataagccaaccattattaatccctttctctttgtgagtgaatgtcttagagatgggaccataactgagttctcaccaaagcctcctaaaaattgtttctttgctcttaaaaagagatgcagtaaactcctcttttcctcaactaaatcatattgatttttctgatagtttctgtagggcttctgaattttaattcttcattctcttaagtctttagattgagctctggcttcttaaatcccatcatcatgaagtcacacagtatgcttcatgcttgaaagtattttattggatcatttgatagttcattaaagaaccacattttaaatagttcagctgagaacaaaaacaccgtgaggtgcttcaaagccgttctgtatgtttagcacagctactcaggcctctggttagccataaaatcattagctatgactgggtcattagtacttataacatctcctttgatacgtatgctcatcagtccaagaagttcagttagttttactttatacgctcatataagagtcagtatttgtgagctgttctaggatttccctctcctcctaagaaagtacaattccaggtaaacttaattatcgcagtaagcacactgaacagggtgtttccctatctgcagtgaccggcactgtggattgatgtgttactgaatttttctcctggaatacatctgccacccactctcccacatgtacagtcagtctgcattgctgtgccctgatctgtggattcaggaatcaatttatagaacaagatgaaacttttttttttaattcttcaaaagtatttagatcatttccaatttttatactatttaaacattataaggcaatagatttggggaatattacttaccattttataaatggagtaaaaagtgccaataccagacctctcttggcaaaagttacatgtgcaaagaaaacaaaatacacctttatatttattaatgaaagggcaaggaaccacaggcaggttttgtcataaaattttcaaaaagaaacctctcgaagaaatttggtaaagcctcaagcagttgtactgtcaaaaactagttaatcataaatataataatttaaattgccattttttataaaatgccttcatatacaatgtttgttgtgctttcattaacttggcaatttagtacctgctttctccaaaagcagtgatcagtcttttctcaaaatagattgaactgctgtatgaattcatgccaaagtccacaatgttagtttgaagaagctaaaattttatttttaagtcagctttgaaataaaatatattgctcagttttctcccctcaaggaatttcactttctctgagcctactactctggaccacaggcctcttttgcacataaattagccaccccaacagtaatagcagcaaccaccactcatctctagggacaactttttgaccatttattttgttccaagcatagttttaaatccttcataaatattttctctgaaagtccttataacagctgtgtgaggttgttttcaattttttttttctattttacaaattaaaaaaaaatccagagcttagagttgaattagtttgcccgcctaaggtatgtattggagctagcatttgaatccaggtctgcattgctgcaaatgcccaacacttgtggtagactaagatgacaaccccaggatgtcaagtgcctttaagttcaagcctatcaaaacctacctattctgtatgtaccctgtgtattagtctgttctcacatggctagtaaaaacatatctgagactaggcagtttataaaggaaagagatttaatagactcatgattccacatggctggggaggcctcacaatcatggcggaagacaaaggagaagcaaaagcctgtcttaacatggcagtaggcaagagggcttgtgcaggggaactcccctttataaaatcattagatctagtgagacttattcactgtcatgagaacagtatgggaaagacccgcccccgtgatttaattacttcccatagggtccctcccacgacatgtgggagctatgggagttacaattggagataagatttcggtggggacacagacgaactgtattattcctcttgtggccccacccaaatcttatgtgctcacatttcaaaaccagtcatgccttcccaacagtccctcaaagttttaactcatttcacattaactctaaagtacatagtacaaagtctcttctgagaaaaggcaagtcccttctgcctatgagcctgtgaaacaaaagcaagttagttacttcctagatacaatgggggtataggcattgggtaaacagccattccaaatgggagaaattggccaaaatgaagggggtataggcccctgcaagtctgaaatccagtggggcagtcaaatcttaaagctccaaaatgatgtcctttgattccatgtctcacatccaggtcatgctgatgcaagaggtgggctccctggccttctgcagctctacctctgtggctttacatagtacagcaccccccaccccgaccccccggctgttttcccagcctggcatttagtttctgtggcttttccaggtgcacagtgtgagcatttggtggatctaccatcctggggtctggaggacagtggccctcttctcacagctccactagtcagtgccccagtgggtactctgtgtgtgggctcacaccccacatttcccttctgcactgccctagcagaggttgttcataggggcttcacccctgcagcacacctctgcctggacatttaggcatttccatacctcctctgaaatctaggtggaggttcccaaacctcaattcttgatttctgtgcactcacaggctcaacatcacatggaagctgtcaaagcttggggcttccagcctctgaagccactgcctgagctgtaccttggccccatttagccatggttggagcagctgggacacaggactcaaagtccctaggctgcacaaagtagggggttactgagaccagcccaagaaaccattatttccttctacactctgggcctgtgataggagaggctgccacagaagtccctgacatgctctggagacattttccccattttcttggtgattaacatttgacttctagttacttatgcaactttctgcagctaccttgaatttctcttcagaaaatttctcctattgcatcctcaggctgtaaacttttcaaacttgtatgctctgcttcctattgaatgctttgcttcttcaaaatttctttctccagatactctaaatcatctatcttaagttcaaagttcaacagatctctagggtggggagaagaaattcccccagtctctttgctgaagcataacaagagtcacctttgcaccagttcccaacaagttcctcatctccatctgaggcacctcaacctggagttcattgtccatatgactatcagcattttcatcaaaattattcaacaactctctagaaagttccaaactttcccatattattttgtcttcttctgagccctccaaactgttccaacctctgcctgttacccagttccaaagttgcttcatatttttgggtgtttttacagcagtacccctttctaccagtaccaatttactgtattagtctgttctcatgcttctaacaaagacatacttgagactgggtaatttataaaggaaagaggtttaatggattcacagttccacatggctggggaggcctcacagtcatggcagaaggtaaaggagaagcaaaggcatgtcttccatggtggcaggcaagagggagtgtgaaggagaactcccctttataaaaccatcagatctcatgacacttattcactatcatgagaacagcatgggaaagacccacccacatgattcaattacctcccactgggtccctcccacaacacatgggaattatgggagctaaaattcaagatgagatttgggtggggacgaaaccaaactatatcaccttggtaccctttctagccataaaaagtaaacaataaggacttttatgttaatattcctgcatttatatgtagctcttataatattaaagtgagattaccttgattattttttccagagagtaattttctgcattcctcaacataggagtgaaaaaaaaactgttgaagtgagatttgttttggcatgtgaatcatataaatacaaaatttacttgctttaagggtctttgatctggcatttaatgtaaattaagtcatgcttgtaaacaagttttttctaaatctttatgagtctacttgccagagtagtaagctcttggtcatctttttctgccatttttttgcaagaaaaaatatatttcagtaaaaacataataaatattatggatcatcttctagaaaggataaatattttatatccctttcaatataagtgtgtatatttagagggaactgtgcatctcaattatggaaacttatttgtttttttcatcagcatacagataaattaatgcattagtattgtctgaaactgtaacaaattcttgacatgatccccatcctgccctcactggggataaccactattctccattataactaaacacttatttattatataagacatattatatcttgaaacttattctgataaaaacagtattcaatgaaagatattaaaatgtaacattttagtgactattcttgttaataaacttgaatagtctcaatgttgtagaagataggcattgtattgcctgtttattcattttgtttaataccattgttcactttagctggaaatattatcactttgagggatctctctttccttccttatgatatttgaacagagaaggcagctggaagcagaggcaccttttttctctgagactctgtgaagtgtacatctgtacctgtgccatctatgcttgttctttgtatttccaaaagccaatgtgaaaatgggtcattctgttcttagtaaaggagtaatattcttcctgccaaaattaatggatatcacatcattcacatcattgatcagtatccctttcatatttatattagaacagaacattgagacgtttattggatccattccctttgcctcatttcttcttatgcagtttatcctaaaatgaagatcagggacaacactgcttggtgttctgttctaacttctgtgtttgtaccttcagcatatgttttgattacagtagaagtcgcataaaatctgagttttctgcccaacttctacacatttcaggaaagaggttgttactgcaaccaacaaaaaagaaaaccaataaaaaacaaagatttaaagtagactacatcactaaagcatattgtgtttgatgctgaaatattttaaaaacatataaaatttaaaaactcatctctgataatctatttttgttttacagttctgaatactcattgtacctttcttaaggaagctgatacttgatatgaagaaactgaggcaccgaatttaggtttttgtgaactgtttataaattaaatcatttgcatcattagaacacaatacaaaattgaagaaaagattaataaaaaggcccctttcagtaaacttaaagaagacataaacagatgatcaagatatctcaatttgtttgctataaatgaagaaacagaaatagtttttcagagctgctattttattatttatgtttggtaggacattttttaaagagaaagagaaacaagactatggaatatataaccatcactcctcattcatttactctcacaaatatttactgaacactttactgtaagtaaaattgagtaaaagcacaattctttgcctttctacttgtactttttaaattgaatcatctgactcataacagtgaaattatagcccataggatttttcaacacagggaagcattatgttatgactaaacaagtacacatttaaaaagtttgattagtgggtgcacacacacgtacacacacgtaacaatatatagcatgtatatgtgtgtgtcaaacagtattatatatttttttacataagaacactgtttaatcttttgaaaggtggttacaaaccaacagaaagacatttctcttatattaactagtatgttaattaataaattaagattatttaatttctcctatcaagacttaaagtctagtaataattattacctatattaagtcctttcaatttgtgtaatatatttactgtattacatctcttcatattttagtattatattactctgaatactatcttctccaatcattggacattttcttttctaaaagtgactcaaaaagaaggcaacttttatattcttttaccttacatttttatatctcttggatcatataaagatttattttaaaaggaaaaggcaatttaaaatttttgccttataggcttataaatctctctttcccatctatatatatctatacatatagacatagatatatatagacatatctatatagatatgggcctttggggcaatttattaaaaaattctatcctctcccctgattgtactgcctttaattatattaactaggtttgcatgagatttctctgaaagttaattgaacccatgtaaaacctaggcatttggtaatcatactctttttttattattattatactttaaggtctagggtacaagtgcacaacgtgcaagttttttacatatgtatacatgtgctatgttggtgtgctgcacccattaactcatcatttacattaggtatatctcctaatgctatccctcccccctccccctaccccatgacaggccccagttagtgctgttccccatcctgtgtccaagtgttctcattgttcaattcccacctatgagtgagaacatgcggtgtttggttttctgtccttgagatagtttgctcagaatgatgatttccagcttcatccatgtccctacaaaggacatgaactcatccttttttatggctgcatagtattccatggtgtatatgtgccacattttcttaatccagtctatcattgatggacatttgggttggttccaagtcttcactattgtgaataatgccacaataaacatacctgtgcatgtgtctgtatagcagcatgatttataatcttttgggtatatacccagtaatgggattgctgggtcaaatggtatttctagttctagatccttgaggaattgccacactgtcttccacaatggttgaactagtttatagtcccaccaacagtgtaaaagtgttcctatttctctttgcctaggtggatataaaattgagttccaattctaatgtgtccagacaattttaaccatttagttttaaaatgtaataaaagataaataaacaataacttgctcagttttctttcaattacatcaatggttagaaaagccaaattcagtcagctcaagatgagttatttacaaatcagcctacttggaaacagattagcaatttaaatagctaagttaataagatccaattatagctaatttgcccatcctttctttcccttgccctcccacaggcttcagagtgtgactgctttgcatgaattcctgggagcaatggggaggcttgtggggcaggcgagtttgcaagaaaaacaaacacagtcatttttattattacacttgttgcagctgtactggactctgcagcctagcagtatgtgggggcaccagcatagcccaagtctctcacagttctaaacttttcggttaaagattatagacatatgtatactttatatatatatatgtatgtatgtatgtatgtataagtatatatatatatgtgtgtgtatgtatataaaaagtatatatttctttttatcagtaaagcttacaagcaacctctactagcataccagatgggataaggaaaggaaaggattgatacagaaaaaacatctgagattaaacacacacacacacgcacacacatacacacacaagagtatgtattatataatgtatgtgggtatattcatgtgtctacacatatgcaaaatgctattctgattccttgatttccttcctctcttatctggctcactttttctaatactccttcatttcacacttctcccactttgttttcatacagcctattctctgaaatttttcaaagctttccccctcttgtcgtttaattctgtaatccttttccatctttcaaatactaaatcctcctgctctgtgccttaaaatttttttgaaagcctacctttgttcatttttatgtcaacatctatgcctctacaatgttaactcattgatgtttataaacatctttgttttattatttaagaaatgtcagtgttatcagtaataatatattttaaatttatgagattttagaggacttttccttattgcaggacagattaactttacattgattttctcgttacctgtgctaaaatacatctgaattttatttattttgccaagcactgtgtttttcaagaaagatatttgtatattcatattacatttttgtaattgaaaagctacaggatgtgaaggcaaatagttgaggaatttggggatagacattactaagaaaattaacaaatatggcatctagagcttagaagcagcttctgctagtagtgtactatatgggataaggaaaagataggattgatatagaaaaatcgtctaagatttatgtttagggatgtgatagaacaaagcatccttaagaattgttaaatagttaaaatatctttcaaataataaaaaatagaaatagggggtgcaattggttaaaaaaatgggaaagatggtttgttagttaagaaactatattctgcacttgtacataccagatcacttctggtatgtacaagaaaaaagaaataatgtttcaagtttgatgattatttttacctttaatataacatttgtttcagacagattatattcccctgatccaggaaatgatgaacacatatacctatcaggttagccctcagaatgtttagtggacataatatttcatatacccagattactcatattttaacatcactgaatggcctttagaaaaggatttgtaatgaattagaatgcataacgtgaattttagaacaacacacctgctgaacgtcggcctctcccactgctaagttgcacagtcaaaacaagccctttcacgttggagaatacatttttaaaaaataaagaaaggggaaaaataacaaaatgaatatttaataagttcacataaggatatacaggaaataatatgtctttgtttaatggacacttaggctcattttttatacttaaattatcagttttagataaagcagatcttaagattatcagttatgttataatagccgtgattattagacagtagtcataaaaatgagaaatttacaactcagccacttcaagagtgcttttcctggccaggcgtggtggctcatgcctgtaatcccagcactttgggaggcggaagtgggtggatcagaaggtcacgagatcaagaccatcctggccaacatggtgaaaccctgtctctactaaaaatacaaaaattagccgagcatggtggcacatgcctgtaatctcagctgcttgggaggcttaggcaggagaatcgcttgaacttgggaggcagaggttgcagtgagccaggatggcgccactgctccagcctggcaacagagtgagattccgtctcaaaaaaaaaaaagtgcttttcctacttaaattactcaagtatgtttcagataattcattactactatgcatgcattgtataactagtccatgctaagtataagatgcctgggaactatgtgtatagaagatctagagtacagggaaattccttttgcttagattggctaatccaaggccaattatttgataaggttattgtacctaagtcactaatacatacctgtctatctctattctttgttgctaaagttaaggctttgaggtagccattgtttcttctagtactcaactcacaaatagtgtgtattgctggtctgagacatgcagtaggagatcggatgcatgatacatgtggttctgttcttctcccaatatacccccagctctagaggaatggtgatatcacaacagcacgaagaacacctcccaatttcctggcagcaaagcctagatgagaagcaatgaatggaaaggaaaaaaaaaaaatgaacaaacaaaatcagaaagagtgaatgtcctaaaggagtggaagtctattcttcctttcatggcccttccttccaatatgttgttaattggtcaaagggtacaaagttcccgttaggttgaataagttctgggtatctattgtgcatcatgatgactgtagttaataatagtgtattgtatacttgaaatttgctaagagcagatttaagtgttcttaccacaatagacgtaagtgtgtgaggtgatggatatgttaattagcttgatgtgcgaaaaagtcacattgtacactgtaaataaaaaacattaagaaaacaacaccttagcattgtggggattcagaacatcatgccccagaatatggccccttgacaacagagaaaagtacagagcaagttactctgaccttctcctgcctttctcccctgaaacaagttcataaaggaattctctgacctaccttgcctaaaagtgagtataacaccttcattcctgagagatcctgccctgtacctgggatggaaggaatattatactgagacacaggaaataatttgaacaaacaggccttgctgaagtttcttactgtttattaccattagatcccaccccttattgtccaatcatgtttctctacaactatccagttatttcatcagacttagcataaatgtacagtttgggggtttttgggtctttatttttgaaggttcctgtgttatgtaaaactttttaaaaatgaatttgccatgcttttctcttattgatctgtcttttgttacaggactttcagccaggaccctggcaatgagtaaggaacatatatttttctcttctacagtattcatattcatattttgccaatattctcttaaccaaattagtgaattgcagggctgtctatttccatagtagctcagttgattgttcctagtaactctttatgaatattaccttgttcttcaatgctcctttccttttatcatcagtaagctataatatttactagctagtatcctcaatatgcatctcatctgtgaataatcgtagccatgtgaagcaagcctataaagggatgacaaatctgggatatccatgacactactcccctctcctgcttttaagagacactcatcatcaatcattgctttctttttcctactgaactatgcaggcatcacagttgttcttgaccttgtgttcagacagccaccactgatcaatcagtgttagcacaaaataaaacttgctggatatcatttttctctatggtcccattctcatcttaaaacaaaaccgaaacctgaccccatgttgcatgttagctatcactccttgttctctcctttccttagctaagctctttgagtgtctacactagctggcccacttccacacttcactttcactattcaacacattgtggtctagtgtgtgtctcctgctccactgaagctgtgctgagaagctcaggttgtatggagcttgtagccactgtgtttctgcctcaaattttttcttccctggggctccctcctacttcctcttctgtttctcttcttgcctgtcttctgacaactcatgaagtgcctacggcttagcaattgttttccctgggatgtcctttgtcaatcactattactctcaggggtttaattatcactctttttttttttttttttaagacagatttttgcttttgttgcccaggctgaagtgcaatagcacgatctcagctcactgcaacctccgcctcccgggttcaagcgattctcctgcctaagcctcccaagtagctaggattacaggtgcctgccactacgcctggctaatttttggtatttttagtagagacagggtttcaccatgttggccacgttcatctctaactcctgacctcaggtgatctgcccgcctcagcctcccaaagtgctgggtgggattacaggcgtgagccaccgcgcccagccaattatcactcatattttgaagactctcaagtctatatcccctgccttagccctttctctgatgtttatttagtcttgtatatcaaaatatctagtgaccatgtcttctcagtaatccacaggaaacgcgtatgtatcatttacacatcctgtagtctccttcctacagtgatatcatcgtcagccagtcatgcctagtttgctggacacaggcattatccatcgcttttgatacatctctttcacctcaactgaatcaactgtcaagttccaaattaaatagttctttatttttttcttcttctctatttcttgtcaccactaccctgactcaaggcttataatcttttaactaatctcctactttctcattctactggtcttatatccattctttgcacttcagttaaagagaactaaatatattttaaataaacatccaaccatgccattcacttaatcaaaatgtgtggaggcctccctaataactatgcaataaaggcaagtctccttagcataaaataaatagccttccatgatccaaaccttcttaactctatctttgggtctaacactataatgatactggaagatatgttgctctttgcataaaccgtggtgttcctgactttatatcttcacccttagtgttacttaggatgccatttcattttttctttgttggtcttttatacataatttagaatgttctgtatatacttcatccgctctataaaaccttcacagaggtttcatctagctttaaatcctattctctgaatgccagtaacaatgttatttttcatgcagtgggttgcatcatattcacatttaacttaagttgctaattttagaatctaactctgaatgaggagtgaaatgcaacttgatccattgtgttcaatgttcaagaacagaagcatgatggctattaagtagggccacttgaggtggggggaggggggagggatagcattaggagatatacctaatgctaaatgacgagttaatgggtgcagcacaccagcatggcacatgtatgcatatgtaacaaacctgcccatgtaccctaaaacttaaagtataataataataaaataaattttaaaaaaaaggaaatggactatgggatcacaaatctcttagtggcaatataacgaaatgtaatattttagcaaaataaatacacattgtttggtctttggacttgcatcattcttttaggtcattctaaaagtttgtttatatacatgtatacacgtgtatatatacgtgtatatacgtgtatacacgtatatatgtgtatatatacaagtatataagtgtatatacatatatacgcatatacgtgtatatacgtatatatacgtatatgtgtatatatatacatatatatgtatatatgtgtgtgtctatatatacacatatatgtatatatatgtgtatatatatatatatacacatatatgtatatatatgtgtatatatatatatatagttttcaagatgatgctcttcagacttgttcaaagcaaccagaaataagcaatttattcctgtttctctgagattgcttttagaaatgatatataagtactagaattttttttatagtttgatactgataattgtgggctgttcttttttagataatttgaacgtaagtgctaaaattgtgtttggttttggttactttatatgttttaacttttattaattgcttattatttctactattgtttaacaattaaacatgtctgggatgtctgtctattgtgacggaaagtgctttgcatcctgtttatttcttagtgaaattcttgaattttcttttacttgcttgtcatatgttcttttaaaagtcaataatcatattcatacacttacaatccttctggatttctggactcgtaggaaaaaaataaaataaatatttaccgttcattttatttaaaaaaaaaaaaagtagggccgcagtaattgacagcatttgaaaagataaggaagcacataccccagttcttctctatacttttcaaagttgtaaatttgataaagaaagatttagataaaatccagcaaacatttattggtacctactgtgtgccagcctttaagtttattacttttaagcctaacgaaaacaaaatcaaccttggtttagtttagagaagtgaggtttagtattaaaatagaattaacatgcagaccagcagggattctttaagacagggatccccaacccccaggtcacagactaggaccagtccattgcctgttaggaaccaggcaacagcagcaggaggtgagtggtaggagaccgagcgaagctttatctgtatttacagccgctccccattgctttcattaatgtcttagctctgcttcctgttagatcagtggcagcattagattctcataggactgagaactctactgtgaactgtgcatgtgagagatctaggttgcgtgctccttataagaatctaatgccaggccaggtgcagtggttcacacctgtaatcccagcactttgggatgctgaggcaggcatttaagaccagcctggccaacatggtgaaaccccatctctacaaaaacaaacaaacaaacaaacaaaacaaaaacataaaaacaaaaaaacaatctaatgcctaatgacctgtcactgtctcccatcacccccatatgggactgtctagtgcaggaaaacatggtcagggctcccactgattctacattatggtgagttataattttttcattatatattacaatgtaataacagtagaaataaaattcacaatacatgtaatgcacttgaatcatcccaaaaccatcctcacacccccactgatccatggaaatattgttttccacgaaacccatccctggtgccaaaaaggttggggaccactgctttaagatgttccattgcctccatattcacttaatagtcttgtaactgtgaacagaaaagttggctatcccgtcatttccacaaaactttgcttttgattcttcctttattcttactcagtggttcttactatgtagaatgcaaaatcatcaggacaatgatggtgtacaagatgttatatattggatttccatggatgatttaaagtatttacagtcttttctctatatgccaaatgtgcttacttagactctgttatcacttaagatgggatgccagttaagaagtaactccatgatagctatcaacactagctttacagatgacttcacaattacataggacactcctggaaagcatgaacatactcttatgtatttctgtatcctctaagcctaagttagtgtctggaatgaattaagtgcccaataaatcttcgttaaactgaactaaactggaattcaacactgctagtacccaagatggagaggatctactgttctcttttttgattgttaaccactcatttattcttgtgctggagagtctcacctcttaagaggaacccactaggttctcttgtgtgtgtggatacagagatttcagaggcctggcatgagaagcagcagctttttaaaagtcattttcaggaagaaagcaaaaataaatgaaaagttgaagttgatatgtatataggggtgatgttactgggtttttaaaaaaataacaaagactgatggggtatgaatataatgctaaatatttagtatgctaaatgacaaattttattattttgatgtgtttatacttcagtgtaacaagacgtggccagcagtaaccattccactctgatcttcactaatctgcctttaaatagagtgctggtgatttcccctttatcattttttattacgtctatttgattcttctttcttttcttctttattagtcttgctagcggtctatccattttgttgatcttttcaaaaaaccagctccaggattcattgagtttttgaagggtttttctgtgtctctatctccttcagttctgctctgatcttagtcatttcttgccttctgttagcttttgaatgtgtttgctcttgcttctctagttcttttaattgtgatgttagggtgtcaattttagatctttcctgctttctcttgtggacatttagtgctataaatttccctctacacactgctttaaatgtgtcccagagattctggtatgttgtgtctttgttctcactggtttcaaagaacatctttattcctgccttcattttgttatgtacccagtagtcattcaggagcaggttgttcagtttccatgtagttgagcgattttgagtgagtttgttaatcctgagttctagtttgattgcactgtggtctgagagacagcttttgataatttctgttcttttacatttgctgaggagtgctttatttccaactatgtggtcaattttggaataagtgctattcctcaaggatctagaactagaaataccatttgacccagcaatcccattaccgggtatatacccaaaggcttataaatcatgctgctataaagacacatgcacacatatgtttactgcagcactattcacaatagcaaagacttggaaccaactcaaatgtccatcaatgatagactggattaaaaaaatgtggcacatatacaccatggaatactatgcagccatgaaagggatgagttcatgtcctttgtagggacacagatgaagctggaaaccatcattctgagcaaagtatcacaaggacagaaaaccaaaccacatgttctcactcataggtgggaattgaacaatgagaacacttggatacaggatggggaacatcacacactggggtctgtcgtggggtggggggaggggggagggatagcattaggagatagacctaatgtaaatgacgagttaatgggtgcagcacaccaacatggcacatgtatacatatgtaacaaacctgcatgttgttcacatgtaccctagaacttaaagtatattaaaaaaaacagagtgctgaacccatctttttaaacatctttaaaaaaatagttatgttgcctgtggagttttagaacttaatgtaatgaaagtactatctttctatgaaccttacagtttgtttttgttgtcatttttaccattatttgataaaggtaagtagacaaatagataacacattcatattggactattcattaagaggtctaagaagaaaggtactcttaaattcacaagtggggactacaaagcaatatgaaaatgatcaggatttccgttttaatgaaataatggaatcacatttaaaacattattttatttttttccaattaaaaaaattaaaaatagaaaactcaaaagcaagatttttattttctgaaatatatatgtattgatctgttccttcattgtattgccatggttgcaaaccaatgaaggccatataggaatagtattaacaatatttcctctctggtaatgtttgtttgcctaatgttctgtttttatatgtaatattttatgcgggattttgttctttaaaaaaaaatcaataaagtgccattgattaacaacaaccagactacatgttttagtaaactgaaccactttggctattactggtaggatagacactttttaatataaaatgctgagccagaggaaagcaaatagatttctctttcttttagccaaaatgtagagaaaagagaggcaaatgattcacaatataaaaagtttaaaaaaatcacacaatgaattcgctacttacaaatgtacaggagtaacatattgtctggttctcagggacttgttaaagggtgaagattagtgttctgttatgtagagttaattgtgttgcattaatgccttaaaataacttggatgattatgtaaaaagcagtttttaaatgtcggttagaaaatatctcagtaaaagatcattttgccctcttcttactaattataacacttaaaagatattatttaaaataattaatggtatacaagtagggggaagaaagctaactattgtgttttaagtggctgtttatttagagcccttggacatcaattatatctcacagttataaatgtactttctaagtagcattcagaacaaaataatgtgagaatttttttgacaaaagttaaatcacatttgggatactgaaatgaaaattgatgaccagattgttgatggacgatttcattctcactaagcgagcatcctcccactaaacgaaagaaaggtctttgcattattaaaagcccattctgcaacactgttgggaatttggttgggtcatgaatgctggcaggttgtcagggaaacaggaataatgcactgaatgcatggtcttcttataaaatgggcttaatattgctacttttgattttctaattgctgatctagaatttctaatagtaacattaaaggagaggaacatattttctagtttaattacatatacctctctgttggcttagtagtaataaaaatattttctgtaggtgtagaatatccttacagtccaaaaggagagtacatgttcacaattaaagtttgaaatttgtgctttgataacagcatgttttattcattcatttttataataatattactgagcctgtatcatatagtgatgaacttttcagctgttttgagggtttgtgttagccacattcacatttgtataacctgtgtttcttttttatttttctttattttcattttagatttagggggtacatgcgcaggtttgttacaagggtgcaccatgtaatgctggggcttcgacttctattgaattcatcactgggtaaacatagtacccaataggtattaacagtttttcaactcttgcccttctccctccctccctcttatggagtcctccatgtctattgtttccatgtgcacccattgtttagcttccacttataagtgagaacatgtggtatttgattttctgcttcagtgataattcacttaggataatgacctctgggtccatccatgttgctacaaaagacatgatttcattatttttatggctttgtaatattctatggtgtatatgaatcacatttttaaaattcagtctaccattaatgggcacataggttgattccatgtctttgctgttgtgaatagccctgcaatacactcacaaatgcagatgtctttttgatagaattacttcttttcctttgagtagatacccagtagtgagattgctaggtctaatggtagttctgtttttagttctttgagaagtatccatagtggtttccaaaggagttgaactaatttacattccctccaacagtgtaaaagtgccccatttttttcacatcctcaccaacacctgttatgttttgactttttaataatagacattctgactgctgtgagactttatctcattgtggttttaatttatatttctctgaagattagtgatgttgagcattttttcatgatttttggccacttgtctgtcttttgatagtttgttacccttttttctaaccacttgtttagaaggaggcttgggagagtccatttccaacttactttctctgagacaaactgactttcggatagcatgactggacctcatatagtaactacaagtacaagaaaaaatgtctaatatgcttcgattgcaaatatgtataattattttagtatacagaaatgcaagaaaatacagaaattgagcatccccttcaagagatgctaaggaatcctaaaatgggagaaggctataaaatgcttgttcataaattagtatttgagttttccaacataaaaccaataatctggccataaatagttgaatgcttaaattgtgctctaacatcattgcccataagctaataaaccttaactgtaaattagagcacattttatggatatgacaaatttatccagaagaatacctttttcctcagcctgcttaagcaagccttcaatgtctctttaattaaacttctaaaataaaagtattatcctcatctgatcctggaattcaggaccctgcattagtttcccccgaaatcattcccagctaatctcctgtagtttccaactgcttgctttcttcagataaacttatttcccagccactccacttgcttgctatgagtttctgtgcaagttctattatgtccctttattttatctatgacttggtctaaataaaagtgatgggcacacaaaagtgcttagtaacttctagccattgtttttatcatcattcccaactatgtgattaattcactctacttctgctcaaaatgtctcacatccctcttgccaccgttcaaaccctgccgtgtttcaaagtaatattaaaacatttttcttttacattgtttgtgtgcaagaaattaaagacactgtcactgtaccttagtactgcttatgagttgggaataaatgtgtggagttccccggtgatggcagaaagggcaggtcaagtgtcccaagaacctcaccaggcaggagtatttgataataatattcaagggaaaatgacaactgttttgaaaagcatgccattgtgataacataaactcagtttagaatcatttggtattaaaagaataagtaatggatattgtttcttccttaagattcacaccatgtgggtactgtataattaggaattctctgttatgcctcaacccacatgttatatccatattaccattgatttcatagccgcaaaacccacattgtgtctggcaggcaggacttttctccacgccagattttcaggtaaaaaatcttagagtatggttgtcgaggacatgaacttgccttttacctaatttactgtttacaaacttgtgtggcatttgagttatgtattttggtttgaaacacaaatattttcctttgttagattcagctaacagtatttttaacttgttttcatcccctaaccaccttgctgaaatttcagggagactgggttcttctggttgccatttccattgtaatttccttatggtctagtcaaaatatttttatactgtgtttatttaaaagtgaaaaagttcctttccatccagcctaaggggatagtatctttagaaccaagaatctttcatctcctctttcactctaaatataacggatacttatcttttattgagggaactaaacaaagagttcatcagctaatctctctcgtgtgtctattttaagttcctttacaaacaaaatattttacagtcccaacagccataaaagaaattcctgaccttgcccatttttgagagactgggaagtcaaactataccctataggaatcagtcctcaaaatcatttcttttctacttcagaagtgtgtatgtgtttttttaaaaactgctaatgaaagcattacaaagattagcttttgaagtggcaagcagctttcatttattttccttctggtattccctcagcctccagctaaaatttagaaccttaaaaatgttgctctttggtactaaattcagttgatattctatcaaagtgtatttggtttatcaaagcttcgttcttatcttgcaactcagtattcccgagagaacactagtcaggttagaactgacaagcctgtgtctagtcctttcaaactagaatgcactccctcacctactgcaggtctgcttacctgtgctggttaattctttctcccattgtcaggcagagaggcgagtgctcacaatgtggtaaaagaggaagtgatcacttccaagaaggaaaaccgatcagagagtcacacagaaattaatggcaggaagaaatacaacatgaaataagtagattcataaaatttagaagatttggaaatgttttttgccatactgtgttactacctaaagaaggaagctgtatctttggttcttttaatgacatctgacatggaaagacttggacactaattagataccagtgataattttatatcaataatctttctcttcttgaatgtcataaattagcaccagtgaaacttattttcatatttcccatatgtcatttttttctgtcagagtcttcagttattggttcctgaaaaacatgtgctatttgtagatttttaataagttgtctcattttaaaaaaattctaacaaattaaattcggtcatggaatcaaattggattaagtcagtattgtcttcccaatacatcaaagagcctcttgagacagatttggaaatgacataatctttcttggaggctttgttgacccttgggtgccatgttataataacatttgtccgaagactacagttacggaattccaaaggccagtcgctaatatttatctgaaggctacaatagctatggatccttgaaattctataattttctgagattatgatagaacaggtaaattccatagaatgatgggagcaacagtcaacttcaaagggttgaaagcggaaaggtagtataagaaatggaagtaccaggtgaaagcctatgttcaacaagtttgacgctgaaggaaaggcccatgattgggcaaaatttagaagttagcgacagcaagattgaatggataaacattaaagtagagctgctttgttaaagtaagggtcatatgaattccgtaagttgtctggtgagggctgagccttgggctagtgtatcccctgaagggacacaggcttgctggaatcgaggatagtaaaaatgagagatcccttctcagtataatattcaaatcaactaacatgaccacaaaattcacactaatttagaggaggctaaaatatggtgcgtgatttagtgatatggtctgcaattcaactgatgtgaaaagtttttttttttttgagtctcactctgtcacccaggctggatgctcactgcaacctctgcctccagggttcaagtgattctcctgcctcagcctcctgcgtatctgggattacagacacccaccaccaggcccggataatttctgtatttttagtagagacagggtttcaccatgttggtcaggctggtcttgaactcctgaccttgtcatccacctgcctcagcctcccaaagtgctgggattacaggcgtgagccactatgtccggcctatgtgaaaagttttattttcacttgattgttgattattgtgggctccagcatccacctggaactggacatttaaactgcatattattagaaaaaaatatgagacctaggaaagactgtatctaagttttggcacatataattacacaatcacctactccgaatttagcttatagtttctatatcataactggctcaaacaagaatagattcaaaaccaatttttgtaatatataactttaatgaaatatacccaagaagtttcattttaatatgtgtttacatcagaacttggcacctttgttagtactgtttccactgttatcaaaagcaatttcacagaacagttcaatattttataaattgctgtaccagaacgagggtgtttaaccagcagtgtcttctctccctcaggaatctctgataactctgacaattttaaatcaaagttctctttcagacaagttttcatggtcatgtttaattatcaggagccttttaattctcatatgtatgatgtttttctcatataaaaaggacattcttacataggatctttttaacatctgttttaaaaaaagttttatagtatttacctaattggcacatgcttattttacaaatacacacaaggttgctaaatattaatgttaccaataaaatttttaaaaataagaagaagaaataccaactctgagaaataacattatatataggtcaatacatattgaaggccaggatcacagttttattatatgagttaatatatgatagggcatgtagccctcagcaatcctcttttcaaatatcatggcttatttcaagtgtttttagaattacaaaataaacaatttctgtttgattactgcaaatgcgttatatatatttatatatatgtctatgtatttatgttgtatatatttataactttgaattttgtaattcagttattattttacatcttcatgtagactacagaaatttcttaattctacattattttgttttgagttgctatcattaattgacatgtattgtttttgcttatattcaatcgtttacttatttattcagtgaatatctattgactgcctttcaaaaattgggcatttaattttaacaataggcaattcatgtcttgtttagggaaatgaatgatttttatatattaattataaaatttgccctttgctggtattatgttagtctaaaaatatatttttattgtttatcttaggctttatttttacctaaacttcctacaaaaagataatttcatctttttcttttaattatctttacttagatttctctctattgactggttgcggtgactattggttccaaaataactgtaataattaatagtggacatctttactttaacaagaatgcttcttattcacaaagcatgcttctagcttttgttttaacatacacctacatgcacctccattcccaccctcaccaccctcaacacttaacacagaacaagtgtgtgctgataatctggattcagtaatcaatggctgttatttattacaagtggtttgtttctttttcttatccagacctagctagagttgacctattaaaacatgtcatttatttacagatttcctgaaggggagtgagccttaaattttcaaaatgagcttcacttagacatattttattattttcatacgttgtgcaattgtatttgctaatattttatttaggaattttataaatatttatgtaagattttgttatagttttcttaattctttattcccaggttttatcttgtgtctttcttctgttttcctgaggtttcattttgcagttctttttaaaattcccaagttgaatacattatatagttattttcattcttatttgtgtattaagtatgtctgaagctataaattttcttctgaatactgctttagtcatagcttataggtttttagattgtagtattctatttcctctttgtcataattacctcagatatgactattttgaagacattttaatttttgttgtttttattagttcctggtttgttattatttattattattagcaaccatttactaagtatttatcaaccatcaagttatgtgctaagcctttgcttgatgatattatggaatgaacaccagataactatgatataggtgttttcaggtaagaactctgggacttcctatatatgcatgtggctcttcttgcattcaaattcttaaagctgtgttaccacgaacaagttacttaacatctttgatctcagtcttcccatatataaaaagggaatgaaagtggtacttatttcagtgacatgaaaagtagtaagtcattaccacaggaagtattagtcataatgataatagttaaacctctgtcctagttcatagagttcaatgagtggcagaggtgaacagagcctcattccggttttcagggtcttacactctatgttgtacaactattgaaggactcattcccagtttgctatttttgtacatttttatttatttgtatagttcagaaattgggagagtaatttgtaattgtgctttaataagaccacattttaggaagtcatgtgaaaatacttatgattgagccataattgttatgagagcatcctctactttatggttattgcaatatctattgagctttctttagcctttggttcataaggggaagcatcactcctgtaaacattatcaactgaatggagcatgcttttaatgatcattatccgcacatcatctcatacaattgtgaggacattgctgccttataactgtagtaacagaagcagtaaaggagacttctgccttttaaaactgtgttggagaggcagaaattctgaaaacgtaaggccaaattgagtttgttcaaactaaatgcaaatacttacatttagttaatttaatgctattgatatttttatttgttattattcagttttttagcactgatttcctgctttgcattacaaacattattttaaatatattagtctcatgctagctaaaataaagtcagattttattacaatcagaggtcgaaaatccctgtatttgtggcttgagtttgtttattttactactgttttgctgtagttacactgaataacataaaataacatttttgttgctattaataaagtagaaatgttggcttttagatatgtggatagagcaaataaaaagggaaaaaaacagtttatgaatttgttcactttcataatattgtaaattggaatgaatacaaaatcactgaattgtaatgctgttaaaaattatttgatgaaactaagttcaattttaacctaatcaatagctactcattgataagattttcctgatgaaatttgttttctgaaaattggttctgaaatcttagttgcttaaatcatttgcaagaagaaacaaggtgtccatgcctttccttagggggacaaactgatatagtgtttcttgctacttctaaactctaaatataatggaataaatgaaattatttctttgttttcaccatctgaatgtctgagaatcccacaatgacattgaagagaatgattttgattacctcggacttaccacggaaagaaaagtctgacttcaaattgtgtcttaataatagtggaccaatgtttttgttaaatgaaactccacctgcccctcaaactattcttgtgcttcggcttatgtgcttgatagcacagtcacttctcacctaattgttgccatagtgtttgaagccagaacataaagaagcatcatgttcagaaaaacttaaaagtatggcccttgtcagtggtacttatacccctccagactgacaaatggttcctgaagctctagagcacatggcaacataaccatattaatgggtggtccagccagtagctgccaagggcttccaaatattattgcattatttagaagatcatttccttattctactccttacagaatttggcaaatataaattggcttcaatattcactttactcgtgggggaaaaaacccacaaactgcaagagtatatttactacctgcccatgcctgcaaattttgtggtgcaaatacagaccttaaacttattctaagacctgaaatcatgtatgaagctgaaactggcagttttgcccacagaaatcttgacaccaaatgaatgcatggtatagagctagttaacaggaataaatagtatgctcaatttcctatatttctaaaattttaagaaacttggagaatcagaataaagtttaaaagtgaaccgaaacacctagagtgtcccagtgaaagctagaaaatgatttttgtatttacgttcatgtaaattaggtttttcctttgtaacaggaatttttcatattaggatgaatgttaggacaaatggaaaaagcctgtgaatgaagttaatttcaaataaaataacttgcattgacatatttaatatgtgtaataatttgcttattttgatggagaactaaacaatattttaatagaaaatatctgtttttctcttattcctaataaatgttaggcagatttctcaggctgggggcaggttcacacatgtaatcccagcaatttgggaggccgaggtgggcggatcatttgaggtcaggagtttgagaccagcatggccaacatggcaaaaccttgtctctactaaaaatacaaaattagctaggcatggtggcgggtgcctttaatcctagactactcaggagtctaggaggcagaggttgcagtgagctgagatcgcaccattgcactccagactgtatgacagagtgaaactctgtctcaagaaaacataataataaaaataaataaatattagacaaatttcttaaggatatttatttacaggagtgctaaaacgttctcagattgtccaccatctaagtcctaccctatatgacagtggctaatctaaaagttttaccttttatagatatcaaagctgccttaaaaaggtaaaacaaatcaaactttgcatataaactcacaataaacaaggtgtcctatagcattttggcagacaatattcattttgagaatatttaaaataatacttcttaaaacagaacttgccaaaacacctgtcagaccaaacaaccagatggtagctaagatcatatgtttttagaatcatggcttttaaagattatggagtttgaagaggattttagcagattgtcttacattcctagaatgctcaactctcaaatctattttgaacatatctcatgtacagcacactgtggcaggcactgaggactaagaaggaatgaagtgttcttcacttgaatacactatgcatttgggatgttgcacaacaatggatcatacacattattaaacactgacttccctggtgaacggaaagtaagacaaaccatagtgtattgcaaaaggtaggaactatgtattagttatctgttcattatcatgtagacaagtattccagacctaaaacattgacttaggcgagtgagcagggtatgatggaaagagacagattggcagtcaagagaagctgctttagatcctttttcagctactgtaaactttagaaaattacttaatagtattttacattgcaaaggaagaggctaataatctctaggacttctccactcaccattattatgtagtaggattttataagatggtccaagtattttttaatggttaccattaataataaaattagttttaggaccaaaacaaaggtaattttccaccctaggcaaagttctaagccttctgcaaagacgggagtaaaatcctccatatataaaaactgtggaatgttttccacagactttgggttggtgttattctgaactagactctcatcgctctcccatctcagaaaatgtccagtttacttcaggatgatcagggactaccctatgaagtagttctcccctcagtaactactactactgagatatggacatttctttgcatatagaactgtggagggaccagtcccaaagactggaagtttcttctgaggactatagccattcatctcatggttgtgtctgatgcatagactgttgtgattcaatgtacactgttgagccccaggcccctgtagagccctttcagtgctctttcagcattccctctgtgttaaacaaggccattcgcctagacagagtttaaatggtatttttgaccttctgctttgcaggtcaattgctttggcagactactaacctttcttctgagtgcagatcagttatcagtgttttctgcaacatcctcaaattatcattgaaagatgttgagcttggaattttcttacttgcaatagagaaataaaatcagaaaacttctttttaatagtagagttaaagtttaggagacatagtcactataaggaaaataagtaagtcttttactttttagcacagtttgactcccacaggcacccaaaactgcgttttctgatattttggaagagtagaagctttgcctttgtgcttggaattattcagctgagataattttgtgagctcatttgaaacctatctcttccttaacaaagttctctttttcatggcattattcacctttatatagagttatttctttatacgtcaaaactatctggctaaaatatatatcaatatattctaatatatatatagaatgcatcaaaaccatgcatatatatatgaaactactggtctgcaagatttatatattctaatgtatgatgttgatgcatttttttcttcactgatctgttataatctcttttatgtcattggagctgaataaatactggttgaatggattagggaatgaatgaaagaatgcatgtcctcttgccatggaaaaatggaaaggtgttatgaaaattatatagtgcgatagaaagagataagaactggtctgttttacacttccaattaatattaaacacattcttagaggaaatattcacaaatgtggttgtaaatgcagtttgtcttctcttgtttagaaaacaatttgtgtctgcccttgtatgaaagatcagtgaaatcctcaaaattaagcacttaatgctcatcaaatagcaaacaaggtctgtagcctagtaacctttgtctgcattgaaagattagaaatgaaactaaatggtgattcatggagacggtgattatgtgtttcagtttattctaatgtataaatgacacttaaaccatgttctataatttgaaattgatacattatggctttaaaaggttactaacagtaatccgtatcaatctctggccctttcagtaaatatccaatgtttaacttaatagcttaataatcttttcatacattactagaggggcatgtttgagtttaaattgaaataattatgaaattcacaaacttgatttaagaattgggtctgtctagaaattaaaacttgtaagtcttttgtgagcctctggcttagccacgaagtacagaataaattaactaattagcaggcattctaataataactcccaagttcaaaagagggaagagaacaatgtattacacattatctttttttttccataggttttcaggaatttgaattcaatagtagctttaatgaaattggccattgtgggtttatatctgttggagtgaagttattatcttaaaaactactcagtctttttacatatatatgcagtatgctactatataaataatacctttctttttgaagtgatttaaaagaaaaatgatcctacctagtttaagtcaatccattttctgagtccttgggggaaatgatacaatttcacataccgtattcctggaacactagtgttccactaaaaaaggattccataattaaacaaattctgtaaatactaaataccattaccaattggagaatcacagtgcacattagttcctttaacattcaccgataaataaacttatttaactttgcttaacccagagtttcccaaactcttttgaaccacttgacccttcttgattctgtataagcctttttaacatttcttagtatagcaggtttcagtggaacagaatttgaattaagcaataaagagttgatcttacacacttgtttttgtatattgtttgttatagtttggtctgcaagtgtgacacaatgagagaagattctgctacctgagtatgagaatgcagacattgagttctagggtcttctccatctgatgagtgggctctacatctgatctctgacatgcttgctgaaaagctgccaaggagtacagtaggagttctatggtgtacatcatgatgaacaccatagaactggagaatgaaaatcacaaagaaatataacttttctaatctatgccagaatgcaatttctaaatccaggaaagtatattggaatgagaaaatggtctacaatttgactgaggacttgagtttttggtttttggtaagaggatatcttaagctatcaaaaatgccttcgctgttttgtagaaagctcattcagcatgtcagaccagagttcatgtgcccaatcttaggtttggggcaaaaggtcactatctgtactgcttccatttccttatgatatacttttttgttaaccctttacaatccaattactttactgtcctggaagactctcacataagtataatttgtgaggtggaaggtctttgggtttgccatatgacacagtttcaatgaactttgactgcattgtccaatctggagcctctcagatcttggccctttcctaaaaacaggttgtatttgccacaaataactatttaggtaatctgcaaatctcatgtattagtcttttgttgaaagtcagtacaagttgtatggttttcgtatgtctataaaatgcaaggacagtaaaatatagagtagaataaagtgagggaaatttactttctctctctctctctatatatatatagttaaatagcaaactgcatgatcttaatgaggtaagaatgttgtcatggaccctacactaacacacaaaggaaagcaacataggagatagatagggcttcctccccggctattaggctgtgccttttcagagcctgtgctgtaaattcaggcaatgcatttgtcatccacctccaaagactcagtgagtagtatcagctctggcacccaggatattttggatagtgacagataccttctttaagcagagggcaggagcagtgtgtgcaataccaggctaattcttggcactggatttaacagtgatgaagagagagtgaagacctttcatcaatccatctcttggcatccagcaatattcattttattgctgtataaataatcaaagcagtggcttgcctaggaaggtgtgttatttctcattttggcacacctgaaaaaatctcacccagctctcagggtcccaggcctatgaatcaaatactaactaggtccagctggactgaacattgtgcttcatatgtatttgaacactctcagatgtgaacatggatatcagttatcaattatattattttagtctttggcatgttttatatttctgtgggattaaacatcagactttccaacatgcttgccttgatggcttctggtgcctcttctgctcctcccatcctgctgagcccttgcacactgcccctcattggatgctttcctctggttgctcctgaagagggatatatcccaagatatgcaaataatattaagctacactctaaatgcaaggatcaagctattttggggcttttacaaagaattatacagaaaaggagaagagatctggatcagagttacagcactgaagtaatcattatatgggtggatagaagaacctattaatattagggtggctgagatggtttcatgaatataataaataagaagaaaggcaaggagagccctggagatcacatgctttgtgtgtgcacaattaagcaggattttatatcgctgatattaaaagaataagaaagatttaactatttcaggaagaattttctttaatgactactgttgaaatagtatcagtaaacattccttcctgactgatcaatcttttcttccaatagaggagaatatgccagcatctacacaagactgacagttactttgaaaatgtgcaagagactaaaatgccttccaggatttaaattcttggggatatttctgtgatgtttatcaattgattgaaagcaattttcattttgaaataaataattattggaaatttcacctgtcaacagaaaagtaaacaaagtaaaaaaagcaatattttcgggagatgcacagaaaaattgcttactgctgtcacagtaattttcttaagtgcatggctcagtcgtattaggtctttttgggtctctattgatcattaaaggctggaacatttaataaattaaacatggcttatgatatgagtttatcaaatgttcttaaagagagtacgtagaatcagtttgaaaacatactttctgtagtgcttattgtttagactctagatgtattatttataagatcacataagttttaaagctcagtttattatagtcaacattgatttctatgttgtcatatccttggcaatttttgcatcaattctctgtatttattttctcaaatgtggaaattccaatatttaaaattacaaggaaggaattttacacgtaggtttttttgagtcatatgttttttcacacatggcttagccttgtttctagcatatactaagtgataaaaataaatactaaatgattatgaaaagtaggactttatgcattctggactgaaaacaatgtatggaaacattcccaaatatatactctaagatgcaatgaagggtcctaaaagcttctgtgaccctgcctgtgtatatcatccagatctcttccagatgtttagagctcccccgggtttatgaagagaacctgaaggcaaagtcaacaaatgtagctactttgtctgtccatcaaagtacccatttatcactcggtccacgatgaattacagcagtcccctgttatgtgcagttttactttctgtgatttcagttacctgtagtcaaccacagtctgtaaatagtaaatggaacgttttaaaaataaacacttgatatgttttaaattgtgcctcattctaagtagcatgataaaatctcacaccattccactccatcccacctggaacatgaatcctccctttgtccagcatgtctacactgaagactcactacctgcccattagccacatagtcgctgctcaaggatcaactgtcatggcattggagtgcaggtgcaagtactcttgcacccaaataaaggtccatttgacttataatggccccagagtgcaagagtagtgataccagcagtttggacgtgccaaagacaagtcagaaagtgtttcctttaagtaaaaaggtcaaagttcttgacttaataagttaaaaaaaacatatgccgagttttctaagatctatggtaagaacaaacctatccatgaaattgtgaatagggataaagaaatttgcgtgtagtatatatggggtttgtattatttgagatttaaggcatccactgtgggtcttaaaacacatccctcttgcatatgggggagctactatcaatatagtggcaaataatgagccaattgggaactgaatagtgaaatgtttaccttgaccccatgaagtttatagttttatagggcactcacatgcattgaggcagtcattattaggatagtgagtctttggtagtattttactaatgaagtatacaataagggcatttcacttagtctgactggtcaaagcgttggaggtggtatctacagaagaagtaaaatatataatcttgccttcagtgagatgaaagagtagaacctgtgtcacatccttcagttgtataatacacaggttcattacctgcattgctcctcccaagtcttaatatattcactacattactgagaaagctgggtcagaagctcccttcagcctggcttggggctcagtggttttccttgtataactctattgtacaaaaagattggcaaatgaagttcatttggtgttatatatcccgacttaccccaatccatgtggtaactaagctacagtacggtcagtttgtgcacttgcccgcagcacaaaaaagaaaagctaaatttatttatttattgtgatcacctttattccttagtttaggtagggactgtttgtttacttcaatccaacaatgtaattcagttgaaagcattttatttttttctattttccaaaaacttgagtttttcaaatgacacaaactctaaaaattagaaccaggactgagtagaatcaatcgtacctattgaatcaatgagtgatttgggaatttggcagatgattaagatcttcaaatgcttattctttattccttttgtttttcaaagggaaagaaaaatacatgtgattcaaaactagcttgaatatcaaggatacacctttgaagtaatcttttaacaggttcaatttatagcatataacagttgtgaatagaaatccattttattttataaactatttaaattattttaagtgaattcctgtggctaaagccttgtgttttgtacttgcatttgaacagacaatattttaatgatagtcatggtgaactttatagacattttttgtgttcttaaacttccccttagagcctctctgcatgcattaggattaattagataatgtctcccaggtgcttagagctttttggagaaagggaacgaagcattgtgttaaaatgattattactgacttcaaagacagttacatgagagttcagaaagaacaattttttaataatagtgactcataaatgccattgagatatagcattttatgatgttaccagtggccatttatttttgtttttttaaattatactttaagttttagggtacatgtacacaacgtgcaggtttgttacatatgtataaatgtgccatgttggtgtgctgcacccattaactcgtcatttacattaggtatatctcctaatgctatccctccccgctcccccgaccccacaacaggccccggggtgtgatgttccccttccttttaacaagccaattaccttctttcttattccattaaattatcatagggaaggatgtagagtttgcagtgccaagttacaagatgagatgcaatgaatggagtcaaaataatttcattgaattggtgaagttcatcaaaggggcatagaatgatgttatccttggtctctctagaagcattgggttagtggtacccaataaaaggccaaaagcagataaaagtttatctaagaattttgcttcttatcggtttcaagaatagagggtagatggaagtggtgccactaaaggaggaaactcaaagtagtcaaaagtgccatgtgacaattaatcactagtacctcctacagactgcctgggaggggccaagaagcagactcctggactaggtggtaggttatagtccatttctctatagggtttattgaaaatgcagcaatatcaacaatacttttaataatggttattttggtataacactttaaattttacagaattttcacacacgtattatttgaccctcagaacaacactgtgaagtaggtgttactctgaccatgttatagatgaagaatctgaggctcaaataatttactgatgttttcagagatacgaaatttataaaagacgtaggaaggattggaaccaagcttttcttataccagtgagtgctcatttgtatacacaactatgggatggtagctcccccttgggtaagctagaacaagtagtaatgtgggtgtgtggaactctgtagttgatcttacgacatgttttatgtttattatccatttattttcactaacctcttcctgatgatattaaccaaacctcgaatttacaagaaagtcttcttttccaagtgtgtttcaactgcctttcattgtacctactcaatactactctgttgttgtataaaggaccacctgatagaaaagctacagaaatgaataaaatgaaaaaatgagtaaaacacttttgtccaaaagtacaacaatataagcttcacaacaaaagctataccaaaagaataaggtgtttgtatgaggaactatgggggatggcagaatatggcaaataccctcagttatcttaccaaaacaagtacttaaaggtattcaaagagtggtagaggtcattttcagttagcatctggatgaagaaagtcaggggacaaaaagtcttgtattagagggcatatgtgagacagatgtttatctgcagggtttaactcttttggttaatctctactccagtggtctgaatgtaggaaatagaaaaggataagcaagtgaagactcagaaattccaatggaggccaactgaaaagagagggagagtacgggatggagagaaggtgagggggcataaaatggaatgggtagagatgtggatgagggaggaagaagttaaatggctaaggtgtggtaagaagcaattataattaacttttaaattttattttattattatattttaacttatattttaatttcaggggtcaatgtgcaggattgttacataggcaaacttgcatcatgggagtttgttgcacagattatttcatcacccaggtattcagcctaatacccgttagttatttttcctgatcctctcttaaaatttaacatctggggtgggggcctacaatgtgtgcgacaatacaataagcaagtgaaaatgccaaactagaggagaaagctcacagctccagaggtgaggtggaaaacggttgaaaggaaaaaattgaatacattgttaatcacacatctcttctttgtctgtgacatcagcatttgctaagcattaaacaccacctgtcttaaacctcggcaacaggctgtttgctatacctccataggcataggtagaatcactacattattaagttcccaaagtccttgtcaaagacaatttatgattctggcagcccccaaggagaggcagttttcttatcttgtttaagcagtgctctctgcttaatcctttctgtgtttctaatgcacaagaagagctagtttcctaaggagtggatttggtccactcaatttttagataatttttccttctggaaacagtctcctttctgtggtaatgtttgaaatgggtgcaggaatgagaattttagattgtttctaaaaggcttgaggaggaaaaacatatatatccaagaatcattaagttttgaatctggattagtctgacagttacaaggttctaggactggtgagttcattgtgttacaattgttacccatacaaatttcaaggtccctgagactggtgagaacaacagtaagactgatgattaaaaatttaaaactattggaagatggtacagtctatgagtataaggaagggaagaaagtagttaataaattgattgcatgaatagaaacaatgaatatttctatctggtaaagcattttatatgtattatctatgtcatcttcacaacagtacttcaaagaaaagtcatagtgagagtcattggaatttggataaaatcaaattaggtgtaggtggggagataagtttcagtcccaggtcttctgatgcaaaggcttgtttttctttcattttacattacctctttagtaagttaccaagagaacaaaggtgggagatcaagtaatgagtttctgctgtgtcattgcactggcacactgatagagaaagcctgacagtgtaaaataggacagagtaggtgaaataagtggttggaaatggtaggatatatgcctaaggctataacagcagacatcaggacagcattgagaattggaccaagggcctaagcaaacacatttcattttacaagttttactcaggcagtacctattaaatattggtgagtgtattgcaagagtattcctggaatcttcttggactaataatattaaacatgtcaataatgttattcgaacaaatgatcaagctagggaaatagcacttccatggtattggccagcttcctctcttccccctcactctagccatagagtcagaatgggagatttatctcttagcatgactctgatttcctgatcagagatcagcaaaggaaggagtgggccccttagccattgtgggcaactcctagaaaaacacacacatacacccctaggcattcctttcaggttgccggagacaggatggaagatgtggggaaggagtccttgctacattcaggtccctagtttgagggatttggctttgttactgcccttcctctggcttggttagattaatcaacacttcccaaaggttctatcacttatgattaaaagtaccctgacttatataatgaccaaagaatttctggatggaatatttcaatataattcaaaggtaaatgatctttgttaatttcctattggatatgtgtttcagccagaatgaataatttacatatttgattaaattcaggtaaaatgtatttcaaatactatatcacctagattgtcttatatattgctcatattttaaatatctgcctcctgaacagaattttggggttttcatcatagggaagttagataaacaacttatattctaaattccacagattttggtaatcctttccccgtaaaataaataccactgcatttagttgctttcttatgaaattacaaaaggcagcataaaacgaatgcataattttaaatataatagctctatgagagtattgaataagtaatattttcttttcagatactagtaccctgggatcttttaaataagaaaaacaataatacttttatcatagactgaaaaactgttactcttaaagattgaaattaaaaatggtaaggtgatttgagagttagatggaagctatttagttccttgttttttctaattacacactgcttttttaaactcagcaagacagtttacctttagatgaactccattcttttgtcctcagagactagacatttatgaaaactaggaacaagggtccccttagttaagtcatggcagctctgggtggaattcctgattattgggtaattgtgcaactctagaataacacagaacagttcatcactgtgaccttcaagcccaggagaaaattatagcacaatgtggaacattttctcccatttagattgactttaaaaaatcactctcctagttgccagttgcagaaattaacaaaaatgtgcattatttgtatgtattttaggaaataaatgccagaaaatgggatattcaaaaaggtaaggcaataggaataggttcaagcaccttaaactacatgaccagatgtggtgagatttaactaaaatggttgaatttgtctttcatttggtattaatttgttttctagccaataccttttctcctatctccagagagcagaataactgtctaagtatagcatttgctatgttctgattttgcatgcctgctctcttaattccaggtgagctgatcgattgcccacatttctgcaagtaccaggacaaatcctatgcctaaacacaatcttgcagtagatttggctgagcaatgcagggtaataaaagtaatgaggccattgaaatccctttagctttgtgctgatgcctggaaactgtcatttattttgtagtgcctttaattgagagaggttttttttttttaattccacacagtaattggtactacatttttttctcatataaaaaataataaagctatatatcttgcttcctgactcttatcaagcattggtagtttttgatgtacaaaatattttatttttatttattttggtattcttgtcacaaaaaaaacttaaagatattctttgatatagccaaaaagaaaaaaaaagataaaggccagttcttgtgacatttatatgcatgaaaaattgcaaacctacctccttcaactcagaaatattccactctttgcagtgcataacacagactctctaaatataggtgaataataaatgtgcatcattaataattaataggattgtaacaaaatacagtatcagcataatcttctaagacattaatggctacacgttgccactttaaataatagcatgaaaggcaatggtgctctctgatatggatttgctatggtaaatgagtttgtgttactgtatatattttgttctacatactgagttatcaataatcatcttcatgcctctcaaacggtcgcacaagcaggaaaggaataattgctactcttcatggagccagcttattgatgaggtggacacaagtaatatttttagcctgctggctgtccatctgtaaggagtttcctggagctgtcacttctcctttctctggaaactgttatggctttgtctgcccaagggaaataatgagatccatctatcaagaaaaaaataaacaataaactctataccttccaattaatttgttttcacctatgtttacccaggtgcattcagttaaccatccatcatgttctatgcatgtaaagaagtgcatttttcaaaaggttgaatccattaacccatttgctaagtaaatatataggcaccctttatagctaaatcagggacttgtaaaaatcaatctttttggagagctcataaactctagctctgtcttccctagcatgcccagtgttgataaatctgcaagcttaatgtgaaccaaacaggttgttctcattcatccctccaactacatgtatgtttctttttaaatttgtctttgattttaatgccaccctaacattttcagaaattggttgaatgcacaacttaaatccgcagcttcaatttgattaagaatttgttaacaacaatttagtgggaaatggtagtgtatatcagcaatcaaatggcatctttttctccttctccattaaaaagtatatatttttcgaaatagaagacactaaaaaaatgactcaggcagtaatttgttcataggattttgctgacatttataaactatttgagctttactgctgccttgttgctggcaagaagcgtcagcagtggaagtgttcctggagttaaatgccctcctctttttttttttttaatccatctgtactatcaaaatagacagccactgttaaataaacacttgtcaaatgctttaaaaccatgaagaattgtggcagagtatgctcaaagtccccaatttaaaaacaaccagtgttccaggacttcatttgtaaagagagttgtttgaaatatagaacctaaaatcctcaaaatggtggtaaaatgcccagtttaatgcactaggagtatagagtatcagagatttaagattatggagtgacttacccagttcttgcttaactcaaccatttgttacagatataaggaaaaagaaaattaggtatttgctcacaagacaactgcaaagaaaacagcagttgtaatcgtgattgtttaaacaggaacacaatgagattagataatagttatatttctacctagaaagctagtacttagagagaaaacaggtttccttagagaaatatgaaggaaataattgtgtttaggaactctgaagaaaacttctagaaatgtttagtgactgtagaaattgaaagcattgtttattatgtgacatttaagttttgttttttttttttttttcggttttaggcatataactcagttataatttctatagagaatgagaaaaagcttatagaaaaagcaagagggagtcatgaggaaagaaagaaaggctaaaaatatacaataattagaaaaattatatgaagaaagaatgcccatcagaagcgtgagagtgaaagtatattgtgagattatttagcaatgagtctagcaaatttagccatctattagttcagagacattggacaagttcctgacactcttaagcttcttagagttccgtatgcctctgtttcttcattgcaaaacacatccaatattagtaggcacctcataggcttgttgtaaggatttctgggcacattgcttgccctcaataaatgttacttataatagtcaacatctaattcatggttaaatgggtggtcagaaaacaacaactggagagccacactcagtcacctgttttttgtatgacccttgagctaagaatggtttttatattttaaatgaatggaagaaagagaaaaataatattttgtgacacattaaaatgatatgaaagtctattttagtattcataaataagttatgtcagaacatagcctgctcactcatttgcatattgtctctggctgctttcttgctaccgtggcgaagtttgctgtctgtcctgcaaaatctaaaatatgtgctttctgttcctttacaggaaaagtttggcaccccctggtttaacaggacacatttgagggtgaatgagggtactattaataataagttaggacaacaggcataagctgagaatatattgggcaagccagtaggtttgatcaccctccatatattatgcacaagaagaaataaacatattagaatggaaagtggtaaaaaaaaaactgacaaagaaaagggagcattttgtgcaaatgactgcaactaggaaaatttgttaaagtgtaagtcttacgttttatctccttgtgttaaatccactatcaataccaagcacaagtagaataatatccagacccattctctacaagcttctatgtaatcccatccttacttatgtcttgggcaccttctcggacagctttctcctttgttcggttatgctatagtcacactcacttttctgttccaataagataccaagctggtcactatcttaggacctttgcaaggctccctacctgtaatgctcttaacagactttaaagtctgacccttcaccttatctaacccttacacctgtcaccatcctcccttccattatcccatcttattatctctttagaactgtcgctctcagaagcgtagaacctaagctccacaatagcagggatttttgtgtgcatagtgcctactacagttcctggcacagagtggatattcagcacatgtgaatgcatccgcctgactctgttgtattattgccactccttttgtgtcgagtgcttcagaggttccatccactgctcttcacatcctgagcttccatttggtctttggctctaggttggcagttcagcattcatacaaattttagtcttgatctctgctctaaatggactctctgggtacagaatgtgacatctctttgtttttttcctcccattttcacattttgctcctattatctttgcttatttgtgtctagagctaagcagcccttttctgtcatggtgttcattattttatattcttcatataatggagaagcagagtaccttgtgaaacaaatagtttccttgtagcttatgctgcattgttttcaatttttttgtctatgagtgtttccaaagttcgagtatgaactacttgtgggcagaggccatatcttttaaactgtatttctttgtacttagtacaacatcagagcaggcaaggatgtgctctcgagaaatatccctgaatgaggagtatggttaactccactgctgtgtgggctaatggaccaagcatcagaagagacaatcacaatcacatttggctttcagagacaccttgatcctgttatgcctagggcctatgccagtcacaggtgtattttattggcattttcgtaggtgcttgatttgcactctcagagcacgtgtaaaccagcctgaatcaaattagcctctatgcagttgttaacaattgattgcagagcctgagaaaagaggaaaagtttcttgtatataccacgtcctccacccagctaggattgaagctgcatagaaaagagaggagaagcataaaaaagcacaggttggggcagtgaagtctcatccagccttagcagatacaagcagaaagcctgtgttccattttgtacacatttagaagttcagcttaacttcacagtttccagaaacagaactggaacaccgttcgccaaaatgtaagttatgtctgccatgtttaacatatttgctataaatccattgccttgaatagtagagaatatttattgcatgaaaggataactttttccttgtttgcttactcatctagtaaagtttagcagactaggtacaacttaaatttcatcgtcagtgtttaattataaaactttaaggtacagctttaaaaaatataaaacaatagaaaaattggaaaatatgcaacacaatgttctttctgtgatattgtcaaatgctttggcataaaaatattcagccactaaaaataaaatgtcatccagcaatggaaaaatactacaatacgagaaaaaatgatggataaaaaaagagcattgctataatgattaatgataatatggctttttattttaagtacatgcagtttaggagaaagctttcagcatgtataacatgttgaaaataagtgttcatgtgatttgatcaaagggctccaatctctgagagacagtaaataatacagtatttaggaaattgctttaaatatttatttctctgattggctaagattgctcacaaattgcagcatgttttggatattgtaaaagcaagtctgaataacacatgcatcttgaagataaataggagtacaccaccatatatgtgctggagttggggaaaatattctcagtaataatgacattctcaaaggtgtttttaatgattgactcctaaacagtttacaatgttattatataatcttttttattaacccttacagctattttatgggaaaggtgggaagcaaggtatcttttcaaaactttctcaaaaagtcttcaatttttctctttctctatatttttatcaaaaattagacaatgcatgtgattctgtagggggattccatttgagatgtaatttaaatgatggaaactttcttacactatgagtgtcttatgaaaaggcaagaagtcttggtattcaaagagagtaaatgcagaactgttcaaatattccttccctctctacccttttgatcctgtcatgttttaacaatttttaaaggtgatttaaacattgggggatgcactacccctaagcactgtctgtttttagagtactcatactgcttagcaacctttgacaataagccataccaaagaagagatctagtatgaaaatctcagaagtgagtccacaaatacacatcaaaaatagtaatctccagagcttttaaaaaatactttttcacgtaagaaaacttagaaatgatatctgtaattaatccttgccctttaaaaaatgttcttcattgatttatcattcttaagatgagcaaagtagagctagagataagagaatggagaaaataacaaagaaaaagaatgtgtgttttaacacaaacgtggtgcagaaactgagatatctttagcaatgggaacatttttctaccaaccaaataaaaccaatgttatacttttaaaaccgtttctttcaatctgttgctcaagtaggcttgttcattacaatgatacgtaaatataaataaaaacttaagtataaacgtgaaatttgctaacctatttttttcaattaagtttatggcctacattgttttgtatatttaatatagtgtttaagattaagaacataatgttttagcataccttcttaatgatggaaataccatttattgttatataaacccccagtataggacattttgttgatattataaatattgtgacaatgagtagcttcatgtctgcgcatttgcttatgtctcaaaaatattttatatttccctagaatagagttccaggaatagctgatttcagtttttgttgttgttattgttgttgttattttgagacaggatctcactctgttgcccaggctggaatgcagtggcacgagcatggctcacttcagccttgacctcccaggctcaggtgatcctcccaccttagcttcctgggtagctgggatgacaggcatgcagcagcacgcctgactaatctttgtattttttgtagagacagggtattgccatgttgtccaggctgggctcaaacgatacacctgcctcagcctctcaaagtgttgggatacaggcgtgagccaccatatctggccagattattggtagtgaatcctctctatgacttttgactgataattccaatttctattccaaaataatttttatcattggcagtgtgtgatagtacatacttagtgggtttctctatggtaggcactcttgtgaatgaacttttatgtaaattagcacatttaattctcagaacaatttttaagatatttggtattatcaggctgggcgcggtggctcacgcctgtaatcccagcaatttggtaggccaaggagggtggatcacgaggtcaggagttcaagaccagcctggccatctctactaaaattactaaaattacaaaaattcgcccggcatgctgatgggttcctgtaatcccagctacttgggaggctgagacagagaattgcttgaacctgggaggcggaggttgcagtgagccgagatcatgccactgcactccagcctgggcaacacagtgagactccatctcaaaaaaaaaattatatatatatatctatctggtattattctcattatggaaaaaaattaaagacttgaatttcaagaaattgaactccagagatgagatgtaactggcccaaggacacacaattaataagtagtaatcaaagtactatgttttatgtcttccttaatattagacaaaataaagatcattttgtgaagttaacaggggaataatagctctatgttgtttaaatctcatttaattaaatgatttaatttagtcattgatcactgatgagactactagttctttcaatctttctttctttcaccttctcttttttctactggattaggtacttacctcatgaatttgttgtggggagtagaattaatatatgtaaaggattagcccagtggcaagcatggtcatttagctattcaatgaatgatagcttttaatactcttatttttagctagttactgagagggttcagacaaaaatccagaactatatatttggtttagtaattttttctgttatataaatctttttctcattataaaggaaatcaatcctaatttagtatatttatttgaatatataattgctcctagaagtagcacaaactgacataattaaatgtgatttcaggaatggaattgagcagtattataaactgtttaaatctttcatccctggcaataaaaatatattttagcacacaatgcaaatatatgtgtagttatttatactgtactaacatattttatacttataaaacatataattttttttttttttgagacggagtctcactctgtcgcccaggctggagtgcagtggtactatctcagttcaatgcatgctctgcctcccgggttcacaccattctcctgcctcagcctcccgagtagctgggactacaggtgcctgccaccatgcccggctaattttttatatttcttagtatagactgggtttcaccatgttagccaggatgttctcgatttcctgaccttgtcatccgcccacctcagcctcccaaagttaaaacatataatgttaacttacattatttacatatgattacagattattcacatatagagtaatattttaaatacttttcttatttgcaaatattacaaaaatatttgtgcttttgctaaaaaaatgtgaaattttgttttgggaataaccatattaaatgtgattagatagtcacaatttttaccttgtattctggctggcaagtcactcctaacctcccagtttctgtttcatttgctttacttatattactttcattctgtgggttttttttttccagaaacattttaggccatttttgagggtgagattagttaaaactagaaaacaaaatctccagatctatttctctaggcaacggtaaactgaaagatgtccagatatgctagactttaagaaatccactcttttctcaaggtatctgtatgtggtaacatttgacatctgggccaagtgaacaatgccaatttagatatgaataatatataattatagtgtcgtttttgttttaactattagccactaacagcttgcaacagtttccagtgttagcagcctaggaagaaaaatactcttttatcttgttttctgtttattgcattctctgctacctctctttcaggttttataagagggtatttatggctgttgcacctgtgactttggttgttcctgctgggttatctgcctggtttcaaccaattagttgtctatctctgggcttgaatctggaggtttatctatatcttcaatgtgtagtaggccctggtactgagttagctgttctctttcaatgaacagaagagtggaccatgaaaatcccacagattgacttttatgtgttcatattttctgtcgtcccacaagcactttttctcacaatgtaacacaaagtacagcctcttgtttccacaaaggtaaagattttcacagtatttcatttagctttctaatctaacgcacctgctttctcttttcttcatctatcagaaaattacacacacacacacacacacacacacaacactcaacaaactgaaaaggtccagtgattccacttgatttattaaaatatgcactcactagctgcctttccatatgtgacatgcacgcactgcagttcccgcttacccaggcctatgaaatgctaaccctgtgctacagtctgaatgtgtcccccaaaattcatatgttgaaacttattgatagtattagatggtggtgccttcaggaagttattcactcatgggacagagccctcatgaataggattagtacccttataaaagagatgtgagggagctattcgcctctctgccatgtgagaacacagtgttcctcccattttgccctatttctgccatgtgaggatgcaacaagaaagccctcaccagacaccaaaagttggtgccttgatcttgcacttcccagcctccagaacggtaagaaataaatttctattgtttatagattaccctgtctcaggtatttttaaaggagcacaaatggataagacaaactgtctcttccattgtatgtgcagtatttctctgtttcactgggatgttatttatacacagttgcatatttcttctttttaaattctcacacttataatattttaaataccaaacatgtaattaaaactgcttctgttgtctctattaacatgataaatatgtgtatccataatatatacacacgtagctatagatacataatctacagttatatacataactgcatttctcaagtgcatgaatgtctagatggggagattaaagagaaggaagtggggaacaacataagtcaagctagagatggcttaattttgtgccatttgcacctctgcacaatctcaactttttgaccactatctccaggtctcaggagagacctggctatctaaaatatatccaggagagacctggagagacccagatatataaaatatttacctcattgagaattatgtataagggttaacttcttagtctgttaacttcttagtctctccctttttagaatttttctttttccaaattatagatatattttgagcctactgataattacattcatatttctgtttcctgagccatgttatcaagcattgcacccattttgttctcctctgccatttgttgtgtctcttctccttttctggttgtggctcctgactgcactggcaggaatatgcacagctttagctaattaattgcttctgcagagcagtaaagtatacttacctagagtgcacttccagaaggcactatagagttattggaaaagagttatggatcttgattcatagctcatatatgcatatgcacattagaattagaatttagtctttaaaaatagcatgctaatgacctctcagcaataaataggtcctgagaccattataaatttgagaactagaaaaggcagggattaattgtaaaaataaaattataacatatgattcagccatatgtgtttttatgtaaaaagcttgttatttagaataggcttccttttgcttctgtaaccactctaataaacaggaatgcatataatccttttagtgcagagcatattctaaggatactatctcaaaacacattgatgcaatttgaaagtatatttcaatttgctgcgtttgtgtgtgtgtgtgtgtgtgtgtgtgtgtgtgtgtgttaaaagcagcaaatactcaaactcccagcttgagactatcttaaatgcagtatgtttttattcgtcaatctaacgcagctttcttaggccagaagagaatatcctctctttggctgacatgtgaaatgtgacagaggtatcttgtaatgggcattttccaagagcatcacatggtaggtttctccctagattttaaacctgttttcgtgtctgctactcagttccttttaggctcttccaagttcttctctctggagtctgaagcaggctacagaacaggtgggacattagtgtgacagctgggcacccttcctagaacagacccagcatggataacattatgtttgaatcacatatctctctcgtactcaaccctctctaagaaaaacactggtgtgggaagcatgatatctcatcactttgtggagacagttctcctacgtctgtctatatttatttcttttgttcctgcccttccttttcactccacagtatttcctttttttgaccacattccattatgagaaaccctgattctcatagcacctcacttggacggactcatatgacagcagaataaatgccagaaatagaagtctgaggaccagatatctaattaccacattacaataagaatctctcaaatgaaacagaacacaaaaacactttgtactgaaatgtatttgttgagcatttctcacaatgaagctctcaagttattgttttttgaatagcaaggccttaggttgtattcaatttctctgtgtggtatagtggtaaaacatcagtatgataatatactacccctggtttcaaatcttcattctgctactgactagatatgttttgtcttgaacgtacaaattccccagttataatccaagaatgatgacttcacagggcaaatgtgtggattaaattaaatccatccatttagcaaatatgtattgggcacctattttatggcaggcatgtgcatgtaagtgttagaggtagaaatgagaaacaaagcaaaatctagtgagggaaatgggcatataaggagagaatgacagtagtgtatacccagcactgttctaaaagcatcacatctactaactcatgtaatccataatataactttatgaaatcagtactactctgtttatttatggaagaactgaggtatgtagagttttaataacttaagtttatgtagttagtaagtggaagatctaggataaaaacctaagcagtctggttccactacccaacctcttaaccacactattaataataatgtactagaaacaaataaatgagaaagtaaaagaagtttgttttagtagctcttgagttagagaagatgatataatgtataatacactcactcattattcatttcaataaatgtttgttcctattttttggtgtcattgagatcacatgtaatattttacattttgatgaaagacataaaataatctaggcaactctatttcagccaatgattatatgacttttttttttgagacaaggtcttactctgtcacccaggctgaagtgtagtggcacaatcatggctcactgcagcctccaatttctggcctcaagtgagccttccaactcagcctcttgagtagctgggactacgggcatggttcatttgtacatttcattaacgtactccagacatgtgcatgttccatctttgcttgtattttgaggagctataggagagcctagccgtggctagcagagcaagtagttgggttggtggacatgggcagtgttgaataatctttttcagcctaagaaaaatgttctactgccctctgagcttctgaatttattttgaaggataatttaattataaaaacggggaagggaaccagcaaccaccgtaactacaccatatgtcttttgaagagcgatatgcctggaaatccagcgataagaaaagaagtcctttcccaagaaggggccttctgagagatgaggagtggatggtagactctcgagcacaggtcatctgtttgcatcagcctcagaatatcttagagtagaatccttagctgattggtcaggttttgctcttgcaggtactcctcaaaacattttagctcctgtcagacaaagatcacaattttttttgtttcctttttaaagtctattccgtacagggatcactacattttgaaaacctctttggttatctgttcattccaggaattctgagtaaccattctgtgaacagttgcccaacatatcatgtttctgtattttacttcatatggcatttcatctttatcactcaggttctattaaactttattacctctttttttaacattttctcttagaaattgttcacagtcaactcaattctatggagcagtcacctagcaagagttctgcatgtgagcatatcttcattagaattgtcagttaaaaatccctgatttcaggagaatgctgagtgagaggctgggctattggctgccttagttaggacgttcatccacttggggcagccggccagtgagtctggctagagtcattactctaatcaagagtacgcaaaatgaacctggagaccagtcattcaggaaagcagcctcattctgtttttataattgggtgtgaattttcaattgtgtagtccagaggagcacagggggaagacaggctggagcacagaagcagctcctggtgtctaattagacaggtgacctacagcaagtttcagattgggtttgttgcttccccagtcccagctttcctgtggagatatggctcaagtgtagatgaatgaatgagggccatgcatagaagtgatgttgctaattttactctttgagtcctgctagcaggtgccacctgcctcaaccaaggacatctcttgatggctactggagctcagcagccagcctggaggcatccttccccttctggaatttatgccaaattccagatggtctcttataaaggctgacctcagtttctatgccagggtaagctgtgacaagtcgtgattgtgcctgtcatttgtgacgttttatacttacactgaactttgtcaattctatggtacaaattgtcaccgagctctggtttaggaagcaggagagctatgaatgacttattttaaccttattaattagtctctacatacattgtaccttcggccacaccactgtcagcacctatctttcctttgcagttaaaagtttacatcttgtttgtatcttctcatctatagcagtcactgctatattcgctgcttttcttcagttaggccacttgtgagcttttgttctatttatcttatagacattttagaaaactaatgaatctgtttttgtccagagcatgacttccagactgtcgcctctattctggctatgcttaacctctgaccaagaggcacaggctgtgtgtataattctttacataatgcactgacttccaacctacctgaatcttgaacttgcttttactcctgctttatattcctcaaacccagttaaattcttccttctgcatctggttatacttggatagaaacattaccagccagtgtgaattgagtattcctcccacacctcatcctaaactggcactggcaataccaaaaacccttggcatttagctcatggctttctgtcctgagaggcagtcttggagtggattagacttggacaacattctggagccatattcctggggtttgatttccagctttgtccatttctccagtttattctgactatcacacctaagttcaaacgcctttgaatgacttctattgcccattagaagtttcatgcaatttctatcaaactaccaacatcatctttcacatgactagaaaaacgattccaaaattcatatggaaccaaaaagaaggctgaataaccaaagcaatcctaagcaaaaaggaccaagtcggaggcatcacattaccccacttcaaactatatcataaaactacactaaccaaacaccatggcactgttacaaaaacagcatggtactggcacataaacaggttggaagtgaatgcattgtataaagaattatacacactgcctttgcctcatggttaggggctgagcacagccagaatagaggttataggctggaagtcatgctctggacaaagacacatttattcattttctaaaacgtgtaaaagatcaatggaacaaaagctcacaactggcctagcggaagaaaggcaacaatggaacaaaagagagaacccagtaataaagccataatctacaggcctctgatctttgagaaagtcaacaaaaataagccatggggaaaggacttcctattcaataaattttaataaatggtgctgggaaaactggctagccatatgcaagagaataaaagtgaactcatgcttttcaccatatacaaaaattaattcaaaatggattaaagatttaaatgtaagacctcaaactataagaatcctagaagaaaacccaggaaacatcattctagacatcagactttggaaataatttattattactaagtcctcaaaagcaattgcaacaaaaacaaaaattgacaagtgggacctaattaaactaaagagcttctccacagcataagaaactatcaacagagtaaacagacagcctacagaatgggagaaaatattcacaaactatgcactcaacaaagatctaatatccagaatctgtaaggaacttaaacaatttaacaagtcaaaacaaaataacccctttaaaaatgggcaaaacacatgcacagacatttatcaaaagaagatatactagcggccaacaaatatatgaaaaaatgctcaacattactaaccattagagaaatattgatcaaaaccacaatgaaatactatctcacaccagtcaggattgttattattaaaaagtcaaaaagcagtcaatgttggttatgctgcagaggaaagaaaacacatatacattattggtgggaatgtaaattagttcagccacgttgaaagcagtttggagatttctcaaagaacttaaaacacaagtaccattccaagtagcaataccattattggatatatatccgaaagaaaataaatttttctaccaaaatgacacatgcactcctatgttcactgcagcacaatttacaatagcaaaaacatggaatcaacctaggtgcccatcaacagtgggttagataaagaaagtgtggcacatatatgccataaaatactatgcagccattaaaaaataatacaattatgtcctttgcagccacatggatgtagctggaagccattatccaaaacaaattaacataggaacagaaaacaaaatatggcatcttctcccttataagtgggagctagacactgggtgctcatggacataaagatggggactatagagttgagagagtaggaaatggggaaagactgaaaaactaactactgggtactattcccactacctgcataagagattatttgtatcccaaacctcagcatcacacaacatacctgtgtaacaaacctgcacgtgtaccccctgaatctaaaagagaagttgaaattattttaaaaaataacattaaaaaataaaaagaaaagaaatttcattttcccctgtcattctcaagcctccgcattaagccattattttccttccaagcgacacaaaccatttctttcctccatctgccccttatgccagacctctaggccactcactttgctctctacaacatttctattcgtaagctcctgcctgaatggcagactcactctataaaaatgctgcaagttccttgatttccaagaaatatttcaaaatccacttctttatgaaatattattttattcacccaagttttatttctttcttctttgacctgtgtacccctgttgttaactcacaataatataccttgcattttgttattcattcatttttttcattgatccttgctttcatggaatatatgtccttgatttatcttgatacccagttgaattcaaggttccttaaatgactgagactatgtctctatcatttttggaccatttatactgactatgtttggtcattttccttaggaaatagactctgaaatggagatttgcttgcaggtagatgatttagtcctgttggaaacccatggagggaagcagggttgtgaagaagtagaacaaagatgaactttctacaaaagttcagtgatgaacattgcagccaattccacaaggaactctgaagcttggatgggcggagttgtaacctcaaagaaaacaattccccgggagattcccaaggactcagccctttgctgtcagcagcccacacttccagcagcttgaggaatgaatgtttcagtcttgaagggaggccggcacagcgtgccatctcattcactacacaagcatagagccttatacgtggccaaagttcagtaaatatttgctaaagtatatttaaagtgattcgtgaatgtcttataacttctgataaagtatatttaaatatctaaattattgtataatttattaatgcacctaattagtgctaggaacaatttgctgagctatgactgtttcttggagtgactctatgtgagagttctacaaagagtcatagatttccctccccagctgagagccatgattgagactctgttaggctttaacctttccacaataggtatttggacacttatattttaaagttaaagtcattaatattacctacaacactttctacccttctaagttattttcaggttcctaacaaaatgttgactaaaaagacaaatccctctgaacctcatggccataggagccctgacactctgtgaagcatataacatacgattaaataaccctctagcaccatgggtcctccctgctcccccacccccaccgggcaggggaggattcagattttatggggctgaaaagctaaacaattgggggttcttagttttaaaatgtaatctaaaaccatttcccttttgaatattttatgaaacattgtatttggggtctctacgaactccaggtttgaggatatggctaggcagacataggattcagcatttaattgtactcacagtttcatggctatgatttattacagtgaaatgatgcaaggcaaaatcagaaaaggtaaaaggttcatggggcaaagaccagaggagaccaggcacaaactttcaagaatcatctcccagtggagtcacacaggacatgcctaattcctcaagattgtgacagggatgaaatgttgcccaccaggaaagctcaatagtgactcagcgttcagggttttttaaatttagagctggtcacccgacaccttctgcctggcatgtaccagaatttcaaactctcaggaggagagcaggtgttcagcatatattattttgttcgtaaaattattttgttcgtaaaaacaggcacagtgagccaatcttatcattttgggaatggtgggacctctcccaaaatccacgttctcagataaacaccaaaggccaaccttgcaatcaggctttttcaaggacagcactttcagacttgctaggttaactcctttctgtgtatatctgcacctttgcacccattactaggggtcctcccaggcagggccttggaagggctgtgcaagtgagggatccagatggtgagcctttatcagctccagggtaagtgcttctctggttccaaccatactgacacactttcaataccttaatgcacttgctttgcatgtgctagtcttttgtcttgagctattcttgctctttattctcttcttcaccaaaatcttaatccttgtttagctttcagagttacaccctcttggaagtccatggaactggtgtttctgttttatgttgctttctgctacgaacccatacggaatacgcatattccttatcatagcactttacatagtgcatggtaattactttagcattttcccccatttccccatgaaatctgagttccttgagaacaaaatctatttagtcttcacgttttattcatgagcctagcattatgcttgacatataacatacttacgttaatattagaataatgaaggatgaacgtacttactagttttgacaagtgttaccacagcactgcagttagtcctgtgatagatatttatttaaatatcttgggttaaattgaggcatgtgttaactatcagtgttaatagtatagtggtatcagagaaaaacttctgttattgtcgttaagtctataaacctattggaaaacttctcctaccagaacataattagttaaaacatgagtaaaaaacagtcaaagaggagttatgtgtcccagatagacttgccattgaaaagttgggtagattttcatgcaactatatatgctataaaaagacaactgcttcttatttggtaacattgattaatattatttttcaagtctgtgcatataagcatgatatcttaattgacattaactagagttaaattaattgtattgttttcagaaatctctgaaatctgttactgaagtaggcattattaactttgttgtcattattttaaaatgcatttcaagatctgcaatcacccaagccatcctactgtgaattctaaggctcaatgatatgtcatacattgcttctataaaactttaggaagtatgttactttatttatttatttatttatttagagacggagtcttgatgtgttggccagcctggaatgcagtggcgtaatctcagcacactgcaacctctgcctcccgggttcaagctcttctcctgcctcagcctcccaagtagctgggattacaggcacccaccaccatgtccggctaatttttgtatttttagtacagaccaagtttccccatgttggccaggctggtctggaactcctgacctcaagtgatctgcctgtctcagcctctcaaactgctgtgattacaggcatgagccactgcgcccagcatgtatggcactttaaaactgccactcttggcatatggaatacatgcacacacttttgtattctatattcattcatatatgcaaaagataaaagtggaaagaggaacaatctgtttattgtatatcacacaggcaggctctctgtgagattaacattttagctgcctaatgaagttgcaggtgactggtctctctgtaagtcccagcattggctatcagcaaaaattagaaaggaaaacatatttcttgaatctagtgctcatagttttggttagaaatagtctactctgaaagaatttacaactgaggagatgagaagagaatgaggattcagcagcaacagcaataaagtttcccaggagaatgagtattaaaaaagttgaggcaggatgtccactgtctgagctggaaatagtcttgcaattaaggagggtgaaaagaagcttggcttgagagaaacggaagagggagttgaggtgattgacgttccccaaggaccctcttcatttgtgtttgtttcaaggctttttctggtgacatagataattactggattgaaggtctctattttgctaggctgtttatgaggagattactaaacaaaagataagagaaagtcaagagctgatgaaggaaagtaatctagcctgtcttgctctctgctttagatggaacacgtgagggtgaaaaacagatcattgattccagttgatgtttataatatagaaatagcagagttatcctcctttacagaaatttcttaaatccattagtaccttacttaggtggacttgttcttgtttatgagattgttcacatgagtttgcggtcaagaaaggtgagccttctgcttttaggcttaatatttgcaaatccctgtgaaatttaagagcataaatctgtagtgcagagatctggagtcacgcccaggctctcctgtctgccagttctgtgagctcatataggttttacaatccctcatgcctggttttctccattgtaaatgggcaattataaacactgtctcagtttgtaacctgaggtatatgtatttaatgaagtaaatttaatgaagtagatgctgaataggcactttataactattttttagatgaatgtatataaagcacttactgcataatgcactttgtaaattcgaaataacagtagttaccatctgccatgttaaatgaaatatacttgagacatcttgaactttttcttgataaaccaaggccatcattctgagcatcagttactgttttgtgctgtagcacaatcaggagcctcctgtattgctggaatacattaggacaatttgtatgtaagcatgcacgtgaaccactcccacacatacccagtggcttttaaagtctttaaatctttttccattattattctaattttcatacatgtattttatttttgtcagtgtttttacatccgttttctcactcttctaataatttgctctgtatgagctgctgttagctctgaaaccatttgagagacttgatagaaatgtgaattagctcagaaggagcaacttcactggaagaaggtaaggtttcatgcacagtcctggcgacatctacttgattctccctgtggccttttaaaattactgatccctgggtttaaaaaattttatcaatgcagcagccaagtaaagtacaatttaaaagtttagtttttctcactggcaatgtgaattgccatatgccaaatttttaaattcttttttttttttggagacagagtctgcaaacatggcttactgcagacttgatctcctgggctcaaggaatcctctagcctcagcctgcctcccttgtgggaccatagatgctcaccaccacacccagctattttttttttattttttgtggagttgaaggcttcactttgttgccaaagccagtctcaaactcctgggttcaagtgatcctactgctttggcctcccaaagtgctgggattacaggcgtgaatgacagtgcctgacccaaatttttaaattcttaattcatttatatgcattatgaaaaactaaaagtttagggaattatttaaaataccttagcattgaggctgatttttcttttattttgcattctactccacatgacaatgaattgtatttttgcctcagtcctcataatttcattttcatttaggatatgtattgtgggaataaagtatagttcatttattgtcaggtttgtagcatggaactttctaaaatgggtctaagtacagattttgaaggtgtgaattaataaaatttttctagagaagcatttcatttccatatgtaatgtagtgtttctgcatgaatggactattctttgtatttttagattttacagttgttgcttttcatcaagatttggcctagctgaaaataatccctcaaagatttactgtgcagtagtggaagttaaatctatttttaaatcaacaagtgcttattaaaatgccaactttgtactaggcactgctgttaacattttacaaatattaacccattgactcttataaccctttgagatggatgctattattgagctcattttacagataaggaaattgcaatatagagaggttaagtaatatgaccaaagtcacacagctaataaagggcagaacagaatttgaatgcaggcagtgtaataccacagtctatgaacttaatcaaacctgagaattgtctgcatcaaatagcaaattgaagaactctttatctctacattttgtaatcctagtttaaagaagttctcttgattatatttaattactataacattaaatattttcaccagttttgaaaatagggtttttatgttacctaagacatattaagtgaacaagccaaaaatggctatgtcgtttttgtgtgtgtgtgtgtgtgtgtgtgtgtgtgtgtgtgtgtgttgcaattatatagcaagtaaaatggagattttgtttatttttaaatagtagattattggtttaaatcttatatttccaatatagttatttcattatttcttaagttattgaaaatgctggattatttttcttcttcctcttactatttgttcttatttccttattacctgtatgtgtctttactagtcattatcagtgggggcaaagaaaatagccaggcacagtggattatgcctgtaatcccagcactttgggagggcgaggcaggtggatcacttgaggtcaggagtttgagaccagcctggccaacatggtgaaaccccgtctctactaaaaatacaaaaattaggcgtgatggcacatgcctgtaatcccagctactcgggaggctgaggcatgagaattgcttgaacctgggaggcagaggttgtagtgacccgagatcatgccactacactccagcctgggcgacagaacgagactctgtctccaaaaaataaaaaagagaaaaaacagtcaaacttcaaattagtaaatttagacaaactatagcagaattggtgaaagattattcagtgtggggttgaaatcactaataaaaatatatttttttagatctattctgtcctccatatgaaaatataaatcatggtctcatttgtttctcctgggtatctgtgtgtttgtgtgagtttgagagagaaacaaggatacattataactttaaaagtatttatagcctttgataataaggtgatcaattgaagaaattaacagtattctagtatttcatttagctgaagcaagatatgctttaccgacttttagctatcctccttttttcctctttctgcttaggaattccactaagttggcatgtaaacagatcacaggctgtgtcagtttaaaacttcttgttctgggcatgccatttattttgctaagcctgtagcactagggagtattagcaaaagcataatttaccttatagtgacagtctcccgaaacacaggaaacctgcctttcttgtgtcactgagcgaacaaaggtaaagttaaaggtagtgggcagaaaggaaagaaagggtggggttggggggtggcatttggatggaaaaaaaaaaaagggaaaaaactttgtcctcagagagaaatggtgggtgggaggaagtagattgtagacctagatgggaaaggaagcttgggcatcaaaagattaaggatgtgtgaaatatagattaacgcccatgggagtctgactgataaaaaagctgggacaacaggtctcgctcagcagccctgagaatcaggcttccagggtggtttcctacactgggcgtcttgtctgagtttacctaggctaatatattttcccatctctccttgggactctacttctgtaaggggaagatacagtacaatttgccagaggtatttgctcagttattcaagatcttagacaaaaggctgtcttgttcctagaagctagaatgttagaattgagttagcctcttgcagtttcttctggatctatcagtctcaatatacgtgagttacagttttcattgttttcttacttaaatcattttgattgtcagagatatttttaaagatttgaatgtcacaggtctcacagtttcattttactaattcttgcttgtgtgtcttaaatattttttatcaattttccattttatatataatatacatatagactgttgctaatgttgtttgtaataatcccttgagtttatattagaccaaaaaacattgtaccaactacatttcccaattaaaaggaaaaggaaaaggaagaaaataaactgaggataattagcactttaactttatggccctccctgattgaatctagctctgcacacaaacacacacgactactagcaaaaacactccccccctccaagatctttatagaaggccttttatatcctcttccttctttcctgtatttctataaatgggaaaaatatgtttgaaacaaacatcctggtgttacaaatttctaacactttatctaataccatgtcatattaccagaaacttcagagaaatcaggagtccttgtagactaaattattgatgataaactaactcgcctgcataggtataaatcccaccatagtaataaaaattgatttcagggcagttagtttcaaacatttatttattcattggcatatgaaggtatagataacataaaaataaagttcctagtcttaaaaaagagtcgtttaatcctatattaaaagatttatattgcatattgactttcctctatgcagtttttacttggaacttttaaagatttttgtctgccacaggaattcttgatgactgaggagttttagttcttattttagttaatcctaattttagttattcatatgcataaatttcaaatcaatctattaatgtttgtcaaactgcagaaaatataaaacatggtatttctgtttagtaatgagaccaattttatttgtgtgtgattgttgaaatcaaataagacattttgaaataaggttatattactagtttaccagaatttttatgtttcattcacttaggttttacataaaatttgcattcatttttacataacatattctgtttctcctctttactagaattgaatggtattatctttagaatgtctaaataaagttcttatgtataatgcttggtaattactcataaatgctgttttctctaccagatacattttgcaaaagaatgttaagaggagaaaaacacttgcttattactttcagtaaaggatattaaagtttagttgaattttctagcagagtcatgaaatagagtaaatattaaaatatactatagtgcttattgaaaatattgggaatcaaaattctgacttttcaaggccaatttgcaatacaccatagacttattagtgccagaatttactttaggcaatccagttaaaacatgtcttattacaagatggagaaaaagaggccaaaagtattaagtttgtgagttggatcacatacaattacatattatgttaaatattcttagcaacaatcattaaattaaaagtctatcctcttcagtgtcttgctgagctttattaagattgcaggtattcaatagaacaaaggagtaaattcaatccacccctgcccttaaggtagagagagaaataaagccaatacagatagtgaataatgtgatgggaagggtattttaggaactgaaagaaacaggtaaataacccaagcctagaaacttggcgcatgggtggcatgatggaaaccatagcatggtggtgggcaacaggaagggaagggagacctgagctgagttttggactataaattattggcaaggactgcatctgatgttagtagtctttccactgtattcttatgctaaacatcaatgaaaatcaaagtgttatatgagttatttactacgtccttttttatccaattgcttaatgctataggctcttaatgtaagcttaatattaattaggcttaatattaatgcaattttctttaattctgaagtcattcaagtgtagacaggcatgtgagaaatttatgcaaaagatatgagaattggttcctaatatgtacttcaatactatttaaattgatgaacccatggtcttttgattgttttgttttccctatggactccatttattattcattcattgagaaatagaaatgtagacttaaaatttttaaaaaaacatttagaacaatagaataatttatatgcctgcttcaaatgtttgtttatgacacatggccaatataaaaaaaaaagatctttaatagagttctgagtttaaaggatcagtgtcacaaatttttagaaactaaatgtcaaatgaattctttctataagtcatcctttttattagattttctgtatgatatttgtatccaaataggattttacaaaatagaaatcaatccatttgcattgggaattgagaaatttacacacacagaaaatcaaacgcaccaaatatacaatttatacagtccatattaacaagcagtgtagtaggtatttaggcaagtgatattacctaggattaatatttagcatctattattttaataggtgatcattatgcctttcatacgtaacaactattatatctaaaagacagctcttttcaatatttaaaaatctagaaaacatagactgctttttattttgatttcttgtaaattcacatcctcatatgcctttttatgagactttatacgtataccaaaggaactatatgtttgtatacaaaatatttatacttttgaataattttaaattataattcaaataaaattcagatttttttattactagctgtgaaactttggacttaacatcactgaagattagtatactcatctgtaaaatgggatatttacaggattaatttataggcccatttcaagaataaaactaaatccatgcataacatctaatagagtgcctgatacacaataatgcctaattaatgttagctgacctttgtcattgttattattgtcatcattacttttttaaacataaaaaagtatcagtaagtattatatggcaattgtttttcttttgttgcaggataataatggctgttttagttttctctgtgttctaaatttttctaattttttataatataaaatttatatttagcaatggctgtttcatcaatatatactcttttactacttctttataaaaattttagttgatccacctatacataaatttcaaatcaacctattaatgttttcaaagtctttgactccttcctgttctatgtgaaattcagattagaaccagttctcaattatctgtagcaattggtcttggtctgtacagttaaagtacatgcaaaaaagacacaaatgctttctcacatgtgtctttcagtctaagaggaactgcaacaatactaggtccctgcaattttcatttgtgtactggccttttttaaagacactatggttacagagagcatgattttttcatggaattgcaaattccagcatggatagatcccaggatgaaaagcaggaaactaaagaggggacagattaaaaatgactcacaatatataacaagggttttgatcttgattgtaagagaaacaggtaccaataaagctataacagaaggtagagacttgctagctaggtagcatagttatatctagggtgaaggggaggtagtgattttagattatcccagatttctagcttgagtaacttggtgagcatttccccatacaagagagggaaaataaggaacagattggagtggattatggaaatgaattccctaagtttaggacattatatctcttgtatctcaggccagaacagtttattctcatgtattgccatctaccacataacgatttttcggtcaatgatggactgcagatataatggtggtcccctaagattataatactgtaattttattgtactttttctgtgtttagatatggcttgccattgtgtgacaattgccatacaggtttgtagcttaggagcaataggctacagaacatggcctagacgtatagtagattataccatctaggttcatgtaagtacaccttgtatgttcatgtatgttcacatgagaatgaaatcacctaaccatgtatttctcagattgtatctctgttgtttatcaacacaggaattgaaatttttttgtgtagcactaatcttatatttctgtagagcctgatacttttccaaagtgctttcccatgtgctacctcactttatccaggaaagtccgggaaaaaagggaaaacacgctccatctacttgtagaaaacaagtcttagagatcaaatgcatatgaattggcatgtctagaactgaagtcaagatcattgtgctttaatcactcaagaatctttttgggtaaagatgaaagcttatttgaagagaacatagcaggatttatgaagatcttttcccgtcctcatagaaaaagaaaaaaaaaatctctatgcttaaaaatttgctaatcttgctgagaaacccaaagagcattttctgctgaaaagtagtgcacagcaggtaaatgctgtaatgatatttactcaaagagcttaaaatttgttaaaaggagattcataccaggatcttagaagtcaacttctgcatgcattttataagtgaataacaaatgctgtaaatagtgtattttgtagggagaaagtgacatagtgtcatccttaatgatgtgaaagcaaactcaggaaaaggttttgtctttttaaaatagattttgattacatctcagcaaattattttatgctcatcagttggaattcacatttatgtggcaatggagatattttaatgcaactactgaattgaaataccataaatttttcagtggtttatttctgaaagaatgttgagaactataattttggcttaaaaaatgaaataaccctgaatttggcattaaaaaatacactgaatggccagtcaagaaccactgtagcaaataatataacagtatatatacttgcagagtatctatgtatttcagaactgggttgaggggcagaaaagttggaggataggtaggcagtggccctttgtgtttgtcaaagttagacttcggctcaaatcccaaatctggagatgcctgtcttggtggtcttggtgagtggaacacttttcttggcccctgtttcttcatgtgtacactggggatagtaatactttatgtggttttaagaggactaaatgcaataaatatttgttcatgcagaaatatgtaccaagggacaattatgtgcctgacactattttagatgcttctgatacataagtgaataagcaagtattcctgccctcctggagatcttatatgtgaagagctctgcaatgtgtctggcatcaatgggtaataaattgtagttgtgaatgagattatgacggcttggtaaatctatatttacttaaatggaggaaaacagtaattttagaaatctcttctacctcccatatcttctacttaatttttttcttagatgtaagtacaaaacaaaaggcataatattttccctactaggtaatgggctttcatactaaacagtatcagtatccttgctttttaaaggtaaaataactttcagatccctcagttttcatataaaagaaggatttgcattattataggtcactagtgttatattgatcaaatcactacttcagatttaaagaaattttcattctccaaaggctcaacatagtttcaataattcattatcataggtatcttcacatctgctccaagtgttgccttacccctctccagctcccaactcatataaaccttttataatgaaatgattatgaggatgattgagcttttgtgtttgaaatatgactggttagtaaactttggagtttgacaaactatataaatttcagtaaaggttcagttgacattttctgaatctatattcatggactggctctctgatttttttgagaaaccagtaatatcaggtatgattgtaagttgctggtgaaagcccaatgacgtaaaattgtattgtaagcagtattccttttggtattgatatttgtctcctctttttgttttgcctcatgtgaatattgtaggcatttttcttgcttgttgtttgtagacagtaactattaccaagtgtgtaacacagtttaaactcaaaataaatttaagaagtctagttaaaacacaattgctgggcatcactatagatctcatggacattaaaaggataataaagtaatactgtgaacaattctctactcagaaatttgataattatgatgaaatgagccaaatgcatgaaagacacaatctgacaaaactcacacaagaagaaatagacaatgaaaaatagtcttatattaatcaataattaataacctttcaaaacagaaagcaccaggccatgatgggtggtttctacaaaacatttaaggaagaaattacactaactctctatgatgtcttccagaaggtagaagcagagagaatacttctcaagtcattctttcagaacagcattatcttaaaaccaaaaccagaccaagacatatgagaaaagaaaccataggctaatatctcccttgaacatagatacaaaaatcctctacaaaatattagcaaattgaatccaataatatattttaaaaatgtagatggcacaactaaataggatttatctcagttatgcaatgctggttcaacatgtaaaaatcaattaatgtaaacctttatatcaacagattaaatgaagaaatatcatttgatcatataaatagatacatgaaaagtatttgacaaaatctaacacacatccataataaaactctcagcaaagtaggaattgaggggaacttcctcaacttgataaaagacatttacaaaaatcctacagctaacaacatacttaatgttgagaaacgagaagctttttcactaatatcagaaaaaaggcaaggatgtcctctctcaccatctcttttcaatacagtactggaagtcctagcttattcagtaagagaagaaaagggaaaaaaaatgtatatacattggaaaggaagaaatgaaacttcacagatgacataattgtctgtgtagaaaatctaaaagaattgacaaaaaacttcctggaactaattaatgattatagcaagttggtatgaccatataatggtagatatacatgtgtgtagagggtgtatctgtggctattgggaactctggtttttgttcagttttgctgttaatctaaaactgccttaaaaatagtctattaaaaaggagaaaattcaattgcgtatgtaatagtagggaaaaagtaccacataaacatgttgtatactgaatttgccttgaatgtcttaaattagcatgccttattagcagcggtagacatggatagttggcatacttcctttgggggaaaatgtgttagctatactctgataacatacacagctgacaatgccagttaacattccgaaaattttattatagtggaatatactcaattgttgtatcacagtggaatccaaaaatgtgtagcttaaggatttactacaactattagagagtgttaatactacgttgcattcgcatttttgcttttaggatttctttcagaataagcagtgcacgttagagtctcacaaccttaacagtagttgtaacaaagcagctgagtaacataaagttgccaaagatctgtatggcacaaaaatgtttgcagtagacagtcttcaaatgcccttgctacaaaaaatggtaatttaaaacattagctcacttgatgccaggagtttcagaccagcctgggtaacacagtaagattccatctctacaaaataataataataaaattagccagatgtggtggtgtatgcctgtatcccagctactcgggaggctgagacaaaaggataatttgagcccagaagtttgggctcaatcatgccactgcactccagcccaaccaacagagtgagaccatgtctcaaaaataaaataaaaaataaaccactggcaaggagctcaatgtggagaaatacaaaattgacatttatcttagaggtgtctttatcagtcacttgttaaccacttgccagcttacttactgaaaagtttttcattgttcctaaaagaattatttagtttttacctgctgaagacagtaatctctagtactgttgctttctgtggcaagtaatggaacctggtcaaaacttaaatccagaaaatactcactggatttaatgatttaagcagagtctatagaaagaaaaccatatttgatgtactgattgattacacaagatgttgagttgatttgcatatggtacattatttatcaacattgttttgttttacaaaagcatctagtaggatttgtgtgctaaaataaattctgaactctcatgtattatacacttaggtttacaaattcatatataagtgcctgaatacattatttgtctattttatatgttggcatagaaaactatattttcacatgacttatcttagcacaatagtgggaagtgttgtagatattacctacagttcctttttgcaaatactttatccttttaaataatatcctctgcttcctccagaaatgttgtgcaaaacatggccaacatggttgaagttaactaatatataaaattttcattggatctaagataaagtcaatcaccattgacaacttgaggggagagacactcttgcttacagagtatattccgtatataacaagctatataacaagttagatggtgtggttttcttgttttgctggatagttctattaagcaggcatttattgagcatttaatttgaacaagccataattctaccaggcacattagtgtgagtaccgtgattcggcctgaaagtcatggtctttcttctaaagttgtttagcatctagttgctaagttgacatctgagaattcctgctggcagctattgttctcttctttcttttggtttgttcagcatttctataatctgtctcttaccactgctttgattttgtaaaccttgctattttaacctagaaccctatgatctgccatattgaaacaccaatacttcaccagtagagcatacattttcactttactatgtctgtgtttatgtgactttctctttgtataattcatttctgcttccttctctatacaaccaaatcaaagcacaagactattgcaggcaaactctgcaaagagttccctgaacccgggtgcctacctctctcccttagaaagaagggattgttcatttgtctggattttattcatacacaattagcatattccatgaaaataagcaaaacatattatctagtgactgactgtcaggcactagcgttatcttggctaattctcaatatcaccttgtgcagtaaatactcttatcctcattttatggatgaagattctgaaatatacagtttatgtaagttgcccagtgttagtactaagtggcagaccaatcattcaaactcaaggattcacttccagagtcatctctcttagccagtttgctatagtacatgtacatactccattatgaatagttgcatatgtacacaccagtatccttgttttcccccaaaccttaatattaattttcttaagttcagcaatcatgtttatgtgtttcatattcaatactaactagcatttaatatatgctttgtaaatacttgcagaatgtttgtcgaatggataagttaaaaggatgtcatgttttagaagagtgttttagtaatcctgttttgaggcatttatgaaaatgttacttttgccttcagctcttctgtacataacctattttagattctttaactgaagtcaaagttttggtcaattgacagaaaaagaagtcagattatctccaatatgaatgaaaactgctaaagaatattaaattctagctgcaaaaagttgacatgtgggttggcggtggggagtaaactttctgactgcagtcattttggtataataggataatggtcataggaacttataacacctcttatctaaattagtaatgaagctttaccatattctgggtagtgagaaaattgtccatctagaggcataagtcagatgagatgataataggtgtcgtgtttaacagcaaggcttgcaagtcagcagacatcttctaaaacctaacctttgttgtatattcagaaagacacttaacttctctgagccaggaactgccacttattaactaaacaaattactttacttttcttcacctcagtgaaaccaagataaagatacagcccatgtcaggttttaatgaagattaagtcataggacactcataaagtgctgagcatattgcctgcacatgtcagtacatgctgaacttttataatcgttcagtgcatttaactatgaaacattttaaaatacaatatcaatcccatggagttatttgaagaaccaaatgagataacagtatgctatgctgggcccataggaagctatatataaatcatagctgtgaaccattctattatcagataaacatttttaagtttttccaattgcacacccctttaaatctgtcataacaacttaataatgtattacattttaagtacatttttgaattggacattagtatagcacattactatgattatttacatagtccatgtaaccaaaactcaaagtaaaaaggctaaaaaattgaatgtgaaataaacattaaattgattttaagtgagacctaagtaaagcattgtaagatctaaggaagctttatgtcccataaaccagtgaagctatataccaccagaccaaagaactaacctatggctataaattaagaaaatcattacagcaggcacatgaaaacactatgtcagaactggaaagagtaacatatgatggcaagaatcttcttttaattatagatcctagtcaatacacatatttatatgtttatatcaaaaatatgaatgtttcagtaaaagagatgagatttgagaaaaatacaaattattaataggactacctttgttgcataataagaaaactgaatttcatacagacagagtctctaaacattgattttccatcaaagaccagggaatctgaaaataatacatacatttttgtacacattggctgaatgtgtggaataaaatattatcaaattctaaattactgactgcaagccagttaccttctctcttactgaggagcacctggtcaaagcattattttttttttccccccagctccatagtcttccacactttgcctcatttcagtaatgtatttaatgtcaggttgctaccatctacaaacaacatacacatcgtgttgtttaccttcggtagtcctctttatcatgtgcattgaagtccaccttttctacctggtctatgaaatcttctgcacattcatcctctgactctttcccgcatcatatgcagatcttcacttattcttacctgggactttcggcttcagtcaacaatctcacctgcaaactcagggcgtcttacttcttttcacctaacactattctcatctttgccttttagttttgccaacacttatgtactttgctaaccttaagtttcattaccttttgctttttacatagtttaatgttctccatgttagtatgccatatgccctttcacctcaagtaagttataggcttcctaaagataaaaataattgctttctattttgttttcctatcatacacagcaccaagtgcatccaatgcactgtcaatcaatgcctgagaaaatatttcggcgtttttttgtcaggggttgaagtggcatttaaaaacttaaaattctaattgcccatattttattatttatgtctcacccagagtgtgagaaattgagaacacatttctgtgcttggttttatctctaaatctaatgagaaccagcagagatcatcagaggtttagaaaatatataaggaacaattttctataaaagtattttagtgattcttatgatttcccatcttttataacctccttcctgttgatttttaaaaggatgtaaaggaaatattaaaaactttttttctgtaattctttcctttgtggggcactagatgttagatttttgtatttcactctagactctaccacttcataactattttattcaaactcacattaatcaacttcagagtgacctcaagtaagcttaattaacctcttttggtttcagttttttttcttgatggggtaagatgatatctaaatttctttctagctctcatatgtttagcctatttatgtaaaattctttccacatgtagagttcatttcagtcctacaagtctacatattcttggcttaccagagtaaattatcaagaactagatagaactgaaaaacatcacctgaatagggctgatctcagtagatataaaactattaaccatttccaaatcatcaacctctattgtcttcagcactttggcttgattaaagattttctcccccactgatttttctctctatttaatccacttaaatttgcatcattttgttttcttttatcatcactgcttgaggcttcctgccagtatgaattttaaagtcttacagtccctaattctcatctgcttaaatgttataaatgttgtacatatcttagctgcatgatttcctctgggcatttttgaagcttacttaaaactatggaaccccctcctcaaatatcctgaaattcaagtttgatttggtgtatatatctatggggaagacaaccatggctaaacatgagagtagaaaaatacacctgcattccaggtcaagagaaatgtgactcctctgcagttacggagaatcagtttattgttgtaatcatgctgccaagataattggggtaaacctaatagtgtaagtgtagaagctccaaagccgcactacctagtttcacatccaggatctactactttctagcggtgtgacattgagcaagatgctcactctctaacccataggattgttacatgcattaaataaagtgacatatgaaaagcaaatgaaacagcacctagtacataaccttcaacaaatgttaattgttgttattattattaacatgttcaaagacagtttggagtaatcctgtaaatagcaggggaatctcacattcttatttcactaagatttagaaatatgtatagtttggtaaacctgtttaacctatgtttaaataaacaaattttcatatgaagtctatggtcctagcaacatttacgacaggaaaattgattgtattatttcccttgtctataagcacactaaagaatagggacttacaaaactatctaagggagcccgctatagcagttaagatgagaacacctgcagcctgatttccaccacactacctagggcatctcatggagcacatcaagaggaaagccagagaaactaaaggttgttgttagcatcatccattttcttcagatttttcttgtctaaaaggaaggaaccaaaatacagaaatcaatgtttatgtgcttttaagggcctgattttaactggcaggcaaggcatttgatatatgcaactggatttttgtctttctcacacttcactgtggcgtctgaacagagctatagatgatctcagtccgctgtaaacaaaacaaaacaaaaataatgcaagtctgccatgtaacacccattaacaatgcagctttaagatacagatatcttctcctcttgtgaatatttacaatactttttatctctcctaatgcactgtgacctataacactctactggagaattagagatttgttctctagttgttgcatgaacttatgattcatttcctcatatagaaaaaatgattatttgagtatcagagccttatcttatatctccttgaaacctcccatatttcttactctaattctgaaatattttgaagttaatatttaatgtaaaatatgacctagtaactatttctcagttgtttcttactcctcagaaattgtgtctttgcatttgttcctagggagattgagaaataaagatctacaggaatccacatgttaggtgcttttctttgttctttattaagactaagaatgaggtaagaagagtaaagaagatcagagatcagtaatttgttagaatttcagctttaattggtcaggaacacctagagcttgtttccactcacatagttaaatgccttatgtttttcgttgctctgtccttcagtttttcaggtgcggatccaaagtttgctgatgtcaccaaagcagtatatatcaacattttttacatagtgaggcagttaagggcgcaatttctaacaacagacctagatcaaattctaatactttcttacactcttcactaaaggaactgactcatttctctattatctgataattatttcataacttataaaattatgaccaatatctttattatgtgaaagtttaagattcacttttcattatatatagctagaatcattgagttgtagacttctctccacttacaatccatgtaactacgaacagagtacttaacttttttaaatgttattttatttctctgtaaaattgagacattaaaaaatatgtaataacatggttgtaaaaatgtggtgaagaatttagaaattcttcttcaaaagtagtctctgatgattagcatagttgaaaaactgctgacctatatgatgttcatgtcaacccaacagttccatgaaaaactgagtcataagagagtaaatgaaacttcttagctagatgattttaggctttttaatctgtttggataatattcccactgactattcaattaatttaatctaatttcataaatactggatgttttccttgtttcaagcatatacttgtgaaaaagacctacacaggttacagttgaccccaagtcctaaataaaatcttgtgatgcattctgaatctgaataaggcttgctgttgtcacttaaaattttgtgcattacgtacatgtatttatttttaactaaatgttagtacaattattataaaaacctatatatacaacctttcaaaagtgtctgtgtagagaattatttaagcagaatatggattttgctcctttatgcagcctaattttaacatgatgtgtacttaagttatactcaaatgtatattttctattctgcataattttgatgaaaataccaggtttagaattttcctaataatgtattccacttaccttagtaagtatacagcctcctatgagatcaactctatcaataaacactaaatatctccctaaggactcttttttatgttatcactttataatataatacgaagtgatcatgtttttctgtaagctgatttgcattcaacatcaagcttacctattcccctgagtacttttaaaagtactgttataacagctgggctaatagttgaagaatcaaatcaaagtttcaatctttgtatctatgcatgcatgtgatagtgtacatgtgtatatccctgggcccagagatctctttgttgtaatgtcttatttatctaggaaaattaggcacattgtttctctataaacaagaagcaaagactagaaaacaaaactgtaggaaaattttagaacaaggaaagcattggtctaatgaagtgaataatagtttttcacatgaataaataattgcagcatctacttgctgctctgtttgattgcaagaactgaggtgaactattataactacaagattttcattgtattgcatgcaatgtgatggtctccaaaatgtcatacaggatgatccaacattatcaactcagtgtaattgttaaagaatagccatttcattcttttctttgttgagatctatcttgccatcccatggcctacttgaaaaaaattatctctcaaatatctccaggatacatacatggacatcccaatactctgatgttttaatgatcaggtccaggaatggctttaccaacccctgttatgggattctcactctttacacttaggctttcctaattgtttttagttacagctcaacagctttgaccatgttatttctgaaaatccttcttatcgttttctgaaaaattcttattcatcttttaaggctttctccatgttcatcttccccaggaattcttcactgaactccaggtggggctatagataccttttttctttacactgggcttgtgttattaaaggagatcgagaccatcttggctaacacggtgaaaccccatctctactaaaaatacaaaaaaaaaattagccgggcgtggtggcggatgcctgtagtcccagctactctggaggctgaggcaggggaatggcgtgaacctgggaggcggagcttgcagtgagccaagatcgcgccactgcactccagcctgggcgacagagcaagactccgtctccaaaaaaaaaaaaaaaaaaaattatctgttatgtgttttcttcattcgactcttcactccaacacctagggttctttctcatatttacacttcaaaatgtttattgaactgagaatgatttaagaacgtagatgaagtccttgacaacacacctgaataagaaagcacattttgttttgctgctggtacttgattatacttgaaatgatagaagccttcaaaatcaaggaaaacacaggaattttcagtagaattagtttttatttttcttctgaaatttggtggctcacacctgtaatcccagcactttgggaggctgaggcgggcagatcacgaggtcgagaccatcatggctaacacggtaaaatcccgtctctactaaacatacaaaaattagccgggcatggtggcgggcgcctgtagtcccagctactcgagaggctgaatgaagcgggagaatcgcttgaacctggggttggaggttgcattgagccgacatcgcgccactgcactctggcctggcaacagagcaagacttcgtcttaaaaaaaaaaaaaaaaaaagtaattaacttagaggcaagctgaaatcaatataaatttcatcttagatggcacaaaaaagatatttccaaattagataggcatagtacataaaagagtagcctgtcattttgctatttgctagagtttgggtttattcgcaaatgacctgatttctcagttatttgttagctacatgcaattggcaagtatagctccttaaaccagaattgtggaaagtcgtgctataatagatgaggtcagcagcctggctaaacttcaaaacaaatgagaagttcataattctaaacctgggaatgttgacgcataaattggctgttatgaatttatgaaagcatcatgatattatattttctatatgggaagtgtatgcaggaaaactgtagagtgaaaagggcttactgtagagtggaaagggcttactgtagaaggaaccaactagtctgattggcaaaagctgggaagagttttctgcagagccaacatttacgctgaaacctgatatcttggatattatttagcagtatctccatctggctaagagatggactatactcattatttttcccaagttagtcacctggaggtgatgaatgattttttttggttgatgagctactggggaagaggagaccaaggagattctggagcctgttaggtatgtaaggctagtaaaaggagggatgcaatattttggcaaagtaagaagattatgcatccttaaaaagataactaaatggtctttattgttcctactctggttaattattttctgacaattaatatgtatcatccttattagactttaattataatgcaaattaagaattgcaaagcatgattttccacatgacttaatatgtaacacctgtaagctctttgaggacagggatcatgcattatttgaatgtctcacacgaggaatgcctcaacagatttaacttcaagcaaaatgtatacaaaatgaagtatgactttgtgacttctattagggcataatactgagtaattaaataatacactgtttctagttaatatcaacaatatacatttcattggtttcacaactgcttaggaggaatgggttttgagatggttttgtaacaaatagtagtccaattaattctttagtacagttaaaaaggttttgtcaatagaaaaatgagtgggccgggcatggcaactcacacctgtaatcccagcactttgggaggacaaggcgggtggatcatgaggtcaggaatttgagaccagcctggccaatatggtgaaacctcatctctactaaaatatacaaaaatgagccaggagtggtggcacgtgtctgtagtcccagctacacgggaggctgaggcaggagaattgtttgaatccaggaagtggaggttgcagtgagccgagatcacgccactgcactccagcctgggcaacagagtgagactctgtttcaagaaaaataataataataataataattaaataacaaagtgtgttttcccccttgagcattatatttaaaaaataaggccagattcttatagataaaagataaaataagagataaagttaggttatcctattttcctgttctgtcataaagacaaactgaaatacatttaaatttcactttttagatacaggatggtccaaatgatatagtcctagtttaattattgaaaagctagaggcataaatatgctatgttgaagaaaatatacataatacatataatggataatatttgtattcttttatggttataggaataagataattggttgattatctaatatatggcatgccctttagagatgttatcccatttaattcctgtaataatatgaagaagagatattatctgcctttttaatatgatgattagaagtatcaggaatttaagtaacataaattcacaattacacagcttctagatgttaaaaatgtaatttgaatttaggttgcctgacctgaaagtacagacattgctttaatcacaaaattgctgtctatctagatggtaagaaacctaaataacatttgtgacactggatatgacatgttgcttaattatatataccaatgtaaagacattgttccgcctttgcactttttatttttgaaaacattaaaagtcaaattcttcttgctcaataaatggctgtattaaagaaatgccattgaaaagccagctggaagagaatgaggttaaagctgtggttctcaggaggaggtgggggaatgttgcattccaggagacttttgactattgactgttacaatgtatgtagcggtgggatgggtagggagaggtgctcctggcatccagtgaatagagcccagacatgctgctaaacatcttacaatgcacaggatagaccacagcaacaaagaattatccaacccaaaatatcaatagtgctgaggctgaaagagagggttaaagcctttgtatggagcctacacaaaaagaagtaggggactctttttgtctgtttattttggtttggatttctgttggatttaaagatcggttgctaccagcattacttccttgtaggatactggttgtcttctaacaaagacatcttcatttttaaagaccttcattcttgtgattggaattttaaatcctgtgcaagttaaggaaatgttctcttacatgttaaaattgaacacagtttattctttactgcagaaatttcttcctcattcagtacctgacaaagccacttattgtttcttataagatttcctgatccttgagacacaaagcgatgcttgagtgcatcttttgaattagcagattttggggagtgtatgcaagacgagtaatgaagttagaaagtaatttaaatctaaaaagaactcaatggagtttatttagaaagaaaatggtttagaagatactattcttttaaaaaaattggttttatcatgtctgaagagtatacacagatatgatttttctttcagacacatgtgtaattcctatcatggtaatatgttgaatttaacatttatttaatgcttagtgtttacaaggagccaagagacacatttgtcaacatctgcaaatggcaagatattccacagcaaatagaattgtttgtgtgaatgttaatgtaaacctgtaaaggacacaactctttttgagatgcgattgtatcaatattaatgtaagaggttttctatcatacatttacctcatgtgctctacctaaaaacaaacatctcttgctgcaatatggatattgatgtcacaacctgacaatttaaattagatagttctgctttgttacgagaaactatcaaactcggatgcaggcttctaatagatgtggggcccctagaattgttgtccatttcttgtcctatagaaccttccctctattatctggcatattaatagcaatttctccttgctgctcagtatcacaaacttgcccagaggcaaggaagcaaaaagaggctgtcttcttggaatttgagggtggggacaaaatatatgaagacaattttatgtctgagtgaattatcttgccacaggtgctatatttactggtacagtagaattgctcaaattttatattagctggtggatatattttccattgtcacaaggcctattctggatgccatacaattgttcaatacccaacaatgcatggtaaagccatatgtatgtatttcaaaaagcaatagtacactgtacaaaagtgtgagaggactggtctattaagatcagtttaaagttggcattttaggccctctaagatggacattaaagtatgcagaactgatccagccatctggagggctgaaaaaaaaatgattattatccctgaaagttgttaatctctgaaaatctgccaaacacctgaagaaaactgctaggagattctaccctcaaacacagacccaaataggctgtattggtcaccattccatttttgaaagctagccggctaaaggaaagatatcatttaggaataatggctccaagagtaaattctccaggaaatcagacatctaattagctagatcatttgctgggcacagaatgtcaggagtatcagtttcttttttatttttttaggagtatcatttctattaatttattgttataaatttattcttgacaaagcagggttttttttgtttgtttgtttttgctgtttttttctatccactccattgggactaagaaccaacctatgtttcagttacttgtgatacacctaaagtatgtatgagatgagagcgcttggaatgtgacataaactaaggtgtaattcagtatttcaggacaataacttcctgagggatgccacgctgggctcatgaaccaagagtacatgactgacttaggtgagtcaagcagatgcggatgtgagccctcaagcacagaaacctgctcagtgaggcagggagaggaatgaaggaaaatgatgtggccacagagcctagatataaccagcaggcagtttaggcacaggctttgtagggcaaaacttcctgggatcccaattccaaaagctgtctgtaccaagatactggagcaggcagggagaatatccaaatgatggcccaacactcacgcaggtggcaagacctctaccaagagacaattttggtaccagatcgaacttcaaggaactggcatgggccaggtaaagtcacctgagaggagggtagtggtggaatacagaatgtaacagtctcttagtacataggaaatggagctgctgaagcacaggaaaaggacaacatgatgtggtgcggggaccactgccccttcactggtatggaccatctgggtcaccttagcatcagcttccttgatctgatggccgtaaaaatgcctgggcctaaactaggtgctcactattgggtttgccattctgacttcattccaggcttcagctcccatcagaaatgaaggggcaggagtttggacacaaaggctttcagcaagtgttaacttatcttggaaaacgaatagtctcatctaaaaggtgaatttatgtgaggtacaaaggaagatagagtctggaggtggggtgacattctgagtaagtcgttcgatgccccaagagagaaggttgcgataacagtacaaggcattttcttatgtttgttggtgggcttatgtttctgttttagattcatctgtattgatctatagtgatgctcaaatgaagtatgtggctctgtgcacaggacaattccctgaagtgtgtcctcttttgtgaatgtattgtgcttcttcgaagagccctttatgacttttccacatcacattgattttttcctttttaaaaattttgtaatgcagctagaaaaatgtaattgagtgtttaaacaatccttgcttcatagtctctaaatgtttcaaatatgtaattcttgtttttttaaaacacttgtaaggggggcaatctgttgcttttttcttctaggaggcctaacagtgtttggctagacatgtgatcaaaacatcttgttttttgatcgatcgattatctgcttgaatcaaaaatctgtcattgactggaaacacgtattaattgtgtgacattgtactcagaaaacagtagactgaaaatcgatgactaagagttctaatcctaattccatataagtttttttgtgacctgaacaaatgatgatttttaggttacttatctgtaaaataaaaatgtggtaaagggtttacagttagaattaattatatatgaaagcaaactttcagatatttagacagactgaaatgagaggaaactagatcttgctactggtcccattttgagtaatgttgttaaaaataatctacaaagcaatttgataccctgaaaaatagagcgtgaatcgaaaagaactttccttaatattatcaacgtggggatttacttggaagcatttccccatgttcacattaaattttctagaaaaccaatgaaaaagtgaactatatagcagtcctgtgcaatttgaaaaactacatctgcatcttctagagtctgttactataatacttcacagcattttacaatcagtatctttagtgctataacctaatgagaactatctggtgagtgtgattagaggtaaagaatgtctgaccttgtaatcatggaattatttttctaataatgccttcaaatgtatttgaatggaagttattattactaaatgaaataatcttagaatcacagaaatcattataccactttttaagcaagcattcactgactaggaagcattaaaaggtttttttgtaatttgtaaagtgatgaatattagtataataaagaaagtagaagtagcctaagctgatgtctccttttttagttatatgatagtcatttaaaaattctgaacctggggccgggtgcggtggctcatgcctgtaatcccagcactttgagaggccgaggtgggcggatcatgagatcaggagatcgagaccatcctggctaacacggtgaaaccccgtctctactaaaaatacaaaaaattagctaggcatggtggcaggagcctatagtcccagtactcaggaggctgaggcgggacaatggtgtgaacctgggaggtggagcttgcagtgagcttgagattgcgccactgcactccagcctgagcgacagagcgagactccatctcaaaaaataaataaataacataaaaacagaagaaaaaattctgaacctggttctttacctgtttaccccttcgctcccctatttctccagacatagcaatatgaaacggtgaagaaatgcttctcatccaaatttataaccttttttgtcttgctaagtttcagattcagtatcttcatggaaaaactttgaattaagcttgaactctgatatggccatgtcatgtggctttatgtttttacagaagaggtatgtttgtgttgctgaggtggtagttgatgatgatgatgatattttggtggtgtaaaacttgaaacgcttatctgaatttttttctcatcaagaatggtatatttttatgttatagcaagtgaagaatatctttttcaatgattatgggttaggggattatggactttttaattttcatcttttgcacttatatgtattctccaaattcccttattttatatatgtacacatgaatgcaatatacacacacacatattgctctaatgctaggaaaaggaaaatttattttggtgttttaaaagcatctaaaataaagggaaggaaacataatgttggagattcatgaatgcatatagtgctcatactaatgatcattctgagaaattaattttgttctaaatgagattacttctttttatctctactcagttctatagttactgcacagcattaatctataatagccacgggaggtcactggcattttttctatgcagcaggatatcccactggtccaatgctatgacacaggtagctagtgtgtaggtttagacaatacttcctcctcaaaacccatctggatgggctgatttatgtggaggctgagacatctctggcagtggaaaagacaagacttctgtcaatgttggactttgaataggtacaacatatctaattggatgcggttgtgaggtactgtgaaaaaagcaagattataggcagggctgaactcgtcataaagaatgaagtctgtcatagtcagcaggatgatatagccgtgtgtggcaacaggtaaagtgaaccaggcaggtataaatatttgaacaggaaaaatctcatgtttcctgggtatgggtccaagtataaaacttctaaatcacagcacagcagcaagtgtttgcctttcagaggagcttttgtggacaggatgggctgacagcaatctttgactgacctaatctttggagatctgcacgtcagtgggttcaggggctgaaatgatcccctggggccagtggtagagtccgggtgtagttataagaggagagcgccagcctcagtttttgtattaatggtggtggcagccctgcaggaacaagggcctgtgcatcagtggttctctggcattgtgtctgggagagaatgatcaacaagactgtagttgagactacagtgtgaccaaataaattgggcagagagagacacatgtaagagacttccatctctgatctctggagaagcacagagacttttgtattccaatatagattgatttttataaaaagatggatttaaggggctcatagccagtcatctccagtgttgtaaatggcaaccaaatatttagtagaaatataaatccaattacatcaagcattatttaacttacacagtcacagaattcatcagtgtttcattattctgacattttttaaggccaagtcatcaggttgtaagagggaattcataaggacagaaaaacataatcgtgctacttcctttgctattacatataagtaacaatgatagcaaacatttataccctttagatttgttatctcactgaattatctctgtaaccttatgaggaaggtgcttttttaaatcactattttatacatgggaaaattaaggcagatggaatttgagtaattttcccaggatcctacagtttacaaatggtagaaaagggatttgaactcaagtagcatgtgattacccactatgttatgcccaatactgggagaaatatgctatgctagaacatgctatataaccaataaatggaatatttatttgaactttatggtactttttgactgtgtttaaatgatttatttaaatcaagattccatctgagtttccctactacatagtgcttgtgaagagttacagtgacactagttaacatgactgagtagttggtggcttctattagcagtaaattgatgacgtgacaacctggaatgagaagaagggtagaaaacacagaaaatgtttgttctttaagagtttatgatttttttgttattactgttagggaaaacactattattgtagtatgttttaattaaagatgaaataagatagaggtttgtatctatgatatcatattgagattaattcacttaatggtagcagtgcagcaatcgataaatgctttgactttgtactaagatgaaagtcttacttggataaaaacttacagagctgattttgttaccttaggaaaggcggaatgatttaagcttggcaaatgcatctaaaataagtgttcattattctatttaggtaaagctggagggatttatctggtgatgtgctttatgactgtccttggctctgtctacctcaacaatttaataaataacagaatgaggacattggttgcagagtgatcatatttatgctctatccattcacttacacagaaattcatatttacagagtacctcctatgtgtgccaggcactatcttaggacatgaaatgcagcagtgaacaaaacacaaaaaatgtattgccttcatagatttttacattaaaatgtggaaagagagtcactcacacacaaaaaggacaaacaaaacatataccatattagagataggcactgtataccatattggtgataggcactattaataaaacgaatgaagtgggtagaaagtgccaagggttcacaatttttaatagggtagtcaggtaaggcctcgggagttgttgacatgtgactaagacttcacagatgagggagtacattatttagatatatgggggaagagcagagggaacaagtgcaaaggcctgaggcaagaaacatcaagtgtgactggagctaagtaagccagatgtgatgtcagagaggaacagagtgaggccgtacccgcagagctttgcaaatcatgaaaagatgttggctttacttgtgagttagtcaatgaagtattcagaacaaaggtgttacatgactttacttgttttttagatggtgtgattctagttgatagggtagaaaaccaattgtaggaaaaataaatgatggaagtaaggagagctactacagtaatgcatccaaaaggtgatgataacagtaattattgaggtggtagctcaatttctggatatttgttcattattgaggtaaaatttacattattcatactgtgtaccaggcactgttttttatgatatattatggtttaaaaaagacttaacatgaggtctacaatcttagcaaatatttcagtgtacagtacagtgttgttaactataggcacaacgttgcatgcagatctctaggacgtattcatcttacataactgaaattttacactcattgaacagcaatctcttatttccccacctctctttcagcctccagcaaccaccattctaccctctgcttctaggagttttactattttagattcctcatataagtatctgcccttttctgcctggcttatttcaccctgcgtaaggtgttcagagttcattcatgttgtcacatggataggatttccttcttttttaagtctacataatattccattgtatgtatatcacatgtttttcctactcatccatcaatggacctttaagctgttttcacatcttggctattataagtaatgttgcaatggacatgtgaggtcaaatatctctttgagatccctattttaattcttttggataaatgcctagaaatgggatatttggattgtttggtacttataatttttcaaggaacccccacactgtttgccatagaagatgcactgttttacattcccatccacagtgtacaagagttccaatatctccacctctttatcaatacttgttattatttgtttcttggtaatagacatcctaataggtacaaggtaatatatgaataggttttaatttacctttcctgatgattagtgatattgagcatcttttcatatacacggtgttcatgtgtatatcgtctctgaagaaacatctattgaaatcctttgcccatattttacttgggtgaaatatggcaagaggtgtggctatttatttgtagtgattccttatatattttagatgttaaacttttattggatatatagtttgtaaaaattttctctcattcaagacatttccatacagtagatttctttcactttgttgattatttcctctgttctgcagaagcttcttagtttgatatagtcttacttgtctcttttagtgtttaatgtctgtgtttttggtgtcatatccaataactcattgcctagaccaaatatcaaggagcttcctccctatgttttcttctaagggttttacagtttcaggtattccatttaagctattaattcattttaagttgatttttgtctatcatataagatagggtttaatttcaatcttttgcatgtggatactagttttcctaccaccatttgtttaagaggctattctttcctgattagatacactggcaatcttgtcaaagatcagttgaccacatatggatgagtttatttctggactctctgttttgtaatattggtttatatgtctatctttatgccagtaccatactattttgattattttaacattgtcatgtattttggaatcagtaagtactgtattttgaagtctgaggcctcaaaatttatttttctttctcaggattgattttggcttttcatggcctgttgtgggtttctagtgaattttaggattatatttcctatttctgtaaattatgccattggaattttgatagggattgcattgattctgcatattgatttgggtggttggacattttaacaatattaagtcttccagtctttggacttttgatgtctatttgctgtgttttttaaaatttctctcatcaatgcagtgtttttttgtaaacaagtctttcacctccttagtttattcttacatattttattctttgtggtgcacctgtaaatgacactgtttgcctaattaccttttcagatagttttttgctagtatacagaaatgaaactgatttttgctggttgattttgtatcctgcaactttactaaatgaatttatttgttctaacagtgctttttctggagtctctaatgttgtctaagatcatttgtctatgtgtctatagactttagtgttgtctatgtataagattatgtgtatatatgaatacatatatacgatcatgtaagatggagtcggaatattttagttctttctgtttttgatgtcatcagtttctttttctggcacagttgctctggagagaacttctagtaatattctgaaagaagtggtgagagtggcattcttgcctcattcctgattgtagagacaagctttctgttcttgttaagtctgatattagttgtggacttttcatatatcactcttgttatattcaggtaatttcctttacttctcattttcgagggtttttatcataagaaggtgttgaattttgccaaattctttttgtgcatatgttgagatgatcctgtgatttttatcctttattctgttgatttgctgtatcacgttaactgatttgggcatgttgaacatccttgcatcacaggaataaatgccgcataatcatcatctatgatccctttaatgggctgtgggattccatttgctagtattttttgaaaatttttgcatctatatccatcatagatattggtgtgtagttttcttgtggtttctttgcctggctttgatatcaggataattaccagcctcaagaattgagtttgtaaatgttccctcattttcttttttttttttttccaacagcacattgaaacaatattttactattatcgagtgcagtttatcccagggatgtaaagataatttgacacaggcacatcaataaatgtgatgcatcacattaacagaaaggacaaaaaccctctgatcatttcaaaagacacataaaaagtatttgacaaaattcagcatatactcataataaggaaaaattgtgtacttgattaaatggtttctgctgcttttttctcttttctttttaaaaataatttcaacttttattttagtttcagggagtgcatgtacggattttttgcatgggtatattttatgatgctgaggtttgaggtacagatgaccctgtgtgatgagcataataaccagtaggtagtttttcaccccacatctccttcttccctcctttagtagtccctagtgtctgttgtttgcatatttatatccaagtgtactcaacatttagctcccacgtatcagtaagaacatgtaatttttggttttctgttcttgcattaatttgcttaggataatggcctccatctgcatccgtgttgctgcaaaagacatgatttcattctttttcatggctgcataatattccatggtgtttatgtaccacattttctttatccaacccaccatgagtgggcacctagattgagtccgtgtctttgctattgtgaatagcgctgagatggacatgcaagtgtatgtgtatttttggtacaatcatttattttcctttgggtatatatccagttccctcattttctatttcatattttaaatatttggtagaatttagtagtgaagtcatcttatcctgggcttttattttttgagaggtgtttgattactgattctatttctttatgatgtagttttgatatgtgtgtttctagcaatttgttcatttattctggattatgtaatttgttagggtataatttttcatactagtctcttatgtgatctaacatatgaaatactctggagaaagatgcatgtctgagaagagtgtgtattctgctcctgtttggtagaatgctctttaaatgtcaggtccattttttctttaatgttattcagattatctgttttcttatcgatctgtctggatgttgtgtccattattgaaaatgaggtgtgaagtctcctgctattattgtattgtggtctatttctcctttcagttctgtcaatgtttgctttatatatcgaggtgctctgatgttgagtgcatatatatgtttatcatggccctatcttcttgacgcattgacccttttatcattataaaagctttttctttgtctctgaaatagtttttgacttaatggtcatttgtctgatgtacccctactctcttttggttatgatttataatatatgggatatcattttctatcccttcactttcagccaatgtgtgtccttaaatctaaagtttcttttttttaatctgttcagtcactctatgtcttttgattagagagtttaatccatttaaagtaattattgataggaaaggatttgctattgacattttgttagttgtttcttattattcttacagtacttttgtatgtcttcctctcttgttttccattgggttttgttggggttttttttggtattgttatgcctcaattagttttttgttcttgttgttttgtgtaaattttacagatttgtatgtgtgtgtgtgtggttaccttgctacttacataaaatatcttacaactgtctactttatgctaataagttgaattgcatacaaaaacttacaatttaacttcctccccagaacatactttatgttattattttcaaaatctattcatattatttatcttttaataattgtgtttgtatctttatagttttcaaaataattttttcttttaacttttatgctagaattaaatgtgttttacccaccaccattacaataatacaatattttatatttgtgtatatatttacttttctcaaccagttttatactttcttatgctgtcatgttgctgtttaatgccttttcattttgaattgaagaacaccacttaacatttcttgtaaggcaggtccggtgttgatgatctccctcaatttattttgtttggaaaagtctttatctctctttcatttttaaaggacagtttttgccaggtggagtattatttgatgacagttttatttttctttttccttcagcactttgaatatatcacctcatcttctgccctacatggtttctgttgataaatttactcatagtctcatggatatttccttgtatgggactggtcacattttcttgatgaattcaaaattctcgtttgtctttgacttttgataatttgattataatgtgcctcagtgtgtatttctttgaatttgtcttattgatgttctttggatttgtggatatggatgttcattaacttccccagatttgtgaagccttcaacaattatttctttgaataagttttctggttgtttttctctattatcattaagagacttccataatttgtatattggtctgcttgctggtattccataaatttcttaagctttctttaaatttttttctattctttttttctctttttactcctccgagttatttccagtgacttctattccagttcgctgatactttcttctgcttgatctagtctgctgctgaacccctttagtgcatttttcaggtcacttgtgttcttcagcttcatgattttggtttagtactttgtaatattttctctttctttgttgaaattcttactttcattgggctctcaaccttatgaaagttatttttaattcattgtcaggttaaccatttcattagggttgatttctggaagtttatcttgttcctttttttggagcatcttagtcggattcttcatttttcttgactctctctgttggtatctgcacattagacaaagcagacacctctatcagtctttactgacttgacttgtacagaaggctcccaccaatcaacctacccagggattctggtggcctctatcaactcttttcctcccacaggaagggaaggcttttgtcagcttactctgtgataaactgaagctatggtgtctataacccactgtttctatttttcctcaggtggctagattgtgccatctccatcagagcttcaggactcacaaggcagaagctagttgtttaggaagccctagagatattgtagcattggatacacagatcaactctttcctttccaagaagaaagctgaaaaaaaattgggattttttttgtttgttcgtttgctcactctgtgctgagcagtggggagtatcaatggcctgtaccagcccaagatgttgcctgcattcttcctcaggtgtctagactgtgctgggcccatcagagcttcaaggctagcaaggcaaaggccagttctctgtgtccccccgccccgactccccaccctgcttccttggaaatgcaagggaactgaacatgggatccaagcccttacctcccctgggtgaaaccaggagcttgggcatctctttctgatcttagggaaccacactgagacaagggtgtctggtgagagggtgtttcatatctctctgtcagcttcagtgagtctggttttgcattctcccaggatgcaggaacctttcaattagtttctgatttcccacacagggaattcttccatcaattgtggctgaatcgatatgcttgtatgaagaaggagagtctaggatttcctgttctgccatcttgctgacatcactctgctacattcttgtatgattagttttgtaggcatatgtttttatgtctcttgggtaaatactaggaatacaattgttggcatacagagtaggcatgtatttaacactgtaaggtatcttccagtttttcaaaatgtttgattttcagtctgactagcaatatatgagatgtcaagttgctctgcattctagctaacgtgttgtgttgtcagcctttttaatgtcagcagtagtgctatgtgtgaagtaaaattttaatgaggtcttaattagcattttctggatttattttttatggacattgagtaggtttatgatgattggatattgtttcaagggaaagagtggtaaaaaggatggcacaagggacatttggccttatcaattaaaaagtagtattgtccattaacagaaatggggatgactgaaatatatgcaggtgggggcaggaaaaggaatataaaaaattcagtattaggtgtgttaattttatattcctattagataagttcaagtagagatgtcaagtaggaggttggctatatgagtttaagttcagggaaatatctatttgaaaatcatcagcatatagatgttaataaagccatgagatttggtgagatcactaagggaggaattttaagtagaaaagagctgagaactaagccctggactcctccataattggacccattaaaagaaaccagaaaaagattttgagattaagtagccagagaggacagaagaaacgagagaatgtgacactcagaagcccaataaaggagagttttcaatagagaagtagtgattaattgtgcctgatattgcccaaagggaggattctgctacattcttagggaacaaaaggttgtggtcagagggtgggatgcttgaagctataattatattcagttctagttattagtaatgtaaaggtctggagaatgatgattgagacagtggctctattaggctgaaggacaagatcacaggaagaaaggaatttaagagacaggtcagtttgttggaagcatgttggaacaagtgatatgcaattggaaaagctttttaaaaatgtgtgtgtgtatgtatttgacaagcaagaataataggctaaatctgtcaatatgtcatttactaagattaaaaaaggaagttttgtattgaggtgtaatatattaaatgcatcagggaaataattatttaacgttaggctatatatatggaatttaatggatttagttgactgtgaacttagtaaagctttgccattagattcttaatgatttccaataaattttttcaaaaaggacttacaaaaaacatggttagtccttatctgtattaaataatttcagcaaccaaagtaagaaaggctgctcctctttacaagcataggtcagccacaccttaaatgtcatgtgccttcacatattctatattgagcatatcaaaggaagagagactaggattatgagcgaagttcaagccttatcacatgactatagtgttatcagacagacaatttcatatatttcccttgagaaaaaaaaattaaggaaaagtaaatgagtggcattttatattcctccttgagcagtagtgacaggagaatgtagagatacccctgcttggcagtattaagaatttttatattttagtgattgatagcactgcttaatcagcaatgtaatccttaaaaaattttgaaaatcagtaaacgagttaactttatggtgaagacatcacattttctggattctaagacaccatcagttacaccatataccattattttatgtagcaaactgccattataattatgatatgccttcatttttaaaactcattctgatttcagaaatattaaaatgtgaaaaaagggttttggtatgtatagtgatatgtagcaattaaaaactgtagctcctcaactttttgttttgaataatgttggtgtcttagtgtgctatgtatctttcacataatccaaatctacaaaaatatatttttgaaaacacatactttttactaaatatcaaatgcttttttatataaaatattatattttattatagttagaagatagctaatgccttctctgaataacttttcaaagcacgttcagctcttagagatcagtaacaaaattcttattgggttaatatcagtttttcagataaaacgttattcttcatttgcttcactgatgccatgtcttttgactattagtaacaaaattaagtctacataaagaatatgttagagataccatgtatcctaattactccacctggggttccttcagcagtttgctctaagttgctcttttggctgtgttgtaaagtagttcacacacttgtaccttctggtttatgggtgaattttgtcagtgcattctatctttatttgtaagagttcttccttgaagtcagattaggctatcgcgggaacagcatgcttctaagatgtttgtgtaatgttgattaatgtgacattgtattgtaactttatggtaataattctttatcatttaaaagcatcttgaattcaagatgtttttactttaatgcagattttcttatgaaggatcctaaaaacttggatgcaataatactgctgaaaaaaacattgtttttgtttttgtttttgtttttttgtgtgaatatgcaccagaaagctggactttaaccttaagtaaatttagtggagagcaaagaagtggcacttcacgaaagtgctatgaagcagctatttctaacatcaaaacatccggtaacttgtaagcttcatagttttctaattactgaatgccggctacatgtaaccatagccattatataatcatgtttaaagatgagagtaaaggaagtggtaaagatctagataatatgtaatcttatttagttaatgtttatgaatgatgcagaaaaaataatttaagaaaaacactaagccatagatatactctttcacagatagccaagtagtgaaggcattaggtacagatcattttggaagtatgtacaggagaatacgggatggatataaaattctgcttatttcttaaagtaattagctataaaatgcttttttactttgaattattaacctttctaattatttgccttcccaccaagaaaggcatgagaggtaaaggtgggatgaatcaatttcatatttttcaatagcaaatttgaagtgaattcaattttggttaaggtagaaaaacttatttcatagaaaaattctgtggggaggtccaggagaaaaattaatattgtatttgcatgccataggtaggatcacagatgaatttcagtggtacccaattacctatatctaagcaaaaggtaaagccatccttcctaaatgatctgtttgattgatagcatctttctcaatatttttgattgtacaggaagaacgcagcaaggcaaaatggtcagcacaggcaatgaatgagacagaaagctgacctgagcatctgcctgtgttctactctgttgtaattttagttgcatcggtataattccatattggcatcatgccgtctttcactttattttgcattgtcatataaagctaccattaaggcatatactctgtcctaaatctcatttgatctctaagtaaaaggtcttaacatatgtaacaaacctgcacgttgtgcacatgtaccctaaaacttaaagtataataataataataaaaaaagaaaatatgtagatgtaattggttattacattcaaattaagttcacattatttcattatgatttatgatttaacttgtgttatgcagtgattcaatagcttttcttattttgtgcctagattcattatattattttttataatcatataatatttattcaattttataaaatctgtcattataacatcacattgagtaaactcccatgtgcagacattaaaacagttaaagcagaaaaaaaaaaaaagctatcaggaaagatggcataccttaggaggtttgctaactaaactaaggaaatctggttctctttctcctcaagatacagccctgtagatagctgcagatttttttcaactgaggtctttgtgacatcagagtattagagtattttctttccttcttgtattctggaggtttaaacagagccctggggataaggcatgatgctatcataggaatagattcttgtcacaagggcagaaggttcatatgtcttttctttcaggtctttttctttagaactgatactctcatttatttatatccaaccttaatttaaaaagaggaggtatggctaaaaatatgcacacattgcaataacataaaatgaattaaaaaatcggaataaaaaggaaacaacactaggaaactcaaatgaagccgagattaaatttagaaagtagaaagggatgctctgcaatgtaaattggaatattgcaagtattgtctttaaataattttttcacttctaaatgaagagaaaacaaatgattataagatttgaagtggtcatgctattaatactaatacctcgggagaaaacaaaaacaatttttgcattccagttctcgtagggagcactgtggtgaggttaacggcatcctcaatgataccctctccagtgagtacaataaaaattattgtaggcattcttcttattgtctacatgtaatataagcccaggagtgacagcaacatgaaaactcagtaaaaagcacgtttataaaacagtgatcatctgaaaacagcaatctctgaggacagaggtctataattgtgtcattttgttactgggataaaaacttagaatatatagaggagtaaattggcaaagtcatcctgtacaggccggagtaaatattttggttttggaggtcatatgttctccatctctacctctcaattctgcctttgtagcatgaaagaaaccataggtaatgtgtaaatgaatgggtgtaccaataaaactttaagcagttagatggtgagccagatttggttcatggactgtcgtttgccaaatctgatctagagaaataggattttattcacattagagattcatctagtctgtaacttctcagagcaaatttttaataaatatttgaaaacaaagattagaaattcaagtacatctttgaaattaaagacctgaaagacattctattaccatgtaagggtactatatgatatagctccccaaccagaaagtggttgatatcttcatttaaaaagtaaaaaatttaaccagagttacctcacctctgaataaggaaggatgaatgagtgtaattaatcggggaacatttcccccttgccccaaattctgcattctccagaacaaatgtatgttcctatgtgactcatggaaagtacaataataaatcatgtgcacctgggaatgatcacccacctaccagatctgtgaacatgagcaagtttttctcacctatttttaactaaatctccttatcaggaagttgggcataataatttattcctcacagggttgctataaggcaaaatgtttagccattggatgaatgattgatatgaatcgatagatcatagtttgggccctaaagaacatgccagaactcccaaactcttgcatatgggactgtatctaactcacagacgtatttgctttgtcctgtgaaacatggactgtataagcatctgtgatgcaaatgagaaaaaaaatggtaactttacatgaaaaaatacattttagggaaaagaaaaacaagtagatctgactgccctgggcctgctgcattgaattaaaacagtccatgtgagcaaggcatgtggcctccagtgtgcacagctgctaccagacacctgtcaccctggagctcagactgggctctgctaccattcacagcccagcttgtcctgctgtgttgctttagtagtgtccataagaaacaaatccttcttggtcccatgtatatatcttttctttttcttttgtatacctggcctgctttgttttttttctattatgttgttcttgttaggatcccagagtaacgtaaagtcagggggttattagtagctctgtgataaatgaattctctagttaagtaagcttaggtatgcttaaggaagcaaagaaaacaggtgtcttctgtgggcctctcattatcgtttaatatattaatgaacagtttcagtttccaagataagagtacaccatacagcaatctcaaactcattttgacaaatacatttttaaaaattttattttaatgccctatatgtcatgaccacttaactactgaccacatttttcccatggaatgtggtttggaaacaatgctctttaaatcctcacagatcttgtaattttaaaataaacatcccagatatatttgttgcaaatggtatccaccaattacctgataattgaacctactttataacattagtggataataatagtatcaagagtaatatacttaagatttattgaaaacttataggcaacaggtaagcacttagctaggttattttatttaatctgcacaaaaattctgtaaagtggattgtcttatccctcttccataaatgataaaaatgaggtagagtgaagctaaataacttgctggcaagtaagacaactaaagtcttttacccttactcttagctgctggatttcactgccttgacttcatgcagtaagagttggaaacatatgctctaaattatatctaaattagattgatcttggaccgtgtttcttcctgtagtaatgatatataaatatcaactgcctgttgaaaatcacttgagcttttaaatgtaaaaccttaatacaagtagaaaagtatacgttagatttattttgtatttgctggaacatatggctggctaattcagtagattcaccaatttataagatttacaaagaagaggtcatgaaacttgatgcttttcagttttaaaaccgtatactatttgatgaaagtttttctaaagaaactgatactcatggttctattaaggcacagatttcttttaccagtccctgagggtactgattagtcctaaactgttctatatttaaggacagtgaaggctaaataaagatcaataaaagctaaaccgaatgttcctgaaatcttttctgcaaacggatagaaatttaaccgtggttagtagagaagtagatatgcctaaactccctttgaactcatgtaatcactcctcaccttgccctgccatcttgtgtataatgttgcccaagaggtacaaacttttaatttattaaggggaaaaaatatgacagagtgttgagacgattttcagtgaggtccagcaatgatctgtaagttgtaagaagccatttgttttccagtaggttgatggagaagaaatacacaaaataattataaaatatcaccacccataattgatgattatactatgtaagtatatatatttatagtatatagtacataggtatatctatacataactaaatatatgtatacatacatgttgtatttcactgataccaagatactattaattataataatacacatcattgatgcaatcagagtttttcagaaagaagataagcatatcaaacaggccaatttttggaagacacgttcagatttcaggaactatcagaattgaaatgtgtcttatgattaagtctgtctggattgctcactattcagatgtaggggttgatacaatgaaagaaaaagataagtttttctaggtagctaggtaaagggcaagggttggtagatctgggaagcaaattaatattttagcatgctgtgaagtttattttagaagctctaaattatgcgggtcaagttccaagccttgttgaattagttggggttgcctttaaatgggtcaccctctaatcatgccttatttgtccctctggtatatttacaggtactgaagatggatggggatcattaggtttctcttattatattgtcccacaaatatcttaaccgtgagtttttcagagtaatatttttccatttgtgtctacagggtaatatatatttgaagaactcatgaccatacatcagtgttcatgtttcactaagattgtttcattttcatccagaaaaaagttttattttatgtaaataatatgtatttttctggctctgaaaatgatgcatggtattgaagacaacttggaaaatgttggtacaaaatagattacttaaagtcacccataatagcccatttacctataatgacataatttgaactgtccattcgtctgctttacatgttttttgatataaagttgagatcacgtagtatatatatatttttaattatttccatttaaaatgaacattgtgaacatgttatctttaaaacaagatgtttagtctgggtagataagcaagcatatgttcaatagttttattcagtgaaataattgctgcttttatacaagttagactcaaattatccatgttattagactgacttcagagaggagagttttataggctatcgttttaaaggaaatttattgtcatataaagctcaacaaggggaaagtagaactaattatcatatttgtaacttgtcactgcattttgtgatactgtattaccatgagctcaggtggtcctagatgcttggaaattttaacaaaggaaattgtacaaattccaatggataatagcaacctcaaatttcatagtatttctgaaaacagcagaaagactccccataattttaaatcattgtcacaagtttacattttcttgagagtctctggtccttaaagtttaataagatagtccaaattgataaaactctttgcccctggttgaagaagtttccatagcatgatggtttattattctcttcccccaaagtatctggtgtctacattcatgttaaaaaacaacaacaacaacaacaaaacagaaaggaaataaatataagagaattgcatagaatttttagaaattaatttaatacacttgcttgtagccaaaaggccaataagtgattagaaattaatttagttaaaattatctgtagtataaatcatttttcctgtgattttaatctctattgtgataagtgttaggcatcacatttcaaaataaggttccttttttagctctgttatttagaattatatctagtataaatgtaagctgttactggattgccgaggtacctggaaattcactgcctttagccattggattaatgtgttaaaggtcaccttaaaaattcctggtgctgtgcaaataataggtgctcagtgaatgcttgactgactctctgatggaagacagctctaataggctcctgaaaggaggatggaaatctagagcattggaggggagaaggaggcaggagcttaggacaacatgattacgtgggtgagagagaaagccactgagaccaaaaaaagaaccaaaaataaattccaaaatgtaaagagtagctaattcttgtttttcccagagacagtattcttttttcatactattttttggtgattttcctttttctgatattatatcctagatagtttatgaaccttaagaggtttttgcatagatgtgcatttgttgcgcattcatagcaatatctaagactgtcatttcagagatttgtatcagtcatctagtgattgataaaaaaatgacatggaacctacttttgagattggatgatgacataataaagtagcttctcattttaattctcataatgactttgtggtcttagttatgttataagtaaatattgacctcctgaatcatatactaccaaatggcaggaactgggctctttagcctgttttatcctttcctctatatagttggatgactcagaaacactcaaaactgcaaggagataccactgcattttaaaacaaagttgattgcctaatcaatgttaagagacattgagagagagagagaaatctaagactcgactttggttaattggattgtccagttgttatcataatgcaggatactgattcatcaatatcactggccttttaggatgagtgatcacagtcttccatgtgcattactttattactgcctttcacactagacgatgcagctatgatgctgtcatacttgcttggtctgaaaatgttgacaagtattgattttctacaaaataatggtacctattaatctcatgttttattaatttctaattttaaaaagcatgggttcagttgaaacattacactggaaaagatgttttatttttgtttataattgtgaaagagaagattttatagcacctgcaactgtctatcacaatatgcagcttcattgtcttttcttgatttccagtagctacctcaataaatcacttatttttaatgtcattcatgaagagtatataaattattgctcttccagttaaacacagcattaatgggaaattgttaatgggaacttgaatcatataaagtatctagaatttcaaaatgacaaatctattatttgttatgaataatagtcctgcagattaatatagctacttcttttttccttttacaaaatgttaatcattcagcctaattctttgcacaatagaagaggagacaaatgttaaacaagacaaaactgtgaattttgaaagatgtctcctactcatttctacatataggatcatttctcactttgtgaaccatagcagaatagaattaaaaataaataattattagtattacgcctgtctttgtattgttttttcttctttgtgtctcttatgcatcactgcatgatttagtaaatattgttctcctgaatcaagatatgcagatgatatttgctttggaagtattacagaggtagaggttgatggatctgaactgttcatcattgtgtgcagttggctattcttttcagtgtggccactatcgccttttcctctatgtacttgtaactagagctaatattgtagagtccatttctgcacttattcaaataacaggtcataggtaaatatgaacttgaataagtgcacaaatttcattgtgtcactgaaaaattattttcaatttgattgacatttgcaaataggaggccgtacttatttgaacatcacctatagatgagtcttgttctacctgctgggttgccaagtctaaatatttttaaataacagtggctatacaggatatagataaaagtcctttccataaataaacaaatgtatacaagagtatgtttgattattttatgaggattttacaatagcttttcaggattcagtttcaagtcagttctctctttctgtctctgggggcttgcatgtataaacatacatgcacacgagtgcacactgtggatgtggattatttcattttacctgcatgaaacattgtctgtagtggccattactctgttcctctttattctcttctataaatctcaaattactctttaatatgtgtttatgagacatcaatttttatctgctccatattttaagaaggcaaacacagttaagtcaaaatgactaatgggatggtagggaaaagtatgggctgataaaaattaaatagggcacaaatgattcccctccagagccatccttttaatatggccaattattatgaataaaaaacagcattctaaaacatttcttttaattaaatgttgtaataaagatatatacccctctgctttccaagccacatgttatctgtactatgcttcagcaggcactaacaattcaagagcagttttaagctctagaaccttttacagaagcataggagtcttatttcacaggtttttaaagtgttatgcataatttttgccagaacacaaaagataatcattggaaaaaatctactgtgttttcatcctcttctgtgaacattatttcacctcactactctcccctgacaacactgcattctcaggagcattcacaagccacttgtcatccttcctttgttcccttccaggtcacactcccctagagttcttgaagtgtttcgctcttggctcatcatcaccctcttcaccactactcttgttttaattactgatgatttcaacattgtggtagattatctttctaattatctggcttctcgggtgggtctccctgacccactgcccttcaattttctgtccttcatcctaactcaggcacccagcccatgatcatttcctgcaaccactctgtattctcaatttcaaattgcctaatttccacccacaatactgtctgtctatctttctccctctaatactctagctccaaaaatatttcagtcacacctggaatctaatcctatcatgttttcgcttcctcttgtcctcaccttgtagcaaatatgccacagttccctagtccattgtatttcctacttatacagtagacatttttttcttgactattcaaatctctgccatctcttccttcattctccctcttacttggctaacttggttcttgcctcactgagaaaattgaaggtattctaaaactttcacaaactttcatcatcacatttaaacatctatctgcaacttaactctatctactattgatgaattgtccatggtcttattgaaagccacctcttccaaatgtcaatgagaaccaatcatccctactggaggacactgatttagccgttcagtattgcccaatccttcattacagagagacaaatagctgggcactgtagctcacacctgtaatcccagcattttgggaggccaaggtgagaggatcacttgagcccagtctgggcaacacagtgacatggcaacatggtgaaaattcaatgcaagcctgggcaacatggcaaaaccctgtctctacaaaaaatacaaaaattagctgggtgtggtagcatgtgcctgtagtcccagctactctggggactaaagcgagaagactgcttgagaccaggaagttgaggctgcagtgagccatgccactgcactccagcctgggtgacagaatgagaccctgtctcaaaaaacaacacaatagacgtgctcctgagttatttttaaaaatcaagatcagtttcacagctatgaaggatgatatgatatgatatgtttctgaattagaataatacatatatatatagagagagagagaagaaaatgttatataagtaagttctgaattatgtgttatagacttaacatttgggcatcagtgatgtaagaactattcagaaatgacttccaggtaagacttgagctgtgcattcatggatggagagattctgatatgtggaaagaaaaagcagctgtcccaggcaagagaacacaacacgagcatgtgtgcagacgtacaaatgagctggtatagtcacggttcagaggggaagactgactacctagtataaaggcttcacaagattgttcggaaagagaggtcatagagaaggattcttagaacctgcttcatgatggccttgactttgaggcctaatattagagatgacagtagaatagtcacatggaaatatttactagttaattttgtattttcagaactgagattggataatagaatacactgagtttcatgtcttctttgtttttatacttagaatcttccaaactgagttcacatgccatattttaggatggaggaaaaagacatattgagggctttgaggctgatggtttggtgagcagaggggaaaagcctgggcacatccaaacttctactcactcattaagtgagatgcaggagggacaggcctggtcagcaaaggaggctgtccctgtgagcaggctcacactcaggttcagtttacatttccgccaacctgggcttcaaggtatcaggaggagacagaaggccccatcaggagagtgaggaggtcgatggttgctattcccgttttttttttagatggagtattgctcttgttgcccaggctggagtgcagtgcgcgatcttggctcactgcaccctccgtcttcttagttcaagtgattctcctacctcacactcccaagtagctgggattataggcaagtgccaccatgcccaactaatttttttgtattttttgtagagatggggcttcaccatgttggccaggctggtctcaaactcctgacctcaggtgatccgcccaccttggcctcccaaagtgctgggattacaggcgtgagccaccgtgcctggcccatggttgctattttatgtgttggcagttgggagacctgacagtcatttttctcctaacaaaccaggtcttcacctcacctaaggacatctgatgctgttgttagcatagaaatctcatacctgcattatggtgcagttgaaattttctgatgatggaaatgttctataatatagatagctattgagcacttacaatttcgctagtccaactgagaagcgaagcatttcattttattttaatttatttgaatttaaatctaaatagtcacatgtagttatgggctactaaatttgatagggcaactatagagctaacctctatttaatatttattgggtgtgtcatgtgcctggcctaatctaagaactttatatgtacccttaatattaactatttgaatttccataataatcacaaggattaagcattcaaattttccccattatagtaatgagtgaactggagtagagagaggtttagcataggaaggaaatagcaaggttgggatttaaacctagttagtatatttacagagcttacacaactgtgtctccccatctttaagttctaagttaatcttgctcttctttcttgctgacattcatacatttattcctgtatgttattactatgttcatttatctataaaatatgtcaatctttcttcttgaggtgttatatttttctcccttaccactgccactaaaagagtgcagattcacttaacgtgtgaatgtctgaatacgtttctgatcatcatcctaccacccctctaaacaagtgccagtgaaactttggtgtgcacagaatcacatggaatacagcgtggttgtttctgatacacgaggctcagggtgaggcctgagaatttgaatatctaataagtctccaggtgacagtaatactgcttgcctgtctggagccaccctttgcgaccctgtactctgccttgcaagtctactgccaggctaattgactttaagatagaattgtcagtacgttttggattctttcactgaaagacataacttttcatcattatttgtgtttttgtatgttgtagaaatattaaattatctttttgtcaagagttgaaaatccaactaaaaataatacaggaaagaaggaggagaaagggaagaaggaagggaaagaagcaagaaaaaaaggaaaattggtttatgtaactgaaagcccagatgtagatcaccctctaagatttatgctgagaatgccatcaggtgcccatcaggacagatgtgcctacaaagctatggagaccacaataatatttgaaaacattaaatgcaaatggctattattggaatgtcttcattttttcacaaaggacatcaatgtttcacatgtattgttttacacatttatatcacccccctcagttgaagatttagagtttgctactccagaattaggacaacagcaaatggcattaaggttttgtcactcgtttcttttctccttctgaacagcaatcttttttttttgagacgaagtttcccttttgttgcccaagctgaagtgcaatggcgcaatctcagttcactgcaccctctgcctcctgggttcaagagattctcctgcctcagcctgccaagtagctgggattacaggtgcacgccaccatgcccagctaagtttttgtatttttagtagaaaagggatttcaccatgttagccaggctggtcttgaactcctgacctcaggtaatctgcctgcctcgcctcccaaagtgctgggattataggcgtgagccaccccacctggcactgaagagcaattttttaaacttttttataatgtacttatctcatgtacaatatggtagtgatgatagttttctcagcttcagacttacatgatttagtttctgcaatctaagtgaaaagagcattgctgttttccaatatagtaaaatttcatgattaattctagtgggctcagctttagtctcatgcttacccctctaaagtagctgcggttaggataagggagtatttcctagagggaaactgtgagaaaggtggctacccaaggtagaatttggatcccattacccaggcaaagggggtggtattttggacaacaaaagcaccagagatctgctccacagggtatgaaccaaaatcatgttttgaactgcaactttgataatgttcttttcatctgaaacacagtggccttatgattacctcatcagaaagggctatcaataattcctgttgcgtctcaaaaacctcatccatgaaaactgtaacaacatctgcccctaattaatgtttttcattttaactactgtgacattttattaaaatatttctcatctgtactagataataaaataattgtaaatatgtatatttgctctttttctcttgtatttgcatgcatttgtagataggaattattttaatgcattactatatcatataggtatggtaagtgaatttaatgtttgcccttattttttttttttttggtagaatgttaatctttagtgtgtaaatccaatacttaagatcgatcttcatgctcgttttcactttgtttgaattagtttttgacggaagtaatcacctatcttttaggatgatttttttaaagaaaataattgtgtttatgtaaaaatgaataaagtaattacctggagagtagaaaacaatttatctgttccaggtcatgatggatagaaagtggatataggggatcccatctgggatgtaaagtcaggaaaattcccatggtagcaaaacacaaaaccaaactgctcattcaggtagcaacaagggacgtgtgcactccaacactgcgcagtcctgtcttggcctggtgtctgttgaggtcctattaaattttgctgaagacagtcaatactaacaaagacacacaaagaactgctagctattactttccatgatgtttagaatatcctaaagttataaatcagaattactttaccctccacgagaaacttctgagttgagttttgttgttgttgttgtttgtttgtttttttgatacagtcttcctctgtcacccaggctggagtgcaatgacatgatcttggctcactgcaacctctgcctctggggttcaagtgatcctcctgcctcagcctcctcagtagctaagactataggtgcatgccgccacgtctggctattttttgtattgagttgggttttaaaatagtatctggctttaccaggagaagatggtgaataggaggcaggattaacatgcatctcccacttggccagacagaacagtgtatagaaattcacactgtgaactttgttccgagaaccaccacaggaatgtaccaggaaaaccaaaagaattcagatcctttgaaagaaatgccatgctactgcaaaatcagcgagacaggcaaaaaactgtgagttcccaaagtgtgagaagggaaaaacctgcctccaaacacacatctccactggggaatctgaaaatccagatcacagaaggatttaaccttacctagagctggaatggatttagggagctgtgtgaaatataaaagtagtagcagcagtggaaagagccttgtaggcactcctagtctccagcttgagcccagggaaggcatccctgactatgtctcacagggttccttggggtaggcaaccagaggaattagggagggcttgcagggtaaaagaagcttccaggtgaattttatgatcacttctactaggcacacacttccttgagcagaaactgggggatgaatgggaactgctgcaaacctgagcaaaggagccactgccattgtgagcagatggggagggaggagaggtgtggcctgaaagccatgcttgctttctcagaagggaagcttatggcctggggcaggtttgagttctgcctgcaggctgcctgaatcaaaactcagcactgttaatggggcactgcaggagcaagattgaccttgccaactgaatgagagctgggtgaggcctttcactaccagctatcccccacttctttggtgaactatactgcacagcagaggcagccataatcccctttggaacataaacccattggcctgagaaccatacccctgtcccccacagtggctacaacaagctctctccaaggagagtctgagctcagacccacctgaccctgcccaaattaatggtatttctctacctgccccagtagctgaacacaaaagacataaattcttgagagctttatggccctgcccatcacctgataaaccagaatacttcccctgggtaacttagggcaacctcaaatcccactgctaataccacagctggtgctctcttgaaagaaccacctcatggctggaagccaaccaactcaggccattacagcaactcatgacagaataacactggtcccgggaaagagaaaacaacagttaataccactgcctacaacatcctggctaaccggaggtcctgagtctgtccatgtgaaaacttcactgctggcataaccaacatttgggaaggccaacacaataaacctagctacaaccaaagattctcacagaatctacatcacccccagccacctccaccagggcaggtgttaatatccacagctaggagacctgaggactggtcacatcacaggactctttgcagatgtttcctggcaccaacacagagcctggtagccccactgggtgactaggcctggaagagcaataataatcactacagtctggctctcagggagccccatctctaggggaagggggagagcacaccacatcaaggtatcacaccatgggacaaaagaatctgaacagtgggcctcaagttccatgtcttttggctggtgagtcatttctcgcaacagggacacaattgcagtactgggcgcaggagggaaagtctgcacctctaccccaatagaccagcttctgtgatcatgaagggccttggagaaggggtacttattccctccaggtactccactaaagacacagttggggcttgccccacaggaaagcagcatggaggtacctatagtcaaccttcctagaacaattcagggtgactggaggtacaccttccagattcaggcctgcatgagaggcagagtcaccgttcctccctacttgggacatgaacagtcctatagatgaaaagaggtgcctgtctgatctgaatacctgaaacactaggacagaagtgaggctgtgaggtaaatggctttcctgctgacctggcaaggggagctgaagtagctcccactcttcactctgatagaacctcagcacatctaattgagagctcccccagccaccctgctcaagactgggacctcggcccactgttagatattacatctacccacctgccttagccacaactagtgcctacccagggatatattccctattggcttgaagcccagatcatcaactcaataaataaacaccagaaaaaaaattaaataaataaagtatacaccacaagagaacaagataagcttctagagatccccatcattacaactccataggagacagtgaacttacccacacttcaagaatataactgctacaagtagcatcaggcaaaatcagcacagaagactctataactaaggaactcatagagtcttcacccctagagcactaataatcaaattaggctaaaataaacattaaagtctgatccttacgaggggaaaaaagaaatttaaattaaaaaaaatacagtccaattaaaaataaattcaagaacagtttgaagaaatagcctactcaaatgagaaggaaccaaaaaagtagttttggcaatatgacaaaacagagttctataacacccccgaaagatcacactatctccccagcaactgatctaaacgaagaagaaatccctgaattaccagataaagaattcagaaggctgactattaagctacttgagataccaagaaaaaggtgaaaaccaactaaaagaaattaaaaaaaaaaaaattaaggatgttggtgaaaattttccagagaaacagatatcattgcttttcctaaagacaaaacagtcacaacttctggaaagaaaagacacacttagggaaatacaaaatgcagtgaaaagattcaacagtagactagaacaagtggaagaaagaacttcagagcttgaagacaaggctttcaactaaccccatcagacaaagaacaaagcctcaaagaaatttgggattatgttaaatggccaaacctaagaataattggtgttcttaagggcacggtggctcatacttataattccagcactttgggaggccaaggcgggtggatcacatgctcaggagttcaaggctagcatggcaaatatggtgaaaccctgtctctactaaaaatacaaaaattagctgggcatggtggtacatgcctgcagtctcagctacttggtaggctgaggcagaagagttgcttgaacccagtaggcggaggctgcagtgagccagaattacaccactgcactccagcctgggcaacagagcgagactccatctcaaaacaaatacaaacaaaaagtttggtaaacttatttgagggaataattgaggaaaacttccctggctttgctagtgatctagatatccaaatacaagaagctcagagaactcctgggaaattagttgtgaaaagattatcacctaggcatatagacatcaggttatctaaagtcaagatgaaggaaaaaaatcttaagagctgtgaggcaaaagtatcaggtaacctataaaggaaaccctatcagattaaccgcagatttctaggcagaagtcctaaagtccagagggattggggtcctatctttagactcctcaaacaaaacaattggcagccagtcagccaagaattttgtatccggcaaaagagagagaaggtcacaaacaaatgctgagagaattcgccactaccaagccagcctaacaagaaatgccaaagggagttctaaatcttgaaacaaaacctcaaaatacaccaaaatgaacctccttgaaccgtaaatctcacagagtctataaaacaattacacaatgaaaaaaaaaaactgtttaggcaacaactagcatgatgaatagaacagtacctcaaatctcaatactaatatttaatgtaaatggcctaaatgctccacttaaaagatacagaacggcagatggaaaaaattccaccaaccaagtatctgctatcttcaagagactcacctaacacataaggactcacataaacttaaggtaaaggggtggaaaaagatattccacgcaaatgaaaaccaaaatcaagcaggagtagctattcttatatcacacaaaacagactttaaagcaacgatagtaaaaaaaaaaaaaaaaaaaaagaagacattatataatgataaaagtattattccaacaagaaaataccacaattctaaatatatatgcacctaatactggagttcccaaattcataaaacaattattatcagaaatttaagaaaattgaaatcatatcaagtgtcatctcagaccaaagtggaataaaaccgtaaattaactccaaaaggaaccctcaaacctatataaatatatgaaaattaaataaactgctgttgaatgatccttgagtcaacagtgaaatcaagatggaaatttaaaaattatttgcacagaacagtaatagtgacacaacttaccaaaacctctgggatacagcaaaaacgttgctaagaagaaaggccatagcattaaatgcctacatcaaaaagtctgaaagagcacaaatagacaacctaatgtcacacctcaaggaaatagagaaacaagagcaaaccaaagccaaacccagcagaaaaaaagcaataacaaagatcagagcagaaaaaaatgaaatggaaacaaaaaaacacaaaagataaatgaaacgaaaagatgtttatttgaaaagataaatacgattgataaaccattagcaagatttaccaagaaaagagaagatacaaataagctcaatagtaaacaaaatgggagatattacaaccaataccacagaaatacaaaatatcattcaaggctactatgaatacctttacatgcacaatcttgaggagatggataagttcctggaaatatacaaccctcccagattaaatcaggaataaatagcaactctgaacagaccgagaacaagtagtgaattgaaactgattaaaaagttgccaacaaaaaagtccaggatcagatggattcacagctgaattctatcagacatttaaagaactggtaccaattctactgaaactattccaaaagatggggatagaagaaatcctccctaaatcactctatgaagccagtattatcgttaataccaaaaccaggaaaggaaataacaaaaaagaaaactacagaccaatatccctgatgaaattaggtgtgaaaatcctcaataaaatactggctaacgaaacccaacagcgtctcacaaagataatatgtcgtgattaagtgggttttataccagggatgcagggacggtttaacatatgcaagtcaataaatgtgatacatcacataaacagaattaaaaacaaaaatcatgtggtcatctcaatagatgtagagaaagtatttgacaaaatccagcatctctttatgataaaaccctcagcaaaattggcatagaagggacagggacatacttcaaagtaataaaagccatatatgacagacccacatctaatatcatactgaatgggaaaattgaaagtattcccccctgagaattagaatgtgacaagaatggccactttcagcacttctattcaacatagtactgtaagtcctagccagagcaatcagacaagagaaagaaacaaagggcatctaaattggaaaaacagaagtcaaactgtcactgtttgctgatattattgtatacttaaaaaatcctaaagactcatccaaaaggcttctagatctgataagtgaattcaataaaatttcatggtacaaagtcaatgtagacaaattagtagcagtgctatacaccaacaacaaccaaactgagaattacattaagaactcaatctttttttcaacgactggaaaaaagtataaattacttagaaatatacttaaccaagaaggtgaaatctgtctactaggaaaactacaaaacactactaaaagaaatcatagatgtccacaacaaatgggaacacatcccatgatcatggacaggtagaatcaatattgtgacaatgaccatgctgccaaaagcattctacaaattcagtacaattcctatcaaaataccatcattattcttcacagaactaggaaaaaaaactattctaaaattcatatggcaccaaaacagagcccacatagccaaagcattactaagcaaaaagaacaaatctggaggcatcactttacctgatttcttgctatattaccagactatagctaccaaaacagcatgttaccaataaaaagataggtatatagactaacggaatataatagaaaacacagaaataaatccaaatatttaaagacaactgatctttgacaaagcatacaaaaacacataaagtcggaaaaggacacccaattcaacaaatggtgctgggaaaactggcaagccatatgtagaagaatgaaacttgatcttcattgctcatcttatacaaaaatcaactcaagatcgatcagtggcctaaatctagaactgaaaccataaaaattctagaagataacattggtaaaactcttgtaagcattgtcttaggcagagaattaatgacccagagcccaaaagcaaatgcaacaaaaacaaaaataaataaatggaacctacttaaactaaaaagcaaagaaataatctgcagaataaatagacaacccacagagtaggagaaaatatctgcaaactatgcatccaacaaatgactaacatccagaatctaaaaggaactcaaacaaataaccttatcaaaaaaggggggcaaaggatgtgaatagacagttctcaaaagaagatatacaaatggccaacaaacatgaaaaaatgttgaaaatcactaattatcagggaaatgaaaattagaactacaatgagaaaccaccttactccttcaagaaaggccataattttaaaaatcaaaaaataagagatgttggcatggatgtggtgaaaagtgtggaacacttctacactgctggtgggaatgtaagctcatacaaacactatggaaaacagtatggaaattttttaaagaactaaaagtagaactaccattcgatccggcaatcccactagtgggtatctatccagaggaaaagaagtcattatatgaaaaagacatttgcatgtctatgtttatagcagcacaatttgtaattgcaaaatatgaaactaacctaaaagcccatcaaccaatgagtggataaagaatatataataataataggataattattattaataattatgttatattattaattatgttatataagtggatatataatatatattatatatatcacattatatattatatatgtatatgatggaacagtgttcagccaaacagaaaataatggcatttgcagcaacttggatggagttagagaccattaatctaagtaactcaggaatggaaatccaaatattttatgttctcattttaagtgggagctaagttatgaggatgcaaaggcataagaatgatataatggactttgaagacttggggggaatggtgaagagggatgagggataaaagactacatattgggtacaatgtatactgcttgagtgacaggtgcaacaaaatctcagaaatcaccactaaagaacttattcatgtagccaaaactacctgttccccaaaaacttttttaaataaaaattttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctaaataaaaattttaagtaaagtaagataaaataaaattggatcctctgccaaactgtaagctgttaaaagtaggagctatgtgagaaaaacatctttctaaaagctagtttatattattcagtattctttctgtaaagattcatgtgacaaattacttttagaaattaacagtagaaaaagagtttcacttaaactagtacacatatttaatctggaaaataaaacattcccattatagtgataaaagctcaaaatcaaattaatgcatagaagaattatgataaaatttatattaaaatattctcctataagatttaaaggtcttaatatatttttttcctgaaaattactttaaatcattttcatgtcattcttccttaaataggctgaagaatacaagcaaacagtggagaacactagtgtttgggagaagaaggatatttatttctctttccttttcttggaaaatacaagttggtttcccaagtattaaaataaaaatcttacaaccaaaaaatgtggctaaattttaggatctatgatgcataagctgacacttatgcacagatgttattaatttctatttttattttcttcactggaaacctgaatctgggaaaatatcagctgtgagcttcagcgaacacaagtaaaattcatatgagaagtgcaaacttcataaggaaactggcagtactgaaactctttaaactgaaactggttctaatagaatattagaatgatgaaacacagcatagcatcacatgttcccattaggcatcaatctttgcccctgagaccttccttttgcataatataaaatgttgctatggtttcacatatagtatccttattatggcattaagaattatgcaaaatatgtaatatgtagattgcaaagttaatgacagctctgtgaatgactgaaaagcataaatttataatacgcatcatgtttattcattttaaaagttgttgacatttctcttggtgtgagacaatttgctatccattctcagatagaggtaaaaacattagaaagacatgatctatgcagtggattttatgagctcagttacatatgttaccttcctttctaagaataattgaaaatacgtgccattttttttactgtactagttcctccctagaatgagttaatgcacagaacatttgagaatgactggtaacttgttcactgactagagggcatgtagggctaggacatcagaatcttaattcactgacttctcaaataaggtatctgcaccagttgactgttcaattcctatccagctatttttttaaaaaaagtgtttgtgtctgtattttacatattatccaaataatacacattcattgtagaaaaaaattttaattactaaaaacagaactgtagaaagagcagaggatcttttgtttcattctgcaacatacaatgttttgattctattattatccttctaactcgaccccaatcatcatgcattcccagaatgaattcatctctacaaaccagactcaaaaatagctgataatatttttactaatatagagataaaactatggagttcaacttgagaccttcagctattagaatcttacagagaataatacttctccaataaggacaaaacttgtaatgattactaccatatgagattgctgtcaatgttgcattgagtcaattaagccagggatcacaggaaattaggccactagaagaactggccctccccaaccatttgtcgttcaaagatagtggaagcaattgtgcgtattgagtcagaaatgggaaaaaataatcaagatttatgactttagtttcctgggagcaatgaaaattccctgtgcttatttcagggggattcacaaagaaaaaaaatactttttactttagacttcttggaccgttagctaaaaatgtttccaccagtctagcccaagcaaaacaaacaatagttataaaagtttattttatttctgtagtggatttgaattttacacagttatagaaaattcaagtataacaaacataaaatatgaagtgtggggaagctcaatttagcttataggtctgcgtttttcctctgtggaggaaagtgtaatcttgccattgatggtaatctagttgcttctggcttaaaattcaatcaatttaggattaacacggtcagttcatattctattttcttgctcatttttttttctccctctcctatgaaacttctgggttcaggagttttgctgggcattttaagtgtgggaactggatttgcaattgattcttggtaatcttctctcattgctggcttctgctgaggtgtgactcatcctatcagatcaatattggttcccttgttcctgatgcatttactgctgaggtgcacattcccactccagtccccaatttcaggttcacaattaccatgtcttcttgaacccaacctcagtgcttctgtagatgatcttgaattgcaaccagttcacaactctaatgacatctcaaaattttcagcttttctccctgttgttcattggtttgtataagatataatgaggctgtgttcagaactggtctaggcactttgctcagaaaataatttcccatcccatagatgccatgttagttgcaagttatctgtgagacttgtaacatcccaggcagtatcttggacaacttttctcctctgacattattccacaatttactgggatgtatactagggttgcagtagtcctacctcactgacacattgggattctacttgggaggggccctgaaatccactagcagaaatcatctttgttccttaaacatcaatcacctcttagtctcttttttctacccactgctgaaattcttatatctttttgatgagaaaaactctacatattcatgaattcctttcgactccacatttttgtttttgatgtgattaccatattttaagtcctaaaggattcagaaataaaaacaaaacattttttatctcaagttcttttattataattgaaaaccaaagcattcaagaatatttgttacttctactaaatacttttcccaagtcatttagagtgaaaaagcccacagtgtgattattgttttcactttgacatctcttcctgaatgcagtgtatttattgacagaggatgggagaattaaccagaaaaaacacgcagttggatagcaaaatattatggtgccacagttaaatttacatatttcaataatgcgagtatctttgtgttttatttgataaagaatttagattttacggtccatattttcaagaacaatgcccaattatgtctaaatgaagtagaaaaaattaataggtcataaattaggggattactatattctagttatagcagatcttatttctaaagcattcattttatctcaagtactatttttgtgttagatatgcattatcattataatcatataaagtgataaaatttattttatcaatgacaaattttgtaaaaaagaagtaaagcagttggctaagatgcagcaaccggtaaaagggaaaataaggatctaaatccagatctcttcactctaaaatccacgtacttaaccattatatgagttttaagaaaatgactcaacctatttaattttatctcatttgaactgtttatgcttctgaagagccaagaacatcttttatctttaaaatcttcacagcatttatcaaaaccctaagcacatatttaaacacaaacatatgtttgcttccagaatgcagtgtttttaaagttaaaaaaatgtatcactgggagcagcagctcatgcctaatatcccagcaatttgagaggctggggtggaggactgcttgaagccatgagaatgagactagcctgggcaacacagtgagaattcacgtctacagaaaaattttaacaagtggcaaggcatagtgtgcacacacctgtggtcccagctacttgggaggctgagacaggaggatcatttgagcccagagtttgaggctgcagtgagttatgactgtgctactgtactccaccctgggtggcagagtgagagagaccttgtctctaaaaaagaagaaaaaagtatcaacaacaactgctcctaattaaaatgatttctaagcaaacaaggaatagaataaaaatttcttatcctgataaatagtgtctacctaaaatctacagttactaatcagacctaattggaatatgtcaagatgactaaatcaggaacaaggcagattgccaccacacccatgtattcatgaatttttgcaaattctgtccagaacaagacaacataatgtaatgaattatatgtagattggaaagtaggaaataaaactgatttttttaatctagtagaattatttataaaaaattcataaaatgtatatacctatcattagaatatgttagacaactaagcaagtttttatgataaaggttaagtataaaactgttaatggttttcttattatcctaccccatgctatgatttaggcttgtatataactataactaaagttagaaaatgcaatataaaagaaaaattacatcttcacaaagcgtacagtgtctagccctagatctgatgtaatgtgcaagtagctgtgttgaaaatttacatatcattattaaaataaattgaagacaatttaatgaagagatgtgccatttaatattataaagatgttaattatccacagattgatctacaaatttattgtaattctaattgaaatctgaaaagaatttttatgaagtttggtaagctcttcttgaatttatatatgaaaacaaatggcccaaatattctagaaattcctaaagaagaagggagattttgtcctatcatatgagggtacttactgtgtagtgttgctgcaagagagagactaacaagtcggacttcagagaccaaatccagacccagtcattagtggtaatgtcatccatgaaagaggtgacattgcgtttcagtgagaaattgtgggctattaagtaatggtattgcagccaactggttatacttacagaagaaaaataatggaacagaatagatccaagaaatagactcagataaatattctctactagtttttggtaagaaagacacaaaaacaattaaatgtagggagaacagcctttttaataaatggtgctggaacatccacaattaaaaaaaataaagaatcttgatctaggtctaataacggtcattaaaagttaactcaaaatgaatcatggacttaaaagtgaaatgtaaaactgtaaataatttaacataaagtatagaagaaaatgctcacaatctaggggcaggcataaagatttaggcttggcactaaaagcataatctatgaaataaatatggataaattgggcctaattaaaaaaagtttgctctgcaaaagttatgtgaagaagataaaaagacaagctatggactaggaggaaatatctgtagaccacaaagaggtctacaaagagaaaaagctagtatctagaatatgtaagaaattttcaaacaacaataacatacagtccagttagaaaacaggcaaaagacatggtcagacatttcaccagagacaatattccgatgtcagagaagcacatgaaaagatgtttaacatcattaactatgaaggaaatacaaattaatactataatcagatatcactacacatatatcacaatggccaaaataaaaatactaacaataccaaattctggtgaggatgcacagaactggacctgacatacatttctggtggaaatgaaaaatgttagacaaactggaaaacattttggcagttccttataaaactaaacatacaactaccacacaacccaacaattatcctcttagacatttattccacaacatttatttccagaaaaccatgcacaaaaaatgttcagaacagctttatttgtaatagccaaaaactgaaatcagccaagatgttctttaacaggtgaatggtttaataaactgtggtatactatttagcaatgcaaaagagaaagctactgatatatgaaacaacctggatgcatctccagggaattaaactgacaaactttttttgtttttgtttttgtttttgtttttgttttgagacagagtctcactctgtcacccaggctggagtgcaatggcgccatctctgctcactgcaagctccacctcccgggttcacgccattctcctgcctcagcctcccgagtagcttggactacaggtgcccgccaccatgcccagctaattttttgtatttttagtagagaaggggttttactgtgttagccagggtggtctcgatctcatgacctcgtgatccacccccctcagcctcccaaagtgctgggattaccggcgtggaccaccaagcctggcctgacaaacttttagtcatagaggacacattactggaactagtagttaagaatatggtgggagtctcaggaaaaaggcagatatggttatgaaaggaaacatgagggatccttgtggtgatagaatagctcatgatcttgactgtgggagtaggtacatgaaactatacatataattgtgtgcaaatacacataaatgaattcaagtaaaactgggaatttgaataagattaggaaatcacattaacattgatatcctagttatgatacactccagttttataaaatgttacctttaagataaagattacatgagactctctgtattatttactacaactgcttgttaatcaacattatctcaataaaaatgccaatttataaagaaattgttagaacacatttgcaagatttacattaaacaaataattagcaaaggtcaattagaaaaaatacaatcgtgggcaaaaaaaatgtacagttttcttttcagaactacaattagaaaaaataatttactaacttagtcattaagtaaattttaattaaattactttatcattttgtactctacagattgtcaagcattaaaaataaattatcaatttgcagagttgacagggatttgaattggaattcatgtaccattgggaggagtgcgagttgaaacaattactttagaaaacaatttggtgcctaccagaagacacagcaattgtactcccaggtttataccctagagtaacacctggttatagaaggatacatatacacaaatgtttgtagaacattgctcatgatagcaaataaaatcagttcacattagcatgaataacctgtgttatattcacactgtagaatattattattcattagaaatgaataaacacactcatatctacatggatgaatcccacaagctaaatattgaccacaaacacaaatcacaaaaaatacattatgattccccttgtaaaaatattaaatctggcaaaactaaatgcatactgtttaggaatacatatgtaagtgaaagaaaactattgaggaaagcaagggaaattataaaattcaggaatatgtttcagagaaaagaaagtaatgctattggggaggaggcgtggaggcttcaaaggcatgttagtgtttcatctcctaaactgggtgatagttacaacagggttattaaactttaaactcttaatatattacatctgttttttgaatgatgtattttacaatgaaaagtaacattgtcatccaattatgtgttttctctggtaatacttgtgcttgcactgattttagtacatgtgcactgcactattttacctcctttattatgataacacattaccacagcatggggcatgctgcggacttttagaaaatattctgatttttcccagcacactgtgtattcattcaggatacactggaaagcgtgacattctgatccatcattatgagtgttcaggtcatccctcactaaccttagaagagtaaacaacactgattgcacacatgggtgctgcagttttgctcttgacccgtggttgttaaggatcatttctagagaacagtctccaccatacatgagcaagttgcaaatatggaactggaagaaaaaaaaatccacacagaatagaaataagatccaatttctgcctagaacaaaagagataaaaagactaaaataaatgctcagatgaaaggttcatttttccaatacgattctcagagaaccttgagagttgattaaacagccttatatgttttgcaatttaattaggtaatgtcttcaacaaaaaaaaagcccacgaaaaaacaaaaacaaaaaaactgaatttgtcaaagaaaaatgctatcaaagtgacttttttattaactctgatagttttgaaacatctccagctgatacgtgtttgctgtggaagcttgttcgttttgcctccacaagctacttcttttaatctttctgtttaattggccattgcttgcactagtaaagctatcagtaggaggatattttgaagtaatggaatgcttaaatctcagctttgtttcttttttatataaagggccaggaccatggatatttagagtataaaaacttcccctcccatcttaaaaacgcgtagtcctcatccctggtcatggcttttcttctctctttagtttccactgcagtccctctatatattagttaatacattatttgatataggtattctataatcattcatttctttaattcctttctgcaaatgagtttccttctgcccatatatatttgagtaaagattttcattatttcatttattttttttaaacattcaggaaacctctattagacatatttttcttgttcaagaaattatgagatgtagcattagagagtttgcacttttgtgattactattttaacattttaaataatagctttatttgaaaaaatgcgaataataaaatcaattctttttaacttatagaatttggtggtttttttagtatatttacaaagttgtgcaaccattatcacagtccaaatgtagaacatttcatcaaaaagaaactccatctccattaacattccttccttatctcccccccgaccaacccctggcaactactgatttacagttctgtctctttacatttgcctatctggacatttcatatgaatgtaaacatacaataagtggtctttagtttttgttttttgactattttttcttcttaaaaaaactgacctctagtcctgcagatcaatatgtggtgtttgggactggcttcttacatttagcatgacattttgaaaattcctgttatagcatgcctcattactttatttcttttcattatagaacaatatttccttgtatgaatgtgccatagtttgtttttgcattcatcagttgatgaacatttgagttttcccaatttttggccatcatgaataatttttctaggaatattatgtataactttttgcatgtgtttttatttagttttggatttataactaggatgagattgctatggcaactgtgtttaacaatttgagaagctgctaagctgttttctgaagtgactgcattatattgcatttccaccaacagcattgagagtaagggttcagtttctctataccctcaccaacacttgttattgtcttttatttttattatagccaaactagtaggtgtgaaatggtatctcatcattttgttttgcatttccctgacaattcaagatattgatcattctttaacattcttgtaagccatttggttatctcctttggagaaacgtctatttaaatccttttcccacttaaaaaaaaaaggttacttttattttcattattgaattgtaagggtgttttatatattctgaatataaagcctttggcagataggtgatttgcaaatagtttcattctgtatgttggctttttactttcttgatggtaccaattgcagcacaaaattttatccatttttttcttttgtcacatgtacttttagtgctgtaattaagaaaccattgcctaaaccaagatcacaaagatttgctcccatgcatttttctaagagattatagttttagctcttacatttaggactatgatccattttgagttaatgttttgtttatggtgagaggtcctggtctaactgcatttatttgcatatagatacccagctgttcgagaaccatttgttaaaaagactgttctgtccccattggattatagtatgcttgttgaaaatcagttaaccataaatgtaagggtttatttctgaactcttgatttaattccattaatatctatatctagccttgtaccagtaccacatgattgtaatgactgtaatgattgtaatggctttgcagaaatttggaaatcaggaaatgtacataccccgattttgttcttttttgccgggtctgtcctgcagaccctggctgatggacgaaatgagtactcagacacaggtatgcagtgtaagagcagttaggtgactgcctggctctagtggccagacagcagcccctagaagctggacctgcttgcttttattcagtgcaggcacaatgccaaaaacctggagccaacacaacctgtaggtaattaaaatttattgttcccctttcggtgaaggtcaggggcatggatgatcaaaggtcagttcctggtcaatataagtaaacaagcctgtttaaaataaattcccccaccctcccttgtacctattccttgcgctctgcctcagggttatagaataggtgtcttcagctattctcccccctgggctctgcagaaccttccgacctttcagaaggtttgcatcctttccctatagtttttccaaccactgtgacagatcccccacactttttcaaaattgttttggctattatcggtttcttgtcagaaatattttttaatcaagtttccagttatatttgtttttgtgaaagtttttggttaaaaaaatgctatcaaaactaatgtattgaaaagaaagtctccttcccactccaaaacctcagacatatctgttcactaagaactgctgaaaaacaatatgtcattcaataaattatacatgcatgtattattttataaatattttattttacaaacatttctatagtttgccttatacattaatgatattacctggtgctcatgccacatcctattcattaatctgtctaaatgattgaatagaattccattgtaatgatgaattacaatttatttaaccagttccctaatgattaatatttaggttaattatgattttttgctattatactcaattctgtatgaaaatcttttctgcatttatttttatatttttgaaagcatatctgtaatgtcggtccctagaaattgaattcctatgtcaaatataaggggattttacatttttaagcacacagacaaactacactccgggaggccttcaagaacttacaaacttagaacaatttttctacatctttattaaccctgtgtgttatcaaattgtgttgataattgtgaattggtagatgtaaaaacattatatttgtctgaatatatgtataatagtgaatgaaaattgagcatttaaaatgtttgtaagtaacatttgtaattgtttttctgtaaaatccttattcttctttgttcatatttctatttgaataatggcattattgaattgaaactatttgttcatattgaaataaaccctttgtcatgtttcttttacttaatcagcataactcctctgatgggatcttcatatcattcctaatagaagattgattacccatgtatatttgactagggttggctgggagcaaagggaagaaaacttttatcatctagtataacaaaacaaaagatatacaattcatacatattatttcaatatgaatttaattcattttacatgacttttattttattgaaggtataaattacatataatgatgaacacaaatcagaagtatacaacagatcaatttaaataattgtaaatgcccaaataacaacgtcccatatcaagattcacagttattttagatcctcctttctcccttccatgtatatggactcttggatgcatatgtggtttttttccagtgtgagtgtatgataaataacactgctacaaacacttacgtgtctgtcttttggtggacatatgaactaatttcttatggttgtctatgtataacaagtgtaattgctaggtcacagagagtgcatatttttttgtgagtagaaaatgccaacaaatttctgaaagtacaccccacaagcaatgtgtgagatttctggttgtcagcatttgttattgtctacccttttcattttagcaatctaactagtatatcacagtatcacaatacagttttaacttgccttttcccaatgacttacgatgtaagtgctttttaatatgcttattatgcatcttgatattatctttcatgaagtacttgtacaaaatttactaactttttaaataaggttgactacatattaatttataggaatttaaaaatgtatttatatatgctagatacaactctttatattttttctatactgcctttttcgtacactatctcttgaataatagatatatttacttttaatgaagtccaactgatcctcctttttatgatattttacttattctgtttataaaatccttgctttctcaatgccatggagatagtttcctatattttaccctagaaaacttattaccttatttttcacatttaaatttatgatctatctcaaattatttgtgtatgcatgtgtggtgtgagatagggttttgtattcccatacagatgtccagttgatccaaaatattatattgaaaaaacccctcttttgccactgaattgttgtgacacatttgtcgtaatcacagttaataataattgtaaaagtcaaattctagtttctctattctgtttcattagtctaattgtgaatttttgcaccagtatgcatgatctaattaatacagtttcacaataagtcttgaaacctggtagtgtatgtcttgcagctatatttttctctttaaagattgccatggggaaatgcaaatcaaaacaataaataataatgagatatcatttcactccagttagaataactactatcaaaaggacagaaaataacaagtgttgatgaggatacaaaataaagggaaatacttgtacatgtttggtaggaatatagagtagtacagccactatgggaaacaatatggaggttcttcaaaaaactggaaatagaattaccgtatgatccaccaatccaactgctaggtatatatccacaagaacgaaaatcaatatattgaagagatcactgcactcttgtgtttgagtacttcacagtgggcaagataggggctcaacctaagtatctgtcagtggatgaatggaaatagaaaatttggcatatatgcacaataaaatagtgtttggccattcagaaatgaaattttgccacttgtaacatggatggaactggaggatgttttgttaagtgaaataaactaagcagagaaagatgaatattatatgttctcacatgtaaatgggagctaaaaaaaagtacatctcttgcagttagcataatggtggttgactgaggctgggaagggaagaagagagggaagatggggagaagtttgttaatgcatacaaaaatacagttagatagaaggaataagtactagtattcaacagtatagtaggaaaatgacagttaacaataatttttgtatatttcaaaatagctagaggagaagaaaatgcacacaacaccaaaaaagataaatgttgaggtgatggatattccgattaccctgattttattattacaaattctatctatgtatcaaaatatcacatgcaaccccagaatgcatcaactatcatatatcaattaaaaaatataaaaagcagatctctatggatattgtagattctttgagtttctacatcaattttagaattctatgtttgatttctataataacaaaaactgcaactacaatagcaacaatataactgatattttggttggaatagcattgaatttatagataacttgagggataattaacttttaacattatctagtattcaattcatgaaaatatcatatacttctacttattaaatcttctttcagtccttccaggaagcattttgtaattttcagtgttgtagtcttgcacatattccattaccctttttccccaaatatgtgacattttggtctctttcatctcgatatttttctttaatttctcaataatttgtttctagaatatgaatatgctgtgtatttttgtttattgaccttgttttcagtgacttcattaaattcatttaattataattgtttataggtccctttgcaaataaaattagttttcccttttatattaaatttttatgctttatatttatttttcttaaattattgcactgattaaaacctgcaacataatgttacataaatataatgagagtgggtacttgttttctttccaacttcagatggaaagcattcatatgttatctattccttttttttttgtagttatttcttatcatactgaagaagttcccttccatttctgatattctaagagtctttagcatgattgggtgttgaattttatcaaataatttttctacaacaactgaaataattatgatttttttcttgtactctggtgattttgtaaattgtattgacacggtgaattatattgattgatttttcaaatgttaaacaaattttacagttgaggactaaatacctcttgattatgatctagcaccatttttccaagtaagttatacgaagtataaaatgtttactttgatgataaatatgaatacttaatttgaatgatatcactggatatgtatcaaagaaatgtttctcaagtcatgagactgtaaaacttctctgtcactcagttctgttcatagccatgcttacttcctttcataagcaatgtaaggttttttccttgacagacattatttgtctgtttgagacatttcagatattcacatacttgaaagagaagtcacctgatattaagttaagtagataacttagcttcttactgatgctacgaagacttttctattttccctttcctaagaaaattatactgccactttgtgactcttttttatgtacgtattctagcccaccttaactctaactctttctttaaatgaaaatcgtatatatttaaagtgtaagctaggtgattattttgctcctttttaaggcttaaagtgagtattaattaccactgacaaatgtttcttgagtatacggagcaccactgaattgtgttcttcttatttaatgccaaattctaggaccttcttggaaatcatattcttaactgaaaagaaaacctgacagtaataatatttgtcagataacaatatacaaaaacaaaaatattccaagtaaatacaaaaataaatattccaaatgatttatgacaaggtggtagacataaaagtattaattgagagatatatatgaaaatgtgatttttaatcagagttataaattatcaatgtacaataccttgccacatggcaggaaaagaattgttttagatatgaataggtgaaactgcatgatgggctatgagttatggcatttcaaaattgctgattgacctagattagaagctatttgaatttaagccactaggatgggcgatatttttgggaatgagttttctttttttattaattctagttatcccaacatcaagcatggtatctggatgattgctttaaaaatgttgttaaaagatacaaaattatatctagatgggaagaataaaactttggccttccatagcactgtaagatgactctagttaacattaatatatagcttcaaacagctagaaggaggatactgaatgttcccaacacaaagaaatgataagtgttcaagatggatatgctaattgccctgatctgatcgctgtacatcatatgtatcaaaacattactgtgtaccccataaatatgtataattattatatgtcaattaaaaagaaaaaaatttaaatgttgaatgaggtaaagaatgaacaggccaatgaaggaagagcttggaatttaggggaaatcaggaaatggaaaaaatgagagtcttatttaggatagatgatgaaaacatatgtgtgtaatatatgctatctttttttttttttgctattctgtgtgttccagagaggcaattttgatatgatttaacaattccatgatatggagataaatggaaaaaaaatctgaaggaaaataagaagcagattatgctgctgaattctgaatttggggaactgacacatgatggtaatagataattgacgtatagtgaatggaagaatattaaagctgatgttttcaagggtacaaggaaatgggcataaatgaaaagataaatggtgtgatctcatttcatattgtttccttggttttaaattgcaccttaaggtcctttgaatagggctatagtaacaacgggaagcccagagatgcaaatgctgggaagacagagaatggaaaaaaaaaaaaaaagggatactaggccccattatacctccaccttacatcaagtttggtgggtaagtgcagtgaagggaggtagagttgcttttgaataggagtaaaggttatttttgaaaagatgtgcattctgagctaggggtgacttctaattgggagaaatgtttgattttagacacttaagggggccaggatggagatgagggaacagaaagcaggtcactagatacttatggatgactaaggtttaagggagagcagtaagtggaatggactatatgtttcttttaatttatgcagtttttaccagagtagaggaggtgggctttaaaattggtttcgatgattcacgcatgtgtagatatttattgagcaccttccctagatacagctatcctacataccaggatttcagcagtgaggaaggcagacaagttaagggctactgtaggaagggtgctcaagggagtcacatctgaagcaggaggagtcagtcatatagccatctggggaaagagtgtgtcaggaaaggaaacaccaagttcaagagcactaaggtattgtttagaaatgaaaagaagttcagtgtatctgaaacatagagtgggaggatcatcacacggcacaagtttgcagagctgagcaaggcacagacagactggaaagagttgaaaatctacttaaaaccaaggagaaaattgttggaagtctctaatcaagaaagtgaaaaaatctcgctttatatttttaaacatcacccaactgccttgtggagaatggactataagaaagcagaaatcaaagcaggaatttaggtaattacaggagtacacatgagaaaaaatgatgacctgtggctgggcacagtggctcacccctgtaatcccagcactttgggaggccaggcaggtggaacacttgaggtcaggagttccagaccagcctggccaacatggtaaaaccccgtctttactaaaaatacaaaaattaacgtggtgtggtggtgcacatctgtagttccagctacttgggaggctaagccaggagaattgcttgaacccgggaggcagaggttgcagtgagccgagatcgagccactgcactccggcctgggtggcagagtgagactctgtctcaaaaaaaaaaaaaaaaaaaaaaaaaaggtgacctaaccaaagcagtaacagaaaacatggagacacagagatattcttgggatacatactggagaaataccctgaaattaattatgtatgggacacggtgggaggtgtgtcataatggacacacacacacacacatacacacacacacacacacacagcatgcttcttcctatgttcttatttactgtatactgatagtttggttatatattaaggttttttatgctgcttaccaattattttactttccttctttattttctgtgtgtagtaaatttattgtctgacattgttcacaaatttaaaaagtaatcctataagaggtagcgctattgctttattttgaaacatggtgaagttgttttcacattgacctgggagccattgttgaaattaaaaaacctcaacctctcataaccgacatctctgtgaagggccaaggatcactgacacatgattgcatatgttgtcaactgttctcccttgagtatcttatttactctatttttgatcatgtacgtatgctttttaaactttcccattaagtggctctaacactcagccttttgagatttaatttgttttattttcaacaagctaaaaggattgtcattctcttagattgtttatgttaatctcattaatgtaaatgaaagttaaactaatggggaggattgtttctttttttaaagctatgatttccttctggtagttactattgtatgttaatgcatacacctgcttatctttttaaagtgagactaagcactgacaacaaatttaattaaagatgaaagtgatctatttgtgtccacatttactcaacctgcttacatttgcagttttgtgcaaaagtctaaatatcaaaatttctattactgaaaccaatatgaagaatttattgtatattttttctgcttatattagtttgttaggactgccataataaaatactataggttgagtggcttaaacaacaacaatttattttctcacagttcaaatgtcaaagtgccagcagggcagttttcttctgaggcctctctgcttggcttgcagactgctgcctttttcctttgttctttctcttcttatgcatccctggtgtcgctgtgtgtcctaatcacctcttcttataaggatgctagttatataggattaggacccaccttagtgtcctcattttaacttaattacttctgtgaaggccctgtctctgaacatagtcactctgtcataccaggggttagagtttccacatgtggattttgtggggatgtaattcagaccataataacactgaaaagtggaacgaagcaaattaaaagtatgacagtatgccagaaaattgtgtggaatcagactagactgatcagtgccagaatgctattttattgtatgttactaaaatctgtaaagttctgcaatgaggtggaagaagtttggcactcatcttcaaatgatgacattcactatttatcccctgcctatcccaacacacagagcaccttggaatttaactgcaatccccagcttggtacttaaatccccttgactaatgaagaccctgcaatgaggagtgataagagacatccagttagacaaaacaaaacttaatttcactctgcatttatagtccagaacccttttctatttgccaagttgtcacattatgtagatctagcccatcagatacaattgtaggagcttttcttatagtaagtatccaacacatggcctgtgtttgaaaaacgtttgctttcggagtcacagagacctgattatctcccagccgtgccacgtaatgttagacatcagcttgctcatcgatgacaccctcataggattttggtggagattaatcactatgacatagatgtaatgctgacacacatattcatacttcatagattttagggcaattagaatgcaaggatatggtagactgtcttttactcaattagtcactcacttccatatttgtttctctatacatttccatatttgtttctccatcaaccttacaataatatgaaagagcctcacatttttctagagatatgggttcagtgttccagaggtcttcagaattttattttttagttttgtcctaatgccagtatatgcaaacactgatggattaacatctttatgttttaatcatttattgctattactaaaggaaaattattttgattgcgatggggtatggtaaaaccactcagggactctcaaacctgaaacaactagtatttgtactggtggcttgtattgtgcattttttgtctgttattctcagaaatgactgccctcagaatgtaacatgtacttgaaattaaaaacctcaccctctgccttcttagatgtaaaatttctctgtatgtattgattaggaattggagcatttttactcaaagttttaacttacactaaacgtgatgtctttgaaaggactgttgaaagttaaaccttatattagcccattcttgcattactataaagacaaagaaaactaaattatatccgagtgcaatagtgaactgacctgttggtgtcagaatagtggaatcatcaaaaaggaggaactaggaaacaaaggatttgaagtggcctcagaaacccaagcgcaagaggctacttttgcatgccaaatgccagttatgtagatacagccaataccaaagtgtgcatatggaagaaaaatataaataaacctgaccatgaaatacagacagccatattctgagctgcaaactaaatgaaggccttggtgatgggagaaaaatattcgatgttctacagccagccagtgtttgccctcccttttttcttactactcctttcttgtttttgaaggcatcatgtgtgttgggaattggcaaaaaagcttattctgagtaaagcaatgccagttgtttggcagatggaagatgtgggataaaccctagcttacagatcctcccagagtacaatcgggaaaagagctttccttccagataatatacctagtgagaaatctgttcaattgggtgaggcgatctacagtgaaaaagggacagagctagagggtaggaaaattttcccctcgctttatctatacagcagacttttctttttctcactaagcactaacagcagcaaactattctcaatgccactctcatccccaagctaagatccaatagcttgcaagtgcactttctgtattgcaggctgtcaagagggtccaagagtaattctatcagtaaaaacgtattcaggttttccttgaaagagctgtatgtgggaacaactgtattttctacattaaatttatgcaccattatatgctacatactgtatgtatatatagatgtatatgaaaatggacttgcaaaaatatttctaaattcatgtgcaagttaaatatttaacatatgttttgcatatattcagctactaaaatgatctaaatttaattaagtaaaacactaatttttcatgaaaggttggtttaacagaaaatgataaaatgaataatctgtcaaaaggatagcaaattttattattatgatcctaaactaccaaacctagaaatttcatattcaagagaggggtgatttatgaaggtgtaaatatgcatgtattaaaaatgttttaatttttttagaatatctgaaatcccaaatttataatcaaactacaatgaaattttagttatatgtgtgagatgtctgcttttccataggagtttcccatgaacacatgaaaactcctttgttttaaatttcaagatccaaatattctgtggtaaaagttgctcagtgatgccttcttagatataaaatttctatatatatagattgtgaactggagcatttttattcaaagttttaacttacactaaatgtgactgtctttgaaaggactgttgaaagttagaccttatattagtccacttttgcattgctataaataaatacttgagactgggtaatttataagaaaagaggtttaatgactcacgttctgcctgctgtacaggaagcaatgtggcttctgcttctgaggaggcctcaggaagcttacaatcatggtggaaggcaaaggagaaacaggcatgtcttacatggcaggagcaggactaagagagtgataaggggaggtgctacacacttttgaacaaccagagctcatgagaactcactgtcacaagaacagcaccaaggtataaatctgcccccatgattcaaacacctcacactaggccccacctccagcactggggattaaaatttgacatgagatttggtcaaggacacagatccaaaccatatcaggcatatattgttattatcatatcaataaaacatgaatctgaaggcaagctgattttatcttttaaaattacattaacactatttagtaacaatactcatcagaaatagcaatgacaccacaattcctcctttataagttgacacctaaagtttatgttcattgaaatgctgaaaaatgagcatgcataagacattataagggtgcagaaactttcaaaacatgactttgtgttttagattttaaaattatttgataccacatgttctcacttataagtgggagctaaacattgagtacttgtagacataaagatggcaacaatatacattgaggactactggagaggggaaggagggaggcggaaaggattgaaaaactgttgagtactatgctcactacctgggtgacgggatcattcataccccaaacctcagcatcacaccatatactcatgtaacaaacctccatgtacccctgaatctgaaataacagttgaaattctaaaaaataaataaaataaaataatgaaaaataaaataagattatttgaagtttaacagggattgtaagtttgttcgaatagctttagaaaataaattatttctaagttttcttttatttctggggaaagtcagagagacctgatgttaaatctagttgtatcactcatttgatttcaggcaggtcaggtagttcttaagcatcagtgcccttggtggtgaaagagagatatgagtgtatacctgcaggattatgtaagaatcagttgacatgacatacacctaagtaccaacacacatagtatgcgctccataggaataaggactattagactggtatgatggaagacttcttctactcaagttattatccacttttcatccagttttccctagatctttctatttttgtgacagttaacagacaatcattgaatgagatggtattaaatataaatggagttttgttggtattttttaccctactgattagaaaaattggcacagatatggtacagcatagaggggatgaactatgcatgtgtatagcagagaatggatcagaaattatgctggatgacagctgtaaataatttctgcacaactgctgaggctttatagttccagaatgtttatggaatttggaatggtagacttcatttcaaaaggagaatcggtggtgaatgttgatcacaaactcaaactgccataagacaggtcacataaaagagagaaggagtcctagtgaaagaagccatcaaagtggtagccagacagtgtgagagccagacattgcctgtgacctgctaacttacaccctttggaatagcatttaaaggtattactgctgtgatacctttatgtttcttatgtgtaaacagataatgtgttcatcctttcccatacatgaagtcttcttaggcaaagttctaatgcatgtggatttactttttaaacaggaatgttcttaatttagtgtaaataaattttactatccgattctgtgtggaagttgtatattatttagtttataatgttcttattttctgattctacccttattacacaattgcttccagaaaagtttatcatatttatacatcaaattatgattttttcatcttcatactgtgaatattggaacactaggtaatgtttcagtatcacatagttgatattcagtatgtattaatctatgtgaattagagtaagttagaaattcagcttctaaatataaaggaaaaacagacaggtgatttttttttcatctgaggaaataaatatactgtagttaaaaaacaaactaaaagttgctggtaaacatgcttgaattataaggaacagtcctactttgtgtgtgtgtgtttgtgaatctaaaagatgcccataagaaatggaatgaaaccattaaggccaattttgcaaaaggccaacaagaatgtctcattgatatttttttgtttcctatacaatatttttattatagatgtggaaatgcaggcattttccacaactttcctcctagtcttgagttctctaaaaatttcctcaaatgatgtttctaaacagcaaagtatcccatcattagaatttttcagatttagaacctatgtaaaatggtaagacatttcattggcttgcaaaagtctctgatgtccgcattcttacttaatcgcatagagctgtgttctataattggagtattttatctagtgttttctctttgaggatttattgcattgaaaaaatttggtgatattgaaagaaatccaaagaacagaaacagagataattaaaggaatgaaaagtggaaactgtgagggaagattaaagacagctgtgatcatttagtttggaaagaggtaaaaatgatcttcagttataggaaagatttaatatggaaaagaacagttagtctccattgatacaaacgatggattaagataatacgaactgaaacttgcagaaagacgaatagagagcaggctgttatagacaaccctgaagtcatttgaagtgaactgagtccttagtcttatttccttgactgctcagtcaccaatggatagtccatatttggtttgctttttaaaaaaaatttccatcaatatttacaaagtaaggtatatgaagaagtcttataaactaaataagttttgtgaaaactcaaaagttagaattgtaaacaagattttagcaaatattttggtacatttatttaagtacttcaaatgaacttttcaaataaactcttaatatactttcattttttgccacggaaaatagagagcctagagtaaaacagcatatacccacgtttcccaaactgtgtattaaagcgccccaggaaaccatattaactcaaataggcaccatggattattttaaattttaaggaaaatagtgatactcaacatctgttaaacatcacacagagtacttcctccaagtagttcacagatttaacattagaacacaatagtttcttttgatgatatcacatcgttgagaagcagagttttcagtgcttcctgtggtaaaaagcaagtaccatggggaaatcagcgtggaataggatatataggtggtggtgtctaattcgattccaagttttaagaagttgcacaacatccaatagacacatgttattagtaatgttgattacgtaagagtaaatctttttttctttcaatttatgtgcattatttttttcaaattgctactcgggtagaccataagtatgttttaagtagtgtgggcttaactattaaactggcggtcgtattacaaaaaatattcatggagtgctgtgaaaaattataaggcaagtggatcgccacaaaaccagaaaattgagagtattctttgttaatttgtttcttattttaaagtaacaatgtgcatcttatgtgcttcacaatatgcttacattggtacaagtaggggttagaacaaatcatggtacatttgtgacagaatattaggtttagagccataacttgattgttcatttaaatgactttcatggtcagaggttctttttctagacaatcttgtagggttttagaaatatttcttattaattataactaatatcttgtaaaatgaagattactttattacttctttaaggcccaaaatttcttaagtgctaaagaatactttagtggtaatctgtgtctgtggctcttatatttttggtattggtgaaaagcatttattgtgactataaaaattttaaacattttgaaatatgtgaatatgccttgaaatatattaagaagctttctttaataatagttttcccaaattagaagtgcactgtcccttgaggaaaaattggaatcactaattatgggcttaataaaatgttgctaataggcaggaatggtcagccctgaattaaaacttctactagtgagaaaatatgaatgaatgtaattctacattttattcaatttccttttttgctatattttcccaatataccagtttgtttgaaaatgatgtgttagtaaaatatgtcctccaactctaacaatcagtttatgtatttttttattttattttattattattatactttaagttttagggtacatgtgcacaatgtgcaggttaattacatatatatacatgtgccatgctggtgtgctgcacccattaactcgtcatttagcattaggtatatctcctaatgctatccctcccccctccccctaccccaccacagtccccagagtgtgatgttcccctccctgtgtccatgtgttctcattgttcaattcccacctatgagtgagaacatgtggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttgacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatttccttcgcccacttgttgatggggttgtttgtttttttcttgtaaattggttggagttcattgtagattctagatattagccctttgtcagatgagtaggttgcaaaaattttctccaattttgtaggttgcctgttcactctgatggtagtttcttttgctgtgcagaagctctttagtttcattagatcccatttgtcaattttgtcttttgttgccattgcttttggtgttttagacatgaagtccttgcccatgcctatgtcctgaatggtaatgcctaggttttcttctagggtttttatggttttaggtctaaggtttaagtctttaatccatcttgaattaatttttgtataaggtgtaaggaagggatccagtttcagctttctccatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggggatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcatgtcccttgtaagttggattcctaggtattttattctctttgaagcaattgtgaatgggagttcactcatgatttggctctctgtttgtctgttattggtgtataagaatgcttgtgatttttgtacattgattttgtatcctgagacattgctgaagttgcttatcagcttaaggagattttgggctgagacaatggggttttttagatatacaatgatgtcatctgcaaacagggacaatttgacttcctcttttcctaattgaataccctttatttccttctcctgcctgaatgccctggccagaacttccaacactatgttgaataggagtggcgagagagggcatccctgtcttgtgccagttttcaaagggaatgcttccagtttttgcccattcagtatgatattggctgtggttttgtcatagatagctcttattattttgagatatgtcccatcagtacctaatttattgagagtttttagcatgaagggttgttgaattttgtcaaaggccttttctgcatctattgagataatcatgtggtttttgtctttggttctgtttgtatgctggattacatttattgatttgtgtatattgacttcagtgatgcattatagattcagtgatttttatgtacttaggtagcctcttgaattgagctcctgaaactttgcaatgtaatgtttatcaaagtacatgtgaccatagagatatatttctaaccatttccttctcttttgagaatccaaaacccatgtggtacccacataaaaaaccaagcatttattctgcctcaatgccacattatttgtcattacatttgaatcataggtgaagagtttgaagcaaaatcaaattagtatctgtcctggtttatcatctctttgcaaattggacatttaatttttttataatagtgcacaagttcatattacatcattgtcagtttgtattagtattgctatatatgctggccataagtctgtaaaatttgacaagttaactgaaggactaatcacctgaaatgcatctgaccagtaaagataccatcagaatgatcatactttaagtttccaaaaatgatttggtgtttctgggaattttagctacaacagaatttaatgatggttcagaattatatgatattgtagtatggatactcttgtacatacactgaatttgaaagagacattcttgtctatacatggaatattgaaatattaaaatgacagttatccatgggttataattttttcttttgtgaaaaatgctaaatattaatataacaaaagttaaagcctgttaattttgtgtgtgtgtgtgtgtgtggtctacacactaagaatgacatatctaacataaaacattctttgagtaatatgaattttagaaccattgcctgtgtgttggccagttcacacttaataaatatttaggtattgtgaaattagctctaataccaacatattatcttgaaaggagaatcagtcatcttaatgatagtaacagcctcttgtaaattttattaagtatattaagaacaattcctttggttgaggcaaagtttaacttccaaaatgatgtaaggtgaatgatacttcagagtactattcttttgcactatttacaggttacagtgtcaaacagaattattggcatattttcattttaacaatcggaatatttggaggcccatggttctttgtcaaatatttgcgtatattttagtaaagctagttaaaaaattcacaaaacaagtaaaatgctcttcttgtatacttttgacatcagtatttctcatgttcaatatgtgctttaatattgaatgttcagaattggatgtgtgtgtatatgtgcacagacacatatatgtacatttaaattttgatgtttattatccagtatagcactgtgcacccaaagatatataacattacttaatgataaatttctgtgtttttttctagtattatcttgctgataataaatatacatagtctcaaaaatttatttctcttagatctaaataatattctttacattctgagaaatttgcatttgataaaatttggatattgaaagaggctaattctgctcttttcacaagtttatctttttgcaatcaaagtagataaagattattgctcattaagtattaaaaatgccaagcagtgggatttgctacagtttcacattgatggctgatctagaattgctacattttacaatccatggcacatattttaatatctcttagttcctaaatatagtttctcaaattaaattaatttaggcaaaaagataagttcactgacttacagaagttaacttaaggaaataattaagcacctcaccaagcaaccaggcttaaattctactgagaccctctcattggcctgccttgctcctttcctttctgagccatgctgattcttagtgcgtatgttttttttctccatgcactttgaatggaaaatcttatctccatgcacttaggatggaaatcttcttaggtggaaaatcttacctctgtttgcttcctggttttacattctgcatcctcaccattggggtggaacggactttcaccccagactcacttattcagaaatcgcagagaaagagcctctttggtccattttgggtcaaatgctcagccttaaaatggtcagcttgggccgaggcctaagtactgtaattaaatagatttagttagggaactttggggtttttattaagagtgtttccttcccaacagtagccacatcatttaggggctgaagtgaggaaggacttcctagaagaatggggatgcaaaccattttctgagttcagccttcttttcttcttgctgaatctctattcctgtaaatcctcaccagggatgcttccttatttcatgcagatctcagctcaaatatcacctttccctgcattattgtctaatattttgtactcctctttgcactctctctttttccactgctttattgttccttcacaacattgcttggtgttatttaagtgttcccttgtttatttttctactacactgggaacagtgtactgaacagtgaacttggcatattgtacgtattccagagatatttgttgaatgaatataagggaacactatgccatttccatagatatttttttctatttaccctaacctgaatttctctctgctaaatagaaagtatgcagggagaagtatctctgatgtatggcaaaagaatgtcaagacaaaatcattaaatgtaatggctagagttggacaatgaaagtgtgctgtaactcattagagaacatttctctgtatcatttcttccccatatagtaactgattttttcttaaataaagagatagtggcttcttggattccacaaaatcctttgatattttctataaatacagtgaatttggcctcaatgaagccactttttatgtccaatatatgcatttagaatacgaaagtataaatagcaaagatagtaatatgtgttttagttccgtggatgttcctaataaacattcaggtgatacctagggtgtttatatttagctaaactgactagataatccagtcatatctgtggtctctttcggtaaactgataattttctgacaaaatttatcacatttgactcattagttctttataagttttttccccaattcaaagcttaccttttcactctggtaaaatgctccttaaagaaaatttaccgtgatttctttagaatttttgtcactatctttaaaaaacaaattttcataattgtgaaggtttttttttagaaaatttcatttgagatgtgtgggaaagaggttaaaacaaataaagtgaagactaacactcaactctcacttttccactaaatgtaaattttatcacagtttctataccctcatccttgtcattaggtattatgcttttttgcagccatattcttaaggaactttttttgttttgttttgttttgggagctaaattctgttggcagaaagacaaaattttcccgtgttctgctctctagcatatctttctaattttaaaattttaggacctagagattttcatctcttcattttgaccatggtaatttgaagtgaaacagcaagatttgacataagaataaaagatataagttagaaaattcatttctgcagtttattcggatccattctggaataatttttcctcctatgatagattcttaaagcaattagaaaaccaagattttgtgatattactaatcataaaacaatgttaagttttcgtaagagagggccgatttgattttttttttttttttttttttgagacagagtcttgctctgttgcccaggctggagtgcagtggtaccatctcggctcactgcaacgtctgcctcccggttcaagcaattctcctgcctcagcctcccaagtaactgggactacaggcacatgctgccacgcccggctaatttttttgtattttagtagagatggggtttcaccgtgttgcccaggctggtctcgaactcctgagctcaggcaatccgcctgccttggcctcccaaagtgctaggattacaggcgtgagccaccgcggccgactcttttttttttttgagagagagtctcgctctgtcgcccaggatggagtacaatggcatgatctccactcacttgcctcagcctcccaagcaactggtactacaggcacatgctgccacgcccagctaattttttgtatttttagtagagacggggtttcaccgtgttagccagggtgatctccatctggtgacctcgtgatccgtccgcctcggcctcccaaagtgctgggattacaggcgtgagccactgtgcccagcccccaatttttttaatgatagtgaagttgaacaagttttttgcatttttggaaacagatttgaatattttaactttttaattcttctttgaataatttgcatgtttttaaaaaactctttcatggaatacatgactggcttttgaagtaaatttgttatatcaaaaccagtattttctcaggtgaagtggaatggaatgaaatagaattgaatagaacactgggatagagtaagtagaatgtcctggttgcaatatattccatgaattttgaattctaattctaactactgctgtttggtgggagttctcctacgtaagtttcattttattatggagtgtatgtaccatcttgctcatatcaaatattcctttaaattctataaacctcaaaatttccctctgtttaatacagaatattgactgcaatgatatcagattttaaaaatctgtatatcattcttgtggaaggaagtatatattcttgtggaaggaagtaaaaaagtatatattcttgtggaaggaagtaaaaaagttccaaagcctgttagaatctgtataaacttatggaatcattacttctttttgttttactacattaaattcaccttaaattcagtccaggtttttactttgagatatttcatatctgaaatggctacagcattctgttgcactcatctgctggagctcaagcaacttataaacatctttacattaatattcagaaatcagtttctatcatttaatatgtagtgtgggaatagttcacatatagagtttggctgtatctttgattccttatcctgtaccacatgagcaagatttcttcttctacacatgcctttggaattgcctcatatacactcaaagctttccatttaagcaatttagtgacaattgcattaattcaaatcatagctgattttacaactgaagtagaatatgattggggattatctgaagtctcctctaaaactctctcagtttaaattgatggtaatctactcctgaataatgaaatatttcaaattgtctaattgcatgatataaaatgcatatacaattgtattaagaataatgataaaatgagaatctctcttgctcttataaaagcaccatgactagtttttacatatgaattcaaaatgattcggttgattcttaacatttcataacaccaacctgttctacacattcattttagcatatattacttttagtacgtgattgggagttttactggaaatgtttctgtcttccagtctctaacagctttaagcttatattctaatttcagtaatgaagtgagatacctattcctacctcaaaaacttccctttcacaaagactaaatttcctcaaagattgagccttaaagaagcaacaagaaagtgcataaaaaatgcaaagctgattctttgcataatattaataggccctttgaagaaactgtagagtgaaaaagggatggtggtattatatcttgctaaagctgctccaaatcaaattatttctaaaattatacttaaaaactaaatttgatactgactttatgatacctatatcaaatattattttatcttgttttctcttgaaagtaaggagaaattgaaataatttgaatatccctcttctttgttatataatcatcatttttgaaagttttttcaggtttgtgcaatagagtagagcaagcaatattagattgatacttagtggatggttcttattccttatttcttcaaacttctcttcagagtaaagttttgataattgataattttaatcattgatttctagggtgatagctattattttggaaaataaaggattaaaattttcatgccgaaggatactgtttacattcatgtatagcatgcaatagggattttgtttatctggccattttgaggcaagaagggatattatgttgaagtattcatttcttatttttaaaatctgatatcattgcagtcaatattctgtattaaacagagggaaattgtgaggtttatagaatttaaaggaatatttgatatgagcgaggtggtacatacactccataataaaatgaaacttacttaagagaactcccaccaaacagcagtagttagaattcaaaattcatggaatgccacagaatcctgaatttggaagaaaattcagaagttgttcattcaaacttcacactaaaagcacctttcaactttacctgttaatcattctaaaccaaacttcctcaagtgtctccttaaataaaaggcacacttctggatttaaggaaaacaaagataaaaaggtcacaatctctaccttgcagaaattagttagggcagcctaagtacaatgaagaaaaactcataattttagtaatttagcacaataaaagcttatttcttgttaaatagatacaggggtagtactctgttctacagagttgttctgggattcagcctccttaccctgtccaactccacccttttctaattcctagcactcctattcattcaactattctttcaactagggaatggtcaaagagagtgagggcaggattgcatcaagagattattaagggtcaggcctaaaagaaggcaccacttctactcatatttcattggccagaatgtagtcatatgaccaaaccaactaatgaaagaaaagcagggaaatgtaggcaaccttggtgtccaggaggaaggaaaaaatagtttagtgacacattggtcagtccctttgaaaaggtctttgcagttgacttatatatctctgaaagattgtccctctagctcctttttgaccacttaaatgtcaccactttagtaaaatgtatatgtaaatttgaaattatctgaggactttaataaaaattttaattcacagaatgattctccttttactttgtgaatacctgtatctaccttattaaaataaggccattttcagttgtaataataaatagaaagtgtgtttttaagcaccattgtaacttgggttatcaaaaggtgggtgctgaatgttattaatactattgattttctttgcactttacttctgttaagaagcaggaatcatgtggctctcattgcatagacagcgtgaagtgcttgtagaaacttgcagttcaccctgagtgacagatctacactcacacagactgcatactaggctgcacatctgtatgaaggcattactatttgtagggaaaaaaagaacaatattatgcttcaggccaggaaagtcaaatagctgaagtcaatattaagatagttaggataatatttcagaaaagatttgcctgcttcacttggcgtaaatttaaatagtcaaacttcctaaacatttaaaagttaaaacaagggcttaaaatatatgatgtgagtttcacataatgtctacactgcctctgcctgtacctaatgggaaaatgaaaatcacttacatgttaaagtctgattggtttacaaatttcaatgactacccacttagtagatacatctattgtttttatatcattatttttatacaatgggaagttactaatataatttttcccatatcccaaccttttactcttccccttctgtttacaggatgaaccccaaagtctttagtttatcaattcagattttttttaaatgtagcctcactgggttttcaacattattttccaatctacgatttgctaaataaacttgttgctccaccaaaactgttctctccaaagtttgtgaatgtacatctctctcttgccctttatttctctctttctcactctttatttcatcacatgtgtagatttatgttattgtaatctgctttttacatttttttaagtactgacactactgttccatgctgcctctcatgagaaattttctagtttatgcagacttacctcagagatattgtagtttaggctccagactatcacaataaagggaatattgcaatgaagtgagtcacacaaatcttttggttttccagtacatataagggttatactatactgtagtctattaattatgcaatagcattatgtctaaaaaagtgcatactttaaaatactttattgtaaaaaagatgctgacagagacacaaagtgagcacatgctgttggaaaatggctctgataagctttctcaactcatggttactacagaccttcgatttgtaaaaaaatgcattatctgtgaagtatgatttaaaaaagtatgcccatagtttggttccaggactagctagtctctaataactagctctactggttatattttgaattctttgggattttctatatacaagatcatgtcttctaataaaagagattgttttattttgcctttccaaattgctttctcttgcccaattgctttggctaaaacttccagtacgatgttgaatgacagtggtgaaaatagacatccattatgatcctaatcttaggggataaacatgtaatgtttataaacagtgttgttaactgaagcattttttcttccttattctagatttattaaaaataaatagtagatttatagaaggcaaggataaacatacagattcctgccatgttaatatgtaatttaacaacaaaattatatgtctgtgctgctagatatgatagaataaaaatgatattgcattactaatttaactggaatctattttattattagtgaggttgaatatcttttatgtttcttgtgtgtattcttttgttaacatctcatacattttcctatttttattttcatgtttgtcttttaatatgcaagtttttatattgactattaacttttacccatcttatgtcttgcaaaagtctttcctagtatgacttttttaaaaatgcctttccatatagttttaaaattctgtggcataaaattttttatctttcattttattctttcagactacgtgtcctactttaaaagtcctatgtgggtataataaaaaatgagtaatattaggttaatctaccaaatattttttgaaaatttgacaaacccttgaaatccaaaatgcaaaagtattttatatcaattaccagttttaaattaggagtcacatttattgtaaaaataaacaatttttgatacttggagaaaacaaaaaagcattcgatacaagtagtccaaacaattagaaattttatttcacatgcacagtttagatattactttataaggggaaaacagatacttgagtatgacatggagaattgtgactttggagggtggcagcttcttagcatgatttcttttaaacttctggtataatcctgtgacatttctgtaaatgactaccactggaatccttttttgtggcccaggtattgactttcagaacccctcattaaaacatagttatggcatcagtctattaccagtccataacattattacacttatcctgggaaaataggaaatacaaaaaaattaatccctatttagaaatctctgcatagcagatatgattgtgttttacgtacattgttatggttgaaagtttttttttccccaaaatctatatgttgaaatcctaacctccaaggagctggggccatttgggaagtgattaggtcataaaggaggaagctctcaaaatgggattaaagcctttataaaagaggcgcaacggagtttctgttcatccattttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaatctgttcatccattttaccatgtgaagatgcagcaaaaaggtgccatgtaagaaacaggaagaagagggcttcaatagactccaaattttctggtacttttatcttacactttccagcctccagaactgtgagaaatacatttctgttgtttatcagaccccccagtttctagtattttgttacagcagccaaatggatttagacgtacattaacttttttttttttttttgagacagagtctcgctctgttgcccaggctggagcgcagtggcatgatctaggctcactgcaagctccgcctcctgggttcacgccattctcctgcctcagcttcccgagtagctgggactacaggcgcccgccaccatgcccggctaattttttgtatttttagtagagatggggtttcaccgtgttagccaggatggtctcaatctcctgatcttgtgatccacccacctcggcctcccaaagtgctgggattacaggcatgagccaccacacctggccgacatacattaacttttaatgatcacataatcctaattaagatatgcagataatattaaatagccacatgtgatgcatgaggaaactaaggatagtgtggtttaaataattttctcaaggtgacagagctattcttttagaaagtcagtattcatacctgggcaatttggctctaggctctatgcttcccacttgactggccagttttgattcaggaaatattctgagcacaatgtgctcaaaaaagaagagactcaactctgattagaatagaaacagtgaattcagactttgaaagatagtgtaaaatcaaggcctctaaatgtgttccagatgtggtactatccttaatgagagaatgtgtaattgtttcagatgttggtcatggagcacagtgaatttggtaattattgacccaacacaggtgctgtacaatacaggtactacaactcgattaaaattagcaaagactttaaaattgttagcttgcaaatataaagataatcaaggaatttgaaaccaataagaggaattaagatactaacctgtagggatatatatgtttcctaccaaataattagatcttagtagaaaatgtattagctctatgttcatctcagtgaagacctatggctcacagagctggaggcatcagaaggtgactggggaagagtttgtcaatacaggctttgcagacctttactgtctcatttaacactagacatgttcttcagctattctgtgtgtaggtagtgaaggatttgcaatcagaaggaagtgatctcaaatgcaatgactttgcacaagtctgttaatgtcttaaagtgttatatagcacttgttttatgttgtaggatcaaataatgtaaacaattgatagaaatgtaaagctctatgcatttctaattactttggtaattaaagtttaaatcaagaaccagagaagttacaaaattacagttgagaggaaaaggaggggagaggaagcagaaaggcagtgagcagacagcagagggactgctgggagagcagtaggcactcaaggcgcatctgctccatttcacccattacccatgggtaggcgctggatattgggccttttatccacagaattactttctgaggggaaatgtaactgtgactgttatgttggtttcttttcctgtgaagcaatgtgcaaacatcaaagaaggtttctattagaatcaaagtactccttgattgcaaaccttcttaaataatggatgacacttgaagatgttggttgtcatttttaataattaactatgtctaattttggcagtaactgaagctttattttctgtaagagcttgacagattacttgatttagaggagcaagagatttagatattgcatagtgctgagagccacaaattctgaataaatttcccactctctgtatgacattttcttttcaggtgaagttttctcctttcatgggtaaatagattacaggtagataggtaggcatgtaagcaaatagatatctactgtgtgtgtgtgtgtgtgtatgtatccagatagatagatagatagatagagctaagatacagatataaatacctaattgtattctcatgctgccaataaagacttacctgagactgggtaatttaacaaggaaagaggtttaattgacttacaatcccacatggctgggaagactcataatcatggtgaaaggcaggcaaaggaggagcaaagtcatgtcttacatggcagcagacaagagagtgtgtgtaggggaactccccttcataaaacaatcagctctcctgagacttattcactaccatgagaacagcatgggaaaaaacccacccctatgattcaattacctcccaccagttccctcccatgacacctgagaattatgggagctacaattcaagatgagatttgggtggggacacagccaaaccatatcattccacccctggcccctctcaaatctcatgtcctcacatttcaaaaccaatcatgccttcccagcagtccccaaagtcttaactcatttcagcattaaatcagaagtcaagagtccaaagtctcatctgagacaaggcaagtcctttctacctatgagcctgtaaaatcaaaagcaagttagttacttccaagaggtgggctcccatggcctttgaaagctctgcccctgtggcttcgctgggtacagcctccctcctggctgctttcatgggctggcattgaatgcctgtggcttttccaggtgcatggtacaaacagttggtggatctactatcgtggggtctggaggatggtggccctcttttcacagctccactaggcagtgtctcagtggggactctgtgagggggctttgactctgcaatttcagtctacactgccctagcagaggttctccatgaaggttctgccgctgcagcacacctcagcctggacatccaagcatttccatacatcctctgaaatctaggcagaggttcccaaacctcaattcttgacttctgtgtacctgcaggctcaacaccatatggaagctgccaaggtttggggcttgcatcctctgaaaccatggccccagctgcaccttggggcctttttagcaatggctgggatgcagggcatcaagttccaagactgcacaaagcagcaaggccctgggtgtggcccaggaaatcatttttttcctcctaggcctctgggtctataatgggaggggattccatgaagacctatgacatgccttggagacattttccttattgtcttggtgattaacatttggcccctcattttgcaaatttctgcagctggcttaaatttctcctcagaaaatgggtttttgttttctaccacatcatcaagctgcaaattttctgaacttttatgctctgcttgccttttaaacataagttccaattccaaaccatatctctgtgaataaataaaatggaatacttctaacagaatgaaagtcacctcttgaatgctttgctgcttagaaatttcttccaccagataccctaaatcatctttctcaagttcaaagttccataaatctctaggacatgggcaaaatgttgccggtctttttgctaaaccatagaaagtgtgacctttgctccggctcccaacaggtttctcatctccttctgagaccacctcagcctggactttactgtccatatcactatcagcattttggtcaaagccattcaacaagtctctaagaagctccaagctttcccacatctttgtgtcttcttctgagcccttcaaactgttccaacctcttcctgttacccagttccaaagtcacttccacattttcagttatctttagagcagcaccgcaccctaccagtaccaatttactgtattagtctgttctctaataaagacatacatgagagtgggtaatttataaaggaaagaggtttaattgtctcacaggctagggagacctcacgatcatggtggaaggcaaaggaggagcaaaggcatgtcttacttggcagcaggcaagagagcatgtgcaggggaactctcctttataaaaccatcgtatctcatgagactcattcactatcatgagaacagcatgagaaaaacctgttcccatgattcagttacctcccactgagtctctcccatgacatgtgggaattatgggagctacaactcaagatgagatttgggtggggatacagccaaacaatatcactaattaagcattataataatgaatagcttgataattacaaatatttttaaaaacaagtcattatgagttacttggaataatccataattgttactatattgtaccatagacaaagactttgtcttattcaactctgtattctttgaaattattagtaaaatattttaaacacaacaagtcctcactaatttggtgtgttggattgattttttaatgctgttatccaagtgattaatgaaattaaattttacttatatttttatttgggaaaattcaattcagtaccaggtggttttatttgaaaagaagccaataaactaccctgaacattttgagagtagacctgtctatatccatatattaatgtttgacctgaaactaatacacctgattgagaaaataattaaggtgtcagatggtaagtgtattttatttaataaacattggtattggacatccatgtgaggtattgttgtaacttaaaatattgggaaaatgtagctcagacagatatatatataggcaaacatacagatgagaagtctgaaaatatgccctatgttcctactgttttcaaactatagttattagtagattttgtgccatgtattagaactagccctaaagcctaagtattactgaaatcagaatgttaaatatgtgaaagatgtatttttgtgagatgaggaattaattattattttattttagtgctaggctacttatccatgagctttatctacttttaaaaatgtaatttgagaattatggctgtttatggatgtgtgaaagtaggaatattcatattgcattggggttaagcaatcagagaccccatttttgcaggtctcaacataaaagaggctgaatataataattgaaggagaaaataaagatattggaagttgcagttataagcaaggcataaatttagaagtaaataggcattacacatgtatataaataatgttggttgttactaagtgcttgtctattttgtttatattacacttctattactaataaaagtatagcaatataaattataatttatgatgaacaagcttcaaaatcatgatcagtctgtgagtaaattattagatagagtatagtctctgtattgagcatgttaattacatttgaaaacttaatccttgagtatatgtttcctacatgacatagcctcattattttctcaagatatatgtttatatttagtaatgatggataatcagtaatttccatgttaatgtttattggaatatttttctaaaagagaaaaaaacactcttttttcttcaacaactattactgatgtaacatcctttgatagttttcaagggtacattttatatccctcctaataaactgaaatgctgggtttcatctaggaaatctcatgccctgcaagttttttcatataactataaaatatcagaatgtggtagattttttatgtgctgatttcatgaatctcattagaaaatcctgttacttttttgagattgaaattttacactgctacctttgttacagaagatgattttttaaaatgcgtttttgattatcatgtagaactacagaaatagtgatgaatagagacatctgccagcacacatacagattgataatgactttatttgtactttggcctaatgtgtatcctgacagatcatcaaaacaagaaaagaaagagctcagcagacagtaagaaatggccagatgctcacagaatgatgaaaagtcattgtctcttatcttttaatgttcaaattatgcaaagaagacacttttattataaattttaaaaggaatctaacttatcaaacttaactgctacttcagggatatgccaaacattctggtctcgaaatgtttggttctcttcatcttctgtgttcatcctctcctttttcactatcagcctttctgcaaactagatgttatctctacctgggaaccttgaagatctcaagggctcccagaccattttgtaactgtttccctacatttaccttagtcttaaaaacctctctaatacattcattatttctggatccctccttatgttttagcctgtctaactccttctagcaacaaaatgtaatgtttatgtcattctgggcctcataagtcatttggcactgtactcaccaccacccgaagagtcccttaatatcttggtgaagatatagctggtatcttggtacagcactgagtatccctcactatctgtactctctgactgccctcccagggaacagagaaaagtaataagactaagctaatggattcactataaaatcactcattttcataattgattgatttaattctgggggaagaaacaacaggtctgtgttttaactttcaagactaaagagatgttctcctaattttgaaaaacatcccagatcaacaaaatatctttatttagtcccagaatcaaagggaatggacaaatctaaaccaaatccttgttaaatacagacttacatgatcatcttgcattttttttcagcaactgttaaccatggattttagtggatggaacagtagactggtgacaagggaattaattagtagaaaattgaattaattattacataatatacatctatttctatcattagttggaagaacaaatggaaacattttcttcatattcaaatttatgacatactaattttcctgccttgaagtacatcatttactctatttttatgttcattagcttccaatataatgatttaaatgtaaaacatatctatgtatgtactatttctagacactttggctttagacaatgaaagtcatagcaattctactatatttgatgtcttcaacttgaactggactctttcatattatgaaactttcagatatattattatcgtacagtagttttgtgcaagtaacttattcatttcattataactgtattaaaaacaaaacattttcaattttcacctaatgcggtttaaaattatgagttctgattctttggtgaattctacaaattagagaagtcacagaagtactgtgtgtcagctacaaagccctagggacttaaacagaaaaccatctcccaccaaaccataaaaataaatgctgatacaaagaatgttttgtatgctcaaagaaagatgaacttatataatgaacaataaaagactgtgtctactgtctttctctttctacactaattgcttttataacaaatcaaaatgtctaatatatatgattatttaataagaacaattcctttgaagttattcctgaaaatccaagaaagtagaagtcctctcccttcaaatacttcatgaaatagcattttgtgtgtacaaatatactttttatttattcacactaagtgaaagctcttaatgatagcccagtttcacagcttcttctttttatggttaaacacatctgtttgtttattgactctcctttttggaattaggttatgggagttcttagtatgacagttttagatatgatacagaaataataccaacatcaaataatttaggggaaacatgtggaaatggaaatgactaacatttcccctttgaatataattttgttagaagacaaaataaagcttagtatattattatataaagcatttgcttgttacccaaaataggaaccgtagaagctcggaaaaaagaaaactgggggctcctacctgtaattccagtgctttgggaggccaagtcagaaggattacttgaggccaggagttagagaccagcctaggcaacatagtaagaccctgtctttacaaaaaataaaaaaaagaaaagaaaggaaggaaggaagggagggagggagggagggaaagaaagaaaggaaggaaggaaggaaagaaggaaagaaggaaggaaggaaggaaagagagagaaaggaaagaaagaaaagaaaaaagaaaagaaaaggagaaagaaagagagagagagaatagctgggcatggtggtgtatgccagtagtcctagctaccagggaggctgaggtgggaggaccacttgagcacaggagttccaggtgcattgagctgtgattatgtaactgcactccagcctgagcaacagagcaagccccgtctttaagaggagaaaattggaaagttttccacagtgaaccttgagagaatatcaggagacacaatgaaggaggtcaagggaaatgtgagggagcttatgacccttaaggaaattcgatgaaactatgcaggtttatgacagtccttgccaatcaagtgaagcatttgaaagtatgcacctgtgtctaggaaatctatcagataccaatatatgtgttttctaccctaaccaatactattgctttcaacttactatgccaaaaactttatttagtattaaattaatatgcctactgtggaaaatgtccatgtattcattttaaattagctaaaaagcataaggagactttaagaaatgtttacctctctgtgaaaacaatataaaatatataagcattagagccaccatgtcagttgctatgcatttcagaattattctcttaaatatttcattattggggctgatttttataatccttctaggataccttaaaacagagaattttttctgacaagaaaagtactgatgattttttttaaaaatttttacttaaactgaactctatatttgctggtggcatgatgctttttagagcagtctgtgggatttatctattctatacctttccacatagctttgttacaacagagatgactataaaaattttaaggatttattttctttgtttccttttttctcagttcagtggagtctttaatacttttcttaatgtagccctagctttacctaatgctatgataatgctcactaacctgatatggatggattagagatgacttcataacctaacctaccttggcattttatttgactttatgcctactagtcattcaaagacgactcagaaaaaccaacatgatttgaaaacatgttctttttattctgactctcaaatgtcatgctagtttaaattttggcatagataaaaccattatgtcacatcattaagggctttctttattctatagctcttttgtttattgcagccacccatagtccaattgggtagacagggcagtttcggataagatcaaaaagcatatttttggtcttatcctaaagtatgggccctactttaggcgtattgaagcagaatttccgaaggtagggcacaagaaactgcatttttaacaccattctcaactgaagtttgatgactttttgataaacatgcttattttcatttcaaacttagttaaaattctctgtctaccgtccattgcctgaccctcatcctttttaacaacatagtacatgcattggaagtcacttatgtccacgcaactctctattttcaagttcagttttcctctgccataccttctttttcctcttgaccctcctaagtacttttactaagctgttttgaattcttgctctgtcaaggactatctatacatccttaactatcttctagattgttttagtcatttcctcttcttaaccaagatgttattccataagaatgatgctgtttgatctgaaacactctcaaaatgaaattgtgtatttttgcctgtccattgtgtcatggaagcaatagatggtcattgctttccttatctttccaccgtagatccagtagccttattattccacattacttgaagtaacatacaaataatacataagcttttcagaagatgaaaatgcgccacagttctagagctcaggagaaaaaattttaaacctagtgattctacactttgcctgaatttggtccaatagcatcatatcatgattcaatcagagaagtaaattcagtaggaaatatatattaagagattggttgcaaagaattggctcatctgattatggggactagctgggcaagtttgaaaactatagggcaggctatcagaaggggcaaacttgaactctcagccactggctgaagcttctatccattgggagaatttcttaaagaggtgtcagccttgcctttcaattgattaaattaagctcatccagattatgtaaaataatctcttttactcaaagttaactgcttatggactttaatcacatttataaaatgccttcatggtaacgcctagcttagtgtttgattgaataactggcctaggcaagttaacatgtcaaaaagatcatcacatgcaaattatttcatgtgaatttgtatgtatttgacatagttctttctgtgttggtacttgcagaaaattgtttcctaaatagcagtttttatgcatttgagatactcactaaagtcaatcctttttctgaaacccgttcccctagggaattctataaagctctgatatgctgtggagcctattggtcaatagtttgatagaatttatagctgtgtttcagccttttaatggctctctggaagtcatcaaaatccatacttaaatgccatgttcaatataattaaatatttaatagttacagaaaatctcttaagctttattctgattcctcccataacagcttgattaggggaaacatagctgtttacaaacagttctgagcaaatttgaaaaataatcatctctgaagaatttataataatttggagaaacattttagttaaacaccagattttctaatacatcactgatttaaatgacagccacatcatcattttgttgccaattgaaatcatgcacacctagaaatttttttgcattaaggtgctcacatgaaggaaaaaaaacgtatttcttgctatcagaaataacccaagcaacaaaccatgagattattcagataaatataataaaccactaatacatgagacatgattgtgctgtgaaaagtaagaatggcctttaaagggattgagctcttaaccagcacaatttaaaatattattaaaaaagaaacccatagaaatgaaaccctatattggactaagattctattagatctttagtattacaaaaacaactgctaactgtgtgatgtggttattcatgtttaaaaaaaatgcaagccaggtgcggtgactcacccctgtaatcccagcactttgggaggccgaggtgggcagatcacgaggtcaggagttcgagactatcctgctaacatggtgaaactctgtctctacgaaaaatacaaaaaagttagcctggtgtggtggcacgcacctgtagtcccagctactcaggaggctaaggcaggaggcggagcttgaagtgagccgagattgtgccattgaactccagcctgggcgacagagcaagactccatctcaaaaaataaaaataaaaaataaaaagcaaaacacttggtacaaaaatgtcctgggacaaattaataatggcacaatgccagaaactagcacatctttcctccttagtggtaattagtgcctttttacatgttgcacacacggagggaagaaagctcttcatcattgttctcccaactcagacatagaaaaacagaatgtcaggaacacaatgagccttcattttatagacatttggtactttgatgtctgtattatcttttggaaattattccttttagtgaaaacaatgaaggtcagagggcagatttcctaaaagcagcaattaatgtgaagtgttttaactattgcctccttgttccaaaactacctgcacatggccacaaacatatgaaagtgaatctttggtggccatagtaaacaattcagaccttggcccatagacagggttacacgtatggtggccctgtcttcatagaggccacctctaatgttaagttggaattgccagacccacttattctttctaagccttggtttctttacttgtagagtaggtttaattattagatattacagggttatcctgaggctcaaatgaggtaaagcactttgtaaattataaagcacagtgcaaatgttagcaattaccttaaatgattttaaccattcaaatgaaaagtgagaaattccaaccttggcatcatgtagacaaaccatttgaatgactgactcaatttctcagtcttctggagacttattatcatgtagctatttaaaacatgctggaatttttatcagatagtaaccagtctggcaggttcttttgtgaagacgtttgttggaaggatgtgttcttttacagtggctctataattggcatttaaacattttctcttgcattaaatatctttagtggtgcaatgttttgttggagttgcaaattcttaataagcgtatacccagatttttaataagcatatacggtagtaagtgattcagtgtaaaattcaaccagaaaatatccatcttctaagatgacagggtgttagacaaattacatgtaagattaagacattaatagagagttcatttctgtcaccccctaccatgccaactccaccccactctttgttagataatatgtggtctattttttgaattctttagaaaatagactctcttttttagagcagttttaggttcatagcaaaaattgagaagaaggcacagagatttcccatatactctttttccctctctataacatcctcccccaccatcaatattctacaacagagtggtacatctactacaattgatgagctgatattgatgcctcatcactcaaagtccgtggtttatgtgaggttcacgcttgctgttgtacattctattggctttgacaaatgtaaaataacatgtagcgaacattacagtatcatacaaaatagttatactgccctgagtgaatcagcttgctgatttacaaaaacgtttgtagaatttctaactggaattgcacaaaatatatagatccaaatttaatcttccatttcatgaatttggtacaaatctgatttattcttgtcttttaaacatttctatcagtaatgttttgtagtttctgtgtataggtcttgcacatcttttttttgtttttgaatgtattcataagtatggttttgctgctatgataaaaaatattatttattaatttaatttaaaaagtttatatttccagtttatagaaatataactatttttccatattagtcacatattctgaaaccttataattttatttattaattctatttgttatccttttagtcctaaactttacaaagatgatcaagtcacctcacaacagtgagctgtatgtcttcctttccagtatttatgccttttgcccatttgccttactactctggcggctaggacttccactacaatgtaaatagatataatgagagcagacatctgtgtctggatcccagaaatgcattcattcttttatcattaagtataaggttagcccttggttttccagatggctttacaaagttgaagtgtgtcctatctactcattcctagttcactaagaattttttcatgcatggttttgaattttattaaatgtttcttcagtatctatcaagatgattatattactttacattttataatccttcattttttctaagtgttcaaatttattggtctaaagatgttggtaatatcttatccttttcatatctgtaaatggtattccaaaatttcttctgatactgtaatttttgtttttacttttttcttaattagtcttcttaggagtttatcaaatttattaatatttttgaagactccacgtttgctttgatttttttcctatggttttcctgttttctatttcatttatttctgctgttgaatcatttctttttgcctactcactctgggctacattgctcttctttacttttcttcttacagtttcaaattaggtcactgctttaaattttttctccttttctgatatagacatttacaaccataaaggtccctccaagcactattttcacagtatcccactatttttgatatgtgtgtttttgtgatcatttcatttgaaagagtttctaatttctcattgtgattacttctttgatttatagattatttagtggcatgttatttacaaataatatgaggtttttctaaatactttactgatagtgatttctaattaaatcctgttttgatcaaagaacatattgtataagacatcaatcttttgaattttattgctaattattttatgaccaggcatatggtctattttggtgaatattctctgtacacttgagaagaatgtacatcccactgttgttatgtgtagtgttcaataaaagttaattaggtcaagggaatcaatagagttgtttagatctaatatatccttacagattttttttgttggttacatgttctgtaatgttctgagaggattttaatactaccaattgtggtgttgtctatttctctccttagttccatccgttttttttttttttttttttttttttgagacagagtctcgctctgtcgcccaggctggagtgcagtggcacgatctcggctcactgcaagctccgcctcccgggttcacgccattctcctgcctcagcctcccgagtagctgggactacaggcgcccgccaccgcgcgcagctacttttttgtatttttagtagagacggggtttcaccgtgttagccaggatggtctcgacctcctgacctcgtgatccgctcgccttggcctcctaaagtgctgggattacaggcgtgagctaccgcgcccagccagttctatccattttaactaatgcattttgaagctctgttattgggtgcatacacatttagaattgttatgtcttctagattatgttatggcatacttcaggtgttgcttttctggctggaaacttgtggccagtggtgcctctgcccgagttttgcgagggccccttgggcccatttggcccggcaaacagggctcagttcgcactaccagccgggatctcatgcctgccaagggcaagcagggcagcaaggggtgtgtgagtgagcgagcatgtggtctggccactgcccatagccaggtatgctggctgcagcagggcaggcagctccaggcgccaacatgagtgctagctccctgcaagtgtgcagctgcaccaggcataccataagcagtttccatgacagacaccagggaatgtggctgggcccagaaacttggagacaccaggaaccgcagagccctaaggaaggagtcaaagccctggctctgggagctcctatgtctggctcccagaagggccgcagctcttctctccttgtcacccgcaacattgtgagcaagggacgtatttcagccctgtttgttttacagctcttttagccctgccattcagtaggtcccgagttcttgttctgtgaccaggaagaacgaggtatgcagacaagtggagggtgcgcaaggagaagaggagctttactgagggtagagcagcacaaaggagacccacagcgggtagcttctttctgctgccagggtgtcctgaggagtgttcaggtcctagcagaggggaaaccctagagtgggtagctcctcttggcaggcaaatcattccattgagtgttcagctcctagcagagaggagaccctggagtgagtagctaatctccacagctggttgtgtcatcatctgtttagccctcagcagagagaagaccctggagccggtagatactcttgcaggcaagtcgtcccattgtctcttagtctgaatgagtctggggcttttatgggtctcagtggggaggacgtgcactccgattgttccatgggtggccatgggtgggcccagaaaaagcaccacaagttcccactctggtcagcaagaccagcagcccagcccccaggcttcagccactgcccctaacctgcttgaaggtggggcttccacccaagatctagtctgcctcctgcccagactgcccaccactgccatcaatctcctaacatcttttgccttattttactttaatttaatgtagccataccatttttttgtgtttaccattttcatattacatgttttctttttatcttcctttcaacatatctgtttctgttatttaatgagcatctttcattgacggcatacatttgtgtttttcttttatatctactctggcaatattttttaattggaatgttgatacatttatatttaattaatggaatttgatttaaatctaccatcttattacttgattttcgtacattccttctgtttttttcttctcttgcctactttctgtcttctttggggttaatcaatatttattcacatgttattttatgatttttttatattctaggtcatagatggcttaggtatttattgagatttccatagtacacgatgctatattatgtctttttatttctgcatatagtattactagatcaacttacaaaatataactaagaggacttctagtttactacatataatggaagggaagagagccaataagaactactttcaaatttttggtaagctgtcatgccatggactggaatagggtgcactaaaggataaaaggcaagaattcttggatttaattttgtacatttttaattagatgcctgtaagtcattgagaagtcgagggacatccttggtaccagctttaaatgaagaggtgaaagtttcaaattatttgtcatattattggcttttttttttttttagttttaaagtataaagaatataaaatgcaatttttttattttttgtgttctattctgaaataatattaaacattataaatttaattcttaatgtttaatcataataagtatttttatacttattatattcctttgaatagccttttttattgtcaaggaagttttttaagataaattagtctctacaaataatgtgctccatattccatgaccttagagtaaatcagttctacattagttgtgagatctcattaaaactacatcaatttccatagaatgtatttattttaaaaattactttgtcaggtttaaaattattttcttaaaactagttaactcaatgaagtggattcaagtttggatctcttcacaataggaaacaaattcaatgttagctaactatcccctgctgttcagtctcttgccagaaagctacagctttctgcccacacttacttgctagacatttgatttaataactgcacattcatatatattttttgaaaggaatgctgaaaacttctcatttgtgtatgagtaaactgaatcccaaagagttgagagatttgtccaaaggcagtgaagtcactgatacaagtgagaaacttggataaagcacaatctcctcacctttcctcattttttatttttaatttcatttcataacaattcctcaatggaaaagtaaatcattccatgatctcaaaaagctgtgatggatctatgagctactgagtttataagttaattgctcctttgttaaataactttaaatggctatttttttgttgttgcggtgttttttaaatattcatctcccatttccttcactctcagccatcattttggctactatcccagtgttgcctcaagtacccctttttcctttcttcaaatttgctccttctagtgtacttgggaaacactgatattagcccaattttctctaatacatacatttaaaaaaatttgtactaaatattataaatttgttcactctttaattgaagatatgcaaatatctaccactaaaaacaattatgggtttaagaaaagctatttctttccaacaaactagtgattatacctcattatctgatttgagattccagtcttaatattttcatatattttttaagtactagctcattcacattcatcattaactatttaagacaaagcattgtcttgaaaagtaaatacttatccgggtaactataactcaaaacacaatacctgattgttttgtgtgtgttcacaaaatattaaagattatatgacaataacaaagaacatacattgactgctttccaggtggcatgtactgtgcttattcttcacaataactctacagacaagaaggttccactatattccccatattatatatttggaaagtgatgtttacagagattttaaaaattgccaaagtaaatcatatagtaaattatagtcatcatttaaacagatttggttttaattgtgagcctgagacttcaattatcatgctctaatgcctattaacactgaaacaggtttcaatttgtatgtttatatacccaacctttgcatcttggatacacaattttattatttgctttgcactaacactcttacacattcaatttttcataattttaaattaaagattttcacagtccatcctcacaatgcattcagtgttacattttgatcttaattatatttgcaaatttaattgaactattaatattgaagatcaatcagtgtctaatataaaacataatatatttgtatcatggtgattttaatttattttataaaagtttattcgtgcttgctttattaatatgttttcattttcaaactgagctaaaatttgtggattttccctaataaagattaataaggaagaacctcattgtcatgagatatagacatgcacaagaacatattcaagaattcctagtttcattaaggaaaggtattaagaaggttgtagtctatatcattagagaaagaaaaaatgtttactaaatctggaatagtatgcttattggtatcatagtcaatgttctttaaaattttctttatatatatttatatagtttttctttaaatatatttaaattgtagaaaataatattttgaaattatagtctttgtctgctatttccatcttttattttaaaatactgcatttatttttctctatgctaaattcataagtgttttgtccccagttcataaatgttactatgtttctttctaatctttcttctttttttttctcttccttctatggcctctctttcactctgttttcctcccactttccaccccaccagccttatatggctttgtattgttcgacagtcaatacagtttgtgtccccttggaggagctcacttctctttggaattcaggttatttggttgtattatgactacaactttccaatgaattcaagaaaagttatcgttttatagattatttggtctattttcattgtttagttggctgggacactaatagaagctttctataccctaagtagaagtggaaatcctgctcttcatatcgtatttgcttttaaagtcaaatttattacattaccattttgtacagtaaaattcacccttttacatgaactattttactcatttggacaatgaatacaggaatataaacatcactgcagtcaagattttaaaaatcttaccattgcccagaaaggtccttcatgccccttggtaatcaatctcctctcttactaccctttaataccactgatcagttttctgcctctgggatttttcctttttcagagtataacctgtgtctggttttttttttttttttttttcatgattttgttgcatttatgagtgcttccttcctttttattaccaacagcattccattattatatagctccagaaactcagtaccaactgagatatttacatctgagaagggccagctttcgaaatctgccaggttactagtttgtggggattgagtgactctgttcagaaattaactgggtttgggatttttcattgctgtatgtacttgttgtacatcacgagtttaaataactctagatatgggctacctttgcccataactccaataactctagatataggctgtttttgccatgtaccacgtgaaggctaggataatggagagttttcttagtatgaatccgctggccccgcttttagccattcctataggtatgtgctatacctataggagaactgttagtgcttacgtccttatttagcagtagactgcagttgtttagtacttcatgctccgcccgtgttgtggggatagcagttctctgttgttttggcccagccacagttctgggaaacccatggagcctggactctgggtggagaattctcagtatgcctttcactcttctgcttgacagtcaaactctctgccttgtatttgttgtagatcttgaccttgagtgagagtttctcttcttctctattgataggaagctttgagtgggtataggattgcagttccaagagtttcccacccttcttataatcacaataactctgagttttttccttttctttcctttcctcagccgtggtatatctttactgcttctctcctgtggcttaagaccttttgctctgcatgagagaagagtccaaggaattgcacagtattttgtgtgtgttccccacagctgctcattctgctcctgcctgtctgctctcccaaggggcatttttatggtggtccacgttctttggcagttgagacagtttgtgtgtcctgtatctccttgtagggactcacgcttctttgtaattcaggtcatttggttgcattatgactataactttccagtgaattccagaaaatttattttgtaggttatctggcctatttttattgtttggttgtgtgggacactttgcgcctttcaacatcttcagtgggggtggaaatcctcttctttacgttattttataatctgctttttgaacttacaaatatatttgaagcaacattcctttataatattaaaatgatgtgtcccacaatttattttaccaatatgctatttttagatttactttgcggtatctcctttgaaaaattgtagttagacgacaggattttgcttggcacaaacactggcgtgacaacagatctcctaaaaagtgtctggatacaaacattctggtcttttaaaaaagatttttaagaaggaagtagaagaaaaatccatcacattagttgtaagtttccttctaaatgaattgatacggtgtaatcttttaaagaatcatgaaaggtgaatgcgagatctggctgcagtcccatgtccttgccctctgcagtagatttctcctctggaatgcacattcagttttctgcttcaaggatgaccagtgttcagggctcacattcattctcactcctaaattatgtgatgcttcctttctttgtttgacatcttcaaagtgaaaagtgtcattgccagggaagcatgaagatatagtcagtcccaaaaggctgtctggaaaaattacagaaagctcggttcttattggatcaaaaaataaatgtagggagaaaatatgaatatgcatttctacacaaagaattggattttcttaactgtttaaagatcacattgtgtaacattttacagtatggggtgccacaatctggatgtatcattttgaatgcgataactagaaaataggtaacaagaaaattaacttgatgttttcagtataatcaaagcaaaggattattttgactaaattgccaaacccttatgtaagcacagtgcaccaaaatgtatttcttaatagtagtgaagattcaacctaaacttggagaaacaaaacaaatatatcatcgagaaaaagtatagtgttgaactaatgacctttcagaagcatataaatgttattgtttgacattctaaaatcctcttttaagtaattttaaaaatgtaagtaaggatagaaggtatgaggaaaattagctaaaaataatcagtgaagaagataccttgttctccatgaacccagatttaaattttgcatgttttatatcagctctgtcaggctttgattatccacagccagatgacaatgaaataaagtaagttatgaagcatttgccaatgaacactcactgcctccttattcgctttcacttgcctaaggcagcctatagctcaggagaaagcttctgaaaccatatgtatagtctttccttaaactcaggaatatttgttataacagcataaatatttaaacttctcatagacatgcatcagtttgagggtaatcctgtctatatgggataaggagtaaagcgcaggaaatgtactgctctaggcaaggggtccttgctgtgttttgttcgctgtgagtccttcagagtaaagcctctggattttgaagtgctgtgagttcatcatcattagatacttatattcaaacaaaaccctaaaaatgcatttctgaaacaagtatatattgcatttctccacttttcatttaaaatatgctaatatttaaatcacctaccacttcatgagtatcttagataaatttcacatatgtattgtcttttccaagaattaagaattatattataagaacagcacaataaattgtgcctcgtcttttctcaatgaagcttgtccaattatttgagtgcactgtactttgaagttcataatcattaccttcttttttcttttaactttctaaagtgaagacctgattactgccatatgacttgtgcaaatattccactttgcaatatgtgctgcatataaatgtgcggtttgtatagtagggggtaaaatgggcagctttcctgccatctgcgtgctaattaaccagtgtagaacacagtcttgtcataggaaaaagccgtcttcatttctacagggtgcaaattatgttgccaggatcacaaggacagggtcaaagttggctgtcagcaatggttgtgggtttagtttgtgctttgaaaagacctaggaattttaaattaatacatagacttatacttccatatctaatgtatacatctacataaacaagctgtaaacataaaacaaaaaataactggccttttacatactaatacatatttgttctggatcattttctgttggcatctgattttctctaagacttacacaccatgctgttacctctccatggcatgtggtgggggggcgatggtgattaaagtatgacattaagtgtacatagaaacataattaaaataaatatgcattaatggttctctttaaatatagtgacccatgaattaactttttggtatgattaagaatgaaagttttaaaggcatcctttagcattaaaattcaagtcagcaccaatgattctaattagtgggaattctagcggggaaagtagttaagggaaattagttacctattgttttgaactataattttaaaatgtagttatgtttggaaatggattgttagcaaacatggatgtatgcacatctgtaacttgtgctctagactgccaaaaaaatcaataattgaaaatgaaataacacaatattttgcatgttatgtcaacgtaattactctcgtaattaaaacctcaaggagtgagaaggatagtacgtcagtcctgtggccatacatagagatacaatattcgttttcacgtcctttcaaacatgtgctgcaaagatggtagaaaatgaaagaaaagttatcaaatggtagctaaatgatctgcctatattcttaggtgattatgaaaatgttctcactttggaattaaaagtgtattgttttatccttcatcaaagtgagagaataacttcaaataggataagatttattttctatatacctattttctttttgtattttctgcacagatttctattaacgtttgagctttcaaaagcatatttcatgtttggttgtgtattatcaacaaacgtggttagctataattctcagactacctgtaaaagatatctaaggctatttttccttgtgggcagagtggcagtggtatgactacaggagtattgaaagatgtgtatgtctgaaaaatatgaccttttaactagcagggccattatttaagttaaggggatctagaatgtccctgaaaaaaagtaaggagctaatatttcctaagattacacattaagcatttaagccagttgcacctgtaaatatattactttattctgtaagtcccacttaacatatcagctctgctgtgaagttttcccttcttctcaacaccaatttaggtgctcctcagtgttctcacaattggcttcgattccttagcgaggcagaaaccaagtctaattatgttttttatgcactggagttaggtgagcatattaagtacacaaaatctttgtggactgagtgaataaaagaatatacattcattcaactgttgttctaacatacagcaagtccttgagggaattgcatttcagtaagctttgggggagaggccacatcctgaggggaaaatgtccagactttggaattggacagaactgatggaatcctgatactattacttattgcctattaaaaattaaaaaagtcatttaacacctttgaatgttaggattttttttattctaaggaatggtgacaaacatggtatcttgcaaaattgttgggacagctggacacgttacccctaaaatgcctgatgatgccttttcacccacaatagatgtgctacaagtaatagctcttttttaatgaatgagaaagacttccagaagcttatgagggagttatatgtaggattcttggccaagtcatagaaagaaataaaagaaataaataatagatggcagtgattgtggcacctacaagaggcataaagttgtaatattgtgtactcactaatttagcacaacattataggcatgtaacaaatttgttggttcatagtttcattaatttttgtcatgtagtatagctctgtcatataatgtgctgtctgtttaaatgttaagaacagactgtaaaagtagagtttaatttaaaatttgctcaatctgtctgttttgtaccttaagagtcattgaaatattttcccctatagaatgtgaatgttgtcattagaattgtatagatttttaaaatagtttgttgagggggatcacacatggtgctagaacattatttgtcattctagtccttccacccactagattatcagtgatatccaatggctgattttagagtagagaataactgaagagaaaacaattacatattgcctaatggaatgtcactgagatagctgtattaaaactatgggtatttttgttttacttttgcaatttcatgggtatttttatcacaggctcaaaaatactgcctgtgcttagttgtgttctctagtggctcactctcaagtgaaattcaaactattaattattaaaatattctaatttttaaaatttttttccagagaattttaaggcaaattctggctttcacagtaatgataggtaaatctaaataagcatgctgagagagaaagggcattagagtgtacaggtggttggagtggttgaaggagacattcagttccagtgattcatctggaaatttcctgttacagtgaacctccaagttaggcctgctgacagcacgggagcaagtatcttgaaaagatcatagtgagaattagagagaggatatggtgtgaaatctgggcaaattatatctacccacaatattacacattcttttttttaaacggtatgagtttactaggtttaagtgtcacgaaagatgaaatatgcaaaaagtaataaattgagcccacttttaagatggtaataagatcatttaatacatgtgtaaaactgctaaatgatttcgcagaaggattgcttcacctctgagtgaatcataaactcataaacaagcattcaacaggagatcaatgctgttttgtagtgcacacactattgcagcatctgctccaatacaaagataaatccagtgcaaaccatgtgttttactttttgggccagcatccttatcctgctgctcttattacacctaaactatagccttcaacaatctcatttctgattaagtagaaatcagttgcaggtacacatactactaatgtttgtatcaagataaatgagacataagactaaaacacaagctccaaaataagagacattttacattttgcaaaagttgactgtagtaaattattgaaatttggtataggaataaattagacaaagatgaataacttcatattaagacatgaaataagccatttacctatgggaccagtaaattacagattttttaggttttaaatcagatagacacttttgatgactcactttaaaagcataactgacaaaaaaatatgaaaaaataaatgagaggactttctatttgaaatcgtaggcccagagagattattgcttcttttgattaccacattaagtataagacataattctttcttttatttttgatttatttggacggttaagtggtcatgttagcaatgtgacaactataccaataatagcaagttgtaaactgtcaaagggcaactattcatcaagaagtatattttaatataagaccaggcgtctaatatgactttgaaattgttcatgattagattgctagcatattctaggtacccaaatgacatttctcttggacatggatgaactgaaaatcatgaaattcaaagccaggttatatgcagcacttattaatttagctaatttgatgtgtttcttaatctttcagtgagtacagtttcttagcatattactataatacagtctgcttcctaaataactttaggaaataatattaaagagattttttatgtcattatatttattcatatcaagaacatcaagcacttatcctctgcatctaaaaaaaagcaaaaaaaaaagcctatatatcaaattttaaactttattattattatgacattgatacattatagacaacaaaaacaaacaaaaagaaagaaatgtcccaggtaactgtttcacaattacacactgcattttgttagttcatttgaatatttcccaaatggtttattgaaaatagtccataggccaaatattatgctagatgaagatggctatgaaggttaatgagacatggacaattccgtgaggaagggcgcagcatctctcagtatattcagttagatgcttctacacgaattttccaaattatataagctaattttaaaatgttggacagcaattctagaatactctgggttactctgcattttcttaggtgctaaaaaaaaatctcttaatttgtcatcttattggaaaagtcttatataatgtgtcttatctttacctgtcttcctcatgcatttctgaatacttttactctactggtacctgaacacatgtttatctctccaagaagtatcccaattgtttgtttgtttttttcactaagtcgttcatatccttttacccagtcatcaaaatagattattcttctcaattttagagtctgcatataaacaaaacttctattttcattcatatttagggctactagattaacttgtgactcttctaaagatattcacatttacagaggatactttgtgatatcatatctgaactcaagggcatggatctacacataagaaagtaaagaaggaaagtcattaggaagatatcttagggctgaaatttgtgacaatcgcttcagagcagtccatgtttgttccacaaatttgtttaagtaattataaatacctgctctgaataacaaaatgtctttagtttcccatattttccattcttaaacaacaggtttactgttatccgtaatataccttagtatgtatctgtggaagcattctacaaagaacacaaatatgtgagcaagagcaaaatattcactcatctcctgattttgatgggagaaatggtcatagttgagaaccccttctgaaaacacatgtgaatgcacaagtgaacttacaattatttcccaaccacagtaatcaacaagacattcccaagtgtgtttgagttcttccagagctcctacttgtgagtgtcaagtgtagccatcaagtgtaattttctattactttttcctatttaagcacgagcctaaagaattaaccacgtgttgtgctagttgtttcttggtatttttttctttttcttttttagcaatcactgaattttgtcaattttatctcactgttgtgaagaacaaaatatatatagcaaaataaagattaagcgcataaaacaagcctgagagtgattccctacttgcttaagggaacacagatatttctataaatcagaaagtttgttagattgtaatataccaagtctcaagaatgtcaaatttaagagattgttttttagtagaatcagtcctgcctacctacagaattgttgtgttttgggcttccaatgaatttgaaaatgcatttaaatactactgagtattctaatatttttaattgtatttttgttactccattttccccctgaacttgaatcatcatccacagtatcagaatattattctatcagttatctttttctcttcagagtcatattgctgcccgtgttcacaatttatagtttttcttattttaatatctttcttttctttcacactcttttaaagatgattttaaaggacctaggttacttagttcgtatttcttttgatgggaaatacaaacaatctgtaaacatgggattagcacaaagactaacaagtcaaggtcagtttagcttccagcctcaaaacttggatctctagatgatatagtgataatatttcctctaggtccaaaatacgggattaacatctcatatctcctctctccattaaaaagtttatgaattttggacaaacaatggattggtcaactatatgtggtcaagaaacacagtttcagctaagctaaatacattaaattatgtatataattatatattatataattatgcatataacctgtcagtgcccagtaagtgttttctgaataaatggataagcaaatattgtttcaacataataaggaactttgccaggtgctaaggctcacacctgctttcccagctacttggggggctgaggtgggaggataacttgagcccagtagtttgatgctacagtgaaacatgttcataccactgtactccagcctgggcaacagagaaagatcctgagtcaaaaaagaaatgatgatgataataataatcgggaacttaattccaaatctatttaaggcactctattaaggggctcttatcttaatctctttataattttaaggatactttctaaattttgtttgttccatagggagaataaagtatatgtttctaaataattttccatactagatagttacatccttctctgtgttgccatatgatttttacagttttactatagcatttctttaattctgcttattttctcaattgcacttcctgggcaggtctttttgtttaaatgttatgtttacctgccatgtactaagcttggcacataactgctcaacaaatgttttaggaaagaatgagtaaatgaactttaaaaatactgattttttgttcaaactgaataatttaccgtatttctgtttttaaaagacagtagtgaggactatctgttttgaactgcataaaataaaccctattttgttttgatttcagtaaagtcaataaatattcatttgctatcaaggcaaaaatctaagcaacataaagtacaaataatttacatgttgctaaatttgagatgcagacaattaaatattaattttgctaaataatacaaaaattgtgttacatgcactagaattctagacttgtattctgcaggatgagtcttactggctgctgaatattatatttgtctggctacttgcttttgaagaatgtactttaattattgttaaaatactagaaaaagcattttaaggtttttgtcttggtggctgttcttgtgttagctgtggagagtacaacatggacaaaagtaactcaagctgtaggctacaatagacttgattcaaattctggctctattagcaggctgctttgtgatcttggctaatttatttagcatctcagcctcaatttcttgatatataaaatttgaataatgataataatacttcaaagagtagttgtgtgggtccaagatttagtatagcccctggattgtcctaagttctcagtgtaatttagctagtagtgcagtatttattgttaatgttgttcacatattaagctgtattatcaaacatataaacccaacatttttcggtagaaagctagattttccatatgatgaccactgatggcatcataactgaacaataaaatatatgtttctaactagtgtgctagaaaaataattgttaggtgttcttttcatatactgatataaatatatgtaaaagttaaaaatttaagcaattccagttaatagataattatatttaacaatcccagatatattatatttaccttaggctatgttatgctgtatgtttatataaaatatactatattatattttatcctacataaactgtaatcaaaatatatctttattgtatttttctggttttctaaataattatatttgacaggaaattcctgtatatattattccctcaatgcatgcagaaaaatatttatttatttaattattttgtttttctatgctttatttatttaaaacttttattgttaattattatggatgcataatagttgtagatatttatggggtatatatgatattttgatgcaggtatagaatgtgcaatgatcaaatcaaagtacttggggtatccatcatctcaaatatttatcatttatttgtattacaaacatttcacttccactcttttaattattttaaaatatgccatacattattgttaaatatagtcaccttattttggtactgaatactagatcataaccattctccctaactgtattcttacatccaagaatcatccccactttatacccgcctcgccgctactcttcagagcctctggtaaccatcactctactctctatctccatgtattcaattttatttttagctcccacatgtgagtgagaaaatgtgatacgtacctttctctgcctgtcttatttcacttaacataatgtcccccagttccatccatgttgttgcaaatgacaggagttcattcctttttatggctgaataatatttcattgtatatacttaccacattttttatgcattcatggacacttaaattgattcctattgtgaatagtgctgcaatacatatgggagtgcagatatctctttaatatattaagttcctttctttgggatatatactcagcattgggatttctggatcgtatgttagttctattttcagttttttggggaacctccacagtgttctccatagtgactatactaataatagtttacattccaccaatagtatacaagggttaccctttctccacatcctcaccaccatctgttattgtttggcttttggacaaaacctattttaacaatggtaagatgatctcacattgtagttgtgatttttgattctctggttattaatgaggttgagcatttttttcatatacctgttggacatttgtatgtcttatattgagaaatgtctattcagatcttgtatctattttaatcagattatttttacctattgaatagtttgagctccttatatattgtggttattattaccttgtcagatgggtagttgcaaatattttctccccttctgtgggttgtcttatcacttttttgattgcttcctttgctgtacagaagctttttagcttaatgtgatcccatttgttcatttttcctttggttgcctgtgcttttgaagtcttacacaaatcttcatcaatacttacattctaaagtgtttccctgatgtttttttttcagtggtttcatagtttgagttcttacatttaagtctttcatccattttgattcgatttttatatatggcaggagatagagatctagtttcattcttctgcataaggatatccagttttcctagcaccatttggactgaagagattatcctttccccaatgtatgttctcggcactttttcaaaaatgagttgactgtaatttatgggttgtctattctgttccattggtttatgtgtctgtttttatgccagcaccatgctgtttcgattactataactatgtagtatagttaaaagtcaggtaatgtgatcctgtctagttttgttctttttgctcaggatggctttggctagtctaggtcttttgtggttccatataattttttttctatttctgtgaagaatgtcatcagcatttggatggggactgcactgaattgtagattgctttgggtagtatggacatttaaaaaatattggctcttttaacccatgaacgtggaacatctttcattcttttgtgtcctcttcaatttccttcatcaatattttacagttttcattataggcatcttttactactttggttaagtttatttctaggtaacttatttgtagctattgtaaatgagattagtttcttgattttttttgtttgtttgttttttgttttttttcagattgaccactgctggcatatagaaatgctactgatttttgaatgttgatattgtgttctacaactttactgaacttatcagttcaattagttttttggtggtgtctttaggtttgtctaaatataagattatattatctgcaaacaaggttaatttgacttcctcctttccaatttagatactctttatttacttatcttctctaattgccctggcaaggatatccagtactatgtcaaataagtgttgaaagtgggcattcttgttttattccagattttagaagaaaggctttcaatttttcatggagaaaatcatgtagaatatgatcagaaggtgacattggcaaaaatgactggaacaatgtatatattgtgagctgataaatacttattaaattttccttgtctctcctccaaagaaacagagccactttagtaagaatcccaaaatctgccaataaaattacttggattttttccttcctcatgagcaatataattttaaaaagattatatttaaaaaagactaatatcctccctcatgagcaatatatttaaaaaagattttaaacatagtgggtattcagaaggtgttacataactgaaatagactttatcattcaggtcattaaactatctcctaccacattgctgtttttctgaccctaaacagctctgttttgggaatagtgcaaatggttgacactttaggacacttgttatttgttagatactttcacaaaattgagtttgacagtagagagaagaagagattatttaaaagtaattaaatgtaaatgtttggtggtatgatctgttagatcttggaaatgtctaagagttctttgccacctacctatattactaagggcttctttgaggattttgtgatgtgtaatagctgttgtccataggattattcaccagcaaatagtttaagatttgaatgtagatatataatctgatacttaatcagtgaaaataggcaatggctattaatatttaaagctataattgatttttagatttttttgtctgtacagtgacaaactatttgaacagaaaaagttaaaagtcgaaaattgtgagctttgtttaaatagtgccaattatacaaacttttcaccatttccaaataatgattggatatattcacttttctttgtgtgattggcattgtttgagttccagtggtagtcatgcttaaaactgcttgacataatgggctttcttctattggaatattttgtattagtttaaccttgctttgtgggatttacagtttattgaataagaacagaatatgattatttctttttaataaaatatgaaaaataaacatgggaatacattgcttttaagaagtaaatgtaaaatcaaatgactttaaacctagtacagttctctagtgacatttgtaataacttgcctaaggcattaattctaatcactttgtcattatttgcagttttattttaagcaagttttatattaattccccttactgttttagttttaaaagtaatatatgattctcttttaaattatttttatgctgcgacttcaatcttccaataaaacaaaaaaagggttgccttaagatgtagtgaaactgaagccttaattagcgacaggcattatagacaatgcttagaataatttgggcaatcttgaaacagatcttaataatattagttaatagagtgttagagagtttacagtattctcacctaggaattggtccaatggcagctactaggaggacagcagcccagtgaggccctgtatggacctgttcagtatcaatgaaacaaggacaggatcagtaaggagatactcatacactttcatagtcattgctatatatttccacaattctaaatcagaaaactttgtcatatttttaaacttcaaatttccacatttttgaaaggatttagtatgaattttctaattttagcattcgttgttcttctaaatctcatttttatgcaaagagaggcattggtccatatagtaaaattgtccttgcattactgttatatttaatattttgattgattcttttgttgagtattcatgtgatttagttattagactcaaaatgatgcaactttaaaaacccaggaataacattcatgtatgatcaaggaatgaagagcacaaaaatcagtttattaatagctctcctgtggaaacactcatgatgtaaattggactattgaatgtttatttcgttagatatacttgcatatttctttgcttttacttagcttcaagcaatgtcttctacctgtaggtcttctctctctgtatctaagtccttcgtatcttttcaaatccagattttacgtgcgaatatcctataggagatgtttagtgatccccccagctgataaaagttaccttctctgagtttcttatgacacagaatttgtatattttatgccatgtatcagttttctaccttgtatcatagtaatttacatatcttcatcctttctctactttgaatttattgaggacagattctgtgttttacaaatctgcattgggtactcaataaatatttgtcaaataactaaataaatgagctgtgttaaaattaaattggttcccggagtcttagtaaaatatagctgcaaacaaatatttttatttctgtttgtgctttcaaaactgcactaaaattatactaaataaataagaaccctaatattagcactatacccaccagaaaaaaagaataaataaaaaaatacagccagaggagtgagataaacatagaccaagggaagagtttagataagttataacagattgtcagagggagaaatcttcaaattaagttcctgaattgctggtaaatatttgacaactcactctctaaaaaatgtatgcatgtatttaagtttgttatcaacatagtttataaataataaaaatataaaatgtgtaatgataaataataaaatgtacaatatctttattgtaaaatccatatagtgatttaattctcacagaatgtttttcttgctttttacaaaatactggtatctatagtcaatctgtggttgcataggatgaacaagtgtattcccaacatgtatgtttaaacaaacaaatagatgaaagtggtacaaggaatatccacatgaaactcggcattttcaacaataatgtgagaaaatttttagctaatttggataatagctttcaaatagccaaagaatatttcttaaatttgttgtactattcacaatataatgattacagatgtgccaacaatttactttcatcttcattgttaacatttcctccattgtatacttcaatgtagacaatagacaaaacaataaatcaagttctcatttgtagtatttgccaattcacatattgtaaatattctcatcataactagtttcgacataccaatagtatgttactgaatgtggacttcgaaagagattaagaaatagcacaccatcattaacattctctaccacatagatgtaaagatgtaaagaatcttgtgagtattaatagtagtaaaattcttaagaatttatgagtttaaaatataatgttttgtcttgaatccatatacttgcattttaataaaatttatttggaaggaattatgtatactttgatttgtaataatagctgtgtttaacaatgaacttgcaaaattcctgaaaacttacaagggtcaaaacttgtggcgggtgtggtggctcacacctgtaatcccagcactttgggaagccaaggagggcagatcacttgaggtcaagagttcaagaccagcctggccaacataatgaaaccctgtctctactaaaaatacaaaaactagccagacatgctcacttgaacccaggaggtggagattgccatgagccaggatcatgccactgcattccatcctgggcaagaatgagactctgtctcaaaaaaacaaaacaacaaacaaacaaaccttgtacacgtctatttctacagcaaatgggcttcagggtggggaatacattttaaaaatcatttgaaagtcttttcaaagaatgatcttatcttttccccatctgagcaatcagacatttatccagactattcctgcaggaagaagccattgcctgtatacaaagactccaataagctttctggagcttctctcagaagtattatagggagtcaatcaaaagagatgatttttgagaaaagctgccgatatatgagacagaaacaaaaataccaagcaaacaaagaagaaacaaactcacagaaaagagaaataaatcagaactgaggaaaaagatctatggaaatattttcatgacaaaagataatgatattaaaaaaacaataatcatggaacataagcaatcaacactttaattgtgaagaaaagagcactttagaactcaaatatttggccatttatattttaaaaatcaatagaacacttgaaaaataaaccaaaataaatctctcaggaaatgtagccaaactaggtgaaaataggagataaaagattttaaaattagaaggtcatttaggcgatccaacatctcacttacaagatttttataataatcaaatataataaagagattttcacacaaataatacaaaaaagaattacagatttgaaaaggactctccaatatgatgggcccaatccttatgtgctgtatattataagttctaaaataacatgatacattatgtggaaactttagagccactgaatattaaaaatgcccatagggaaaagcaggaataaaattaaaaacaaaactaaatgtgactggaatagcatttgtttttcaactaactgctagaagtcaaactttttttcacttttaaacttctaaagaaaaattattctcaatctagaattttatacctaactgtcataagagtaagagtgtgataaaggtgccctcacatatgtaagatctgaacatgttttcctgcagtgttctttcttaggaatccatcagaggatcttctcaacaaaatcagctaagaatacatgagatccagaaactagaggaacacctctagaagactgttaaagatagtcctggccggatgcagtggctgacgcctgtaatcccagcactttgggagactgaggcgggtggatcacctgaggtcaggagtttcagaccagcctggccaacatggtgaaaccccatctctactaaaaatacaaaaattagccgggcctggtgacaagcgcctgtaatcccagctacttgggaggctgaggcaggagaattacttgaacccgggaggcagaggttgcagtgagccgagatcgcaccactgtactccagcctgggtgacagagcaaaactctgtctcaaaaaaaaaaaaaaaaaaatagtccacagaccacacactcagtctaaataggagcatgagtatgggagaatgggagtatttagaaatatgtgcgaggatttcaaaaaattaaggtttgaaaaccaaaggaaaaatgcagttaactccaggtagagaaaagttgcctaagaggaattataactgcagtcaaattacagtcaatttttattgtttgctaattgtgtatttgtaaatttgcctaaaatttacaccaaaacttatttgttatcccccagtcaatattcacggcacttttgcaggcattcacagacatgtgaaaagcagccaaaaatttgagatactcaacacgcatatgcccaactgaggtcaagccaagcaacactctgccttcttctttctgctctcaaactatatacaagtgtctttttgctgtctgtttagtgtcacattattttacattttcgttataatttcactgttttaaacggcctgcaaatgtagtgtgtagtttctcagtgcaagaaggctatgatgagcctcatggagaaaatgtgggcactaaataagtttcattcaggtatctgttattgcaccggttggccatgacttgaatgttaataattcaataatctatattaaataaggagttttgtatttattggcaaatacataaatatattgacaaataggttgtgatcagaggctcacagaaacctaaccctatattttcacctcaaaacaatggttcattattggataattcaatcataaagcaatggttcatgtggataattcaatgtttgcagccaatgtgtagaacataactattataaataacaagaattgactgtatattacaccatttggcctgacaacaagcaatttctaataataaatataaaatacataaagtagatgttaatatgaccaaagtttgccacatagccatactgggaaaatggtgagaggatggcaaaataggaaataataggcaaagctaaaattaatatcctaaagtataaacatattgtatataattttgaagttaaataagtaggaaaaacaactcagtacttgaaagtggtggcctacagaagcatcctgggagagggggaagagtgaggtaggaaagtgttgcttttcatataaattgtgatattacatgtggttataaatcaggattaaatgtttacttgagagaaattagtattttacaaataaaaataaagttttgataatatagttaattttaaagctcatctacatggttaagtcaactttaaattttaaggtaatgtcttttaatccatggtagagaaaaaaaaaagtctttcagggggtgttttggtgagatttggaaataaattatactaaaaacgatctgtacaatggaaaatgattgtattttatgtcattgatacaaagcacacatttctttatgtctatttttgttttgttgatttgtttacctaaaggtattttaaacatttggtaatgtgaaagcctgactaatcagaccactttctcatcctggaattccaattgacattctcgactgcatgaataaatgattctactgaatttagtcttccattttgtcacatattacaaagcagtgttgcatcttggcaaaaattctgctggtagatatatgtatatatatatatgtacacacacacacatatacacacacacacatatctatatatagagagagatatagatatatacacacacaaagctcaaatattaactaagatgttcttcttgtcaatagtttctaagatagacctaaaactaaatcagttgtgtttcatataatagcagtaacactattggcaatttgtatgcggtcgtttgcagtaagaatggagaataacttggtggaaacttctgaaagctacagttccagagtaacaaaaggaaaaagaggaattcgtctagtaaaaggccgtatggcaaagtgtatgttaaaaaaaaaaaaagtggaaaaggcattattgacttgcagaatgttctaaaaatacctcattcaataagtacatcttgctagttgacacacaattatgttaatgtagtaagagttgaagagtaatttaaatataattagggcttaaaagatacatggcatagagcatggaacttgttttggcgcgtgcgtggagtatttttaatgaaaataaaaaataaaagtaatctgtaaattaaaacctttgtgtattttcaatttcatttgaggttattctcacatgactgataaagatgatgaaacaaatgagtttcatcatgaatttattctcatataaatgacacttttcaacatcctgttttggaaaaaagaatgaaaaacatttcttgattcttaataggacacctatttcatgaacattcatttccatgccaggtcccaagctgcatctataaaacaacaaaataatttattaaataaggggaaaatcagtctaccaactactaatagcaaaacaacaatattttaaaaataacattggctgatacttattttcagtgagtttactcattgttttttagagagttgatttgttctgacataattctaatcaattatagtaagttgtagatagatttagtgtgctctgtaaaaaaatcatctaatctgacctacttttaaataccagttactagtagaccaagtgtaactcctggtgacagctataaattgagtattgtattagttcattttcacactgctataaagagatacccaagactgggtaatttatgaaggaaagaggtttaattgactcacagttccacacagcaggggaggcctcaggaaagttacaaccatggcagaaggtgaaagagaagcaaggcaccttcttcacaaggcagcaggagagagaatagtgaagaaggaacttccaaacgcttactggggagaccacctccatgatgcaatcacctccctccctcaacacgtgggaataacaggttgctccctcaagaggattacaatttaaggtgagatttgggtggggacacagagccaaaccatatcaagtatgaaaactgatccttttctagaagtcccttccaattttaaaaaattatattaggacaatttatttattaactcattgagcaaacacttatttttatttttattttcttttttctttttttcttttttttttttgagacagagtcttgctctgtcgcccaggctggactgcagtggtgcgatctcggctcactgcaacctccgcctcctgggtttaagtgattctcctgcctcagcctcctgagcagctgggactacaggtgtgtgccaccacatccgactaatttttgtatttttagttgacatggggtttcaccatgttggccagggtgttctcaaactcctgacatcaaatgatgccgctgcctaagcctcccaaagtgctgggattacaactgtgagccaccacgcccggccaacacttattgaatacgagttacgattcaagaatctgttaagtgtagaagatataagcaacaggtaaattttaaaaattcataagaaatactatgttaatcttactatgatgaagtattatgagaacctataggaagaaggtatttcctgagtcctaaaggttggctctcaagtagaatagattttgatattttagaacaacatcagtgaaatggttgaaagctggtttattcctatatccttatatacagtctaaatggaaggataagagatatactaacaaattaaaaatcttaacaaaatgccaggaaataaacaacaaatttagatacgaaagataaaggaatgcaaaaaaatactatatgctattctttgtttcatttagcattgtttcataagcatctttccatgaccttaaatataaagcatgaaatttaatggctttctacttgatatgattaggctttgtgtccccacccaaatctcatcttgaattgtaattcccaggtgttgagggagagacctggagggaggttattagatcatgggggtggctttccccaagctcttctcataatagtgagtgagttctcacagaaactgctggttttataaggggctcttctccttctctttctcactatctctccttctctttctcactatctctcctgccaccttgtgaagaaggtgcctcctggttccccttccaccatgattgttcatttcctgaagcctccccagccatgccaaactgtgaatcaattaaacctcctttgtttttaaattacctagtcttgggcactatctttatagcagtgtgagaacagactaatacactactataacatcttattgatgtatgcactctccttttttttccctttttttggggccatttaagttatttataaagttgtactaagataaatagtattgtgatgaataaacatacatatgtatatatatatatattgcatatctttgtgtacatcttaaatttttttcttagaagaaatttataggatgccaattatatcacctaagaatatgagaaaatttaagcctcttcatatgtattgataaattgttttctaataattttgccccaaattatatataaattatactaatatatatgtttgtttgttaattgtctatctttcccagctgaatgtaagtcctgtgagagtgggaacctttagttttatttaaagaggcctagaataattcctgggatatactaggagctccataaatatttatttagttgaatgaatgaaatttcaaaaggaataattttaagccaaactcttcacgtatttagattcaaaatctggctgctctatataaaagaaataattttaaacattgagaaactaaagcagttaacacagatttttttcaagaaaattataacttggtgtgaatccaacaaagtgctaaggtgagaaactttactgaggagaaaatcagctttgaaatacccaaaggactgtaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtactttgtagggacatggatgaaattggaaatcatcattctcagtaaactatcacaagaacaaaaaaccaaacaccacatattctcactcataggtgggaattgaacaatgagaacacatggacacagggaggggaacatcacactctggggactgttgtggggtgaggggaggggggagggatagcattgggagatatacctaatgctagatgacaagttagtgggtgcagcgcaccagcgtggcacatgtatacatatgtaactaacctgcacaatgtgcacatgtgccctaaaacttaaagtataataataagagagagaaaaaaaagaaataaaacgataattaaggtagaatgttaccagtaagagttgttgttacccagcaaagcagactagaataaagggccagaaatgatgctaaagatggagctcagaatttcatgaaccccaattccatacatgtagaggccataaccatctggaatcatgcttccaaccttatccttgctctgttctggtaaaacatgcatgaggaagaatttgttttgaaaaaaagatgtattagaaaaatgccactatacttatttaaaattcactagattttcagagttaggaagaatgagtgttcgctctagtttgcatggatcaactgaggttacttgtctgttgaatattatctttctatcacaaaatggcttttcattgagaaattaatatcttcttgagcaacatttgttctttttcactctgataagtctggaaggaagactagatcttgccttctagattaccattaaatattttcaccttctacctatcccgtaaaggatgatctggataggcagctggtgatagataatgtgaatccaggaatctggagtaaacctgatagaaaatctgtgttatgatgtaacaggaaaaagcaaagacaactggatgttaaggggtgaatttcttaccaagaaacatcagttgtgtcagtcaagaaaaggaaagaaatgttgttgccctcacagagattacactgaggtttgggaaaaataataaatgaacaaactaaaatgtattaaatcactggctgaagaactaaccaaattaaatacagaagtaaataaatttacataaagatataaataatagagagtgtgtcatgtggtaattaatgctaaagaaaagtaaaacagtacagggttgggagcattggtaggttggatgcaatttaaaatagagtagtcaggaaatgcctaatggagaaggagagatttttggaaaactctaaaagaagaaagggaatgaggcaagtaaacacctaagagaaaagtgtttataggcaaaggaaacaataagaccatatgcccaaacctggcagtcaggtgatatcacccagaacagaactctggtcactcccaagttgataaggtagaaccagcagaaaagactgaggaggagaggccagtgaggtggaaagaggccacataagtaaggaatactgaaagccaggtgaaaaatgtgttgcatggcggagaatcaatgcgtctcttgctgctaagtcatgtagaacatggaccaagtattaatcatttggctatgtggcatcattgaagacaaggacaagaacacttgtgaaatcctaattcatactgtaagttcagatgatattagaaagaacagaactggagagagtgagtgagacaattttgagaaattttgctttaaagagaaagagaccccaaggcaggcagatcacaaggtcaggagttcaagaccagcctggccaacatggtgaaaccctgtctctactgaaaatacaaaaaattagccgggcatggtggcgggcacctgtaatcccagctacttgggaggctgaggcaggagaatcatttcgacccgggaggtggaggttgcaatgagtggagattgcgccactgtactccagcctgggcgacagtgtgagactccatctcaaaaaaaaaaaaaaaaaaaaaaaaaagtggaagagaccaatgaagctgtaactgaagacggagacagaggcaagaataaacttttttttttccttttgggaagagaaataaggcatgtttgtatgctaatggaaagatccaatgaataggaaaataattgatgatgccgggaagaggggaagaattctgaagcagagtcccagaataagggaaaggcaatcaaatctagggtacctagggtttctaccattgggtgtcttttcctcacccttcctggactctgtttttgttctagtatttatacaagacactgctattgtagaggcattgcaagaattccattaagcatctttctgtgatttaatcccacttaagcccttgatagtcactgataaagagacttaaaatctccatttttgccagtttgaagattctatacaagatgtaaagttaacttcattttcttgatttgtttattttgtcaacttgtgttggaataattgaactcaatcctactttattttctatgttccatttagacattcttccctattgagagttagttagaacatttgcttccagtgagtcatctgcctacttgagatagttaccacctattgctacatgacaaagacaatgaaaatatagagatctgcatagtaatacaaaatgagagaatttactgcctgtgtgtaatcatatccagaaaagaatgcagagtgaaaatgtttaaaatgagatggtgcatggacagggtgtagtttgttagtctaatttggatattaatctacaacttaaggaatgtgggatttcgaagtttgtttttaattgatattacaatctctcagagtcaagaacaagatgacaactgatacttctgtgtatgggggggatgtgtgcatagacatatgtacatgactacatattctgcatacatttacattcatattaatttacgtacagtatgcacatattttcatgcattcacatatgcgtgcacatacacacatacatatatatttgtatttatgttttgaaggagagactcctgattattcctttgaagtgtgactatgatttggtataattatgatgtttggtttattaccagcttcatttatagaactaaaaggccatggttaattacttcaaatgaataacatattgattaacaaaagctgttttgtgcctttttgagacaccgtttaggtagcctaagacattcacatcctctaagaattagatgatttccctttcttgtgttgtttctagatgctggtaagcaaactgtagctccccagaaatagcctagatacatcatctacttgggaaatactgttctggacaaaaatcattacagttctgattgatgcccagcattttaagcagtcttcttctgaaagagagatgcctcccttttagccctgaataaatataactaagagatggttatttaattcctttgtcataaaaaggttttaagaaatcttgatcttttcacattatgtgaaaattgtttccttaatacatgggtcacaggcattaatataagtgatatgttttccacttttctaaaattccacagaccttgaaactgttctggatattgaggattcaacaattcatttttagtgctcatgacgactgggtgtagtaatttaggatgtggctatttattgaacaggaatgaaagctgacttgggagtataagctatttctcttattatatccagtcaagtattacagtcaagtactacagtgggccccaaggtaactaaaaagtgaaaacttgccctccaggttaagatacatatcctgtagctgcaggtatagaatcattcattctttcattctagagatgtttattgagtttcaatatagattgctttgttttcagagctgtctactcataaaaaataaagatgaaataataagatattcaacaaaaatgtttctgtttctatgttttgataaattttctcttaattaatgcttccacagaaaattgatgaatttacttcaatggaccattgtaattttcaaggatagtataaaattgtagcaaaattaaatgctgtatctattgtatatctatttttcttttctagtcatttatgatactatgtcttataaaagtttcatacaaagatattctcatttgtctgaaataatgagaatgcttctttcctacttgaccataattatctgctcttatttcctaaaataatccatttggaacttttttttatttctctaaaatacctttataattcaaaggaagtctttcagaattggtaactccagtctgacttaaggattggaaagtacattacatcttcttataacttgtaatttggaaatgttatgacattgcaaagcatgcaccgttatcaagagtcataatattgtgttcaaaataaaattaaatatggaaaaatatgcatataaatatataaaaatatgagaaacacttatttttattgattattttcaaatatgtataatatacctataaaaacataaacctctacaagtttgtagagtttccttttccatttcagttgaagaattttttgtccagatgcacaaatacctctgagacaaaggcggaatatgtcataggatccagaaaatcattatgaaaacaaagctcttttctctagtggcatgaggtatatagtatgatgaggggggtctattttgctctttgtacactggtcatttttgcaaaggccatttattaaagcaacagatagggagacatcagttatgtttttggccttctgtttactataaaatgttggaagacttgaaaagccccactaaaatcattgaaaagatcaaagcctaagtccagtgtcacaggagagaatggacactgtcaattgcagtggatgtagaatgttttactacaaaaagcttggaaatagtctttaatttgtatttttttcctatgtaagctgttaggtcagtggctgttttttaaaaaaaattacttttatgtgagctcgatagttgacagtcttctagtgatagacttcttatgcttggatatattgataagctgtaaaagtaccctgaaatttgatatcctttctcatcagcatctgcctatttgtatataaagtttatataatatacatattttcaagaagcacagtttctttaaaacaagcttttcccctgctcgagtgttctaactttttgctgttgcctcagatttcttttctcagattttgtagacctatgttacccttgtaacatttctattgttgaatcactaacagcagataatgaatcaccaccaatgtcaaaggcagagtgttgccctaaagatcaaatttaaatcttggccatgttgttttgagactctgattattttctcttcctccccctcctctccttcatttttatattattattttttgacttggaagtgctcccacatctctctctttgacaaaaagttatattaaagtctagactttgggaaggcaaagagccaatctctttacttttttgaccacaagaatgtgcagtgtcatcttttaaaaataagaattgttttcagtaacctaaatgaatctgtcagataagattttaggaggtgtttagggaagtatttcaattttatttattgttcattacttatgatgaatttagcacttacacacaggaatctttttgtgaaaagcacttaacagatttctttgaattctcccaataatcctgtaagaaatagaaatagagtatttataacctctatctcacaggtgaagctgctgaaaccacacatttatactcttgtgcgatttgctcttggaaagaaatttcttcaagtttggaagattcactattgctactctcttggaggcaaaaaaaaaaaagaaaaagttactaatactctgaatctagtggcctgaactcaaacctccttattgagtgcatttatgccacttagagggacttgatcacacatttctgtttggatccctttcatgtggggtttggactgtggatttgtggattgtggattgacagacatgtggattatggactgactttcccttcctttgagatcctgtgtagctgaagctttttctatgaaatggttcatgggtatgatataaaaggaagtagagctataacattgctgttttgcaaaactcttctaatattgaagttggcatttacactcacgcgtaattctctaaggattcagtccctgtgagtttttctaagctttgtattttatcttttaatctgttttttattgtagaacatgcagaatatttgcagattcaaacactcttaaattaaaggagtggtattcatttcaatgttataattttaaatttggggagcatttttgcctctaataaataagcataaaccatccaattttccagagatgccgcaagtttcattaatagctgcttttcattcattaaggacttattattttggatagacagtttcccatgaacctttcctaatccatttctaattagatcaacccaggcccaggtatgacttcttagcttacagaaggtaatgcctcataactgagggcagatgggccttctggatgtggaacacacaagtattcctttggtgaagggagaaaaataaaaaagatctgtcttagtttgggatgctataacaagataccatagactgggttgcttaaacaacagacatttatttcacacagttctggggactggaaagttggaaatcagggtgctagcatggttgggttctggtgaagaccctcttcctggcttgtaaagtaacactttcttgctatattctcacgtggcaaagcaagagcaagtgagagagggagatctcatatctcttcttataaaggtactaaactcatcatgaaagttccacccttatgatctaattactgcctgttatggactgaatgtttttggttcccccaaattcataagttgaaacctaaacttcagtttgatggtatttggagatgaggtctttgagaagcaaatctgttttggaagtgaagccttcccaaatgggcttagtgctcttataggaagagaccaaagagctagctggctattttttgccatatgagtatacaacaagaagtcagcagtttgtaaccaaggaaaaggccctcaccagaacctggccaggctggcaccctgacatcagactttcagcctctggaactgtgagtaataaattctcttgtttgtaaggcatccaggctcttatactttgttatagcagcccaaactgactttaacatctctccaaagccccatcttcaaataccatcacactgggggttagggattcaacacatgaatatattgaacacacaacttagtccatagcaagacctaaaatatatattaaactaaccattgtccatggtagtggccaattacctggctcccacttggctgcagtctatgctgaggtcctttgtaagcctcttgcatttagaaagaaagtctcttacccatttctctgtgtttttactacaggtctattgccagccctttttctgtttcaatgaagtcaatttttaatgtaaaatgaaatagttttaacgttaaatggtgcttcaaaattgtcaatgcaaagcaatgtataccagatatactttcaatagaaataggaaatttaaaacatagtgcctatgttttaattgcattcattctatcatggccatctttttatcacaaaaacataaggaaagagatgctagtaagtaccaccttttctaagctgagagatcatataatactgttagtcaactaataaatatggcacaattgaaggtgtgtttctaagtcaagatagatacaaagttaggaaaagatatgtagtcattggaagatatccagaatacatcaatctattttctgcactagcctagctcagatgacagtatttaaagacagaaattctttgataggccaataagatggaggaaatgtaccagataaaataaatgagagaatgcaagtgtgacacaagttaataacttcacatataaagatgaatttaatggctgtggcaggtagctactaagtattaagtagtttcaaacaaattaaagattcacttgacctagccatgaagatatatggactatgtgaagggcaatctgtagtcactaatcttaattctaaacatgtcaggaagaagttatctcataatgtgaaaaaacatacaatttactttctggtaatatattatgttcacatatttccaagtattttcaaagatagatagatagatagacagatagatagatagatagatagatagatagatagacagacagacagacagacagacagacagggtttggctctgtgtccccacccaaatctcagtttgaattctacttccttaattcccatatgttgtggcagggacctggtgggagataattgaaccatggaagtgggtctttgccatgctcttctcatgatagtgagatctgatagctttaaaaatgggagtttccctgcacaggctctctttttgcctgctgccatccatgtaaaacttgacttgctcctctttgccttctgccatgattatgaggcctcccagccacgtggaactgttaagtctgttaaatctctttttcttcccagtctcaggtatgtctttatcagcagcataaaaatggactaataaagtaaattggtaccagtagggtggggcattgctgaaaagatatccaaaaatgtggaagcaactgtggaactgggtaagagggagaggttgaacagtttagagggcacagaagaagacaggaaaatgtgggaaaatttggaactccctagaaacttattgaatggctttgacccaaatgctgatggtatggtcaatgaaatacagtctgagatgatctcagatggagatggggaaacttgttgagagctggagcaaaggtcactcttgctatgttttagcaaagagactggcagcatttttcccctgccctagagatttgtggaattttgaacttgagagagatgatttagggtatctgatgaaagaaatttctaagcaacaaagcatttaagaagtgacttgggtgctgttaaaggcattcagttttaaaagggaaacagagcataaaagtttggaaaatttgcagcctgacaatgtgatagaaaaccaagtctcattttctgagaaattcaagccagctgcagaaatttgcataagtgataaacagctgaatgttaatacccaagacaatggagaaaatgtctttagggcgtgtcagagccttttccaacagaccctgccatcagcccagaggtttaggaaggaaaaatggtttcatgggatgggcccagggtcccaatgctgtttgcagtctagggacttggtgccctatgtcccagcgactccagtcatgactacaaggggccaaaatacagctccagctgttgcttcagagggtggaagccccagtcctcagaagcttcatgcgggtgcaccgaagttaagaattggagtttgggaatctctgcctagatggcagatgatgtttggaaatgcctggatgttcaggcagaagtttgctgcaggggcagggctctcatggagaacctgttctagggcagtgtagaagggaaatgtaaggttggagaccccacacagagtccctactggggcacctcctagtggagctgtgagaagggggccactgtcctccagaccccacaatggtagatccactggcagcttgcgctctgcatctggaaaagacacagacactcaatgccagacagtgaaagcagctgagagggaggctataccctgcaaaactgcaggggcagagctacccaagaccgtgggaacccacctcttgcatcagcatgacctggatgtgagacacggtgtcaaaggaaatcattttggagctttaagatttaatggccctgctggatgttggacttgcatggggcctgtagcccctttgttttgaccaatctcccatttggaatgggtgtatttacccaatgcctgcatccccattgtatctaggaagtaactaacttgcttttgattttacaggctcataggcggaggaagggactttccttgtctcagataagactttagactgtcaacttttgagctaatgctgaaatgaattaagactttgggggactgttgagaaggaatgattggttttgaaatgtaaagacatgagatttgggagggacctggggtggaattatatggtttggttctgtgtccccacccaaatcttatcttgaattgtactcccataattcccacgtgtcatgggagggacttggtaggagataattgaatcatggggtgggtctttcccatgctgttcttgtgatagtgaataagtcttacgaaatctgatgttttaaaaatgggagtttccctgcacaagctctctttttgctttccaccataagacttgactttactccaccttgccttctgccatgattgcgaggcctccccagccatatggaactgtaagttcattaaacctctttttcttcccagtctcatgtatgtctttttcagcagtgtgaaaatggactaatatttatgtacattttttctagatatatacttctttatataaatatacatatatatatacttgcacatataagtatatatctaaaaagaatattcaaaaacatagaaaagacatttattcttttcttaattagaccctgtcttctctatcttcttcttttaacctttatatgtgattacaatacaacattttggatattcagaattttaaactccgttcttgtaggcacatctgacttacacaagatctcacaaactttttaagaatcggtcgacattcaaatattttctgcccattctctgcctaatttctcaacttatcactaggcatgccaaccacggggattctaatttcccagccttttctaagctttcttgtgacccagctcattctctgggtaaaactgactagacttcactgggcaaatagttaaaggctgtttaatctatggattgatcagcaacttataaaattacttgattagaaaaggtttgctagatgaactagaaaaggccaagtgaatgaaacagtaattagcaggaactgaaattaaaggaaacagagagagaagaacctggacagagaacaagccatgaaagatcatgatgagcctacatgttaaagaataaaaaatgataaatagcagaatctttgaggtaaagaacagtatatagattcgattgaaaaaatgagctaattgtactgaaagaagtgagtagatccttagagagaaacagaggcacaatgcaaaagaaactatgtgacacccaagacaagaaacaaatctttaatctaagtctgtctctatgttatccccccactttcctgattgaatctgtgtattttgctctcaaatttgcttacgtaaaatatgccccaatagaaccatcaatctgcatcaatttgccatcactggcaaaatggcattatttttgaggaaaaaaaaaatgatcttggtttgaggggatttggacaactattttccagtatattctgttactcacagtgcttgtgttagtcttctaaactaaactttttacattgcaccaatgtaaaaagccatataaaccccccaaccttgtaagtaatttatgaaaacttatgttattcggtaaaaacaaggtaattgcaacccttatatgctgattcctcagagcagggaaacataggaaatagacttggtggcagctttcagtaggaaaggagagaattctgagttgctgggggtacaatgggaaccagtctgggcctgagaaataattatttgggctacagttggatgacctatgagctaccatcatattaccacaacaatcaaaattttgtattatatattgcctattggattgtaatattcatactctacatgatctccttaggttaattttaaaagacaaagttaccttttagagaaaaaaaaaaacagaagttcactctatatgtgaattttacttcttgataattctttacaaaccataattatattctatcataacattttctgcactagcattgaaatgcaattggctgtcgccattgcttgcccctttagcaagttggtgagttttgctctttcccacctgtgtatccaggtgtcccagctcagttccctatggtgagccctgatggtgacagtgatgctgccaaagcaagataactaaaatcttgtctgcaaaccatcttcccattccatggctttggaagggagctgggattatgcttggtccttttccttgtcttcctttcctcaaattcactctcacatttaagaaaacatggtgaaaatgtgcccacataaggcatcttgactcttcaaactttaagatatgttatacattgatgacatatagatgtatttctttatgctttcaggacctttgtaatatgtgactcatttttatgtgatgtctactagggacattacataacatgtgatgtctagagaaagaatgggattcttcaaaaattctgcagtaacaagaatgaaatcttctaaagcttacctgtcaatatgctaggttatgtgtgatcactatactatacgaacattccaaaatcttacagatagcatgaccatttatctgtgtttttataatgttttcccccattagtaatcaacccatgtttgcttttgagtgattagttctcaatattatccacctgctcgtctatgctgtaggctttgtagatcattcccttcttcaaaattatcctgaaatttagtccttggatctatgtacctcagacatttatcaaggcaccccaattctctcactttccagctctttctgttgtctagttatttactcttggaagtctttgcagacttacttttcagcatcaagattgtcttaccatttttgtctctaaagcatcattgaatctgaacatgacacttcaatgctacagttcctaaaattttatttcttcctccatttatgcaatttttcctaaaatactatttctttcacagtcatttccaggaaaataatctaattcaacataaactttatgaataatccatttggatcccacactatgctagttgtaccttaaacacactgtaaaagaccttattggtggtgtccagtagggagaaaagaataattccaagtgaaaccactagggagctcaattagggcacattttcaagtgctaaattctagtatgcatacaatatgctctttataaatatagaaaccatattcttatttatctcttcctatttagccaattgcccatcatggtcctaggattacaaccaccatactatataggatttaatgcttgtctctgtatgtactgataaaatattatccattaacatactttatgttcaattttattacatatttttcttcatcctccatcggtgttgtctacttgggattttaagcttatgtaggatctggccatgtaggatttactaactgcacaatcagctcagtagcctcccacagattctaaataatattctaaaactaacaaaaaagttgtatcgatactttgttgattaaatgaatagtgcgaagttttcctcccaagtgcagtgtgtatttttatacttcttctaagctataagtttcattaacttcaagaacagtagttcccctagtagtgccaatttttccatcaagcaacttaataaggtatagttgtaatgctggctaccattcagatggtgacaggtggcagagaaagcacacaatggaattttccatctgtctcctactttctggccaaagcttaaaggacagagtatgatttgttctataatcttcacttacttcttttcatctacacaccaataaaaataagtatactttagcttatggaggtttacagatcttgaaggtcaaaaccatgtgcttcatctatcttcactttttggaaaaagtacatttgtttattccatatgaaagctgaattctggcttagaatttcaccccttttctatggaaaacatcttaccttccaaaagctttacaataatctgaattcatgtctccatacagagtaataaacataaagaagatggtatacatcctatttattgaattgctgaatgcattaaagacaacatcacttcattttattaatagttttgtaaagtttagattttggtggtattcattatgaaagtaagattataatactaataaggaacataacttatgacagatggagagctgcagctttaaattttgcatatgagggaaaatatatatttttgatggaaatggtgagttttggagtaaaattttagttttgtttttgtttttttgttgtttttttttttcctgagacagagtctcactctgtcacccagactggagtgcaatggtgcggtcttagctcactgcaacctctgcctcccaggttcaagcgattctcctgcctcagcctcccaagtagctgggattacaggcacccgtgaccactcccagctagtttttgtatttttagtagagacagggtttcaccatgttggccaggctgttctcaaactcctgacctcatgatccgcccatctcagcctcccaaagtgctcagattccatgagtgagccactgcacctggcctagtttttatttttttttctatttaatttttcatgattctttttatatagcctgttctgtgccattataatgcagtaaagtttaaaaaccataacagaggcagaaaatatgtagttataaaatgtttctagggaaattgctgtccttttcctctcactgaggtcttgagtggcattcttggataacatctagtaaagactatattttaatatgtttaaatttaagtgactatctgagtgaatgggttaactctattaaatccatttttctcaacaattattaaataatgtaaacaaggcagtatgctatgtgatatgtaataaagtatatgtcttttttaagaagcttataatgtagcatgaaagaattaaaatatagattgtgctgtaatcaaaaggagtgtacaatgaatgcaatgacaatggaacatgtattctctcaaagtcaaaacaagcagaggtcacgtgtgggtcggagcccatacacttgaggaaggcattgtaatattgatggaagtggcatcgctgtagaaagggcagaggatggtccaagttgtgggaacaatatgagtgatgatattgagtatggatagcactgaatttttcaatgatctgtaggtctaaaaatgtttctagaatgaaggatgtgaataaagaaataatgcaaatgaggccagaacagtaaattggagttaaactatgtgtcaatgtttcccaaatctgaatgctcagagtgatcatctggaaagcttattaaatatccagattccttggttttgtctaaggcaactgtattttaacaatctggtttgggcagggctagtataaaaggcaactcggatggtggtaaacatagatgcttccatgtgaaaggttttgagagattttgaacactagggagaagaagaaaaacctgtctttagtttggtaaacaataggaagacactaaaggtattggaaaagattaataagatgttaagagaagagtgcttttaaaagattcctctgatgtggagaaagacaggttgtggcactgaaaatgcaatgtaaaaaaaggaacatataaaatattgcacacattgaattcttcagttttggcaagaagttgggtgtgtgggatcaaggaaaattaagattctggataattcacataagtattctagtttaatcaagggaaccgacgatcattgagacatactatggaaagacaaaagttcaaatgtgtgaactctgacaataccgacatcagaaaataggaaagaatagtctgtaaagaagcagatataaatctagtagaatcagcaggtgagtgcatattgtggaaataggtcatagaatttaggaaacttgcatataactggcaacgtgaactaccacagaacaattgaggaaggagggacttggaaaagttagataatactgttctggaagccagtaatggctctagggataacttttttttgttgtttttgtttttgttttttttgagagagagagcctgaaacagaggatctggaatttatcaagaaatgagtggctagttagtaagcaggggcaatagaaagcatttctcttttgtttaattttgttatacaaaggaatgataggacaagaaattaacaaagtgttagtgagagaaagtataattgaaagaactgtactcaagaagattagtgtgaatgatttgtgtatttgtgtgttggtatgtgtatgtattttaagaacagctttccagtgaagtatagcattcacaaggtagtaagaatattcttcctcagaaacaggagtgagtgaagaaaggaaataaaaatactaggaaagtgtagtaaaatgcattaagcattatggtccttgatgtccagtatagcaatatcttgaatgtatgaggcaagaagaggattcttagataaccctggtattttcagcttgataaccaactgaaaggtaatgctatgatagggagcacagaagagcagttacactgaggagaaagatgatagaaagatgatgtgatttctttgagtggaggggtttttgaggtgtcatgagggcatccataagatgtggtcagaggataattaaatgtatagcacaagagaactaacacgatgcagagacttatttaggaaagtcattttcaaagaagtgagagttgaagctgtggaataagataaaacagaacaaatgatagagtagggaaaaaagggttgggagttcagcaccacctcatcatttttctgacatctgagggggtagatggataaaggttagccaggggggaagaaaaacaggaaggagcaggaatagcgaaaagggaatcctggaaatatgtgagacaaaattgagagacgggagctttcaagatgaaagttttgaattaagaataaaagaaacattaaaaatatataatcttatactttttaatgttcttggctgctttcatgaaagctattttaataaagtaggaaaaagagaaacaaggctaaaataggttgaaggatttcagacaagtaggaaatgtgggagccagtaatatacactatttttgaaatgttgtggaaaaatagaagtcacattcttagaggctaacatataaaaggaggtttttaaatataaaagcaatagaagttaaaatatagcttggaaaacaggatgactgaataggaacagctcctgtctgcagctcccagcgagatcaacacagaaggcgggtgatttctgcatttgcagctaaggtacccacctcatctcattgggactggttagacagtgggtgcagcccaagcttcataagcaaaggagaaataaaatcctttagagacaagcaaatgctgagatattttgtcaccaccaggcctgccttacaagagctcctgaaggaagcactaaatatggaaaggaaaaactgggaccagccactgcaaaaatataccaaattgtaaagaccgttgacactatgaagaaactgcatcaacaaattggcaaaataaccagctagcatcataatgacaggaacaaattcacacataacaatattaactttaaatgtaaatgggctaaatgcacaactagcaaattgtataaagagtcaagacccattggtgtgctgtattaggagacccatctcacatgcaaagacacacataggctcaaaataaagggatggaggaatatttaccaagcaaaaacaaaaaaaagcaggagttgcaatcctagtctctgataaaacagactttaaaccaacaaagataaaaaaaggaagggcattacataatgataaagtatcaatgcaacaggaagagcgaactatcataaatatatatgcacccaatacaggagcaaccagattcataaagcaagttattagagatgtacaaagagccttagactcccacacaataatagtggcaggatcccactgtcaatattagacagatcaatgagacaggaaattaacagcgatattcgggagttgaattcagttctgaaccaagcagacctaatagacatctatagaactctcctccccaaattaacagaatatacattcttctcagcaccacgtcacacttattctaaaattggccacataattggaagtaaaacactcttcagcaaatgaaaaagaacgaaaatcataaaaaacagtctctcagaccacagtgcaatcaaattagaactcaggattaagaaactcactcaacaccacacaactacatggaaactgaacaacctgctcctgaatgactactgggtaaataatgaaattaaggcagaaataaagatgttctttgaaaccaatgagaacaaagacacaatgtactagaatctctgggacacagttaaagcagtgtttagagggaaatttatagcactaaatgcccactggagaaagcgggaaagatctaaaatcgacatcctaccatcacaattaaaagaactagagcagcaaggcaaacaaattcaaaagctagcagaaaacaagaaataactaagatcagagcagaactgaaagagatatagacacgaaaacaccttcaaaaaatcaatgaatccaggagctggttttttgaaaggattgaaaaaatagatagaccactagccagactaataaagaagaaaagaaagaagaatcaaataggcacaataaaaaatgataaaggggatatcactactgatcccatagaaatacaaactaccatcagagaatactgtaaacaactctatgcaaataaactagaaaatctagaagaaatggataaattcctggacacatacaccctcccaagattaaaccaggaagaagtcaaatccctaaatagaccaataacaagttctaaaattgaggcagtaattaatagcctattaaccaaaaaaagcactggaccagacagattcacagccaaattctaccagaggtacaaagagaagctggtaccattccttctgaaactattccaaacattagaaaaacagagactcctccctaactcattttatgaggccagcattatcctgatatcaaaacccggtagagacacaacaaaaaaagaaaatttcaagccaatatccctgatgatcatcagtgcaaaaatcctcaataaaatactggcaaaccaaatccagcagcacatcaaaaagcttacccaccatgatcaagtcagcttcatccctgggatgtgaggctggttcaacatacactaatcaataaacataatccatcacataaacagaaccaatgacaaaaagcacatgattatctcaatagatgcagaaaaggccttcaaaaaaattaaacaccccttcatgctaaaaactctcaataaactaggtattgatggaatgtatctcaaaataatgagctatttatgacaatcccacagccagtatcatattgaatgggcaaaagctgtaagcattccatatgaaaaccagcacaagacagggataccctctctcaccactcctattcaacatagttggaagttctggctggggtaatcaggcaagataaagaaataaatggtattcaaataggaagagagggagtcaaattgcctctgtttgcagatgacatgattgtctatttagaaaaccccatcgtctcagcccaaaatctctttaagctgataagcagcttcagcaaagtctcaggatacaaaatcaatgtgcaaaaatgacaagcattcctatacaccaataatagaaaaacagagagccaaatcatgagagaactctcattcacaattgctacaaagataataaaatacctagaaatacaacttacaaggaatgtaaaggaccacttcaaggagaactataaaccactgctcaaggaaataagagaggatacaaacaaatggaaaaacattccatgctcatgactaggaaaaatcaatatcgtgaaaatggccatactgtccaaagtaatttatagattcaatgctattcccatcaagctaccattgactttcttcacagaattagaaaaaactactttaaatttcatctggaaccaaaaaagagcccatatagccaagacaatcctaagcaaaaagaacaaagctggaggcatcacgctacctgacttcaaactataatataaggcaacagtaaccaaaacagcatgctactggtaccaaaacagatatatagaccagtgaaacagaacagaggcctcagaaataatgccacacatctacaaccatctgatcttcgaaaaacctgacaaaaacaagcaacgggaaaggattccctgtttaataaatggtgttgggaaaactggctagccatatgcacccttgttttttcattctcgtgtttcctataattgagaaaagctttctactggagaaattactataaatccctccactgttagaccctttccttgtaaaatctatttaatatattttttttaaaagtactatcataataaaaatgaaaatgtatatgacagaaaactgaaactggaccccttccttacaccttatacaaaaattaactcaagatggattaaagacctgaacataagacctaaaaccataaaaaccctagaagaaaacctaggcaataccattcaggacataggcatgggcaaagacttcatgactaaaacaccaaaagcaatggcaacaaaagtcaaaattgacaaatggggtctaattaaagagcttatgcacagcaaaagaaactatcaacagagtgaacattcagcctacaaaatgggagaaaatgtttgcaaactatccatctgacaaagagctaatatccacaatctacaaggaagttaaacaaatttacaagaaaaaaacagccccatcaaaaagtggccaaagcatatgaacagacacttctcaaaagaagacatttatacggccaacaaacatatgaaaagaagctcatcatcactggtcattagagaaatgcaaatcaaaaccccaatgagataccatctcatgcaagttagaatggtgatcattaaaaaatcaggaaacaacagatgctggagaggatgtggagaaataggaatgcttttatgctgttggtgggagtgtaaattagttcaaccattgtgaaagacagtatggtgattcctcaaggatccagaaccagaaataccatttgacccagcaatcccattactggatatatacccaaaggattataaatcattctactataaagacacatgcacacatatgtttatgcagcactattcacaataccaaagacttggaaccaacccagatgcccatcaatgctagactggattaagaaaatgtggacgtatacaccatggaatactatgcagccataaaaaaggatgagttcgtgtcctttgcagggacatggattaaactggaaaccattccggcaaactaacacaggaacagaaaactaaacactgcatgttctcactcataagtgggagttgaacaatgagaacgcatggacacagggaggggaacatctcacacgggggcatgtcaggggctggggggctaggggagggatagcattagaagaaatacctaatgcagatgacgggatgatggatgaagtgaaccaccatggcatgtgtacacctgtgtaacatacctgcaggttctgcacatgtatcccagaacttaaagtataattaaaaaaaaaaaaacccaagggcggagtaaaaggagataaaagtgagtaaaagcacagatttgtcataagagatctgttgagaaaggtggaaggacagaagtaggtttcaaaacaatcacgacatgttctgaaacaggaggtaaagaggggaagatgaagaggaagatgttggttggctgggtgtagtgggtcactcctgtaatcccagcactttgggaggcccaggcagatgtaacacttgaggccaggagttggagaccactctgtccaacctaagaaaactccatctctactaaaaacacaaaagttagctgagcatagtagcacatgcctgtagtcctagctacttggcaggctgaggtaagagaataacttgaatctgggaggtggaggttgcagtgagccgagatcatgccacggtactccagcctgggtgacagaacaagaccccgtctcaaagaaaaaggaaagaaaaaaaaaaagaaggaagatgctggaactgggaagtttgaggaatttggcagccaatgtattggaaatgtcatccatatggatcttcaaatcaccaagattgttggtaactatggccttccataaatgtacctatggttttgtagtaattatgtgtggaaaactgtatgattcctcagtatttatttggttttccctgcactttctctgctaccaaacatcagaatcctagatcattggataagctgaagttttcagcaactctaatttgactgtcactacttttcttatctatagtagatgttgtccacaaagtgaccacgttatatacaggaaatattacaatcacatgtcaaattttgttctcaaattattattaatttcccaaaatattatgagtcttttgtatatcttgttgtttataatgacaataatttgagccttttgtttattggaatcttctttattttcatggctatggaggcattcacatcagtttccttgagaaaaatcaactacctagccaatagaaatgatttctttctgtaaaagatatcttttttttttaataatttaattagttctttttttttattatactttaagttttagggtacatgtgcacattgtgcaggttagttacatatgtatacatgtgccatgctggtgcgctgcacccactaactcgtcatctagcattaggtatatctcccaaagctatccctcccccctccccccaccccacaacagtccccagagtgtgatgttccccttcctgtgtccatgtgatctcatttttcaattcccacctatgagtgagaatatgcattgtttggttttttgttcttgcgatagtttactgagaatgatgatttccagtttcatccatgtccctacaaaggacatgaactcatcattttttatggctgcatagtattccatggtgtatatgtaaaagatatcttatctgcaggtacaactgaatggcttgtcaaacagcttaagtcagccgaccaatctaccactattgctgctctttgtatttaaaagttcagccgagatgatatacctaaataatagacattactcaactttccaaaatacaaacgggtatccaccaccactccactaaagtaaatcaggagcattctaacaatttaccatgttgcccctcaaacacaaaaacttaagcaccgtaaggactagaaccttcttacttttgttttctgttgtttccttgacactttacaggatacttaactctaaataaataaataaataaataccttgttgaattaaggataatatatgtagtaaattttggagggtagagaaggaatactaaaatatattttcactagtggaagataatttccattagtttctgagcttaccatggttatctcaaaaatattttcatttgtctagaaattttgctcagtattttttaatccacaactcagccacttatatatattcctagtgcatgttggctccatcctcaaagtatagtttaattgaagttctgtttccttggtgcattaattagagagagataagctggtgcatttttagtttgggaacatgtctctagctatttctcaggtgtttgcgcttggccaaccctagtgacattttcctatgttcttttttcacctaagtgtgttctccatatctcttaaaccagatagtattttgagagacatttaatccatctggtttattactttagctcatacacatcacattttagcacttcagtgtatcgtaaatgttctttgattcaaaagatactcagcagcttagtgaatatttaaagaatcctactctgggagaaataatatttggcaatttatgccaattccataattttagcattttgacttaatttagcatagaatttggaatccacaggagtgttatatatatatttatggtttcattagcttcaaatcttgtagtttagctactacaggttactagactattttcatttgctaagaaaaaaaatgttgattactcttcagcttgaacttatattgcccccagatgcagattaaccagagtaaaaaatatcagtgcttcagtaactgatattcagaaaaataaaattaactttctctgaaattagaagcttttaccaaactggaatatatcattgtgtcaggagttggacgaacattctatagtttaattgttgggactttcagctcagatagctctgagtttgaatctagactttgttaatttaatagatttgttatctttcacatgcatcacatcctttctatacttcagtatcaaatctgtgaaaggggcatattaagagtatgtatgttataaatttgttataaggcaaatatgacatgatacgcataagttgcttaaagtggaaccaagacatggtgcttactgaatgttaactattgataaaatatatataagcttcttaacagagtacctggtatatgctcacaaaagaagtttcagattatgaaatgtagtttcagatgatgaaatgtcatttcttcccagtattttacattcagcacccctcctcaaagcggtttttgtttttagtgtctcaaaactggcatttttctctgttttaaccatagtttctgttattattgcagctaagggaactaataagatagtgtttcaatggtttcggggattcttatttatagtccattcttactgcagttctttcccccacagtgccactaggttgatcatttaaatgcacatgtctgatcaacctcattcttgttcaaaagacattgatgtctctccattgtctattgcatatatcatattggtcatcatgccattcagtatcacccaacttgactcacatcagcatcagtgacctccccaaatcttcttgaaggggccagcaacactgggtctctagacatttctccaaaacaagataattttttacacctgagattatgcccagcctacctccacaactcataactcagttatccctctatctgtgttttatggtctggttgtcttaaaagttttatgacctattttgggaggagttgaaacaaatccgtgtggcctcgacacctctttcatagtgagatgagtttgaggagcaatacaatagatctggacttagaaggcagactttacagcctaacaccacaacctattgggagatggacttttgaaaagttctgtcgattgtttcagcactgattctctcaactaaaaaagggagctatcacccgttttctctccctcacaaggtttttgtggggatgaggcactgttttggttttctattgctaccatatcaatttaccacaaaacgtattggcttcaaacaacataaatgtgcttttcttatggttttataggttggagttccaacacaggtgtcccactgggctacaaccaagatgtttacaggacggtatgcctttttggaggcttacgggagcaatccatttttttgcctttttcaccttcctgaggcctctggcaggtctttgcacataatttctacatttcagaaccagcagggagatagtgttgtgtccttctcatactgccttcactctctgagcactgccaggaaaagttcttcactttaaggcctcatgtgattagattgtgcccacccagaatgcaagggcggggtcatggataacttttggagccaacctaaaagtaacatttgtccacccaccaaaatgtttagtgattgtgccacccctgtgatgtttcttttgaaacagatgaaagttcaaaactctctgtgtgtgagtatatgtttgtgctgagacatttttaaaaattgcttttgcttcgagagcaaagcaggagacattaatgtctctgaaatgatttcacaagaaatgatagtgaagtgaaaaagctattttatttcttttccgcaatttctactcaacgtcataaacttgagaatttaattccactagtagagaataatttggatcaagtcctcagatctatatgatattggtatatcagaatgtgaaaacgcttagggatgtcctcaagtcaagaaagactctcctggaggtgtgcaggaagtgacaggacaatggctcctctttgcatagatgcagcatgtaataagccaagtactgcaagtgttgtgaagagttttttctttatctctcctatatttaacaacaagattgcctagacatagaatataaaatttacatgtggctgatgcaatgattattccagttctctttgtggattaagttatatattgttgggaaactaacataaatatattctgtatccatcagtggactgaattttttcacatcagttttccgctgctatcattcagatgtccttaaattatggactgagttactataccattaattgtatttaattaagtaggaagagtcttctaagatgaattaaaagagtgttagctattgttgaaataatcaatgcatagaacacttaaacgaaaagtgactcttcatatcataccactctttaaaatcgtagccttttctcctttaaactgatgaagaatttcttgtgaatatgtgtaggagagacaaaaaagacaaaaacaaatgagctccagaatacattttagttcattgaccagtatgtcaataaaattttaataagattttctgtcttacaattttggaacttgaatgatagattagggttctgagaccatttttctagtaatcttcttttgtcctcagtttcttcattttgaaatggaatgatcataaaatggttttaagttgccttccacttaaatgtgatgtcttggaaattgaacagaggtggcttatagcgattgtacataaatgccttctactgttaagtggttaattagtatccctgtgtttgttttatgtcttccttcccccccaccgaaccttttcccaaataaacaaatttatttatttatttatttactattgctcatatacttcaaaagtgagttaactaattacttattaattcccaaggatttttaaaaggctctcttaatttatgtctttatgcttcaaacattatcatacattccttagtctgtgctgtactttattattaaccaaaaataaactaccttaagtagtttataattgtgtatgtggagctataattttatatgtgtgactataacttcccctagcagattgagttgtaaaaccatattttataaatcttagtacaatgccactgggcatatatataataagcacattctttggttatacaaggcatgcttcttgtcatacaggcttatgatctaaatctggtggtagactaaggaactgaatctgcttgccgacatcagtgtgctaacacaggataaggaaagggcaaaattacagcaaactttctcctgtgatagacattatataacctcaaagcgtaactatcccatcagagcatcctattctatacacagatgttgggcaatgaagtgaaattaacaggcaagtagcagaaatgttctgaagacaaaatgagttactaaacttcagttattaaatctcaataaatagtgaagaagaactgttggtctggttctttaaaaaggatatatttaaatatataaacaaatgcagagcctactgctacacaatttgctgcaatttgtgagcaactactgtgttactatgtagccacaatacctctttcaatggattagtctaaggtgggaaaagtttgtttcagacactaaatggtagtaccaggatacaaggtttgcctgacagcaaagctcctcctctttcctctgtcgaagtgagtggattctgcaaaacaatggtcattataacgaatcaaaggatatctttggtacttgtgatagaagagagtgggagacaagactgtttttagggagagctatggggggtagtcatatgaatcacattgaattaaatcattaaggcaaatgttttatacatgtcaatttatggtccaggttctctcactaagaagacaggatgaggcttccatttttactagtatgatggattagttaccctgagcacaactcttcttactgaaacaataagatgctggataaaaatatttctaaaaatctgtttaaatgcactttggggccagcacacacacacacgcacaacaaggaatccaaacagtaccacaataaagtgaaagtgggacccatgggagtttagtggacacccagtctagctttcatcctgagggtttatgttgaactcttgtgtcctggagtttcttctttgaaggctgcctgaagcacagagaacagaagttaaaacttagagctggctggccagatgtagggaagctaatatgagatctcaacaaaaagctggattttcaaaggactgtagcctatataaaggtgaatgagaaagaagtcctgtcacagaagaagatagcaaggaaacttttctgtcttgatcttggtactaggataagggggacaggtgtattttgagaattcatgtgttgaacccaatctccaatgtgaggacatttggaagtgaacctttggaaggtgattaggtcatgaggacagagccctcctgaatggaattagtgcccttttaatagaggccccatggagatctttgctgtttccaccatgtgagattgtagcttgaagatggccatttataaatcagaacatgggtactcaccaaacattagatctgctggtgccttgatcagggattttcctgcctcccaaaaggtgaaaaatacatttctgttctttgtaagctgctcagtctgtgatattttgttatagcagcctgaatttaacagaatttttgaagagcccaatcttaaaatccagtaatcccaaataattcaaaggagaataaattaaaaaaataattacaactaggcataccataataaaactatggactccaaatacaaagggaagatttttaaaacatctagaaaataatcacattattaaattaccggtaatttaattgatgtcagacttctcaacagcaacaatgaaaacaataagaccgtaaaatagtaccttcaatctactaaaagataacaattattaacctagaattccaagtgcaggaaaattatcttgctagcatttggtcaaaatgaaagtcttttaaagaagtgagagaattatcaataacatatactcactaaaggaaaatctaaaggaagtgcttcacataaaaggaatatgattgcaactggaaggtaggagacttacagaggtaatgttagtaaagatataggtacatactaagtatatatgagtaaatattgaatgaataaaaattataataatcctaattcataacgatgaaaagagtagactaatgggcaaaaaatggcacatattctaagaagagatggtcagaggtgttgatatctaaggacttggtatcatctgaagaaagataaagattattatttaaatgatggcaaataaagtatgcattctaaaacagctaaagtaatcactaaaagaataaacacaggtaaactttctaaacaaataaaaatgaagaattgaatggggaatttattgaaatctattgttttaaaataggacaatgtacacaaaaaggagagaactagaaaacataaaataagtttgtggaagtagtaatactgaaagcaagtttgtagaaataataatacacataaattgactaaactctccagttaaaagaaaaagatttttggattagattttttaaaagccagccatgttctgtgttaacttaaagtataaggagacagattgaaaactaaaaaatggaaaaatacataccatgtaaattttatccaaaagaaaggtaacatgtctgtattcttagcataaacacttttttattcatcaaaatatttataaagagaagaaaagacatgtcaagcccagaagaagttatttcaacaacataatgagcaccacaacaaaaagattaatttaccaaatatgtaaaaaacttatataacttaaggaaaatactagcactcagtagaagaatggactaaagaagtaagcagacattttacaaaagaggaaatcaaaattattaataattatctctataaatattaaagctctttagaagtaagcaaagtgataattaaatccacattgagaacctattataaaaccaccagattggcaaacgctacaaagttagtcaatattgttggtatgtactactggtgtatgagtgtcagtgaggatgtggtgcaaagggacccttcaatctcctctgataggaattcaaattgatagaaccctttggaaaaatgtttgatattacctaataaatattggtagtttgtacattatactgcctaaaaagtctacttctaaatgtaaaacctatagaaatttttgaacctgcaaagaagatatatataagaacattaccaacacaaagaaatgttaaatgtttgagatgatgaatatgctaattatcctgatttgatcactatatattacatgtattgaaacatcactatgtaccccatgaatatgtataattattatttgtcaattaaaaatgaaatgttaaaaaagaatatacatataacggtaacatttgcaacagcatgtgtgcaggtatgtgctcatgcgtggttcacatagtcacacaaatatacaccaaaaatgagaatctacccagaaatccattaacagtagaatggataaataaatgccatatgcatcattgaaaattgatgaaaaatctacaggtaaatgtatcataccaatccaatatcaaaagcatacttttgagcaaaaagaataaatcataaaataatttctaaactatgaatcatttctgtaatcagcttaacatatgtgtttagcgatacagacataggtgctaaaactacaaagaaaggaaaaggaatcattaatacaaatttcaggatcatccttacctgaaggaggaagatgagatgataaaaggaaaatgggggtggataggcacacatggggacttctaacttactggctatattcttagtcttgatagatattttcattctttaaaaatatatgtgtgtgcatgtataacatgcataacataaatatatgtatgtgtgtaaatatataaagacaaacctaggtgacaattagacattagttaaagtatattccaaatttatcagagtagaacagaagaagatccagttgcttctccttcctcttcacttcagtgtgatggttaaaaacagaattacagtttcggggttcagtcaactacctttgtgattttaggcaagttacttagcatctctgtgcctcagtatccttatctctaaattaaagataatgataatgtctaattcatgaggttgttaaaaggcttaaatgagtttacatttgtaaagcacttaaaacagtgcctgatatagaacgacaactatacgttagttaaataaaatttataaaagcatatccctttgtcttcctaattgtagttctatatttacttctcagaatccataagataacaaagagaggaaaaataccaagtggtacctggattggtttcacactgaatatatagaatgacatggcggagaattgatatttttacaatattgagttttgaagttcatgaacatggtctatccctgtatttatttcaattggtcttttctgccagtaatgtttataaatttcagtgtggaagccttgcacattttccactaattgtatttctagttattgataaatgcagtgctatttaaaatatatcttttatcaaaatgtcatttctaaatgtttgttgttactgaatataaataacatttgcttttgtatgtggcaaattcaccaacccaacttaaagcttttctgtagattctaattgtttacacaggaaatcatgtcttttgcaaatagtgatgatgttatttatctccatatgaagggattaaaaaataaaatagggatggagttatatttttaagtcagtctctgccaaaataaagcacatctagggcaatttgttagtgtggaggctgctttaagtcctccctagtccaataggactctctttcttgtggtgacatatgtgtgtgtaagtgttcaattactactattatttaccttgaaaatcaaaagtaaaccctccctaaaccctgatagcattcattataaaatttgcatggtgaaccatgaatgttatttgaaagaatgcaatagcatacctgttattttcccactatatcttgataactcactctgtgactcagaaattgtcttttctttttgtatcatcttctctataatactcggttgtttatgtgcaatgttctactttttttttttttttttttgaaacagagtcttactctgtcacccaggctggagtgtagttgcataaacctccactccccaggttcaagtgactcttctgcctcagcctcccaagtagctgggattacaggcatgcaccaccatgcctggctaattttgtatttttagtagagacggggtttcacaatgttggccaagatggtctcgttctcttgacctcgtgatccgcccgcctcggcctcccaaagtactgtggggattacaggcgtgagccaccgctcccggctaattttgtatttttagtagagatgggatttcaccatgttggccaggatggtttcgaaatcctgacctcaggtgatccgcctgcctcggcctcccaaagtgctgggattacaggcatgagccaccatgcctggcctaagtgttctactttcaattgaagtaatttgcccaattgagcaaattatcattcctgttttgttatatttagctagctgatggtaaaggacatccctatgagagcaacatctgtcaaagtattgtactttgttttatgaagagactggcttttaggaaatggtgaattgctttcttcttgctttttgtggtgggaggcactagagagtgtaatagagcagtgtagattgatttgtatttttcttttccacttgtgttgggttttgtttcactattatattataaaaaccaaaataatgggagttttccacaaatggaaggatgtgacaaatataggtgtgattcagcccaagataatgatttcgaatatgaagaaatcctacttgaaggacttggaagtcttattacattacttcatcattaaaacgacactaaaatttgatggtagtttcctctaagcactgttttaccatccttaaatattgaagtactagaactctaatatagaaatattagaaacattaaaactagatagtaaaatgctttaacaacagcaacaaaaaagcattacaaaacaatagtataacctaacatatgcttcatctcttcatgaacacctaattattactctaatgtagtcacctctatttatagtcagctttttatcgtgcttaatagcctttctcgttaagtcccctgactgctttagtcttcaccctgaacagaagtctcctaaaattgaggccaggtgatgaattaggccccttggctccgatagtgaactagtagagtccggctgtctaaacagctattcctgttcaattgcattagtgtgtttccctccagggtgataattgctcagaactcattgtggctcatttctttataatgcccataacagtgcttttacaagggaaggaattgcatattttagtgctgtgataaaatgcaagaaggcatgctgctgtaatgtggttggccccatcttgtgtacagctatgaacatttgtatttatgacagccatttcacacttgtatatttgggaaatggtgaaatgttgatgtgctcatataccagaatttgtgaatctttcatattctgctaagaataaaaaatacttatctaatttcaaacatttctttgaacagtgtctacctgggggtgtgagggaagcaaagtagttgtctacctcctcactctgtaaagataatacgcatgttaatttatgctggtagtttgaatgaggcacagctgctggataaccatgtgatccatctatttcgcggaggatgccgcatttttattcaacagccatggagcaatagaaggaaagcttccattttgtacattttttacaaacggaaaataagagaaagggaggctcacctatgaatactaaattagggaaagcctatcaccgtcagtgatcagaatgttcaaacttctttgtgttgctcattgatgcacaaacaaaccacatgaatctctatttgctcaaaccataattgaaaccatcaccccagtcataaccagttataggatgcttgccttaaaatatgctctcacttgtcctttgatttagaaatcccacagtctcttctgtttttcgtttatctacccaagtcacagacattctgtggcgctggtgtctttggggcatcgtttcctttcttagtttgctgctcttcaaaacctttgcaatcataaaggagcagcatcacctttatttgaagctcctctccactgaacaaatagatatgggaaagaaagttgattttagacatccaattaaatcactctcttacaagggaaattactccgtggagtgttaacgtgttagtctattctcagcaagtcagttggcaaaaaggaagccattttatctttgggcactgaggttatcatttgggcaaaaatactctgaaggtagggaaatgttgtcacaacaaaaatccaaaaggtcatcacccacagatacaggtcataaatttttcttaggaaaactgcattggtttatgatgaaggtgatttttctgtcatatatttctgtgaaaaataagatagttaagggagctcttatgtacatatgtgtaattcataaacttattaaagaatgaaaggtacaatctgatcaattttaaatttaagcaaccacatttgccatttcagagcccatagaaaggtaacccaggaaacagatgtaaactggcaatcgttaatgctgttatatatcttcaatgccattaccagaaataaagaaaaagaaaacacaccatcctaaatctgatagttctgtcctagtaacatttctttttcagtagtttagtatgattaagagtagataagtcttggaaatttgaaaaatcttaatttccagtctttctctaatgtttcagcttagacaatttagttaaaatatctgtgcctcagtttcttcatctttgcagcaatttaagagcccgtatcttggcattcttgattagaggaaagatatttctgatacattgtaaacactaataaacagtagcaaatagaatgtgtgtgtgtcaacaggatagagtttatcttcaaaccattttcttctgcagtgtccttcctcctggggtaaacaatgtttcaattagctttctgttgttttttttttttttttttttttttggtaaaatattagatgacaactgatatacaaacaacgtgcaaaagctataacttcttttggaagtgagggagataaatacaatcttatgcctgagatctctgatggttttctcgaaggcgttgtcactgactgggttttgttttttgtttttgtttttatttttttttcactagaggacaagtttctacacctctaatcagactggtcatacaaaaaaaccattccattgtcaaaatggatgaaagcagatggctgaagaattttgagctttttttatttattgtctctgttgtgctgaactaaccaaagggtaaaacattctctgggaatctctagcttcaagccttggttgcccttgcatgcacctttgaaaatgctccactaacagaaactcctaactgatggagccaagttccagatctgtggtttaagatttgcttcagggatcaggttgctcaaacttcctacagctcttaggagctcagagtatgaaattcatctttcaactcacccagaactaatgtatttgccccatattttctgaacaatggctttatcttggagtataccatatttgagacttcttgattataaaattagaaattatttatgtaaataaaaactcaatttttctgaacaatttatgaaagcccatttgaaatacaacataacctaatgcaatttacataagacctaaaaaggtctactctaatttccaggatataagaggaaataacagtccaaaatagagatgggtttgcacttgcattcctgtttcaaaacctagcaaatgcttataaagcactgccttgtggccagcactcctctatgagctggacatatattaattcatttaatttttttcttttctttttttttttttttgagacggggtttcactcttgttgcccaggctggagtacagtggcacgatcttggatcactacaacatttgcctccagggttcaagtgattctcctacctcagcctcccaagtagctgggattacaggcacccgccaccagcccccgggtaattttttgtatttttagtagagacggggtttcaccatgttggccaggctggtctcaaactcccgatctcaggtgattcattgcctcggcctcccaaagtgctgggattacaggtgtgagccaccgtgctggccaattcatttaattcttaaacaggcatatgaagcagatgctattgttttactctttttcaagattaaaaaaaaaaaaaaactgaggtatagacagaggaattaaattggtcagattcacacagttgctgagtggcaaagctgggactggaatccaggcagcatggttccaaagcctgcactcacacaactctgtagatttgtatatttgcattatttagttgtttccagtgtgccctgtgacagcaagaaataaaggatcagaacttaaattatggaggtgatttttattcattaatctgttccttcattcattttttggtagaagtccttgaaccaaaaaaccaaagttaagatcttgtaaaaagatttattttcttagctccttattttagtacatccagggaactgtggaaagcaaaatgataaacgataacttgaaactatgtaatatctaataatataaaactgacaggacttgaagctatatggtgcagagattaagaacataactttggaaccagtcaggccttcagacaagttacttaacctctctgggcactaattttctcaaactataaaatagggaaaataacagttttcaccacataaaattcattcaaagaggaaattaaatagtacgtatgtagcaagtatgaatctctggtaggcagggcctatattcttcactttctacagaacaacttaatttcttcttttaacttttattctcttgactggtggcaaatttaaccttagtcattaggggaagtactctcttccctatagtcttgtcatggttccattaggttacgtagttccaaggcattttgagagcagtggatgttcctccaattatatttatcattggataatttaaattttctcagtcttccataaagtgctttgtaaatccagatgaaagcacagcctctcatccaagctgggtttcctgagcccatctatataaatgttgcatggaggtggttactgaggaggggtttacctcagtacaccactgaggcatccatcattcctgtctgtctgcttcttctggtctactggccttttgttgattctgtaccatatgtggcactctctacttaaaagcccttctcagccattttctgtctcaaattggaataaaattgatggaataaaattggaggtttatatggtggggaaagaatacaagtacatgtgagtaaacagaaagcagagaggggtacagaaaccatgaggatgaggggcctggcatctcattgtttgggtgtggtggtctggtgagtttcagtcccttgatactatctgggagggctgagagttgatttcctgaggaaagaacccaaattaggcaaatgtaagcttgaagctttcgagaaagtcagtttctatgtttatttaaaaagactattaccatcagttctatgggccagtttcaaaatatgataccaaaaaacattactcaaggatttggtataaataggttagtattcagtaagtgcttgctttcattactactagtcttgctgtcattgttattattgataataggtgaagaacacagggaaaaacagaaccaccacaggccagaagacagaagaaaaacctatacctttaaaactaagcccaaggcagagtgggtccactttctgtctctgaaggctactgatgcctagatgactattatggtggttcttggctatctacacccgtgctgcaggtggggtgatctccctggacacctatttttttcacctttcatcattcttcaagcttatatacaaaaatagagtgttatggggccattctgtgaataagacactctaatgccaagggatttctgctttctgacaaagtatacattaaaccaaataatgattaatattctttattgattctaattgattatgactttgttgaagataatgaactcaatgattagtaatgattacacagctagttagaattagaactgcatcgataaatcactctaataacaagcaagtgccttccattataacaattttattatgtccaaaaaatcattttcataatggagattcatttaggtcttcagcaatatatattgagcacctataaaatgtcaagaaccattctatggactaagtatatgtttgtaagccatagagaaaaatctcagccttcaaggagcttacatcctagtggggaagatgagaaatcagtaagataaaaaagtagcatgcatagtgtgttagagggtgttaaatgcaaacgagaaataataaaacagaaatgggaagtttggaatgtgtggtcaaggtgagattgtaattttagacagagtgaccaggataacttttgagtaaatcactgaaagaagtgagagaataaaccacacaggtgtcagggaaaagagatctccaggcagacaggatggaacatgtaaaagcgctgaggcaggagaatgcctgctgtgttcaagaatcagcaaggagacctagtggagggaattgcaggagaggtacaggagagaagggggtggtgagacaaatcaggagactggggccatttgcaggaggggttccttttactctgacatgggaagccactggagaacatttagcagaggggtgacatgattttattatattttaagaggattactctggcttttatcctgtaaatagattgcaagggaacaagggcatggaaaagtctctaatatatgagctattgtagagaaaattttgatatagttgagacccattgaattctaattctataaattctccttttcctgtgctgcagtctgagaattttgagcagtgaaattctaacttctacatttgtacttacatccactcaacactcaataattgtgctgagagtaatatgtgtaagatgcagttcttggccctgtgagaaatactgtgatgaactagagaggactgcccgcaagaaattctcatttcagaagctgtgatataacctgtaaatgttagacttcaagaacatttatagagatggaaaaatagcataaaagattggctacagtgatgtggttattcaggtctctgagaaaaactctgaggccaaaaatgtcatctaaaaagattccagataggagaaataaacagataagctgtgatacaatctcgtcttgttttacttttctttcgttccttgttttcatttttcttttttactctctttctttttactattatgcaagaaaactaagcatgttgacatccattactcacagccttaactgatcactttgccaaatctctaagtttacagatgactacctagtttccattttgaattatcaaggaattaacacttcaacaatgttagttgcacctgatttacatgtttgaatccctcagacctcgagggaagtatcttagtaacaacctaggtgactgtcatagtcattgagatgtagttgaactgtagctgttaaatggaaaacattctaccacattaatagttgaggtttaaatggcaatttgaggccagcatggtacatgacgcccgtaatcctagcactttgggggccaaggtaggtggatcacttgaggtcaggagttcgagactagtctggccaagatggcaaagccccacctcggctaaaagtccaaaaattagcagggcattgtggcgtgcacctgtaatcccagctactcgggaggctgaggcaggagaatttcttgaatccgggaggcagagattgcagtgagccaagatcacgccactgcaacaatccagcctgggtgaaagagcatgattccatctcacacaaaaaaaaaaaaaaaattttgaaatggggacagccttaatatccatgctttgtttttttctcttcaggctgggttgagggtctctcctctgcttgcctgtcacccagtaagtacctatgttagtggaatgtatcaaaattaactgaaaatttgcgtgtgccactctgccatctctttgagggcagagccaggtgttattcacacctgtttatgaccaccacagggcctgacagacgttagttgttccataaatgtttattgcattaaaccgttgaactggctgtgactatggtacttaggcgactttcttatggaaggcaaatagacattgaataatcatttttgaatgccaaatatttatcaaatatcatgcactcataatccaaggatgcatcaaattccattgccgtcctggaagagcccaaagtccagtgggggagagagacttgaaaactcataattgtgacatggggatgtgactaaacaagtttaatctgagatttagacagcacagggaagggctactcatctctcttgaaattgcagcaggattcgctgaaaaagtttaataaagagcttgaagagtggaatttgttttgtcttctaaagaaaagttggaaacattacaggaaatgcacaccagatattgaaagctctagaggtataaaagtaaaaatgctgtcaattcctaaaatagtttagaccttgtttgtgagcatattgggtaagtgggatgagagcttaagccaaaagctaaagggatttatcacatatgagaatgaatttgaatgtatagattagttgaaaagaaatggaaagttatatagaaatggtaggctagaattgtattttagaaaggtcattttggtgacatatggagggtagattagaaaaggaaaagaccaaaaactggaaaaccagttaggttaataacaagcaacgatgggacctcacattgtgtattgctgtggttggaaatgtggactctggatcaagtctacctgggtttgccttctggtctccatgaccttgagcaacttagttaaccacttggtgcttcagttttctcatctgcataaggagaataataaggaaagctctttaagggatattacaagtattaaattaatgaagcatataaagttcatgacaaatagtaaccatttagtaagtgttgcttgttataattaaaaacttattggactatcataaacattctgtgaggaagatgcagtgtttacactcattttatagttataaatactaaggcttctagggtttaagtcactatgatggctaaatactatatttcgtacatttgcatatgaagtacacatacaagcagtcataagacagtgggtaaaataagagtttattatttactaatatctatcaatggatcttgaatttgatagatttattaaaatcatgcagtcatgaagctctcattccctttagatttttgctacaaattcagaagtttagagtataactgaagcaaccacagggcatccgtagaaaacgaggtttgagactatacagcagaaaagtatagactataaatgataacttttgctcattggccttgctctgcggacacaagcttcagtctgcctgactctgtacctatatttctcctgtcaactgaagagatactctgtagactcttagtttcctaacatggccatgttaatacattttacaaagttgcatatcttgtcagaagaaaaaaatcattacatagttaattcctagtcttctgtcatactaacaggccagataaggtctaaggtctaagaacttgtttgtaaaccgtatcatctatgctactataaatgtttgtttgtttgtttaatttaaacagcacgtgacaacaccatctgccagcttagcaaatgtcctatgtccctcatggttcttttaagacaggtagttctttgttacactgttactcagatatgcataatatcacttggttaaaaaaagattcaaatttcagaaccatctgtgctttatcaagcaatctatatgggtgagtttctgatgtgcaaactatggaaaatggcaattttgaagcacctatcagataaattttcaggaatgtgatgaaggagcagataaaaatctgttttccttgtaggaaaaaggaaatagaataccctgtggataagtcctaactacctcttaataggtgttagacttccccagctcatatgggtttaaggcatcacaattcacaaagtaaaagtttattttaattttcataagaacaatttatgtgtgtagcagagggaatgagaagctatttaacattggagaagtgcattaaaaattattcaatatttatttagtagtattttgtttaaactctccttttggatcctgagttccatagcttctagtacgcagatgcctcacctcagcaaccactcctgtattcactcatctcctcttgcctctgtcactgcccagtctgggagatctcctaaaacattacccggatggtatggaaaacaataagccatagttggcaaatatatattaaactttgaaaggttatttttttctttatacagttctaaattttggttcgatttttcagggcaatcataagttacattctaattaaaaataagtctaatatagaaaaaatctatagttggttatttcaaatggccaattgcttctgatgaaattgctctataaaatagatataagacctcctgtatcactaaatcttaattacattgtggaatgtggaaactagcactactcagtagctgtagaaaaagattggacccccagtggggaaaggatgctgaatagcagctaccatagccttatcatttttgcatttttgtgataaattcttgagtagggcagcatctaagtatagtttttaatttttagttgcttttttaaaatctatatctcattcagtgttacctaatatttaataacaatagtgtttgaacttgtctgtgccagctatataaaatggtgaataaaacaccattccaatctttaatatgtttaaaatctaggtataagtcatttacaattgatatctcataatttttataatatatgtgttgatagaaatcactgcataaatttcaccatttatgcagacaggtccacatccaaattatatggacatataagctgtatgtatattatatagctatatacgtggatgtacacatgtagatatagaaataggaatagatctagatatgtacatttacattttcagaagtcattgagacctatagcatttgttttttttcaagtgacttcattcaaatatgttaaattaatagaaagatacatgctttctttatgttagttaaactttacatcatgtctatgtatttattaggttcatgtttgctatccatgtctatttttaacaacggaaacaaactttggaacagtttataatttaaaaattaccctactcttagaaatattagaatatagaaatattattttttatgcttcatttttaatactgttgtataccaaacttgtttaaataagttcaattcaggacacatagcacataccattgttgtaaaatataccaattttaaagtaaatacatacttagaatttttaaaatggatacactgaaacaaatagcctaaaattggcaatttattttgtaataagataacagaagggagtttaggcaattttatgtgccttttatcaaaaagcccagagttattttcctacagaaaaaccaccagtgcaagtaattagtagattgtgctttactgaccaggctgctttctaattctcaccatgatgctactccattctctacgcatttacagggctgtaattacgtatgaggctttagactttgccaggccagcaaggcaatcagcccccttggaacaagttgaaatggaaagcggcaaaacagtataacacctgggtgatgtcacaccagcaaaacccatggacttagtggagctcacctgtagccaggggactggagtctgaaactgacattgtttccttcaaacagaaatgtgaaatgtcattttcagtaaatcaaataaaccccatcaagaagaactgaaaaataaacaaaacccaaaactccgagattaaaaagacaaagtaggaggcaataccattatttctagacttagttatgatttttattctgtctacttgattgttcacacctgaagcaaaatatattttgcataacttaatgtaatattttttgaatccatcataacctgtgacccataatactcatgatgattctttatataaagaagcattctaagaatgtttattgacaaataatttcctataagttttctctaaaatttttggagtataatttatctgttaggtcaaactctatatatgtgactgagatatggctggcttctcacattatttaacccatatttatcactctgctgcccagactggagtgcagtggcatgatcttggctcactttagcctcgacttcttgagctcaactgatcctcccacctgagcctcccaagtagctgggactacaggcacacaccaccacacccggctaattttttgcatttttggtagagatggggtttcgccagcttgcccaggctggtcttgaactcctgagctctagtgattcacccacctcagcctcccaaagtgctgggattacaggcatgagccaccataccaggactgatttaattgaactttttgccatgacattttactacttggctagcctctccctaagaaacgtagctgatttgaaacagaggtagagacaccttcaaggtattaagacattcatacagacctacattactgtaatgttgcttagcatagtgaggtaacataaaattggacaagagagtatgggcttcagttgtcaggtctattcagataaagatatggatgtggatataaacagtgcatggatatagatataaacatgtagatatatagatgcacatacacaattcttagatttaatgatcatatctttaaaatgcaagggaaaggactacctagtcatccttctcaggctttatctttcacttctgtgattagcaaacttgaagaattaacgaagtccaatctagtgataaagagattctataaagatagaaaagacattttaacattcttagaaactttcaactctggcaaaataaaatgttaaatcacaggaagctttgccaacaaactgtctttatgatatattttgaaagggtcagaatggctgtcagaactctgaagaacagtgcagctctagaacctgttactcctgctgagattgtcaagcaaggacaaatggatgtacaggatcctgattatttatctatgacaagaaaattgcttgattactttcagaaagttaacaccgttttcatgaaagatatcaaaaatgctaattgctaccactctttaggcttctatttcttccaatgtgtgggctgttggtaagaatgtatttttcagccaggcacagtggctcatgcctgtaatcccagcactttgggatgccaaggtgggtggatcacctgagttcaggagttcgagaccagcgtggccaataatatggcaaaaccatgtctctaaaaaaaaaaaaaaaaaaaaagagaaagtatttttcctaaacaacatcacaaattatggtctacagaatcacttgaatgctctagataatggtataatacagtggatatattaaaatttttacacagaattttaagaaatgtgttgcttatcacaataaagatacaataaacttctctttagacattgggactaatagtcagtcagttgatccaaaatatttttaaagcagtgatagatacatatctgacatatgttactttaattcaaattataaaatactcttgatatagaattaaggactcatttgtgtatgggataactggttggagctttactatatttggcatgaaaaatatctttaatttattgtctatgaatttttatgtgttgatttcttcacagtggaataagaactttaaaaagacttgtaaaataatttgggaagagaatccttttatatcttaattattgtttttccactcatcctttagaaactcatgttatgcctttatgtagtctttttaatatgcttaaacttcattttcattttttaaaaccttatttttccactcataagtctatcgtgtatgtaataattaaatcatgtaataacaagtaaaattgatatacttgcatttgtgtttacaacaagcatcgtgtaaacatacaattctagtgatgagagccaacacatgcaagcacaacttactgtaggtgtgcatgaaattcaactgatcagagcagaagtatgtgtaaggactctgggaagcccactatctgtaagaacatctcctacatgatatttaactcaagacatcagtataatattcatatttgtaagtagttctgtgctttagagagttcctaagcaaattggaccccttaaagaaatttagcattctatttttttctcccaatagtagtatcagttgcttcagagacaatgtcttaactttttgccattgccaatagaaggaaagtcgttaggagatagaagactgacagcacagcagcaatggaatatcatgctgagcactatgtgaagtagaaaaaaaactctattacttacatatttttattagctggtattttgtgttgttttatcacacataccaatgaatgcactgaaaagaaatgatatgatgagttcatggaactagaaaaatcatacttcaaagcaaaatataatgaaatataaacatatatacacatttgtatatattataacatatatattttatatatatacacatttattctacatattcagtattgtatgtgcatataaattttaataccactgctgaagtgatatcataatgttcaaactttgggctctagacaaatcatctttaccaaataacagccatgtaaccttggtcaagttaatctttctctctgcctcagttttctgatcttaaaaatggagataatatttcctaagttatactgttgcctacttcattaaataagctcatatgtataaaatgcttagagtaatgctattaatattaatagtagtatgtaaaatatgtgcacagatagatagaagaagcatgtataaaatttagcagttgaaatgctttgaattttcatgtttaaggtaccttgacagaacttaccattttgtgcctgtaccagttatctaagctgcattaatagtctgtggtagaacttctaaaactgatagaaaatatcatgtcttattacacttacccatggaaagccacagtcacctctgtcaacaggaaaacaaatattatgactacttcttttcagagcagcatctccgtatctgtgttgaattcaatactagggttacttcaaagggcacaggagacatggtatttaccataccagaaatagcatacctcatgacaaattctaaaacgtccctgcagccatctgaaatgatattctcttgtagttctggtggcaatttctttttcttttctttctttctttctttcttttttttttctttttctttttttttttctggagacatagtttcactcttgtcacctaggctgtggtgcaatggtgcgaactcggctcactgaaacctccgcctcccaagttcaagcgattctcctgcctcagcctcctgagtagcttggattacaggtgcctgccaccacatttggctaatttttatatttttagtagagatagggtttcaccatgttggccaggctggtctcaagctcctgacctcaggtgatccaacggcctcggcctcccaaagtgctggaattacaggtgtgagccaccacatagggcctctagttgcaatttctgagatactgactcccacagagactgccagtacatggtagcgatctcaataacagttctgctttcatttcatctcttgattggcctttagcagtcagagtaagtgaggctgtcatttcatctcccatccttatgaaattgaattttacgaaagagacgtcacctagagtttgagaggtttgattgacaatctccatatagctgccttgctctagtcagagacactgtcctgaaacctctgctgatgctttcacttgaggaaggaaagagcagatgggagggaagggagacagaggagacaccagcatgcaggtcactgtgacatctccttctcctgatgacaacagctcacacgcttccacctgcaatcctattaaatatagtacttgcttgacaggaaacagctgatgatggtaatgacattgttaagtcactgcctcaaatgggtggagggcagctaaaacggagagggcagaactattggagggccattttaccttgttttggattcataaaataaaaatgcaaatgaaacacacaaatatttatcaagacccaaacagaaagctgtctatacattgtttctctgataatgatatatgaggcatatttttggaaactttatcagcttttcagaaaaaaaaaatctgtatttttacctagttgacaaatttcaaattctccagagggcagctttaatatgtttaatatgattctgctgttaaaaaatagcaatcgagttttttctagagaaagtcatttgctatgagaaagcaataccatatgatacatgaacataagaacattgcaagctatttttatttggcttttactgagctctcaatgaatacaaaatcagtactgaacaaatagatgctgctgatgataaacctagcaacttattctactcaatttctaaagttcctgttaatatataggcaacccatcatccctcatctgcttttccatgtattggtaatgttagccacttattgatgtttttgtttgtgtatacttgctaaattaacagtaagagatatgggaatagattggaacatatagatccatggaaagactgtcatttgaacagctacacctgggccttcttgggtgttttgaaaatttctgccctaaaatccatttggctttgtgtccccacccaaatctcttctcaaattgtaatccgcatgtgttaagggagggacctggtgggacatcagagatgattggatcctgggagtggtttcccccatgttgttctcatgatagtgagtgagttttcacagatctgatggatttataagtggcagtttttttctttctctctctctcctgcctccatgtaaaaggtaccttgcttctccttccccttctgccatgattgtaagtttcctggggcctcactggccatgtggaattgtgagccaattaaacctcctttcttatttttttttgagacagagtcttgcttgtcacccaggctggagtgcagtggcacgatctcggctcactgcaagctccacctcccgggttcacgccattctcctgcctcagcctcccaagtagctgggactacaggcgcctgccaccacgcctggctaattttttgtatctttagtagagatggtgtttcaccatgttagccgggatggtcttgatctcctgacctcgtgatccacccgccttggcctcccaaactgctgggattacaggcgtgagccaccatacccggcctaaacctcctttctttacaaattacccagtctcagatggtatctttgtagcagtgtgaaaatggactaataaagtggattggtaccagcagaatacgaagctgctataaagataacctgaaaatgtggaattgggtaacagacagaggttggaacagtttagaggtcttgtaagaagacaggaagatgtggagaaatttgaaacttcctagagacttgttgaatggttttgaccaaaatgctgatagtgatatggacaatgaagtccaggctgaggtggtcacagatggagatgaggaacttattgggaactggagtaaaggtcactcgtgctatattttagcaaagagattggcagcatttttcccctgccctaaagatctatggaaatttgaacttgagagagatgatttagggtatctggcggaagaaatttctagcagtgaagcattcaagaggtgacttgggtgccgttcaagcattcagttttatgcagtcacaaagagatggtttggaattggaacttacatttaaaagggaagcagagcataaaaattcaaaaatttgcagcctgataatgcagtatgaaggaaaacccattttctggggagaaattcagaaatttgcataagtaacaaggagccaagtgttaatcgctaagacaatggggaaaatgtctccaggccatgtcagaggtctttacgcagccctcccatcacaggcccagaggcctaggaggaaaaattgtattcatgggctggtcccagggctctgctgctctgtgcagcctcagcacttggtgtcctgcatcccagctgttccagctccagccatggctaaaagggaccaacgtacagctcaggcctttgcttcagagtgttcaaaacccaagctttggtggcttccacatggtgttgagcttgtgggtactcagaagataagagttgagctttgagaaactgtgcctcaatttcagagaatgtatggaaatgcccagatatccatgcagaggtgtgctgcagagatggagccatcatggagaacttctgttagggcagtgcagaaaggaactgtgaagtttgagcccccacacagagtacccactggcccactgcctagtggagccatgagaagagggctactgttctccagaccccacatggtagaaccatcaacagcttgcaccatgcacctggaaaagccacaggcgctcaatgccagcttgtgaaagcagctatggcaactgtaccctgtagtgcacaggggtagagcttcccaaggccttgggagcccacccctcgccctggatgtgaggcatggagtcaaaaaatatcatctcagagctttacaattaaattacagccctactgggttttgaacttgcattgggcctgtggccactttgttttggcacatttctcgcatttggaatggaaacatttacccaatgcctgttcccccactgtatcttggaagtaactaacttgtttttgattttacaggctcataggtggaaggaaattgccttgtctctcagatgagattttagacttggacttttgggttaatgctggaatgagttaagactttggggcactgttgggaagtcatgatctgttttgaaatatgaaagggacatgagatttggaagaggtggaatgatatgttttggttttgtgtccccacccaaatctcatctccaattgtaatctccatgtgtggagggaaggacttggtggggtcgattggatcctgggggcagtttcccccatgctgttctcatgatagttagtgagttctcacaagacctgatggttttataagtggtagtttttcctgctatctctctcctgctgccatgtaagacatgccttgctttcccttcactttctaccatgattataagtttcctgaggcctcccagacatgcagaattgtgagttaattaaacctccattctctataaattacccagtctcaggtagtatctttatagcagtgtgaaaatggactaatacaccatttcagatattagcatatatcatagtgtaaaactaattctgtcagatgacatgaatatgtctgattcatctcatcattgatttgggtttccacacctcactagaactaaaacagtgtatcacattgctcaatacctatgatactctataactgcttgtagaagtgtgtgatttaaaagcccatggccattcctcttccaaacattaggtatttttttctgtgttatgaatatgtaaccaatttgtgtgttagcttgaccttgtatcagttgagactcctttgtgaagatattggaaattcaaggttaaatggacgcattatattttccaactgttacctgtcatgtactttgagtgaatcatgaaaactacctagaacagctgtcattttgatatgttctggttcttctgagaagttagatttccactgagtaaaattataggctctgtggagaaatcaaaacagtgctccatctaccaggaaggcctgcactgtgatcttttcagctcatttcacatgagtatagggagactttaaacttaataaatgagaatcagactacaaaggtataaaattattttatagtacaactccagataaatgtcatttttgtgcctctgcagtattattattctattaactgcattgatagtagaaactttcagttcatgtttttatcagaaatgttctgttcttactgtgaactagtctgtactgtgaattgcataatttgtagtaatagagtaatagtaataatcatggttattttataaggtcatcatagtgattataggaatttgcaaaccatggagttatatgtaaaaatagttattagtgtgtcttttcaaacttttatttcatctcaagaacaaagaacctattatatttactggcttattgaattagcaaagtatttggtagtaaagcagaagccctaaaaattgtgaaaacaataccataaggttcccctgtgttcagttgctaatgatatgtggttgaagtcatggccatggaagttaaaataacagctctggagttatgatcttggacatgttatgtattctctctcatcatcaatgtgattccctcatctgtgcaataaagataatggtagataatccttgtaaacgcatgatttaaaagtaagcattaacttaaaaacatattatttattgtagtgtacagaatataataactactcaatatatattaataattattatcacagaatgcggacacactattcaaaaaaaaggtgggagatttgtgttatgataaaaaaattaagctaaaaatctaaacactaaaaaaaccctattactgaaaatcaagtaactctttgcgattaggcatacacacacactcacatacacatttataaaacttggcatgtggacacacacaacaaggatcaggaattcacatgacttgttaagctcaattaaacaaaaaacaaacaatatttttgtgctctagagttaactttgtgttactttttagaagaattttctgttttttaaacctcatataatatgctagtcatcagcttgtcttttgatagcatgagtattaactatgaaatggttataaattgctatgcagaatgaacagctgtgagaaataataaatgattctgttatcacaactagagtattagatggcatatttagaattatatataaatgggattattatacaaaatagtggaaaagtcttaaaattaactatttgacttctatgggggcttttacataaacttactgatttaacttcagaaaaatgtgactctgtgtttcaaaaaggtatattaagaaatgccatgtatgatatttcagtaatacaaattatgagaaaatgcacttcttgtctctatttggtttctttgaacttatgccaaatcttctccaatattttcttggaaagctttattgtgatgaactatgtggagacagttttaaaaataaatgttgattttcatcatatgtgaaaggtggaaagagaggaggtggaaacagaggaattataatgtttgaagcctattcttttaccatagtaccacaacagatttaatatatggggtgttaaatcaggcaggaaaacatttctcaagaaagaccccctccaaatacttgaggttatttaggaatatttgtcatggtattatttgcatttgtaaccaatagaataagaaacatttgaacatctctaactgaaatagtctggcaagaacacaaatatagaatgataatgcactaaaacatgatttcaaatttgtattgaaatataaaataattaataatagcatccattttaagatgcaatccaggcatcttaataactaatgtatgtacattatcactctaattttcatgaaaatcttaggacttatgtattataacatccccatattgtagatgaagaaactgggattcatagagattagtgggccgcctgtagtcacatagtggttagaattcaaacatgattttccaattctaaaacttgaagtctgaaccaccatgatatgctgacttctcgtgtaatcagagcaattagggccaagtctctttttggtggtgtttcgttgtggtggcggtggtgatttatttccttaatttttttggttttgttttttgtttttctttttaaagaaaaaccattatatggaaaaaggcagacaattcttagttctactaaattaggataaattattatttttagtaatacctaacaattttattttcttccccttggtgaacacacacacacacacacacacacacacacatacacaccatcctaacaagtatgtacacatatatacacatgcatttgagatactttagttattcaaatgtaactaaaactctttaagtaaagctctgtggtttgtcctttatctttgctcctattttacatgtataatcattgcagactcaacttcaagtttatcctcttcattttatatgtgaatccgatctcttggtaagataaaacaaaattatatctagtatatctcttgcatataatgtttaaaagccagcacatatgttctcattgatcttgtccactacgaacaacacagagaatcttaaaaggagaacactatcaataatatttgtagagttttgctttgtgatattgtgatattttaggcaatcttgtaaagagcacagcagctcaacaatattataaagacctagaatatctttaaagtctttacaactttcttggtcattggcttaaaattagagaaaccaacatgggcatcctttctgactctggagcagacaggcccagagcgtgctcaagactacagtttacttaggactacaaacgaattaagcaataggaatggagatgagctctagtgtggcaacatccagcaaagggcagagtaaacctagacatcaaggttaacgcaaaattagcagctttaccaaagtgagcagacaacaaggaaacagaaatactgtactgagaagttgggcacaggggaaacctgaatccaaggcaaaatcacagggcaagggtttcctgctgaaggaacaaaattttacatgaatcaaggacgtagtattcaaactttctacatctcatttaatgttgttttaagatctctgtggggcaggaaacaaagagtggatgctactggaaactagaaattagccatacttgactggaatgtaaaaacaaacaaacgaatgttagcagcaacttttattgacaaaagtatgaccaacacatggccattctgtaggttaggctggaagtttatctaaactttaatggtacctacagatgaaataagactttggactcaacctagaaactgttaggccccttttaatttccatcttggattttccctagtagtatgtgtctgtgtgtcgtgtgtgtgtgtgtgtgtgtgtgtgtgtgtatctgtgtgtgtgtgtgtctgtgtaagatgctataacaggctaattttacttgttaggtaagttatattcccctgcaaacaactgaaatgaaaatcatttctttgttgattcctggaattgtattaacttttgacaagtttgttagttccttgaagtccactttgtcaatgcaaatagactttggaggggagcactctacttggcctaacactgaaatctgagtctgtcttctctctttcttcaaaaacttgagagttgagtcaatctgaaagctcagattcttgaagggacctggagacacttaagggggaagaggtacagagaggagaacagggatatccatagataagtttaatttccatttataatttagcactagaaacataatttggttgtttacagcctttaataacacaccttaaaaaaaaaactctgtttcatcatcatagtttcaaaagcccattttttctctcaaaatctacatataagttttattttatattatttgtttcaatatcaggttaagttttaaggacataaaaataatattatagtaatatttggaagaaaatttgattaagaaatattagttatgaacaaaatgcaatttcttaaggagaccaattacaggtcttaccagttgaggaaaactacctggaaaaatgtcattttggccttttaaaaaatatgttcaagtgcatgtaattttcttgttattaaagttgaatagcaatagatgcctaaccagtacaaaggcttcccttttgccttgcaaacatttgaagcaaacctgtttcagactaaatcctctcctatgaagaggtaaagcttagtttaacaaagtatgaacttaattgggcccagttttctcatgtgtaaattgaggagtatggagtaaaaagtcaataaatttatttatcttgaagacattttacagatgcttctgatgaacatttattgtcatggaaagtaagacaatttgtccttaatagcacttatcacaaaggttttgaaaactttttcagcttaagcatactctgctatattaacaattaccattaaaattaacatttactatggtgcaacgaaaagggtaatcttcatgttttccagctcatataatagcttatatacatatatatatacatacacacacgtacatacacacacaaacacacatatacatagctcatatatatatatatatatatatatatatatatatatatatgctattatatgagctggaaaacatgaaatatatatatagcacaaagaattaataaaacctgttatataatatttgggatttagcaaccagaattgacccaacatttctattttggggagtttgtcctatggctatattaacacacatacagaagattctataatgcacttatggatgttatagccaaaaactggaaatgaattaaagatttattaaaatgcaatgccttaataaggatataatgaggtagatctattaatgcagcatgtgctaatgtataaaaacctcatgacacatcactaagtgagaaacacaaggtgaaaacacacaactacattgcaatccattttgtaaataaaaataatttgaaaaatttttacacatacatgacagatatatgcctatatgctccatctacatacaatattttactgaacagctatgcagttagcagtagctccccaaattcacacaaattgcctttggggaaagttaatgtgactggatggttttctctacgtttattaagagttttggccaggtgcagtggctcacacctgtactctcagcactttgggaggccgacgtgggccgatcatgaggtcaggaaatcgagaccatcctggctaacacggtgaaaccccgtctctactaaaaagacaaaaaattagccaggtgtggtggcgggcacctgtagtcccagctacttgggaggctgaggcaggagaatggcgtgaacctgggaggcagagcttgcagtgagccgagatcacaccactgcactccatccagcctggacaacaaagcaagattccatctcaaaaaaaaaaaaaaaaaaagagttgtaaataaaatttgtgtcttacttatggtttgaggccagtgtaacctttataacagtgtcagaaaaagagagaaaaagaaattgaactgtaggtcagtttatagatacaaaaatcccaaataaaattttattttgtttaaattttataagtaaaatttaatccaaactaaaaatgtgctaaaaatgatatgccatcccaagtagggattttactagatataaaaggataatgacaaaaggatattgatcgaatactcaatctaatccatcacattcattgtataaaagaaaaaaaataatgtgattatctcaatagatgcagaaataataactgataaagattagtcactattgatgttacaaataaaaacttcataaagatagtaatggaagggaagataattctttgtggtagcaaagaattgaaagcaaccaaattatgcgttaataatgttgtgatctgtgcaagccaaacacaaggaaccaaaatttatatacaggaaaataggcaagcatgaaagggatgtacaccataagacttcttatgtgaaaataacacataaacagcagcatgtattttgctaggccaaatacatacatttctatgtcagatgattacaaggaccaaaagtaaatacattaaagaggtccccatgggcaaaatcagattaacactgagatgggttaaaagagggaaaaactaacctaaactaaacaaaaaaggagctttgtcttaaccaatgatgatataatgtcatgaactgacaagtatgatcagagagattctatgaagtagcatatattatataatcagcatggtctctactatataaccaacaaaaacaaaatctatttgtttttggactaagtgtggagtaaatagaaaaggtaagggcatagcaaaggggccatgcacagaagcccaaattcctgttctactacttacctcttctgtaacttcaagataatcacttagcacaccacagcttggattccttaatctgcaaaatgggacaatcctatttacctcccttggttttgtgtagaatcaatgtgataatacatgcctggagaaaagcataaagccccagcatacagtaggtgttctaacaaatatgtgctctctccatccctgcactcccaggtccactatacaggcccctcatagttaatagtcttcctgtgggaaggaattcataggaaagactgcagctactcctacacatattataacccttacacttactgaacttttcagacaatcttgcatttttcaggcctatcttaaattacagaacatatgataatgctacttatgatccctaatagggctaatcaaaaaggggaaaaaggcagaaatattatatgcaaagaattacagattagcttgttcagtctgcacaaacttgtaagtaagaaacaattggttgtgccataacaagaacccaataaatgttgacataatttcacttcagttttacagacttagttattacattatcatctctatattttttataattaataggactgctattttctttcataattggtgcatttattgagatatttcccactgttagactgatgtgtttcatcctctatacgtttgccctgctgtgtccccacagttatgatgctccaaatttatagagtttagatgtttcttgctgttggtttacattcctattcactatttattcataaaataaggcggagagggttctatgttgaaatgaacttttacacagaaaattagcaatcatgttctcagaacaactacttagtttttgataccattcacagattctaacttcgcatatgtaatactgcctaatgtcacaaatgggtctcatttctacaaaacgttaactatatgagaaagttgaaggaatggctcatcagaagacaattcaggtttataaagcttaagtgatattccagtcctatgacagtctgtgtttattaaggagtaagaatattgcattccactattgagactctgatgagtatcatggctttagcacagggtataacaaatcaaggttcttttgtttttttaattatggcgaagatgcaatgagaattacgatttgactaagttggactgtgactgctacaaccattacatggtgcccagtgtgccttagaaaatagaggtgtcatgaatttattttctctttcaatgcctgatgggaaaacgtgctactcagctaaagaactgcagtaggaataatgatcattcaagatgtcttcaaactgagctacagatatttaatttaaaagcacattgcctgttttgagagtcagtatttccttctgaaaagaaatatcattaaagcatagtgatgttaggaacttagggattttaaaatcatcattttccttgaaaacctggctgaataaaatattgaatcttggtatggagcatcaagtccttttacaatgtttttctctgaacagagagtttattatcatcccccctgagggcaggcaggaagaataaagccaacattctgctttactttgttggatctgatgagatcttgctagcttcctagatctcactttgggatgtaaaatggtacttccggactacccactaatctcagtttgttgttatttttggttagttggttggttttgtttttctcctctcactgcttagatttttatatgtcttaattatagttgtgaacacagatgaaaatagtataatttaaatcgacttaagtgtcttgcttttataacagtgatgcttgatttttgtgtttgttttccattgttctaattttcttttagggcccttcttttacctggtagccaggtatgacaaaacatcatatttgatctataatacaacactattagaactagaaggaccctacacacctcgtcaaagtccttcatttcacagacgagggccagcacccagagaagggaaatgacttgcgtaggccactgcggctacttagtggcagactcacgttcagaaatctttgtcttgctaaagggttcttgctacaactcttgctaaagatttctttttcctccacatcaaacttcctttgttctattctcaacttatataatgacgtttgaacagatctagcaacaaactctttatgtggacttccctgacttgctggttgatgacttcaaatgtttgacagtgcacatgacaatataatttatcctatgactgcaaagatgacatcttgtgaatactgcttgattcctccacaaaatcatccctgaaaggcttgtaggtgtctatagatccacagattccatagtgttcctttgaaataactgaaaatgtcattctcgctgttagttaaagacaaatgccagatatggtaacacagttataagtgctaattatgttattaataattttatccttttttcctctcaccactgtgctgtttctcacatgctgatctgtccatcctgttttgctattctaggtttgtgtgctggagaggcaaatatttgacttccttggatatcagtgggcacctatcctggcaaattttgtacatattattatcgtcattcttggtttgtttggaactattcaatatagacctcgttacataacaggagtaagtacattttctgccttttaaaaatcttattgaactagagaatgatgtgcaaactccaaatgccttgaaaacttatgtgtataatctatcttaaagatgtggatactctcttttaagtaccatgtgtttattttcatagtttcagattccatcaacagtaattgaaaatgtcaggtttaaggcacttgatagtgagtgtgatcagactgaattctcataatttgtactttcagcgaatagtctcataattacaagccaaactgtgtttctatgtttctacattataaagtcatgctttctggtttgacagattttaatggaaattttttctcattttaaataatcatattttatacattgaataaagagtttaaaatcaataggaatgaacatatactattgatgtgaaaatattaaccacattagggctaatatttggcgtatgagaaagccagaataatctggacagttgcctctgtgttctccataattctctttttggcttgaaggaagtattttgcattcccactcaagttaaacttacttaacataaaagtgaaatccaactgtgtttcagttactatgggaaccataactcagggttgcttttttttaaacttttgtatgtgcctcagatctcagctactgctcttcattaatgtacatttttttctttttagtttcatcattttttctatttcttctatttttgacaaaggaaatgtctataggcatttatttaaaattgtaaagcaggtttgtagtaaaagcatgtatataagatagtaccgtgaaagctctgccttgttcaacacaaaccagcagcccttctcatgttttatgaaagcgtcctcattaaagatgcccccccatgacctgttctctccatcatctagaacccagataaagctcattggtacagccaggcaatgtggtggtggctggaaccaaggaagaatgagaagcccacagtcctcgcctccaggtgcatgcccagcctccagtgcatgtcactgcagaggctaggtagccatctaaatcttgtaaaagtgggaggagttctgttgcagggtgaagttttttaatgcacaagatatgatagtattgtccattttcttttatgaatcgtaatttgatacagtgtagggcgggttgtacagtggttgagagtgagtcctctgaagtcataatatcaagattggaatcttcgatctgccaaattctgtgtgactttagataacttcacctcaccaatctttaattttcttatctttaaaatgaaagtagtcattacattaactcataatgatttaattaattgatatatattagccattatatgaaaaaaatttaacttaccattctttttttattagactttgaggttccttcatggttttattcttataaataatggttgctctgaatatcattatgtaaatatttcatctttatttctgataaagttcttgggataaaatctagatgtgacccaaaatatttgaactatttaaaaactcagaggttaattttgaggactaaaggggatgttctatgaaaagtccctagcaccgtgcttgatatttaaaaagcccccaataaatattagctataatatttttgtttttaattattattatttaaaaataatactaacctgtgtaacatagcaataggctgaaaggaaatttaaaatagagcaaggtgttctagatgttggatgaactatttctgtcccttttatcctaagatgctacaatgcaaaaaaaaaaaatttgggctttctatgtatcaaattattatctcatccttttgaataaagacgtaccacagatctttcactactggctactttctctggcatgggataagagttatgatgccaagggaaaacacctttaacattgttagaagttttgttttctgaggctattagacacaacctgaactctttttaaggtcttaacaatgaatttcagagccttgatttcatcttgactggtaacatcactgtgcatttggatttttccctgagacaatgtctttggaaatcttttgccggctggagatgatgtaaatgataaacttttttttccaactcagcaagtcctgggttagaaatatatcctctaaattctgcttgaaaatctttctttagctcatttctctcttacaatatcatgctgtctgtggctaaaagataacaaatagcactgtcatcttttttttgcttggaaatccccttaaccagacccataaactcataggcatattttctatctttccagttattgaagacaatagctaagataattgttctggcagtaaattccatgagtcttcttttctccagtcctcaaaaacaatttcctctctccactcagagtctccttgctgccctcctggtgtcatttgcctccttatctcaaaaccagtactgtgtgttttaggtttaagtatcactgactttctggtaccaatatctgttcaggtatctatgtctgtgtaacttctgtgcaacaaactacagttgacccttgaacagtgtgaggattaagggcaccaaaccccccacacagccaaaaatctgcttataactttctactcctcaaaaacttaactccaatagcctactattggttgaaaaccttactgataaacagttgattaacacatatttaatatgttttatgtgttatatgctgtattcttgcaatagtgcaagctaaagaaaagaaaatgttattaaaggaaatcataaggaaaatatatttattattgattaaatggaaaaggatcattgtaaaggtcttcatcctctagcaatgtagacctttataatttttatatttgccatattttctctgtaatatttttacattataaaatagcttgacataaaatataaaataatttgatacaaaaataagaaagcatttctcgacttcatgactgaagattaacattttgcgtatttcctttgtgtacatacaaatgaaacatgtctgtgtatgctatatatccaagtatgtcttaattttaaattgaacattatatcaaacaatttaaaaattaacatgactatttcattgtttctttaagcctttaatgttatacattatgctattttcatatttttctattatattaaataattccctataatcatttccaacaaaaatactctcgtctttttttgtgaatcattccttaggagaaatacctaggtataatcaaataatatgaacaattttaaggcttttactatataattaataataacctatccaaaattattttactgaattatcctcttaccagtgtacagcagagttgatttcactgcactcttgctaaccctgtgtattatctgttctcatagttgttaatttgatagaagaaaaaatgttattttcatttttaattgtatttctaatcgtagtgagttagaatttttcgtatgttcattacccatttttgttttctgtttggaaaattgtgtgtgtgtgtgtgtgtgtgtgtgtgtgtgcgcgcgcgtgtgtgtgtgtgtgtgtgagataagtttcgttcttgctgcccaggctggagtgcaatggtacggtctccgctcactgcaaactccacctcccaggttcaagcaattctcctgcctcagcctcccaagtagctgggactacaggcgtgtgccatcatgcccggctcatttttgtattttttcagtagagacgaggtttcaccatgttagccaggctggtctcgaactcctgacctcatgatccgcccaccttggcctcccaaagtgctgagattacaggtgtaagccattgtgcccggccagggatttgtcttttggtcttctttgctaattttttaccctgcagtcttagtgtttatcttaatttatgtagataatttaataaagacatttacctttaaaacatcataaagcttccttttgatacttagtatgtctatcttattacagttaactctctttcaacttgtgatattttctgctgcttttaagattatgaaattcaaataccattttgaaaaagataagtcttcattatccttatgtctaattttaccaaaacaaaaaggcaggttttctgatattgagactgagggcatttgctatatttgaagagcttcaaattattgatgggacattttatttaattgatcttgcctcccacacaaaaaagtatgtggacattcttcaaaccattgagcttgtagcaacaaataaatgagagtattggtaatgatttttgttttcttcattcatcttctttttcatagtagcaaagaaaaaaagattaaaaacttaaaacagataattggaacaagaactcattagtgccatagagagcttctgtcactttgcagaatatagtatgctgaaggaaaatgaaatagatgttttcaggtccaagcaaaggaaacctgaagccagaattcatagaaagaatcaatcttgtatctcaatcacatcaaatcccagaaaataattcataaataaatatatacaatggctcccaggaaagcattattttacatcataaatggaattatataatgcatcatcatttggggaagtagaatgtgatctgagatatccagtgtttataagttaatgataaaataatgttaaggagctgcactggcgctaaggagctgctttagattatctaaaataatctgaggaatatgtaggttcctatccattaaagccatagcaactttctcagtgatattgccaaaaacaaatgttgctgtgtaacatgccaaaaataaattatttctccccccctctccctttcttccttccttctttcctttcttccaaactcagtctccaaactagaaaaaaaaagtttcaaaatagctgaaaatctattactcagattttatagaggatagtatactaaaataacagtaatatttgtaagaataatttcttgtttcttaccaattccatcactgattctcctgtatatctacctttcttcataaattctataaccctcacattaacttgacacaacttttgttcaaactcatatggaaaggaaatagtagagttaggaggttgacacaggttctcctgacaaccagtctgtccttgtaaccaccacagtgaactgcctcttagaggcacagttcagagacccaaatctgtctgataaatgaacaaaggtgctgttaagttgtgggcaaatttaaaattcattacagcatttgtgatttccagaggatttagattttaagttgtggtctgcctctcccatatcaaggattatgtttttaactccttagttaatggagaaataacctcatgtttcaagagtttagaacagaaaactcttagtgatggatattttattcatgcgggaaaacaataacacaaactatctttaatctctagtaacagtgaattagaatggcatgttattctttttctatagcacccagctttttgatggtgattttacatatatgcatatgtacacattcatctatacaatataagttatatctaatatccattataattatatgttaaataaggacaaatgatctatttctacatttgctatttgtaaagagtttcaaataattgatgggagaatttatttctatgtaattgaataaaatactcaaaacatattggaaatacaaaagacctaggaaacaccaatatagacatacatacatacatatcattatgcctaatgaagaatctttctatgacaccaagttagactacaataactaattctaaaatcaaatgaaggagaaatattgggattggtttcctgttttgttactgaaaaagcaagagatgaaattaatgtgtttaaagctgatttgatgaagcaagtcatcaaatgatggttagaaagagaagccaatacacatgaatcttcatttcttgtgttctaagaattgtaaactctaagactgtcataataaccctgcttactcttccaaaataataaaaaagtaaatatttcttttagtctgcattttaaagttttgaatggtattttctgattaatgctgaacactgaacttctgttcaccaatttaggccactttttgttttactacattttttttaacgtgatacatatggtagttggtggctgttggtttctagattgatgtacatcctccttctccccagtgaggcaaggtcagcttcagacaaagtgtcacctgctttgacttccttaactttgctttttctagagccaacatggtaaaggatccccatggcatcctggccaaagcatggggccacagggtgactggagcaccagagacaaagacaggattcattttgtaaaaagattacgacacagcaacttgagaaatctatagacaccttagtggttctgtataagtaaagaatcgcatactcaatttgcatgggggaaaaatcctctaaatttctagaatttactatttgctgataattgccgtgatttgatttttaattgtccatggagctcaggtctccatagagactatcaccaacaacaataaatcaggagcactgtctccattttccaggtcatatgtttttctaaaactaataaatgttacctccctaaaaatttttgcactcctacaagtcatttctaagaagtcattaatctatgttcaagtagttgttttgccacctttattcaatttttctaggagaaaaaaatatctgaaaggaaacttattgcagctaaagcattaacaaatgcatgctttctgtgttgaggacagaaaatcaatgtagattagagatgaagagacttgagatactagtaaattaacaatacttctaatgactttagagtagttgtgaaaataagtcttttcccataagcctggaagggagggagaaaacaaaaaaaaacatcattacaagtttaatggatttagcctgtagtcctaaaataaatgtaataatgcaacattgcaaatgcaatttattctcaaaagaatgtgttcccttggggaaatgtggaccatttattctacaagaagatactttgtgccctcattttggtgttagactatgactaaagatttataggatgtggtacatataaataattacatttgacagtctagattcacttttttaaatcatctaataatttttgaaaatgaattttgaagaaaagatatattgtgatatgtttaagtattagtttctttttctaaaataaaaaaatcagattatgtagtttttttaatcaaaaagtaaaattgggcttataataaaataaaacttcctttccatactcttctccagctgttcctcatctctttatagttcttctggggttacctcagaaatgtgtgtgtgtgtgtgtgtgtgtgtgtgtgtgtgtgtgtgtgcgtctgtgttgctaattgttgatttttcagctttagacagtgtctaataacgacctgccccaaatcatttggtctaatttgtttttgaattatacgttgtttttacaggttttctttcccctctgaagtttctgattgctttttttttttttgtaagaaacaaaacaggccttgcttaagtgtatcctaaatacatttccaattcatgtgcattctattgcttgatattcattctgttttaattcttgaaatccactgctttactatttgaattatccagtccgtttatatttgaccatcactatctgtagctttttgtttttaatgcaatgttcttcttccctggagatttctcttagtactcttgtcattttactccgatgtcaactgtttgttctcaagccctattatacatctatctctcccttcttctgatttgattcatgctttcttaaattccatctattatctctttgatattctacaaacaacttcctgaaaagcatgtttgtgagagaaactttctgagttttatctgtctcatgacagagaatgactttattctacctttacacttgagtactagtttggccaggtgcagaattcagggttgaaaatcatttttttcttagaacactgaagtaattgttcacaatctaagaagcagtgttactgatggccagtctgatatcaatctgtaaataactttcaaagaactgcttgagatattcattttattattgttttggcatttcaaaatggcgtgtctaaatgtgaacctatttaaaaattgtgtagtcttttttttattatttaaacacttatagaagactttgttgtggctcagaaaatcatattcaatgtatggcaattttgaatgaaaagagtagcctcaaggtctctctgaccttccttcatcctctgtctctagatcctctctttcccaaagcaccaggagtccctttctctgaagttcacttgtctaactgaggtaagttcttccaaaagaaatgcaattgtcttgaaacccctccgcaggaatctcatcaagcagccagggaagattaatcactggagaggagattaaatgtcatccgcatacccagacagcctatcacttattcttctggaggctgctctgagaagctttatctgcataatacgacaacctttgttcatcttgtggttcttccttttttctctcccttaacttttctccacctcccctgaaagccctcaagcccctattcctttatggtataaaaactcaaccatctggctcctcctttgagttttatattttctgtgagtctcatgagcttaaataatgagtatgccttgtctcctgtttatctattgtcagtttatttcagcagactcagttgtcaaaccttcagagggaaagtttgaacctccctacaccttcaattctggaatttgcatgcatcattttgatgattcttgatgcttttcaacatttgcctttgctatgctatccccaggtaatttcatttaacagttattttatattatagtttttaatttatttatgaaaaatctccttgttttccccagagaaataaactcctggctgattctaaaagtggtagagggttattgctgttttccagcccactttacacactgacctttggtcatatgtttcttacccaagtctccagagcatgcaaaattctccctagcagtccagcatttttttgtctctttctcctccatacatattatagactggcaattgcttcattctgcttattaatcaatatccatctctttgtcttcctcttcaggcaattggttgaaatctctttgttgctaatgttttattactaatagttgtaggactatatttgttgtatgctcagtttgcctttttgaaccaaaagtgtaacaataactattagattgcattaagtatgttttactttggtgtaatttcctttttaacaatgagagctgagcagatgacttttttttttttttgagacagagtgagactctatggggaaggcaaccccataggtttcagcctcattttacccagctcctgttcaagatggatttgctctggtttaaaggccttttacattgatacattgatacttatcaaaagttcaattaagaaaaatgatatttatggagaattgcttacaagataagaggttcatgcattctgccagaccctaatgtatcctaggcagactctcatccctatactgtgtcagtttaatgttggcagtgtgttttaatttatttttttactactgtaatgtattttattaatgttattaaactacattgactgattttataagaaacacactcatgacacttatttatttattaggaagatttagttgaaagtattgctttaaataggtgcacaagaaaaacaatctaccccttgtctcaatcctgaaactagtgatactttccttgtgcattaggttgatctaatggcaatagcaaaaatctcagtcaacttcctgaatttaaatgagaagactttttagcagtctgcttactgtgttatagctattagtattcagtaaatggtctttactatatttaagtagtttccttcaattattaagaatagctaataatattttattacatatctttgaagctgtatgctaatatctctttaaaatttttggatgcattgaattagattaataagtgttctgatattaatttaactttccattactagactataccttatttgtttgtaatatgttattcttttttttgattgctatattcaacttttactatttttaattacttttttgcatccttattaaaaatgcaattaatttatagctttttacttgtaatatttttaaaattatgcggccttaagaaaataaattggggaaacttttttctgtggtatagaataattcaaataggattggaactacaaatgttcttagaactaatctatgaaaccatctagtcctgatactttcatgaatggtagctatctaattatctttccaatcttttctacaataattgatcttttcaaattttccacttcttgaatgattttggtgatataaatttcatcagagcatatattttctagagcatttgtttcatgttattgtcatagttttatttcaaattctattgctctttttagaatttctttgatattactgggttggtcttttttctgcatacccttttttgctcatttcatgtattaatatctcgtaagagaaaagtgacgacagataatatcaaaacacctcatttctgcttttttctattttctctcattccaagataatgggaagaggcaagtaggcaccatttccaggatatttgctaatttttatggcaatgagtgtagcaaactgataatgtgaatcaatgaattgtttttagtttagagtttcttagtataatgtcttagtcttttttgtgttgctatagcacactacctgagattggatgatttgcttatttatttattttaaaaaatgtttattttagctcaacgtactagaggctgggaagtccatgatagggtggctgtgtctggttagctactggtgagaacccagttctgtgtcataaatggcggagaagtagaaggggaactgggagcatgtgagaggagcaaaataggaggggcagcctcactttataacaatctgctctagtagtaactcatccagtacccagcgagtgagaacttacttattcccttgagaattaacccagttccgtaagagcagcattgatccctctcaatgacctaatcaccttggatagacccaacctaccaatatccattcatagcacacagtctgtttgtcaaataataattataaacaattatttttaaaggttttgactgcaaaagggtttcagcttcatgttaattctgaaattgattaaagactttcattgaccacaccagcaaaactgacactgcataaagaaagtctttggtagctgtaattactacaaaaccccttttgtataatattctttatagtatttatttccaaataaatctttccttgcaagtatataagcaatactctgaagctgacccttcagaggttttatgaattgttttatttgccagatgctttgtgattgcccagctgactctttaaggaaatagttgtcattttcctggtcatctctgtgttgtatttgtagatgtcttgtcagtggtttttggaaatgttgactcatctgggaactccatgcccagtaagatgttatctacaccccacagctaaacttctgtttgactagacctgtcattttctgaaacacagcggaatccatttttttcttcatatttttttcttttaaagataccagttatgtttatggaattttgtaaaagaaatgtttggctgcaagtattaagctcattttatctacaattcatttttatgggagtgtcatgcacttaaaatttaatatgtgtgtacacaaagatttcccttggaagtgaagcgactaccatattatagtacagtaaaattggaattatgagatgtcttattttaattctcttcttgttttgaaaggttagtgtttgatggggagtttctgtgcttacatttacacttaaagttacattttcagagtagtttgtacctaagaatttatcatggagcaaaactataatttggcatagttttcattctatcttctaaaacctttgtgtcgttttccttctccttgttcttttcttcttcttactattatcattctatttttcttcttttaatgcaataaatttagtcaaaggcatgagaagctctgtgaacacgttgagaggtttgtagcatagtgttgtttagctgacaatttagtaaaactaagacaaacagccccatagctgcaggttagtctagaataatggcttgaacctgctttttattattgcttatttatatcatatagaataaatgctgacactggctgctgtgaggagaagaaactcaccgattaggaaggagattaaaaaacataagccagtttgcaaaatcctaattttatttaaggagaaattagtatcatttgtaatctctgctatgccctactactattgatgcattagggttgaaagtgaatggatttcaataagccagacagaacatttctttcagatatcggatatcaaaacaattctcagggcacaatataattgttttctgaactaaaacatctataatgctcctggaaatgttttcaaaaattgtatttcttttaaccaactcaacttcccaatctgaactcccctttactcttctccataaaatactaaaaataaatgagacttcagggaacatatgccaatttgtcaatctggtgataccttttttcttgtaaccattgctacatccttcattatagtaaaaaagactatctcaatgaataacatcactgtttatgtataaagaacagcataattctatttttaaaattataaatttaaaaaattgtaactcttctcttttctttaaataatgtataattcctccacaattgcattctctttcacattcaccaccttggatgcaaatttcttcatggttaagcctctactcagctttcacttctccttgtatattagagtataatgaacacagtttttctatgctagtttgctttgagttataataggatatgtacagaataaaagtataaaattgaggtttataaagcaagaaatgatggcctaaatggagttgctagaggaaaaaattctcagttatgttttatttcaaaacatctttgatgaccttattcgatagttatggaaattattttacataactgcttctaatattttccccatcttatcattttatgtagctaggtatatgcaaataaatgtccaagcagaaatcattataatttcatttacaagaatgtttatgagttcagatattcttttgaaacatgcaataatttcataaaatgaggtatgtaaaacttatatacttaaagattgcattgaaaaccagattatagatgttggagaatggtgtacaaaacattcttgaaagataaaagaacatagactccatacaaggaaccacatcaaaattcctattatttccatgttttcaagtgtgatctgtggataagttatggggcagtgaagtagttttaaattaatttcaaattttcccagagatattaggagcaattaaaatcaaggaaataggaattgtttaggataaaagcattcaattaagacccagaacctttactgggcttcttgatgtgcctgcttctttagtgttgtacatcacacacggacacacataaaaaaagtagtgcctatttaggcacaaagtccttcagcatgtgttttggactagatcagtcaaaccagcactaagacactgaagcagcttccttctctcagatgcctgtacagtctgcagaaccatgagcattttctctctcataaatgatacacagctttcactatacaacgattaaaaccagataataagaattaccatgatgactagtatgtcataaaattatgaaaactgttatacatactgttgatccttgaacaacataggggttagggatgctgacccacacacagtcaaaaatctgcatataagttttgactcccccaaatcttaactactaatagtctattatttattggaagccttactgataacataaacaatggattaattaaaacatttcatttctgatatgtgttatatactgtattcttacaacaaatcaagctagagaaaagaaaatattaagaaaataataagaacagaaaacatatttactattatgtaaaagtggatcattataaagatctttatgttcatcatcttcatgttgagtaggctgaagaaaagaagggttggtcttggtgtctcaggagtggcagaggcagaaaaggtggaaactggcccccctgccccgtgtggctctcaggtgggctgcagcaccatactgctcttccttcctctccctggatcataccacccttctagtcagttctgatggagaacctggttaccttggttgctggtgaaggattcacatgcttattattgttcttttccttgagagcctcagaactgagctgtttccgagtcggccatcttggccccgccccctgtcagtaatttttaaagccatggctttctccgtgtttttatgtggaacaaaatcgggcatttggcaagaaaccaccagttgttcataatttaaatcatttcttctctaaaaccctcaaaatttcataagaagttgaggtcccagaatctgaggctaaaaacctgactctatcaatgaaatgtgttaatgcatctgcttttatacaagtcagataaactctttactttggtttcttcttcacatcagttatcagttgtgagtatggaatgaaaggttaatataaaatattgagcatgtgtcttgcataagtagactctcaaatgttatctattatgttaataactttcacttctttgtctatttcaacatgatccttggccatgttttactgaaactcaatagcaataacacctcatctaggagtcaaaatatttctgaactaagagataaaaaaaattactgaaatatttttctgaatagggtttcaatactcttttagcagaacttttttttaatgttttttatgtattgccttctcacaaatctctataaccatgttttgtgtagcaatatacctgttttcttctttatctctttctatttttaatgtttccattatgattttcaactttcatggttcagcagaaaaaagtccactactttttcaaaccttacttgttgtcatgattcgaattactaggaatgaaacattttcaatctgacactgaaaatcaagataaatatcatgtgtggtgagaaactgctgcgctaaagatgttccaaaatgtccattgttcactatttccataatttacctgtcaacagctctatttatttgggattatttttgtgggttattgtctacactcaggcatagatgataatgccacacacattcatctgggataaacagaactataaataatatataattttaaatatagaatgataaagatcccagaaaagcagtttcttgccttctgtgaactcagcagataatgcatgaattggtaatgcttggaaggagagaagaccccccgtgtctattatcagtggggatgctatcattaaaccactttagaacagcacagcaaatggtttcatgtaagggctgctacaggacttgagtgaagccctcagagaacagtgtgattttagcctgcctagggctaatgatgtatcaaggatctctccacagtaaccatgtgtggcagcttgtggataggctttgtccttagtaaagaaataatcttacatttaatgactaagcattttaatccacttaaatgtttttagatcaaattgattcttgaggcatgggaattcactgccctggcaggcagaaagagacactgatgctctgttacatctggaaaatgcctgtagggagtctactgctactcagagaatccaaggcttctttctgaaggacaagaagagaaagaagcagcagccacagcagcagaaacagcagcagtgtaagagatatcagaatatcagtgcttagaagacacatatgaggaaactgcagaaacaaaattgtaataaacataatttctaaaattcactttggaaatcacttagatttatacgaattgcctatcacttctaatttggagactgaaactgatagaaactcaggacttttagaatgttactggactctagagtttgtttttccactgagatatatttttcctacattttctccaaatcggatcattgctctaaatagaaaaatgattttttttaaagagtggtattaccaaatgtagcctttccttgacgattcatgatgtaaattgttgttattgcaataaggaagataaaaacatttatttgacatgataaaaaaatgttgtttctatgtcttaaaaataacatcgtcatagatattagtatgcatatatgcaaaattccatgatttttcttcaaatttttcccctgaagtatacattaccccttcttttctagttctacttctgttttctattatcctatatttttctattctgaataagtacaaaagttaattagactgaatttaattgttcactgaatgttgcctacgaaaatgtatggaaatgttcaatttaaaagtgtaacttaacaatgaagattacaacaatgaagtgttgtactttgtcgaataatctatttcacatttctttcccagtatgtgcgatgtttcacattatttcacatggtagagaggattcaaaacttgttctgttgttactgtgtgtatgactggcatatctcaaatcagctttccagaggcagagttgggtgacccagcatcacctggaaatgtcaccaacaaatgttggcaggatggttgagagagagaatatttaaaattctttccaacccccaattcctctttacatggttgatctgtgtccccacccaaatctcatcttgaattgtaataatccccatgtgtcaagtgggggggccaggtggagataattgaatcatggaggtcatttcccctatactgtcctcatagtagtgaataagtctcaaagatttcatggttttaaaaatgggagtattcctgcacaagctgtctctttgcctgctgccacccatgtaacacatgacttgctcctcattgtcttctgtcatgattgtgagacctccccagccatgtggaactgtgagtcaattaaacctcttcccagtattaattacccagtctcaggtgtgtctttactagcagcctgacaatagactaatatagtaaattggtaccagtaaagtgggatgctgctgtagagataccagaaaatgtggaagtgactttggaacagggtaacgggcagagtttggaacagttcagaagtctcagaagaagataagaaaatgtgggaatgtttggaacttccttgagacttgttgaatggctttgatcaaagtactgacagttttatggaccataaggtccaggccgaggtggtctcagatggagaggaggagcttgttgggaactggagcaaaggtaactcttgttatgctttagcaaagacaccactggcattttgcccctgccctagagatctgtgaaacttttaaattgaaagagatgatttagggtatctggcagaagaaatttctaggtgtcaaagtgttcaagagaaagaagagcataaaaatttgaaaaatttgcagcctgatattgcagtgggaaagaaaaacccattttctgggtataaattcaagcctgctgcagaaatttgcataagtaacaaggagccaaatgctaatcaccaagacaaagcagaaaatgtctccagggcatgtcagagaactttgcagcagcccctcccatcacagggtcagaggcctcagaggcaaaaatggtttcctggcccagtccagggcccctctcctgtgtgccacctagggacttgctgccctacatcctagtcactctagctgtggctaaaaggggccaaggtacagctcgggccatggcttcagagggtgcaagccccaagccttggcagcttccatggggtgttgagcctacgggtgcacagaagtaaagaattgaggttcaggaactgctgcctagatttcagaggatgtatggaaatgcctggatgtccaggtagaggtgtcctgcaggcgcagaaccctcgtggggaacctctgctagggcagtgcagaagggaaatgtgtggtggaagcccctacattgtccccactggggcactgcctagtggagctgtgagaagaaggccaccatcctccagaccccacaatggtagacccactgacagcttgcactgtgtacctggaaaagctgcagacactcaacaccagcccctgaaagcggctaggagggctgctgtaccctgcaaagccacagggtcagagctgcccaagaatgagaacccacctattgtatcagtatgacctggatgtgagatatggagtcaaaggaaatcattttggagctttcagatttgactgcctcattggatttcagacttgcatggggcctgtagccccttcattttggccaatttctttcatttggaatgggcatatttacccaatgcccataagcccattttacctaacttgcttttgattttacaggctcataggcagaagggacttgcattgcctcagatgagactttggactgtggacttttgagttaatgctgaaatgagttaacactttggggcaatgttggttttgaaatatgagaacctgagttttgggaggggctggggtggaatgatatggtttagctgtgtcccgacccaaatctcaccttgaattgtaataatcccccatgtcaagggtggggccaggcagagataactgaatcatgggggccacttcccccatactgttctggtggtagtgaataagtctcacaagatctgacgtttttataatgggagttcccctgcacaagctctcttgcctgctgtcatgtaagaggtgactttgctcctccttcaccttctgacttgattatgaggcctcccggccatgtgaaactgtgagtcagttaaacctctttcctttataaattactcactcacaggtatgtctttattagctgtgtgagaacagactaatagagtaatctgattcttagatttctaggtatcaaatggtttttacaagtattgaaagttttcctccatgacacagactatccattttaagtattacaataaagactttcttgttaatcattcctcagttataatattgtttttataatttttgagtatgctaatatgtcaaaatgggtaatgttttttaaatttttttatctggaggatggtcattttatttaaactaagctatcctatctttgatttttgcatattaagtttcttatattatcttcaggtgaaaactaattaaagcaaaacagaaataaataattatctgccatgttccaggcactttggtatgtaaaaggtatgcaatatataaaatattatcttcaaagggttcacacaacaaataaatagtaagcttgtgtacattattggaaaaaaaaacttagaagaaacatccatgtctgactcatgaattaatgaagacactgtagagaagataaaatttgggctgaaaccaagaatacatggtatattcccaggcagaaaacaatctaagaaaggtatcaaaatatgtagaggcaaagcagcaagaaagagcataccatatttagaagacttcccaggcttctgcacagagtttatgaatgagagcagcaggaatttggaccttttatgtagacatattttggcctgtgaagcaggcatctttggtctgattcaataatttaaaattagatggggtatgtatgtgcatctttcaggagagaggatctattattttgaacactattagagaactttaagatgcacaaaatataaaaaacaacttgtgaagattacagacaaccattggtagtttttaaaatacagaatgatatgattaattttaaatagattttaaacagaaaatcttccatgaaatgaccatatatgcaaagtgacccccaaaattggaaggagccaagaaaccaaagaacatggcaaacaaatccagtttgttggtgatgggtgatttattggggaacttatgtaaagcatagtcttcggcagcagcaaaacaggtagatctctacactgttactcttcagaaccaaggcttactacagggaaagagtttatgtggtctatagagacaagtaaacagaacccttgagaacaggcaagaatgctatgtgtgtcaaaggccgtaatttgtgcaataacattaaggttgctttgatctaaagacagtatttatagtcagtacgtggtcttccactaaggacagtaaatgaatagaagtaaggaagcattgctgggactggcattaatcagaactcaacaaggtgggttagcacccaagatggagttacttttgtctctacagggaagttatatgatcagatataataatcaatctggagacaatataaagggttaataaaaggggagaagcacctgagtctgaaagaaaaattatcagacctgcagtattcccagttaaagatgaagaggacttgaactggtggggcagtaattaaaatggagacaagagagtggattcaagggatatagagatgagtgaatctgaatgatttgttcatgattgcaagggaaaagtatcaaatggaactcaaatattgggcttgggtaaccaaatgagtgaaaatgccatttactgtagtgggtgatgaaaggcaaaccaagttttggcatggagatgatggctttagtttagaaattgcttaatttaaggtgcctattgataacaggttgaaactgccaatcaagcaggaatgtataggaatctggaactcaggaaagtaatattgaatggatactagagacacggtagatttgtttagtcatcagtatttagatcagagtcaggaatagtaaataataattaactcatttccaccttcccatccatgcccatagtgagctttattcattgactgaaacttcttactgagcctaaattttatctggattcttaatattgctctgcatttattaatccgttttcagtcatataatttgacatttgatttaatcctttcctatatgcttgatatagaccataactgaaggcaagaatatgtggtataagaagaagaaaagcatacatatagaggcctagtcaaaaatataaaatgagtgcagaaaaaaacacaaaggagacttaagaagtatagttagagtagaaaaacggctgaaagagtagtgtcatgaaaattaaggaatcatgcatttcagaaataagcgagtagtggtcaatagtagatcaactactcagagagatccacttccttataaaagtctataattggccaggcgtggtggctcatgcctgtaatcccagcactttgggaggccaaggtggggggatcatgaggtcagaagatagagaccattctggccaacatggtgaaaccccatctctactaaaatacaaaaaattagccaggcgtggtggtgtgtgcctgtagtcctggctagtcaggaggctgaggcaggggactcacttaaacccaggaggtggagactgtagtgagccaagatcatgccactgcactccagcctggcgacagaacaagacttgcctccaaaaaaaaaagtctgtaattgccttcaaactaagatataatggataacacaacttacataatgtcaggaattgtagaaagagaaacaagattgctgtaggttaatatggaatccgagatgatgaaggattttggtacacatttaaaaaaattagctacgaaagaatgaaaaatgggtagtggtagctagagggaatgaaaggtatactttgaagaagagtttttcatttttaagattaaaaaattaatctatttaaatatttagagagatattcccatcaataaaaaatgtttacaagtgacgtgattggaactgagctttaagatttctggtattacagtggagaatgtatttgggtagagagatacttaatgtgaggaggccacctcggaggcaatcaaacaagggacaatgaggaaccaaattaggctgtggtcttgagaatgtaaagaagataaattcaaataatatttatggtatctttggcaggacttcacgacttactggatttagagtgtttgaaaaggatatatgttgttgataattctgattttggtggtaggggacagtggctctaattaatacaaggatgccttccttggaggggaagtttgacaaggaaataaataaaatctaatgaataagacacccaaatggagatgttcaaaagtttaggaatgtgagactagagatcaggattaaaaataaaatctgagatactcccggggtcatactttaagccacagtcgtggcaaaagggtggtagactgctgatcttgatacttcattttcactttctatcttatgttcttagctttgctcatcttttagacattttcttgctgttaggcacttatttctggtccatttggttttaattttcaatatactcattgccattttagcaacctcctggccctgctgctgcaaacccatgttctgtacaaataaagctctgctgtctctcattattgtctccctttcttatttcctaattctttcttttcttctttccttcctttcagttatctttggccctctgttttatatttaatttctcccaattgtccttactcttcaagttactagtagatgattcttgtcatcaccctcaccctcacctctccactaactccagattagtttattggatgtttataatcagaatctgcaaggatttgctgaggaaaagcattttgaaatagattattaaatgttttggggattggtatctttttagccttctaatatggtaagttgcttcttgttactaaagagttgataggtaagaaatttaggaaggaggacctttgaaaaataaatgtctgctccatggtgatttccaagttttagttttcataggtccaagaaataccagggaacactgcaatagcctttataacttcaaaaagaaaggtaaagaatgttgtatttttactcctgagtgaatatatatatatctgatatacattagaaaggcagtgtgaatgcaataatcttttcccatctaaaaagcaaaatatggatcttaacttcttatgcataaactagaaatttctggaattttaatgtgttcaagtgttatttcaatccaagcaactgatgattaaagaaaaacaaaatctgtcatgactcagtacttctattgatcaatacagcaagctgcctttgaagtttatatgctgaggtcttaaaagtgcaaatgaaataggtaccagatcactctaatacccagctaagacatatatattcattttcctctcttcttaagtagcatgataaaaaactatttgaagtatacaataaaaaattctgtgcagtgttgccctgctaattgctgtttgagtttgtggatcagaagacaagtcaatcttaatggccattattcagaactgtatgtgacaattctgcttataaggaaagtaacatatatttctatgcaagtaagctaaacaatattaaggcacaatacaatcagccaatatttgctaacctttcattaagaaaacgagcttaaattgaaagctaaatcagtaataatgattattagtgttgcaacttgcatttattacatgcctaacaagtgtcaagagttttacctaaatcatgcctattcttatgttaaatgagttctgttaccacagtgaggaaaaggcccgctcgggaaggtctaacatagaggacctctacaagaaaattgtttttctgacataaatttagtatatatcatagtcaatatgaatgaaattatttctctgataaaaaattatatatgggataggctaaagggcaaatgagttaggtctggctatgcttattttgagatagccaacagatattttaacaattcactagtaaaatgttctggctaaataaaagtgaaaatagataaaatttcttgaacaacatggttgggtcaggatatgtaattaatatgcttatggttaaattatagtttattgtgtatttcttattccacacggtactatcttaagaaacctctggggaggagtggtaggtaggtgaatgggattggatgctattaatggttgtttaacagtttgaaggtttgatgagctcaggttgaaatatttatatttacgagagaagaaaccattaatccatcctgaaaaaatagcttacaatcaataaccatgtgtatcctgtggttgtcactgatggaagtggaaagcttttaatatacataaaggttgacaattacaattgaatttcttgttctttattacatgatccataggaaaatattctcttaaagcaatgtaaattactatatcttggaattatttattaaaatatgacagctttgttgtacttttaaaaaatgaaagcaagagctagcaatctattccaaaataagcatttctcagaaatgttgcaatagtgtttgaaaaattttacaagttttatttggaactaaatatattctttctaattatcagaatttatcatttcaatatataaaatgtgaagtatgataaaaatgtattattaatcctaagtgaaaactgaaagcaactaattccccataactttctttaaaaaaaattttttttattttactttaagttctcagatacatgtgtagaacgtgtaggtttgttacataggtatacatgtaccatggtggtttgctgcacctatcaacctgtcatctaggttttaagccccgcatgcattaggtatttgttctaatgctctccctccctttgccccccaccccgcagcaggccccagtgcctgatgttcccctccctgtaaccatgtgttctcatttttcaacttccacttacgagtgagaacatgcggagtttagttttctgttcctgtgttggtttgctgagaatgatggcttccagcttcatccatgtccctgaaaaggacattaactcattctcttaccattgtattacttggtagaagatttatcaaactccacgactattagttaatttttatatgcctgaagaacaatattatttattttatctgctaaagataagccaagtttacatgagatataaatgtaatcaaaattaatatttagcaaacagatataaacatttaaagctgaaatatttcctgagtagttatttatctgagttgcttttgttttgttttgtttttcttaacagtaaagattgaagtaaaagatgaaggcttattgtgctttagaaagagattcagatccaattatttaatctcggcactttcttgcctactgtatcaaattaaatctatcttctcctcttaagtatattcacccattttatggtgctagttggtacctatttcatttcccttcttaagtatatttacccattttatggtactggttggcacctatttcatttggacatctaaacccattcatagttgggatggtggaaaaatgaatccaagtcccaaatctttcaataaggaaaggatccactaaagttttcctttcaaataccaaaggatttaaaatggtacagttaaacccattgtaacaacacagtctacaatttggagttttaaaagtaaagattattacagaatgataatacctatcgacttggaaaataaaagagactacagaaacaaaccgagaacaggcatccattctattttacctttgaaatttgactcttttgttttgatctggtttgtttctggaaaggagaagtgtattaaatctgaaagatcctgaagctcactcacatactagtgtaacttatagaaagtgcagtggacagggaatttgggagtcctcaaatccaaaccactaattttagatgagttattggaagcttagaaagggtaaatcattccctcaatgctttaaaattggtgtaaaagactcaagcctggaactaattatttgatgttttttcagtcacaacatgctatttgaaggaaatcacaccaaaagcattttctaaattgaaatttttgggggataatttattaacttgagttaatagcaggtctatatctgaaatcaagttgatattctcatgaaaaaatgtaattagaactgtatgttgtagacatttcccttaatgtattagggttttaaatagataaaacctactaatttttaaatttcatgaagacttctatctataatattgacagcttaatttagcatattatttaaataatttattattacttgcaatgtatgtctttatttgtgtcttgattttcaaccaagaaccttacattgtatggcctcaggcaagagaggttttctgggtgtctttgtcatctcaattgtaagtggattgattttgacaatgtgatcctgtagattcatttcagtcacaacagtctgtcagtgcctgggatttttactgggctttttaaatgacactcactagtcatcctagttttattgattttaccccagaatgttaatcaaatggtatcccttctttctaactttcttgctctttttttcttctttcccttctctctccttcacctttaccttttgccagtcttctcaccttcattctcactcttgggacttaagacctcaaacaatagtaaaagaggtaaaattacttagttcagcttatttccatacataggtcagacttgaaatacctgtgtttcacagaaactaagttctttcagataaatggagcttggtgggaatagatgtcccgaaatgtttatcataaaagcacacaactgatgaaatactaaaatgagatcaaaccacgaagaaaaatgaagaaaaatgcattgaaaagcacatagctgttttagtattgttaacatgggaatagaagatgatatatatagttatgttagtactttcatttatgtagatttttttttgtaattttatttttattatttgtgcagctgcattataagtgccttgtattgccatgcctgcatagaatggtattgctgacacatcattagtaataagagattttcattccttaagacaaagactttaatgatctttctgaaatcatagttagaaagttaatatttgaaatgcattacatgttttaacaaacagaatgtgggctacagatttttttttctttttttatgtatctacagctcacagaaaaactaaatgtacctccctgggttgtgatttgttaggatgaactaaaaaatattactgtcccttggaggacgttaggaacctacaatgaatttgaaacataccatgcacttcttacaggataagtagattcattcagaaattaactgaaagccgaaagtagctgttctgccaaatatgacccgaatctccactgaagtcagaggtgatgttagtgaataattatgatcttgattcttagattgccagcgaattcctctcacaattagtttgaccagatatgttcagaatcccaggccctgaaagctagaagtgatactaacaatgagattagcagcaaaaggaaggcagcgtggtaaggtggaagcacactgatctgagagttaaaagctttggtcccggtgttggtttcacagtgtttgcaactaaaaatctgtgaacaaaatcactcattaataaagaaacaaaactaattttgttcattcctaactaaagttgtttgaagactttcaaatttccttccgtaagtaaaattctgggtctaaagccacaattttcaaagtttgaacacctgatttcccttttcatcaacttattaggagagattttaatatgtagagcaaagaacagtgaagatactcagtgaaagcagaaagaggggacaaaggcccacacttccactgtgacccccatcctcagtccagagcagggtcttcagagcaagtctgcagagttggacaatactgagaagccctaattttggacaagataaaatattagcaattataaacagataagactactatatcccatttgaaaatacacaaggaggaaaatgccacaaactctccgcatttaataggattatggacccagcaaagtttccccacttgtacaaaccaccctgtggccatgcgctcacatgcttccattgtgtggatatgcttctgggccaccctgaaaatatttatatatccactgccaccatggaaaaatcatagatttgcttttcacgttttaaaaataggaaatttcaaataagtcagtttctaaagattacatctactacgtttacttatgtgaaaacaaatgtaagcaggaagcaaaacgcaaatagggaggaacatgaccaggatggagttaataacgtgagaggcacgtttgcttattgaatttgcattcacatgctcagtagagcccattcttaattggtatcgttagtgattataaagtcacaacatgttcactagtgtcttaagagacctggttgcagaaaagagaccattgcctgtctgatgaatctattcctttcactttgttttcctgtttataaaaaatatgtattttttagctttcaaaggttaaacgtatgtggtataaaaatgcaagcaacacagataaagcaaaaatgtactctcctttactcccaataactactagtaagtagtggttaacaggattgaccactgttaacctctaattctaacccctgtcaacctccagttgtaaactttggggagagagaaagaggtatataaatagagaaaacctatgcaaacataaaatcacacactttttatttgcatacatgggagtatttagcatcgctttctctttttaactcaatgctatgctatggtcatccttccttctgtgtcagtgtgagtgaaaaaaacacaaactttacaccacaacaatcagcattgaagacttctgtgacttaatgtgcagagatttctccccaccagcaagcaagaagtctattctgctgcagacaccagctagctgtcttccaattcagttctgacactctacctggagatagcgtcagatcccacaggttgagactcagtcccagaaaactgcacccccttcagacaccagttgcatgtccaggcctctggaacttctgacagacctgctttcagttgggttctcataacccctctttgggttagattaacctgctaggacagttcagggaaatacttacatttaccagtttattataaaaagaatattacaaagaatacagatgaagagatgcaaaaggcagggtgtgggggaaggagcacagagcttcggtgccctcgctgagtgtgctgctctctgggaatcttcatgagttcagctgcctagaggctcttcataccgtgtcctcttcggtcttttatggagacttcattggctagttacgattgaagcaatgaacaattatgcataaatgtgattggacaaaagggtgtgatctaatgctaatagactgagtgggggaaacccagcaaggcctgtgcagattctttttggcttttcaatgcagcattccttcctcccagttatggggccagacctatattcagaaaagttaagtcagagaatacctatggtcagctccaagacagaaaagcgggaggaaattagagtcacgccttgggcaggtgcaaggaggatgggagaagatcagagagggattctgctttctgaggcctaaagtgccccaacattataacaaaagcctgtattaagggttatgggagtcataagctaggaaccatgggaaaaaaaaccatttatacatataatatcacagtcagtatgtatgaaaattttgtaagaaaaacctgcatagctgactaaactctttagtaaacagaaaaattttccttcagttagtgcatcaaatcaagcaggatagcaaatgttcttaatcatacttctccaataaagtaggttaagatttctcatatatttacaaaaatgaaatgtaaccagtccttgaacactcttaaactagtaggtggaaacatctttttttttattccaatcattgccttcgtgctgtgtctgatatctattgcctgtcccttaaaagcatctcaggcaggtctcatagattctcatgcattttcagatattaatattctcattagttcagtttaaaacttcagtcacttatccaatttaccatgtatcattcccatcgactttcctccccagtacaggtgcctaggctgggaatagggcatgacctgcttttctatgctttcactacacttctgccctcttccttgctattctgggatttcttcttctccagtgtattggtgaccttagaggaaagatggggtaaaagaggtaaactcctcttacttaattggtggtattgtgattttctcactattgattcttgaaatttctccaattgtacactctgggtggccggtttccccatgctggctctttgacagagtatctgttgtttccttaaaggatctttcaatagcctcatgatggcaaaatcaattttcaatgcagaaaatctaccctagctcggtgtcttttaaccttttatctccttcctcaacttcaagggcactaaggcccatcagcaagtttgctacaaaaatgccctattgaataagttgccgggctctctttgtgattatctcagatctctgcaagggattctcttgacattcccgggggtagaagattgggaaaagggcacaaactaggttaaggctgaaggtccacacctttcagtttttgcttatacaggccagaatgggagggctaggatgaaaatttagggagcacgggtggattggctgccagaggccaccctctttttagaatatgaagtgctttctgcttgtctttgtttcctagcagtcaattctagacaactggaaaattcttcctcaacatccattacatacacagaaactaaagaaagtcacagagagatttaccttaccttttaaatcagaataaattattaatggaaaatgagcaaaccattcaggactttgggtttagcactttgtgtttggtcctctaaactaatttccactaaacattactcctataagttttgcaagataaaaatgtttagacgttttcttggattggaaaatgtgctctgaggtgcagagggcttatttggaagtgctctgaaagacacaccagcaaagaagctagaggagttaagatccaggaaagggcagagggagcagctgcaatgatgttgcaaataaagcctgggctcctcctacaaaggagctcaggagcaggcatagcccttcagagttgtgccaaattgagacaatctagaggctggggcctttctatccataccttatcagccagtcagtagctgaatcctgtcccctgaaaagggttcagcctacgatgaggaagttctcttaggacaagggcaatgcccagtgagactgctgtgagccctcaacagctaatatttccagcagctggggtggtgcctctgcctaaagaggatatacagaaagcaccactgcaatatccattacagaaaatatgaattcattctaatattctactaggataagttgtttctgtttgaacatacgttaaccaaggattctatctcataagtgcctggtgcctagtatcaatattcaatttaaataaagaggccttgcttcagttcttctaagtgtaaaaatctctaatgtgtaattgttaatatactaattatgtaagttttttatataataaatgattgatttttggccagaagtagtaatgtgcattacacattcttttcattatattattattaatgatgattcctagaacttatattccaggaagaactgtatttctcttgtagatgatgaagtaggtacatccacatttgtaagatctttggtgcatcccagatcaacaagtcttgcatcttgggtttgtaaactaatcgataaagccatccaaccctcccagacacatggccacaaagtgacaagaatccagagataaaggtaccgattttttctaaaaggatattacaaaaagcaaatgagcaggtattacttctagatataaatagttacaatgtcagagaaggtagtgaatgcactttaaaaaaagagcaatttttttaggatagtggcacaaaaagaaaatctcataaagctgcagaaacttacaattttggaagcaattgacatgtgtaaaattattcatggatcaaaagttgctaagagcctaaactcttttctagtttctagagaatcaacatattgaagacatgacttaaattgtaaggacttagcagatgaatagaattggcaaaggattaattttccaaagtgtcgaatctccagatataaattacactgcactggcactttgttcaccaaatgcattggagaaaagatattatcctgctaggtgtccttgcttttgcctcagaaatgaacatttagagtaatgtctaatcctttttatattgatattatagtaagaaatggaaaaatgtgcaggatatattatcattaactcttatttgcttatatctcttcttattcaaaacattttattttcctattaaaataaaaacatttttagaaactcagagaattgatgggtcaagttaaaatgttcttatgacaagatgggtgaatctttttcctagtacgctgcacctaagaggctcagtatcaagaaagaaaaatcaacaaagaggatttggttcatgagtaaaaaatacaataaggaggaataacatctagtgttcagtagcacagtagggtgactagagttaacttttttttgtatatttgaaaataagtggaaagtagaatgtttctaatacaaataaatgatacatgtttaaggtaatgtatatcttgactaccctgatttgatcattacacatttgtacgcttgcagcttgttttaaaatatcacatgtatcccataaatgtgcacacctattatgtatccataacaattaaaaatttaagaaagaaaaatcaacatagtcataaatactcattaaatttcttagctctcataactacatgtatgtctgcatgacacagaaatgaacatcaacacatagacacagatgattgatggatccatggttaggatcagtgtaatcagtgtaaattaagcaaactgtatgatataaccgcatttctcattactatatgcaataatttgcctagtcacagtttatacactgagtgtccaagagtcactagtttaattaagtaattttatgatctgatattcacaaactttataaaaataaatgaaagttgaaaagagggacattgatgagatttgtaaaagtcataagatacagttaagaaaagggaaagctaagaggaatttcaagtaatacttcttaatgcaattgtgatatcctggaagagtttctaaaagttggtagcaaatgtgctattagagagaataaagttcaataaggtgactcattctactcagcaccttctggaacttgaagattcaggtggactgggaaagcatcattatatatttattctctctaatagcacatctagaattcagcaccttctggattcaaagattcaggtggactgggaaagcatcattatatattaaatgtgttgtgttgctttatttttctctattggtagctatggaaggttaaaagcaccttcagtccattaggagtgggactctaattgaaacaaatttaagaaagccaggcacggttgcatgtgcttatagtcccagctgctctggaggataaggtgggagaatctctagcttaggggattaaggccagcatgggcaacataacatctctttaaaaaataaaataaaataaggagactactgctgggctcttgagatggtagatgtcaggagtgtttcctacaactagagaaggtgaactcaagttagcattgttccaaagcttgtcagaaccctggactgtggtcttttctcaagttttaattgtaattttcatatcaatgcatcaagtacctcttaaggttccaccatattgcaagtcattgaatcaaagtctgtgtctggagtgtgcagtgtaggaaagaatattctctttgcttttaaaaacattttggagggactagtttagacatttggtactgattcagtgtttctaaataacttccttagagtatattaaagacaggatgggaaagatgtctagtattgtgtaaagcagggtgctctcattgttttgaacacataagattgtctatatcacaatcattggcactcctgtgaactttactagggtgattgagttaggttacaataaaaatcattcttcattaacttatatactattttaacataaactggaaaggaaaggaaatctggttaattttcttaagttataggcccctaaaatgtacatatttcttagtgctcagggaaatactagagcaaaatattctttcatttattttgatcatcagactactaggttattcacatcttgtgaaacttttagttgaagaattttctaaaattctgctcatgcttgtattcaatatatttataataactccaccaaatatgcctaatttgtagacccatttgttgtaatacttgtaaatagtttttttacttttcctgtaactttcttggctaatgaagtttgctggttggatttgttctgatcatccttaaatccttccatgctgacagttttaattaaaagaaaaatttccaatcatttctctaatgccagagaaatgctaagtataaatcatttctattcagaatttcaataccatgtcttctgctaaagcctcatgaaatagttttggcatgtgtggaatatttcatagattgtataataaatgtgagcaatactttacttcttttaaaaaatgctattagaggacctaaacagattacaaatgtagtattcttgatgttttgctattttagtctcattatgggtttaattaggtcttctaattttgaaattttgtcaaactttgtcacactttgcctcagctactgattttttttttaaatcttgtttggggagttttatgtctgttggtgacatttactcaaaatcatcttcagagagatgaaacaaatggtggattttcattttagcagcatttttatcatctcccaataaattattcttgataattattaaagtaaggatggcctcttgacagacttttgggtgttaattgccctggaaaaatatcttagctttattatgtatccctcttctatcatttaacttaaaaaaaattttccctgtactcttgccatttgttttctttacttcaacttatctgtctttgtcttaaatctcctcagtttaactgagaatctgaataccccatgaaagaattatgcatttctggacctgatgaggaagttatgctgacactaagatgacagaatcataacactaagtacagaaacaagagtgcagccattcaggggaacacatagtttagttctctttgatcaaagccagaccctaaaattaaaaggccaaccattgcctctcattttcagaccccaagaaaaagagattccaaagtctgctgagtaaacaagtctgggtgttatgcttaaccaagaggcacaagtgaacatttctccctttagaatttattcttatttattttaattatatgtatttaacacagaattataatcagaatgctttgcttctttactttcagcagtggtggattatccaggtggtttctgggctataggtcctatttaggcctatgtgccccactgagataggatgcaaagataaagttgcggtctctcctaccagtccctagaaggaagtaataagcctcagtaaacccattttacaaataggaaaactatagtccagagaatttatgtgacttgctggaaattatgaaaataatacatacaagagcacatatttaaattagtttctaacttcaagctcacttctatttccaatagtagcccattattttagcatgttccatttcgacattcaaatttggagaaaacgcaaatgctggtttcatacctagttgttctccaaagacatagggacacattttatcagctaacagattaagagaagtctagctacctgtgcattcagtaacagagcatttcaagactttaaaaacatgtagagaacctctatcatatgtcactggtgatggggtgatttttattagttgtttgtttatgcttcccgaagtatggcaatctaattatgccattatctttgctacaaatgttttcattacttagaaaatcattctgctctttttgaatctcaggtacttttatttgcttttcatgacctccagtaactgcgagtgctaaaatgttattatacatgctgggaaaataaatatgtccattcattttaaatttcctgccctttaatttcattgaatttgtcccctcaatcttttattatgcatcaggatataagggcagagcaaattcatttttattctgccctttgttattttgaaaaaccaatgtcaactctttttaatttccattattctggattgttaattctatacttttcacatttaattttacaagtctaattagtatcatccagatcatcaggcagagaaattagtagccataaattaagccacagttttaaaaatgggtttaaaaaaatacgttgaaagatgacttgatctaatatgttacactttcactgtgggatttgtggaagagccatctggcttgtggtcctcctgcccttgaattgaaatctgggttaattgaggcaaagctgagcttgctcttttgtgaaatatgtggaaggctactgctcttttaattgagaaaatcatcaatactgtcttgacatttggatatattcccattttgtttaaaatgtcagctatttgctctcatatttagttgtctcttgccctataaggtttttaatttaaatttccacccaaaatggcatccatctctaatgttgtaagaaatgcactattttcattgcagtcttgttccaaaattcaagagcccaactcaaatgaagaaattttaaagatatgtttcttctttgaaatatctttaaaataagagataaaaagcatttgaataatgacattttgcaacactccaagagttctgaaggataaggtttataattagaatgaagtttttttctaacctgagagagcctactccctttatcccccaatacatatttcaatgtatccaatcatttattcatttccttgtccatctcttacaatagattgtgagttctttgaaggcaaactgcctattatttgtttatcagtaaatctatagcccctagcccaatttatgggctcaataaatgtttgttatgagaataaatacttagccagcatggcaagaatgtagcaaaagtagatgaccttttgatttaaaatgtttcatccatgatattcaatgaataccttgaagtataatgactgccttatccattgttagaagtgttgaacttgaagctgtgaagactttttgggtgcttgtgggttctcaagcagctaattgcttcttttataaaccataattactttaaaaccaaggatgagaaatgaggacattaaaggaagcttcagctaggaattactttaatctgtaattatcccggtgtgtctccctgcctctcctggactgtgagccacataagagcaggcagcgtataggatttcatctcaaaggctgtagcacctaccacaggacctaacacaaataagtgttttataattcaatatttcttgggcatttcatgaagtcaaaaatggttggaataagtattttcactgaaataatctaaccgtggcaatcctgcctgccttccttttagcacctttgcatctgttttcccattgattactttaaaatccccattccccctttattctttccctaagaaactcatacagctgccttgctacttatataaacttttggataaatagcagtgcttaagcatcacacactggggcctgtcatggggtggggactaggggaagaataccattaggagaaatacctaatgtagatgacaggttgatgggtgcagcaaaccaccatgtcacgtgtataccaatgtaacaaacctgcacgttctgcacatgtatcccagaacttaaagtataataaaaattaaaaaagagttttgctaagtcataaataaagcattctatttgcaaggtaagtggctaatggaaggaacctcttttatattcctagtatcataattttacatagtgatacctttctgcaagctcccagtgctttggcagctgttatttatgcttacaacaaacatccagtgaagagccaggatataccatgtcatattgctttcatactataaaagaataacctgagctctggatggctaagtgattcacaggcttgcagttcatccctggactttgggggccctccttgcaaattccttggtgcagccatttagaggcaataaaaacattggcatggctgctcagaaaatactatgctgaagtcttataaacaaatcacttaatatggttattatccatatggacttaatattttaacaactattacttgaaatggaaataagcagaatatgtaggaataccataagtacattttccttctaaattctgactttaatatatatttctataagtaattctgtaatctttagtaaatgaagttctgcaatactcgaaacatagccagatatctaatgataaaatagttttgcatatagagccacaaaataattccaaccaaaagataagaacaaagacatattgcactaaaaaactttgtaaaccagatttagtagaatatacctttttgcttattaagatgaaaatgtttatttaataagaaaattatagagcattacacttgaaggtgatgatttaaaaaataactctagccttaattagtaagtatcaatgactggctaaaaagataataaaatagattataactttttttcaaataattagatttataggaagttgaagaactagtccaaagatgccctgtacccttcacccagttttccctaatcgttatattctatttaactatagcgcaatatccaaaatgagaaattgacattggcaaaatgtgttgtgtagttctatgccattttatcaagatgcagaatgattccaccatgataaaaatatttgtgctaccaccttatagttatacccaccctcatcatccctaccatcctttaaactctagcaatcattaatttattcttcatatctataactgtgtcatttctagactattattgaaacaatttgtttaaatattcacccaatatttaattaaatattgtaggacatttcagttggttctaatttgaggctgttacaaatgaagttgctgtgaacaattatgtagagatttttgtgtgagcatagttcctatttctcaggaataaagactcagcagtgtaattggcatatcatatggtcagtaggcttttctttgagttgtgttatttaagaaactgccaaattactttcccaagtggctgtacaattttacatcctcaccagctctgaatgagagagccagtttctccacatcctcaccagcatttggtatgggcatatatttattttaattttagctgttccaataattatgtagtgatatctcattgtagccttaatttgcatttccctaatggctagtgatactgaaaatgtttttcatgtgcttatttgccatctgcatatcctcttcagtgaaatgtcttcataacttttcctcatttctgaattgtattgtctggttttatattattaacttttggattgtttaaatataataaatataagttagctgccaggtatgtggtttacaaatattttctcccattctgaagcttatcttttcatacttttagtagggactttcacagaataaaagtaatcgattttgattaaatccagtttatcagtttttttgtcttatgaattacgtttttggtgtcatctaagaacactgccaactactcattctcaaacattctgtcctacaaaatcttagaaaagttttataaatttggaaaagttttaaagttggtttagctgtttttcatttaaatctcatccattttgaattaatttttgcataagatatacagtttaggtcaaggctcatttactgcatgtggatatttaattgttcccatagtatttgttgaaaagactactctttccccccacttaatcacttttgtacctttctcaaaaattaggcatgttcgtgtggggcatttctgggtttattagtatgttccatttttctatatgtcagtctctctgccgaaaccacactatcttgattacaatggctatatattaaaacttaatattggtacagtaatttctctcactttcttcttttgaaagattgatttagctgtttcaattcttttaattttttctttttttttttttttttttctgagacggagtctcgctctgtcacccaggctggagttcagtggcacaatctcggctcactgcaagctccacctcctgggtacatgccattctcctgcctcagcctcccgaggagctgggactacaggcgcctgccaccacactcggctaattttgtttttgtatttttaatggtgacggggttacaccgtgttagccaggatggtctcgatctcctgacctcgtgatccacccgcctcagcctcccaaagtgctgggattacaggcatgagtcactgcaccaggccttcttctaactttctgtaaaaattgtacagtaattttatctatatttgtaaacagtcttggtgggatttaaatggcaatttctttaaaactgtatcccaatttgaggataattggcatctttactacgatgagtcttttaatccatgaacatggtatgtctcttcattcatttagatcatctttgatttctttcataagtgttttgtagtttttaccatacaaattctatacatttttctagatttatacctaagtatctgaggcctttttttagcaattgtaaatgttattctatttttaatttctgtgcttattgctagtatataggaataaaatataatgatgtcatagtctgtgatcttaactcatttaatatttctaatttttttgtgaatttcttctgaattcagtatagaaaattataagtagattcaactgaattcctttttttctgatctgtcttttaattacttttcttgcatgattgtgctggctagaaattctagtactgtgtttaataggagcagtgggaccaaacattcttgctttatttacagtcttatggggaaagcattcagtcttttaccattaagtagaattttagttggtatgttttggaagttttttttttatcacattgaggaaattcacctatatttgtatttttctgagattcttaaatcatgaattagtgctgaattttttcaaatgttttttctacatcaaatgatataatcatgcaatttttttcttccttagcctattattattaaatgaacttttcatcccttgaataaacactacttggtcatagtgtatttaatatgtatacattgctgaatttccttggttaatattttgttaaggatttttgcatctatgatcatgacagatatttctatgtaattctcttcttgtcttgtacaactttacatatataaatttaacaatttaaatacaaggggccaattctttaaaggcataaagagccaattcatgaaaaatgaaattaatgatttgaatagcctcatcactcttaaataaatttaatttattatttaaaagcttccataaggaaattttcaggctcagacaattgcactggagaattgcaccaaaggttcaatgtagatttaacactgattctacaaaatttcttccagaaaatagaagaggagaaaacactttgcaattcatattatattgctagtggggatgtaaaatggttcaaatactatggaaaacagtttagcagtttcttttaatgacatactctgtgacccagcaataccacttctaggtatttacccaagagatgttgaaaaaacatgtccacagaaagtcttatatatgaatgtcaaaagcagacttacaactcataataactaaaaaaacaggaaaaaaattgtaatacccatcaactgatgaatgagtaaacaggttagatgtattcataaaaaataatacaataaaagacaataagctactggcacatgcaataatattggtcaatatcagaaacattatgtggagtgatagaagccagatactgtatattttacggttccatctatatgaagttctagcaaagggaaaactaagctatattgacataatcagaacagtggtcttctcaggttatggtgattattaggggtgttagaaatgttttatgtcctaatgtgggtgctgattatatgggtttatataattgttaaaacccaatagcacccttaaaatttatgcattttatcacttgtaaattatacttcaatgtaaaaagcaatacttttactagcatatgtctcaatgtttttattttattttgatgattaatatgtggaattgaattctcttttaagaaagttttattgaattagagtttatatatttttggttacagtctttgattttattctttggtgactcctgtttctgtgtgtgtgtatgtatatgatattttttcaaatttttttacttcttttgttatttttattttatcctttatacctttctatttttgtttgtttatataaattttaattccttctgaaggattttttttttcgtctaaccatcaaatttctgagcttttctgttctttcaaagctcttttttttttcatttattttagctcattttaaagtattagaatgcactttttacttttgtggccacttttttatggtgattttactttcatctttatctttctagtttttaaaaaaatataattttcaggacttttagtaagagattcctgtggtgaatgcagagatgaaccaaaatgtctttcacagcttcctcactccagggttgcctcccctcctgttaccatgaacacctcaaattatagcctttctgtgtagccatgtctctgcctctcagagctaagcccaattcaaaaggttatctcctcaattctatttttcaagacaatgcttcatctttagatttgcagttacaggactttgccagatctgctctctggatgcatttcctctactatttactcacccttacctccagggttctagctctgctcatttttgttttacttctagcagtgttccttcagggtactgctctatacttctagatagttctgagatcctggagatagacttgccagataaaatatagatgcctggtataattagattttctggtaaacaataattgtttaatgtaaatatgtcacatacaatatttttgtttcttaacttgagtaattctaccaggagggcataggtaaccatagcagtgttcatctttccccattcttccctctcccagctccccttagtgaccttagccacttagtttttgtacccatatatgattttcctatgtttttgacctttccaagaaactgagatccagcgttctgatcaatgtgagattcttgccaataggagtgagttttatttacaattgagcagttctgttgctcatgaggttcctcagactatttttttttttcattttctgtcactttcattgcttggctgtattagtggtttggccacacccacccatattctgagttttttatagaacattcctagtcaacaaatttttctggaaacatatttttcttttcttgccatagttgacatgtgtagtttctaaaggaattttggagggattaaaaactacatagctacatctcaagtgtgagccagaagtagtaggagccatagcttttaaaattatatcttctattttttctttgtgtataggaacaaaactgatttgatatatgtatcatctttcattgttgaactcttaattagctctaatcatttgtctgccaattctcatgtaaataatcatataatctataaataataaaagtataatttctttcttcccaactttttaatttgcttttcatattttcttttgctacctaaggcatctaatagaatagtgaagagaagaggtgatagcaaacattttagtcttgtgtctatttactcaattttataatggggataataatagtatctactaaacagagttgttagagaattgaaagaggcaatcataaaattatgtaagcagcatttagtacacattgaactagtaataaatgatagccattatttttttaaatgtcaataaaattattttgtgttatacttatagaggtataaagtggttgaaataaattaaagaccttgggaaatagcaattagaatatgtatgtggatgcactcacaaataagcatattactctgggccacattacattaagaagaaaatatgatcggaattaagagtagatatgtagtaatttcttgaatgaatcatggttttccatattctctttaaaaataaagaggctagtcacattcaaatttcaagtatttagataaacattcagaataagtactttgtaaaacattggattatcatcgcttcctttacagtggtggaaactttatagttgtaagtgtacacagggaattaaagaacaggaaaggaacaaaacaatctaaatggaaagaaagatccagctgcagaagccagaagtgaaagcatggatatattatttagtaacagcctggatgtactatactgcaggtaccagctttatagagatcatcgtacagatattattaatatattactggacatttggaatataaacctttaaaacctgtgtgatgtttaaatatctgtgatgtatttgtttattttacaaatagagtattttctatattgatcctggcttataaattttcacatataatttagccctgttcttgcttatttcttattctactactacagtttatgcttatggtgattcatcaaagtgttctgtggaatctcattttgtgttggagaaattcaggggtctttctctttgctataatctgtagtgatttccacacatgtatcagctaccctgggatacagactctgagatggagatttacatgcagcaagcttactgagctgtgctctcaagaacaaaatcaggattgagcagacaaaatattgtaaaagcaaagcagttgcaacacaagcactatttggtgttatagggctctctaaagccatgggggcctttcatatatgcccaaaactgagcatatacatccaaaattacaggaatggtaagcaggcgtttgtactccccgtggagctgtcattggatgtaggctacctaaaggaaggggacatgccattgaatgaagaaacttcctttggccaggtatttaaaaataagccatactggaagaataagagcttaatcctaaaggggagatgtgactggcacaccacaggattctcttttgtccataatttacactccgtggacccacttgcttcagataataatgtcatcccttctggaaacaacccctccacattagtggttggtttcttttccaaggtgaatatacaagattagagagtaaaaccacagccccactgctgcagatggttgtgagaaaactgacacatattgtctctgtcctctactatccttccaatctttattctccaaacactcatctagcacctctaccagtctggccagcttacctagtgggatgatccagaccctcaatcccaaggggtctatgccactgttcagcatgcctgtcaagttgtggcaactgctctgatgcactgccatcaaaacttggtaaagaattagcaagcgatgcctcattatctcatctgggtgccaaacatattcttttctggacccaatgatgatcaggatctattacttctgccaggagagtgacttcttttctttgttcctgatctcttagatcaaagaatttaaagtaactgggtggcagctatggtttaaatgtaatggaattctggctttattccctaatggaagcacttttctcagcaatgtaggacccccagatccacagagcctaatttgtggaaatgagaaacacaaattcccccaagattgtcgctgggagtgatgagcagaactactcctgggtccactgctccacccctggatccacacattctacctattggagacatagcaccatgtaaccatcattcatataagacaattactgcatcacagagaagacacctacacttgcacagtatcatctccaagttagcacctcatctgcatcttcaaaagccagattggtctgtcagactggcagcatctaggtgctatgtgaccaatgggtatctgctgacttccctcctttctttactataaagtatgtctctagtagcaatacagtattttctaagatcgtatgttgttggaacaaacattctatatggcctcagtgactggttcttctaaagcttataagcagaaaaggtaatccatactcagaatatttccaattttgcccagatgaatctttccgacttcaaggatgcaagggatccaatgtaatcatctgttactgactggctgttggtcttatcaagaagtagcaccattttggggattgagcattgctctgttgctggcagattagttattcagctgtggctaaatgtgccatcccaattcaccatcagtgtgcatattaagagtttcagtgttactgaatgccaagaactattatcacaccatctatttcaagtggtgaggtcctcattgccagctatcatgaagtgatctagtgtctcttttcctggacaacttctgattttaatggttgtttgttcagtacctcggtaatagactctgagatggagatttgcatacaagcaatttattagagtgtgtttccaggaacaattgtaatggaatgagagaagcatgactggtcagaaggaaaagatttgctgcaattcagtagcaatagaagctgatcccatgtagagcactgaagctgggctagtctttcatgaatgtccagaattgagacaaggacctggtagccttgtacctccacatcaaccagtcatgacatgaaggctgcacctgaaggagtgcataaccatgagacaccttactttggctaagggtaattcctgagcaagaacttgactgtgagctgtcaacaaataatatttccagcagctggaggaataattagcatctcagtcctaaaggaacacatgggatgttcccttacagtagaggtccccaaccccggggctatggactggtactggtctgtggcttgttagaaattgggccacacagcaacaggtgaacggcaggcaagagaacattactgcctgagttcctgagctctgcctcctgtcagatcagcagtagcattagattctcacaggagcgccaaccctattgtgaattgtgcatgcaagagatctaggttgcgtgctccttatgagaatctaagtaatggctgatgatctgaggcggaacagtttcatcccgaaaccatccccacacccatctgtccatggaaaaattatcttccacgaaattggtccctggtgccaaaaaggttgggaccgctgccctacagcatctactacaatctgagttctagaatgcgttaattgaattatgcttctttcaagtacatatttggcaccccaaagttttataggaaagataagtttgtactgaaataaactgatgatactttttttcaatttagagttaggatctactgtaaaacaaaaatcggccgggcacagtggctcacgcctataatcccagcactttgggaggatgaggcaggcgtatcacgaggtcaggagatcgagaccatcctggctaacacggtgaaaccctgtctctactaaatatacaaaaaaaaaaaaaaaaaaaaaaaaaaaaaaaaaactagctgggcgtggtggcggatgcctgtagtcccaactacacgggaggccgaggcaggagaatggcgtgaacctgcgaggcagaccttgcagtgagccaagatcatgccactgcactccagcctgggtgacagagcgagactccgtctcaaaaaaaaaaaaaaaaaaaaaatcatttccctgtgaagatgacactattaaagtaccaataataaatagggctcaggattttacaagttgtttggctgaattttcatcattcctcacatttgcttaccttgtaacaccttgtggccctgcatttgcaagatgtgtctctgctgagacttacgttctatagacaaagagcaggaaaaacactaagaagcctcatacatagaaattcaatccaaaaccatgacctcattagtagagtattctaaatacctgtgcatagaattatgaatttgataaagatacaatggttatttctggagccaaatgataaaacttgatttttatgctgatttagacaaaactcaattttacccttgagtaggagaaaacatttttcagaggaagatagtttttaaacttttcagcattgaatcatatgtttaagctgtgaattagtaaatttggccctagggtgatttaaaaaactaaacaatctaaagattggaagaagctaatatatatagttttaaagacaaaatggataaggatataggcttaccttctgaatcaaggccttagtttttaagtgcaaactttgaactgcaaataaaatacctgtcaacgaagtatgttcttgaaaatccacttggcatttttctcaagttcatgcatatatatgtgtgtgtgtgtatatacacacacacacacacacagagagagagagagagaaagagaaagagagagagtgtatatattcttcatggatagtgaaacataactatccattgttggtgcttgcagagcactcttacttggccttctttcatcttttggaatgattactacacacgacactctaattcaaagagtattttagtactaaatgtttatttaaatttgtacatttttggcattattttaacatatcctctaaggccctatctactgacaccctatctactgaatttgatcaacacatttgatcaagtagcataagtcttgcaaataatgtgtctacttgatggccattagagggccttatttttttttctcatgatatattcgttaagaaattataactacaccctttattaaagaattcttgtataatgatacaaaaagtaatcccagtgctgatacttttgtttgatgtcactctacaatcattatttccaataaaaatgattgactgtctaagtggctgacataaggaatgagacattctgtttgttgctatcaccactgttggacttgcccatgggcactgcagctaagacttgttatatgagaaaagtatacttctccagaaaaaaataacaataaaatccctttgcactcatccaggaatgttagtttcaaaagtagatagaactagaaatatcagtagatttcagattatacaggtaggttcacaatggagttaagacttaaactcaggtctccaaacttctatatatgtcttcctattaaataactaatttaaataaatattattaacaattgaattctagaaatctgcctagaaaaattaatatatttaaatgtctcaggattcaaaagaaaatgcatataccaaaagtcagtgtgaaagattctattaaatccagtccactcaatatagaatatatgtatagcacttggccctcgtggcaaattacttgacactaataaatcttttctttttaatcaaaaacctcaatattaacatattcatttcctgttgctaaataacaaagtaccacaaacccagaggcttaaattaacaaccatttactatctcacagttctaggggccatcattctgcctaccacacttaaaatagggaataaaaaataaatgaacttaggctgggtgcagtgtctcatgcctgtaatcacaaactgggaagccaaagcggggggatcacctgaggtcaggagttggagaccagcctggccaacatgatgaaaaccaatctctactaaaaatacaaaaattagctgggcgtggtggtgggtgctggtaatcccagctactcaggaggctgaggcagaagaatcacttgaacctgggaggcggaggttgcagtgagctgagatcacaccactgcactccggcctaggtgacagagtgagactcagtctctaaataaataaataaataaataaatacataaataaataaaataaacttaagaaaaatgccaagcagattttcaagaacacactttgttggtattttatttgtagttcaaagcttgcacttaagaactaaggctttaattcagaaggtaagcctatacctttatcctttttgtccttaaaagctagaaatgaaatcaaaaggatattttattggatactatgaccatattcagattacaaagtcatagccaaaatatgcataacttaaaactgaattatgctttttgttaaagcaagtacttttaacagttttttattttaaattgaccattttaaaaaaaagtttttatattccatgataatttactttagctcttctgagagcaagctttcctgctatccatgtttccgtcttatgtggtatgcatttaaatacagatatttcattaattaaaagtctcgatgattttaagtatttctctgtaacactgaatcaatatttagatttgagcacatggttctctcttcaggagattttatttctctgcacttctcagtgtaccagaacccttgagcccaaaataccagtatactaatgtaatgttcaatgtataatataatgtatacatgtgataggtaacatccaaagggttctccttgcctgctccccagacagagtcgatttatccggacaggagaatagagagtttaattcatgcaatgctggctgaacacaagactggagttttgttattactcaaatcagtcccttcgaaaatttggagactaaggtttcttaaagaaagataatttggtgggtagggggccagggagtgcagactactgattggtcaggctgtagctgtcatttgcactgagtcagtcggttcctggtggggggcactagaagaccagataagccagtttatagatctgggtggcaccagctgatccaaccagtgcagagtctgaaaaatacttcaaacatgaatcttaggttttataatactaatgttatctattagagcaatttgggagattagtgatcttgcggcatctagctgcatgactcctcgccagaacttctaatttgtggctaatttgttaattttacaaaggcagtctggtccctaggcaagaagggggtttgttttggaaaagggctattgtcatctttatttcaaagttaaactgtaaaatgagttcctcccaaagttagttgagcccacgctcaggaatgaacagcttggaagttagaagcaagatggagtcagttaggtcagatctttttcactgtcataactttctcactgttatgatttttgcaaaggtggtttcactgaaaattcactagatatagaaagagtgagcttttgctcttgacggtatccaaccaagacaggtatttagaagacaggtatcacacgaaatattggtaaatgcctatcctgtcacttgtgtaggcagaaaaaaaatatgcacccagtaaaaatttagatagaaatcttttttatataaaagcaaattgggaagttgtattgtagcaatttaaaatgtttagaaaaatgttatgactcagcctacacttataatctaataccatacaaaagactcaaaaggaatgaggatttcttaatgtgtttgcctaaaacaagattttatatatagagagagattgattgacctgtatctgtatttggatacttttaaaccaaacacaatgaacagatctttttaaggttctactgattgatgtctcatatttcccaattaagataatttacatattttagaagctgtttacatgattcttagaattgctttgaatttgaaatgaaggctgggggataggacagctgaaatgagattaaagcatctctgatgagaggaaaccacttatttttccaactctaaaagggaagaatagtagactatgcttattcaaaaaaatttacaactaccacacatctaccataccttagtaaatgataattatataaattttgaaaatattattaactttctatttttgggtctttaaaagttcctgatttccttattctaatattcttaacattctctacaatattttttcgtctttctcaaaacacagatgtatgatatttccaatgagacatctaatattacatgtatttttcctctttactggttaagttgaaacttgctgattggttggaacacactttatctatttttttgtttgcttctttgtcttatctttctgtttttcatgccattcctcatagactaagatctaaaatctaatatttacttagggaaaactatgattgctaaattaattctctatttagttgaatttgtatcatcttactgaagcaaagggttgggtgtttctctagaaaacaagagactcataaaaatataaaataccaataattcacttttacatattaaagaaaagcaaaatgaaacagaaaagcaaaatgaaacagaaaagctgtatataggttgtagtggcagatacctctattcttctgttaacagaatcctaatttgctccaggagtttagaggaacagcaaagctctcaggcaggtcaaatcatcgtgcagttccaagggatgcattacaattgattaagcagccataatcatcccaaacttttttgccagtggtttaatttggggtaggcttgttacaaatttcagctaatgagatgtaagaaatctcatgtgtgcctctctaggaagagttttccttcctggaagaacagagtgttatacaaggaaaggagcttttttctcctgcctagtgcctttctatgtgtctaatgtgttactttgtggggatttgaaagaaaatcccagaagtatagatctagagctctgatagcattgagccattttgtcaacagtagcccatttccagactttatatatgagaaatttttttaaacatagtatttaaaccacgtgtaatttagtattttcttatgtgtagccaaaagtacttctaactgaaatagtttgtttttttttgtttgttttttttttgagacggagtcttgctctgtcactaggctggagtgcagtggctagatcttggcttactgcaacctctgcctcctgggttcaagcaattcccctgcttcagcctcccaagtagctgggactacaggcatgcaccccacacccggctaattttttgtattttaatagagacagggtttcaccatgttggccaggatggtctcgatcttctgacattgtgatccacctgcctcggcctcccaaagtgctgggattacaggagtgagccacagcacctggcctgtttttcattttttaatgaatcttaccaaagtaattatgatactaatagattggaaccctgcttttgttgatagtcactggagagctgttagatcttaaaaatatatgtgcttctaaaatgggggaaaatacaaagctgcaaagctttaattcatattaatcatttatgatgtaccatcaataaatttatttaaatttgaaacttcactctccaaatgagcatttgcaatacaaaaaaatactcgctgggtgtggtggctcacgcctgtaatcccatcacattgggaggccaagatgggcagatcccttgagcttaggagtgcgagaccagcctggataagatggcaagaccctgtctctacgaaactacaaaataataataataattagccaggcatggctgtacacacctgtagtcccagctgctcaacaggctgaggtaagaggaccactctagcctaggagttggagggtgcattgagccgagattgctccactgcactccagcctgggtaagggagtgagaccctgtctcaaaaaaccaaaccaaataaaaaaacaacaataaataaacttaagcacctagtttagaattctgtaagagaaatgcaaaccgagtgatcactgcctccttgatttgtccacattatctaaaattgctgagcaattaattggatcagccacatgatattcagaagctccctataggtgactatagaatatacagactcctggggaactctagttaccctgttgagcaggttgagcagacagactatttttgatacattagcaagcctatctttttgaaaagaaattgtgtactatatatgtttttctgagcaaaacacttcccaatagtctcacaggtaatagtttacagatgtgctgggatgttgagctcctcatgaggaacaaggggtggctagagtccttgggttagtcactttcagctgctgcaagctatcttttttgtttacattggtgtaccttacgcatagtatcattgtctatgagtgctatgaattttttcatgaagcacagtagaaaaactataattaaatatatggttaataatgcttctgtttaaaattaattacttatcacaaggggaaaggactcaacacttttagctatcccaggatacatcagttaataagaatcacagatgccttcgaagtggtcaaaatggtcataaaaatctaagaacatagctaaaagtgatgctctccactcacttttctgggccaaatacagcagtattcatttatagtgttaaaatttgtcaaaaagtcatagtgaagaatatttggtatgaaaactaaaatgacagatattaaacaattagtaatttaaactctctcccaatttttaagggagcaatgataggtgataagtgtagagctgctacttggttattagaattttaatatttttgatgatatcatgtaattcattattctaactaaaaagtattacaccgtcatactgatgatgattatcacttgcttttctccttctttgctttcaaagtttgttgcaataaaaagttatttgattaggtatatttttctaggcgcttaactcattttgacaattttttcacaagtttggaaatattcagaactctaaatttatttatttctgcatcctagaactttattctaaaaacaaacaaaaaaagtcttatattgttagaatgttggaaatacactgagaatttgcagagatgcttatgaaacaacagtacctcatttcctgtcatagaccttcacagtaattacatcagccaaataaccaaaaaaaaattttctatttgcatgccatttaaagattagcaatggactgattctgaagtagtgatgtaattgcctaaaaggagtgaatcaattttgaaattaattacactactccacaagtatttagatattacactcttcagcattatattttagtgacagagaggttaggtggggagagattttggtgggtgtactagtttcccatggctgctgtaacaaattaccacagatcattacaaacttggtggtttaaaactgcagaaattggccggacccagtggctcacgggctgggtgcagtggctcatgcctgtaatcccagcattgtgggaggccaaggcgggcggatcacgacatcaagagattgagaccatactggccaacatggtgaaaccctatctgtactaaaaatacaaaaagtagccgggcgtggtggcgcgcacctgtagtcccagctactcacccgggaggctgaggcaggagaatcgcttgaacccaggaggcagaagttgcagtgagccgagatcgcaccactgcactccagcctggcaacagaatgagactccatctcaaacaaacaaacaacaacaacaacaaaaactgcagaaatttattcttctggagtccacaagtttgaaatctgtagcaatgagcagaaatcagagagacttcagagtctctgggggaaaattcgatccttgcctcttccaggttctgttagctgtgggattacctggtttgtggccacattagtccagtctttaagtccacatcttcaaccccctctctgctctatcctcatcatcaatttctttttgtgtgtgaaataggcatctacctccttctcataaggatacaggtggttacattggacctacgcagataatccaaaataatctcttcatctcaaaatctttaacttaattacatctgcaaagactttttggatatttatttattttttgctataatagtaacattcacaggtcctagggattagcatgtgaatatcttcgagagagccatttcccagcctactattgtgcgtgtggaaggtcgggggaggccaggaagagggccttaaagcaatagaataaagagagtatcagacgtattatatgaaaatcttcaaatttacatgaccctaattttttaaaaactgtattataatacatcttgactatgttctttcaatacctaggtaatcagaaccagagacaattttattttattttattttttagtgttattgggctaatccaagaaacttcaacatagggaaagccccttttattagaattctaaaactgagacttccaaaaccaaatagatcaataaatatgactcatattatttgctgactggccaaaattaagtttatattttgatgccacttctaaaaacaagtagtgatgaatatgtgacaatgagacagaagttgctgttttcaacagtttgctggagattattttcttattattcatcattttgagatctatgaattacacatctacatcttaaagccttgttataaggacaaatatacatgaacaaaaatcactatatgattattttttaaaaaaactcatccctaggccttttctttttttagctttcattttaggttcatgggtgcacgtaaaggtttcttaatagataaacttgtgtcatgggggtttgttgtacatattatttcatcacctaggtattaagcccagtacccaatagttattttttctgctcctctccctcctcccatcctctcccccaccaagtagaccccagtgcctgctgtttccttctttgtattcataagttttcatcatttagctcccacttagaggtgagaacatgctgtatttgatgttctgttcctgtgttagtttgctaaggataagcatgtaaaagtatagtttggtatttttcaccagtttttatgttttgttaacgttcaagtttctaatttatttacatacatgcagggtaatgtttctatataacttaatttataattgtaggtgtttaaagacgcttcagtggcatgctcccagccttaggactataggaatgtaaatatcttggcatgaaatgttttgcaccagtaaaggcaagcaattaatcatatacaggtgttttcatgctgaatgagtattattttttcaatcaaagggaattatttttcactttttacttcaagaaaattgaatacctttggtatactgtttttatttggagcttcataaaacttaaaagtcatgtttatatgttcattaaaataatgcctgttggatgttctaacattgatagtctgtcttaagaatagtgtttaagcaaaatattttcaggcatgatttccaaaagagtttatatgtcttactaaactaaaccgttttttgcaaaatggaaatttctgggaattgatcataatataagcaagaaaatgacaaaaagctaagtaatattgaaataaataatagtagttgaataactcacagtaaatgattgaactgacacatatgttatagaatacttagtgagactttttaatcaactgaaaaaaatcaggtaacagaatatagagcaagattcccatttcatttaaacacatattaaaccatatattcataggaaaaagaatggaaacctgtacactaaaatgatacagatgattacattaaatatggcattttctcaatttccctttttgatgctcaaaattttaaatattttctagaataagaaatttctataaagggggaaaacaaatcttattttaaaatgaattaaacttaatcattaaaacatctatgcaaatataaaatcacaagaaagcttgatcatatgacagcagcactgataaaaaatgagaaggtagaaatctgacttcctctatgatctgcagcataatctatgattagaattggatttctgtcacactctggctgataaccttatcagaacttttatccctgacaaactagaagttataataatagtgtgtttttatgtaggtgtttttcttaagggacaggtttatataggttgatttagatgtaacaggatttgtgaattagaacacaagatttacatcgtaatgtagactgccattggtcctaaaggaaataagttgctttatttgggccacttttgctcttcatttatcataacaataggaaaagaataagaccatggtgagaatgcctaaacattaaatgctactgctattggagatgagaaaactaagctgaaaatataattaactttgtacaaacggtaaatattgtcctactattttgaccagggatgtttgttttatgagtatacatttatatctattaaaacaccttggccaggcacggtggctcacgcctgtaatcccagcactttgggaggccaaggcaggcggatcacgaggtcagaagatcgagaccatcttggctgacatggtgaaaccccgtgtctactaaaaaaaaaaaatacaaaaaaattagccaggcgtggtggtgggcacctgtagtcccagctactcaggaggctgaggcaggagaatggagtgaacctgggaggcagagcttgcagtgagccgagattgccccactgcactccagtctgggtgacagagtgagactccatctcaaaaaaaaaaaaaacaaaacacctttattattaatattaaaacacctcattgttaaaaattctaaacctttttcttgcttaaacaagtctttttttgttgttttttcttttattttcaatacagggtcttgctctgtcacccaggctgaagcacagtgggatgatcttggctcactgcaacctccaactccagggttcaagagatcttcccacctcagcctcctgagtagctgggattacaggaacatgccaccatgcccagcacattttttgtattttttgtagggacggggtttcatcctattctaggctggtcttgaactcctgggctaaggatttgcccacttcagcctccaaaagtactgggattacaaggatgagccaccacacctgcccagaagatgttttattattattattattattattattattattatactttaagttttagggtacatgtgcacaatgtgccagttagttacatatgtatacatgtgccatgttggtgtgctgcacccattaactcatcatttagcattagctatatctcctaatgctatcccttccccctccccccaccccacaacagtccccagagtgtgatgttccccttcctgtgttcatgtgttctcattgttcaattcccatctatgagtgagaacatgcggtctttggttttttgtccttgtgatagtttactgagaatgatggtttccagcttcatccatgtccctacaaaggacatgaactcatcattttttatggctgcatagtattcatggtgtatatgtgccacattttcttaatccaatctatcattgttggacatttgggttggttccaagtctttgctattgtgaatagtgccgaaataaacatacgtgtgcatgtgtctttatagcagcatgatttatagtcctttgggtatatacccagtaatgggatggctgggtcaaatggtatttctagttctagatcccagaggaatcgccacactgacttccacaatggttgaactagtttacagtcccaccaactgtgtaaaagtgttcctatttctccacatcctctccagcacctgttgtttcctgactttttaatgattgccattctaactggtgtgagatggtatctcattgtggttttgatttgtatttctctgatggtcagtgatgatgagcatgttttcatgtgtcttttggctgcataaatgtcttcttttgagaagtgtctgttgatatccttcgcccactttttgatggggttgtttgtttttttcttgtaaatttgtttgagttcattgtagattctggatattagccctttgtcagaagagtagtttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtcgttgcacatgcctatgtcctgaatggtattgcctaggttttcttctaaagtttttatggttttaggtctaaggtttaagtctttaatccatcttaaattaatttttgtataaggtataaggaaggcatccagtttcagctttctccatatggctagccagttttcccagcaccatttattaaatagggaatcctttccccattgcttgtttttctcaggtttgtcaaagatcagatagttgtagatatgcagcattatttctgagggctctgttctgtcacattgatctatatctctgttttggtaccagtaccatgctgttttggttactgtagccttgtagtatagtttgaagtcaggtagcgtgatgcctccagctttgttcttttggcttaggattcacttggtgatgcgggctcttttttggttccatatgaattttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttttagttctccttgaagaggtccttcacgtcccttgtaagttggattcctaagtattttattctctttgaagcaattgtgaatgggagttcactcatgatttggctctctgtttgtctgttattggtgtataagaatgcttgtgatttttgcacatttattttgtatcctgagactttgctgaagttgcttatgagcttaaggagattttgggctgagacaatggggttttctagatatacaatgatgtcatctgcaaacagggacaatttgacttcctcttttcctaactgaataccctttatttccttctactgcctgattgccctggccagaacttccaacactatgttgaataggagtggtgagagaggacatccctgtcttgtgccagttttcaaagggaacgcttccagtttttgcccattcagtatgatattggctgtggttttgtcatagatagcccttattattttgagatacgtcccatcaatacctaatttattgagagtttttagcatgaagggttgttgaattttgtcaaaggccttttctgcatctattgagataatcatgtgggttttgtctttggttctgtttatatgctagtttacatttattgatttgcgtgtattgaaccagccttgcatcccagggatgaagtccacttgatcttggtggacaagctttttgatgggctactggattcagtttgccagtattttattgatgatttttgcatcaatgttcatcaaggatattggtctaaaattctcttttttggttgtgtctctgccagtctttggtatcaggatgatgctggcctcataaaatgagttagggaggattccctctttttctgttgtttggaattgtttcagaaggaattagtacgagttcctccttatacctctggtagaatttggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtgatgatatcccctttatcattttttattgcgtctatttgattcttctctcttttcttctttattagtcttgctagcggtctatcaattttgttgatcctttcaaaaaaccagctcctggattcattaattttttgaagggttttttatgtctctatttccttcagttgtgttctgattttagttatttctgccttctgctagcttttgaatgtgtttgctcttgcttttctagttcttttaattgtgatgttagtgtgtcaattttggatctttcctgctttctcttctgggcatttagggctataaatttccctctacacactgctttgaatgtgtcctagagattgtggtatgttgtgtctttgttctcgttggtttcaaagagcatctttatttctgccttcatttcgttatgtacccagtagtcattcaggagcaggttgttcagtttccatgtagttgagcagttttgagtgagtttcttaatcctgagttctagtttgattgcactgtggtttgagagacagttttttataatttctgttcttttacatttgctgaggagagctttacttgcaactatgtggtcaattttggaataggtgtggtgtggtgctgaaaaaaatgtatattctgttgatttagggtggagagttctgtagatgtctattaggtccgcttggtgcagagctgagttcaattcctgggtatccctgtcaactttccgtctcattgatctgtctaatgttgacagtggggtgttaaagtctcccattgttattgtgtgggagtctaagtctctttgtaggtcactcaggacttgctttatgaatctgggtgctcctgtattgggtgcatatatatttaggacaattagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacaatgatgggtcttgactctttatcctatttgccagtctgtgccttttaattggagcatttagtccatttacatttaaagttaatattgttatgtgtgaatttgatcctgtcattatgatgttagctggtgattttgcacattagttgatgcagtttcttcctagtctcaatggtctttacattttggcatgattttgcagcagctggtaccggttgtgcctttccatgtttagtgcttccttcaggagctcttttagggcaggcctggtggtgacaaaatctctcagcatttgcttgtctgtaaagtattttatttctccttcacttatgaagcttagtttggctggatatgaaattctggcttgaaaattcttttctttaagaatgttgaatattggcccccactctcttctggcttgtagagtttctgctgagagatcagctgttagtctgatgggcttccctttgtgggtaacccgacctttctctctggctgcctttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccgtcagtttcaggtacaccaatcagacacagatttggtcttttcacatagtcccatatttcttggaggctttgttcgtttccttttattcttttttctctaaacttcccttctcacttcatttcattcatttcatcttccgtcactgataccctttcttccagttgatcgcatcagctcctgaggcttctgcattcttcacgtagttctcgagccttggctttcagctccatcagctcctttaagcacttctctgtattggttattctagttatacattcatctaaatttttttccaagttttcagcttctttgcctttggtttgaatttcctcctgtagctcggagcagtttgatcatctgaagccttcttctctgcactcgtcaaagtcattctccgtccagctttgttccgttgctggtgaggaactgcgttcctttggaggaggagaggcgctctgctttttagagtttccagtttttctgctctgttttttcaccatctttgtggttttatctacttttggtctttgatgatggtgatgtacagatgggtttttggtgtggatgtcctttctgtttgttagttttccttctaacagacaggaccctcagctgcaggtctgttggagtttgctagaggtccactccagaccctgtttgcatagttagcagcagcattgtctgcagaaccgtggattttcgtgatccgcgaatgctgctgtctgcttgttcctctggaagttttgtctcagagttgtacccggctgtgtgaggtgtcagtctgcccccactggggggtgcctctcaggctgctcgggggtcaggggtcaggggcccacttgaggaggcagtctgcccgttctcagatctccagctgcgtgctgggagaaccactgctctcctcaaagctgtcagacagggacatttaagtctgcagaggttactgctgtctttttgtttgtctgtgtcctgcccccagaggtggagcctacagaggcaggcaggcctccttgagctgtggtgggctgcacccagtttgagcttcctggctgctttgtttacctaatcaagcctgggcaatggcgggtgcccctcccccagcctcgctgctgccttgcagtttgatctcagactgctgtgctagcaatcagcgagactgagccaagatggccaaataggaacagctccggtctacagctcccagcatgagcgacgcagaagatgggtgatttctgcatttccatctgaggtactgggttcatctcactagggagtgccagacagtgggcacaggtcagtgggtgcagtgcaccttgcatgagccgaagcagggcgaggcattgcctcactggggaagctcaaggggtcagggagttccctttcctagtcaaagaaaggggtgacagacaacacctggaaaatcgggtcactcccaccccaatactgtgcttttccgacgggcttaaaaaacggtgcaccaggagattatatcccacacctggctcggagggtcctatgcccagggagtctcgctgattgctagcagttgtttttaagacaagatttgttagtacaatgttccttaggagtgattctaacgtagtttattagaactgattatattattgttgtaggaaaaaaccgggttcttatcagaggaccaggataatttagacacgtggacatattgtagggtgagtagggcagggtttattgggtgcaaaggaaaaaagggaaacaggaaccctcagcaaagcaagagagtcctgttagctggtttaccccctcacagattgaatcccaggttaccacacaggaagaggagagccagcctgctcccccctacaaaggcgggaacttcccgaggctccaccccattctcccagtgcacaggccggttgggtattctccagggacccctttttacttggctgcctcattattacattaaaattagcagcatgatatctgtgatattggtgagctgatactagttttgcatcctagtagaaacaatcacacctaaaaacattcctatagattgcattaattgtcaatcattaatacatatagataatattaggagagttactcagttatattctgtaatatttccctgtagcttctgttgcagtcacttgcatccagctggtatttaataaaagtgaactcattcatgactcacctccttttctaattaagttcttagtcttatactaccttggtctacctttctaattattgtataacccatgacatataatagggccatgtctctgagcctgaccaatattttggcctttcatgattaacagccttaactaatttttatcttatatagctaatttgatttcatcattggagccacaaataccacagggaagccatgatgattcaattacttttttcagctgatagttttaaccatttccctggattctcaagttaagttaatctctcagatggttcacctggtgcttcagaaatcaattcttaaaagtgaattttatcatacaatagaatttttctctcatcacagacaatatctcaaagtttctgtctgaaacataaaatataagattttcttcacaagaaaaaatgaggctaaaacaaaattagttttatagcagaaaactacaagttaggtggtatctagcaattgtgatactttattatattaggtcatctctccagggcagaacatcttttccaattatactcaaactgcatcattgtcaattatatcacatcaactagttgtagcaacagggaagaagtttgtactgatctttatactcttaaataactatgctgagtaattttaagagcagggtttattgacaaaaatcataggccgaattacaaggcagtacaaaatctccatcaatgtttaggcaactaggcaaaatccaattacaggatatttgatatagataagtgccagctactaaaatgagaaaaaaaatgtagaaaagaataaaaaaagaaaataggattaagataggaggtataagaaagataaatgagagaaaattaatgaggaaagttaaatgagataaattagataaagtcctgcctttggatagtgatgcacaagtagcaattaccctctgtagcactagggtggatttctatgttcattaaaggggttacaccagtgtttttggcaaatctgtaatgaaggatagtgcattgtgagactaactggattgtaatgaaatatacaattaagtgaaaatagtgaaagtaaatgcaaggatatgaaaggaacatttgctatattctttatgtacatatccttctgaattactctggaaaaaagaggataaaaaattatattctactccaaagtaattgccaataaatactgtcaagaggcaactcatagctgcgcatggtggcacatgcctgtagtcctagctattcaagagactgaggcaggaggatcactagagtccaggaattcaaggctgcagtgagctatgatagcaccactgcactccagccttggcaacagagtgagacgccttctctaaaaagtaaataaataaataaaaatatttttaaaaaagtaactcataaaacaagacatagaaaatgctttataattatgtgttgcactaagttagaaataataaattgtattttagatcaaatgaaggttggtttcatgaaatagcattcgtctatacataatggcgttaatatatcaaaaacccttaatctagtgaataatatgttgcattaagtaaacaagtctagtttgcaagttcaatatgatggaacaatgttttatatcagttaatatgagaagtttgagaggctgaggcaggcagatagcttgagcccaggagtttgagaccaacatggtgaaactctctctacaaaaaatacaacaaattagccaggcatggtgatgcatgcctgtagttccagctacccaagaggctgaagtggaaggattacctgaaccagtgcagttgaggctgcagtgatccaaggccactgccttccagccggggtggcagagtgagatcctgtctcaaaaaaaccaaaaaaaaaaaaaaaagaaaagaagaagaaatcatgtgggaagtatattttgtaatatcctaataaataaatctttgaggattactgctattttatttatttatttatctatttattcattcgtttattttgagatgaagtcttgcgctgtcacccaggctggagtgaagtggtgcgatcttggctcactgcaacctctgcctcctgggttcaagtgattctcttgcctcaagcctccctagtagctgggattacaggcgtctgccaccatgcctggctaattttgtatttttagtagagatggggttttgccacgttggcccactggtctcaaactgctgacctcaggtgatccacccacctcggcctcccaaagtgctgatattacaggcctgagccaccgcgcccgaccctactgcttattattttaacaagaagagatgatgatgtgacataatcatcataataaaatgacaacatatagtgaaaattcaagtattgtgtactttcaaacagttgatcattccattcccatacaagccatggagtttgctactactaagaagcctattttatatttaagtaaacttaattgtaatgggtcatatcacttgaagatagtcaaagagcatccaagtgacagagccagatgttaggttctgtgttctcattctctatatgctatttatttgcatgtaatccattacctttcatatgctttcataaaattattaattttggtggctaaaacataaatgtttcaacttgatttttaaccaaactaggtataatttacatttatacatacacataaatgtaagtaactaagtataaatgaagattccaaatttttattatattttcaacatataatactgaagtagtgactattccatatataccatgtgaatacagataaacatggttagcatttaataagcataaaatataattttagttatgaaattaaaaagcttcagcattgacatttttaaatactatattggaaagaatgcttgccgacgacaaattttcaggagagtttgatatgtgtaatacagtgtctttcattagctcatcagccattgctgaagtcctagtatcctgctactttgacttttagtaaatagtgtttatttagctctccattataaataatatggggaaaatatgtcattgtgcacaaaggaagtgataaaacattataatcagtcatgcgttttctatctcttgtaatcagttaagtcattgaaacaaacttaaatgtctccttagatctctgttctataactgaagttcctctcttgctacagcctgcttagccccctaattctgtctctagacccagccctcaactcatagagcttctcaaattccatattttgtcttggatcatttagtttgccctaacattatactctattgagcaacgcacacattaagcagttagatgaaaccaactcctttagaaaacagttttgagttatcatttattgttacataaactcttcacgtagagctctcactcctcatactacatgaatgatcatagtaaatctgataaaaaccgggtctgagagggaagaatgggttctgaatctgaaaataatgattttctccatattgctacttattcattgacttacaaaacattgtcttaataactattttgtgcaaagtactaagttaggaacctaggaatataaacaaaaattaagaagtagtatttttaaggagattaccactgtgcattggagaaaatatgcaaataatcagatataagacatttcatatgaaattaggagaaacaaagtttgttgcagcactaagcagggctcagccaattctggttcggaatcatgagggaggtgatatttgaattaaccttttaaaaaaaatgataggtggtaagaagagaaagtaaaagtattcaagaatacaaggataatatacaaagaggcacaggccgggcgtggtggctcaatcctgtaatcccagcactttgggaggccgagacgggcagatcacaaggtcaggagatcgagaccatcctggctaacacggtgaaaccccgtctctactaaaaatacaaaaaaattagccgggcatagtggcaggcgcctgtagtcccagctactggggaggctgaggcaggagaatggcttgaacctgggaggaggagctctcagtgagccgagatcgcgccactgcactccagcctgggcgacagagcgagactccgtctcaaaaaaaaaagaggcacagaggtgggaaataactttccatctacatggaacagcaaataatatatgtgtctggaatcaaggatgactccagagatcaactgaaacacatggctcaaaaggtaacaaggtgcaagatcatgatcatgatcatggaggttcttgaagcataaattaaagatgttggaactcacctagaaaggttgggagccattggcatttgtttagaagggaagtgacatgatatcctcttgtttcactttttcagaattcacacctgctctttcctttgtttacaggatcctcccatgaaagcccttccaaccccgcatgcttttaagtccattcgttttaagcttgattcatctcttctggaaggtgtttcttaacctcttttgttaagctttgcagactctttttcccaggacaggttatgtactcctctcattttcctgtcttgtgctcagactttatatatttttatgattcttgtataataatgatctatttttaaaaagtcactctcatttgatttgagttcaggaggaattcatcattggtctttgcattctcagtgtcttgctagcatgttgccttctggatgcttcatacattttaactgactgaatgatcagaactatgtcttagtaagaaaatctatcatcattatagaaggtacactagagagaaaatagaataaatttagggacactagttagatggtcactgtaatgggagatagtgaaatgataaaataagaaggtgaatggagaaatgaaaaggagacaccaaagagagaaagctgattggaatgggacagaggcagaaagactgatttgattatccttgacaacttggggaaaggttgatcattgtcctacacggagatggttttgctaaggaaactgtgagtcttcttttggtgggttgtatcagacatatatgttagagcactgaattttttagatgtctagaaactataattattcacttttaaaacaataatgtggattactattttttttgtcttaaaacctaaaaatttatccttaagcaggtttgagctgtaatcctatgagtccataacagtaagaaaaaaaaaaaaaaaaaactcaacagtccagtctggccaacatgacaaaaccccatccctactaaaaatacaaaaactagctgggtgtggtggtgcgcacctgtagtcccagctattcgggaggctgagggtggagaatcacttcaacctgaaagaaagaggttacagtgagccgagatcatgccactgcactccagcctgggcaacagagtgcgactttgtcattaaaaaaaaaaaaggaaagaaggaaaaaaaaatctcaacagagataaacgtacatctaatcctgttccttagagagaagcaatatttaacctttcccactaatcttatattagggtgtgcgaaagttcgttttatttgaatcatactcaactgattccaaattaattatacgttatttctctcttgcttctctacagtatgctgtctggctagtcctctgggttacgtggaatgtgtttgttatctgcttctatttggaggctggggacctctcaaaggtaatttacatctaatttgcctgagtcatcagtagggtgttaacaagtctcttcctaagtaaggcagagtctcatcctgttctgcttgcttagctgcacctcaatgaaagtaaattgaaaggtgtcttgatttatatttctgcatttttatcattaaaaatatgtctggtgagtcacaaaaatgtactttttcttaagcaaaactaagtgaactgttgcttattatagtgaccaggcagtgcactttaaaacattaaccactgaatgatttctgaagcaaaatgtgaatttttttcagagaaaaaaatcttgaagatttctgaaatcacttagtttgcttataactctgctaaacattgtccttattgattttaaataacagtgcaataattgaaacagttaatgggctttggttgaatgaaattgttactagaggtatataatatgttatagaaatgaatacaatcaaccctttattctaaataggctaggaaaactaaatacttgcttttttcatttagtttttttgtgctctgtatgtgtgcatcttgctactatatttttcacatggatgcccttactacacaaatagtgtaggcttcagatctcgaacaccatcatccttctgttagaatgcaattaacagcaaagaagtcaaatgaggtaatccattcaaggtagtagcaaattctgactcttgagagagtttcaaacttgtatgtacttcctcgtatttaaaactttaaaacataaaaattgtaaaatgttcttttacttaccctgtattagagcagaaggcccctgcaaacatgttgatatttgtaaaacccagagatactcacgtgctttaaaagaccaagagagctaaaaaaaattttttttaaagaaaattcctcaggaactacctttgccttgtcaagctatatattttggaaggagagagaagagaatggtaatacacatttatgatcttacatgcaggagtttcacaaagcactcatcatgtgatgtttgtttattagttaactgtgatatgtggctttatatcaaggaaaaatcattttgatttgtttttattcaatgacaaaagatgaaggatcaaataggaggatgacatcatgatatgagagagaaccaaaacttcttggatgtgtaattttatgatcagaatgtggacaagtcctcaccgtggctagcaaaatctccctagaggatgccatttgtgtgttttttgcagggcatcgttccccacactctggttagcaggcagccttttcaggaaggtgccgtgaccaatgaaaataaattgttcagtggctctaggagggacccagaccagattgctgcttaaaactcacattcgcctcagtgtaagaaaagcagacacgcttttccaaggatttgaattccttgcccaatttatacatctctgctactctataatccactttcttcaaaggaattccatagtcgaatgacttttaatgatattttcaattttaaataatcaccttaaaaattgtaaggcaggtgttcagacatatggcctgagtaaaatgatccagcagatcagataatttgtttaatattaagaaaagagagaaagagatttgagcaaagctggctgcacaaaagttctgtaattgtgctcactgctccccatgatgactgcaggcacagaataaagctggtgatttcatgacctcagacacaggcattgaaaccacagcaagggcactaagaattcttccaatgtacatgggcagataatttctatcccttggcaatgaaacagttgataatattttattttcttctcatcctataaaccaaggctgggctctgcagagcacatgaaaatttaataatttcctttttaacaaataacctaaaaaaaaaccataaagggcaaagttatatagttatcgttatatagttatctgtactgggtttttcctctctttcgtgttcaaagcatttgaaaaaaggtgtatttataccatttaattctttagtcgttgcaactgcctcacattcttcaggtaatacagtgccagaaggaagcaatggtaattggtaatggaaaaatgtacagaaagatagaaactcaaaaatggtacatatgaaacttctgataatactaaaagaatgtaaaccattgtttttctcaatccatcagaaaaaaaaaagcaatttgaatgtgtctaccctatgaatggatcagttagtttgaggctgagggagaaatttgtgaaaaagaatcagggttgacattctgtgggctttatatatgtgaaagaaatgtatttatttccatgaaatcttttgtaaataagtgatggcttcataatggatattggtaagaggtaataaaacgtgataaaacattaaggtaaatttttgttacctgattagagtttagaacttttcttttttttattattatactttaagttttagggtacatgtgcacaacgtgcaggtttgttacatatgtatacatgtgccatgttggtgtgctgcacccattaactcgtcatttaacattaggtatatctcctaatgctatccctcccccaacccgcacgccacaacaggcccctgtgtgtgatgttccccttcctgtgttcatgtgttctcattgttcaattcccgtctatgagtgagaacatgcggtgtttggttttttgtccttgcaatagtttgctcagaatgatggtttccagcttcatctatgtccctacaaaggacatgaactcatcattttttatggctgcatagtattccatgatgtatatgtgccacattttcttaatccagtctatcattgttggacatctgggttggttccaagtctttgctattgtgaatagtgccgaaataaacatacgtgtgcatgtgtctttatagcagcatgttttatagtcctttgggtatgtacccagtaatagaatggctgggtcaaatgatatttctagttctagatccctgaggaatcgccacactgacttccacaatggttgaactagtttacagtcccaccaacagtgtaaaagtgttcctatatctccacatcctctccagcacctgttgtttcctgactttttaatgatcaccattctaactggtgtgagatggtatctcattgtggttttgatttgcatttctctgatggtcagtgatgatgagcattttttcatgtgtcttttggctccataaatgtcttcttttgagaagtgtctgtttatatccttcacccactttttgatggggttgtttttttcttgtaaatttgtttgagttcattgtagattctggatattggccctttgtcagatgagtagattgcacaaattttctcccatgttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctccatatggctagccagttttcccagcaccatttattaaatagggaatcctttccccatttcttgtttttctcaggtttgtcaaagatcagatagttgtagatatgcagcattatttctgagggccctgttctgtcacattggtctgtatctctgttttggtaccagtatcatgctgttttggttactgtagccttgtagtatagtttgaagtcaggtagcgtgatgcctccagctttgttcttttggcttaggattgacttggcaatgtgggctcttttttgttccatatgaactttaaagtagctttttccaattctgtgaagaaagtcattggtagcttgatggggatggcattgaatctataaattaccttgggcagtatggccattttcacgatattgattcttcttacgcatgagcatggaatgttcttccatttgtttatatcctcttttatttcattgagcagtggtttgtagttctctttgaagaggtccttcacatcccttgtaagttggagtcctaggtattttattctctttgaagcaattgtgaatgggagttcactcatgatttggctctctgtttgtctgttattggtgtataagaatgcttgtgatttttgcacattcattttgtatcctgagactttgctgaagttgcctatcagcttaaggagattttgggctgagacaatggggttttctagatatacaatgatgtcatctgcgaacagggacaatttgacttcctcttttcctaattgaataccctttatttgcttctcctgcctgattgctctggccagaacttccaacactatgttgaataggagtggtgagagagggcatccctgtcttgtgccagttttcaaagggaatgcttccagtttttgcccattcagtatgatattggctgtggttttgtcatagataactcttattattttgagatatgtcccatcaatacctaatttattgagcgtttttagcatgaagggttgttgaattttgtcaaaggccttttctgcatctattgagataatcatgtggtttttgtcgttggttctgtttatatgctggattacgtatattgatttgcgaatgttgaaccagccttgcatcccagggatgaagcccacttgatcatggtggataagctttttgatgtgctgctggattcagtttgccagtattttattgaggatttttcatcgatgttcatcagggatattggtctaaaattctcttttttggttgtgtctctgccaggctttggtatcaggatgatgctggcctcataaaatgagttctggaggattccctctttttctattgattaggctgtcttttctgcttttcctaatgaactctctgccatatgcttatgagtgaaacagaaattatagtaatcaaccaactcacagtgtacattcatattgaaatgacttaatttcaataatatgatacacaggactaacccttttgatcatgttttctttgtacacatagaggtatagttaatatattttcttcattgaaaattctatgaaaatccaacattattattaaaatttccattaacatattttaattacagtgtccacaaaatctaaagaaaaataaaaataatccaccggagaaacttttaaatgttatatcatagttaaattaacaaaatgatgggaatatagtataaaatgatacataagatgataggagcaaataaacatacacatttcatataattatttctgctaatgctaatgcattgagatattagtgttgaaactaaatatcctaaagcatttagcagtgtgtaacttcctgggttgatattttcctagatgtcctgttaaggaaactgagaaaaaattagtctgtaacctgaagtgtctggtaacggtttgaaattgcctttgggcatcaaatgtgacatgggttattgaattaagagttttgacaattcctcatatagcttcattattctgttgtattattcttggcaattgtggttcccttgatcatatatcaaatagagagaaataagaactaacctcagccatcaactgagttgaggtattttcaacacagaagagatatgctatttgttctgaagtgatttttaagttgaaagtatatagcagtaggaaagaaaacatatataatatggtgattaatctattcatttcatcacctggaaaaacaaaatttattaaattattttttgaatagtaatacaaagggaagaaaacttagtggtcttctggattgtccgtaaaaacctatattttattgcatgtgataaaattataaattactcaggctgaaattaaatacttacacttttcttcatattactattttcagatatgtttctaccttcataatgtatggggcaccattagtgaatggtgtgcctatctttagaaataaaacaataaacttatagagcgtaaaggataaaccaagggattattgtacacttaaaacaacccaacttgtctttatttaaccctttgggactagggatgcaggtatatctctctcagatttcactatagtaacagaaatttatacctaatgtttgtttcagaatgaacacatttagaagcaactcctagaaagctgtcatattttaataattttgatagttgcttcagagatctagatataacttgtcaatttgaaaatttgttatataaaaaagtcatgtaacaatgtggcttatttaagctttagggaataaaattgcactcttttgaatgtaagagacaggaaggagataaaagttgtcatatactgtagactatagggaacaaatccttaaaaccagatgcaagtgcaatgtggaataatgtactgttccaacaatgtcagttttatttcttctgtaacaaaatgaataattcatttagaaagatatcagatatttggattcttttgctcaataaaaccaatgcttgtatcaaaatttgcttttctgacctcatatgtaaaaagatggtatgcagagaaatatgctgtaatctttttttatttgaaaaaataactcttcctctttagtcttcttcatgagataaaaatatatgagcaattactattaaacaaagactacctataataattgatttaagacaaaatttaacaaatattatgatgataatatattgggttcattttttaaattttgattttcttactgtaaaatttatatatctgagaaaatttcaattaactattactaaagtaattagaaaaaatttttatttcccaactatcaaagcagatttttgccttatgatgcagggaaagatattcgacctattattaataattaaatgtaatgtaactctttcccaaatctagaaatgaaccaaccagttggaatttggtcagtcacaatctctcttctctcgttttccttcataattcatgaattaaactgattatttcctcatttcttaaattcatttttctttgttttattttctgtttccttttactacccctaaagtgaggaaaacagttcatgaacctttcttattctctgtctccattctttttcttgaaaatgccatttgctgacataaactatcatctttacacatatgtctaccagatttatgtcttcagtcttgaccttgttgctaagttaatgtgtcacatctccaacttcctgctggtgtcaggtcaattctattgtcaccttaaattcaaaatgtccaaaatgatttattatcatccccaaagaatccaacttctttaattcactttctactaagagaagaaaaaagagataaaaccaaaatttattttgaaaaaatgaataaaaaaggaaaaagaattttattattattatttttttgagatagagtcccactctgtcgcccaggctgtagtacattggtgcactctcagctcactgtagcctccgcctcccaggttcaagtgattctcctgcctcagcctcccgagtagctgggtttacatatgcgtgccaccacactaggctaatttttgtatttttagtagagatggggttttgcaatgttcgccaggctggtctggaactcctgacctcaagtgatctgccctcattggcctcccaaagtgttgggattacaggcatgagccaccacgctcagccagaattttttatgtggactactaaaatccttataaattgaccatgagataaagcaagaaatatatgtttgtataatgtatctattacttgtttgtgtgtgtatattgtaaactttagataccaacaagttgaaaacaacagagatctgttaaagtaatgactactcaaaaaaagctatattcgaaaaagatgagctaactttgtaaacatgctataccctgggtgcatttgttgtttctggttggggcaggaggctaagtattcaggctttacaccctgttgaatgctattttttgacaaatgtataaatcagcatagctttgagggaggtggtctagtgcacataggcaatttttctgttaaggcattaggcaaattctgtaccaggctaaaaatataaatggaaaaactctgtaaatgcataatgaaaatttttcggcagtcatgccaaattagtttgaagacagggaaggactctatagaataaactagactttcatgtgaaaagatctgaagaacaagccaggggcaaaccaaatacagactgaagattaccagaactaaatccaggctcaactcagcacaattcttgattgaaataaactgattacccatcactttatctctctagttgagagaaaagagaaacatcttaggataaagacaccattatattagacatttacagtttatttatgtgcatgacatcaggcaattgaaaattattacagatgctaaaagaaagaatgtaatgattgaaagagaagaagaagatacacaattgaaatagaccaagagatgattcagatattttaattatctggtaaagatttttaaaaacacataaacaatatattagagaaaataaacgggaaaactggaactaatacattgaaagagaaataatttagccccagagaactggaatttatgtaaagaatcaaatggaaattctaagacttaaaaatataatatctagaagtaagaactcattaagtaggtttaatagtagatttaaaagaatagaagagaggattaaggaacttgagaaataattgattaacattctccaaactaaagcacaggaaagggttaaaaataccaaaaaaaaaaaaaagagagaaaagaatgtcaaaaacatatgggttcaacaaaagattcaatatgcacattattgaattaccaggataaaaaaacagaattggatagaagcaatatctgaagtgaagatgacagagaattttccaaaattaattagtaacatcaacccacagattcaagaatactttcatatttcaagtgtaatcgagaaaaccagatttaggtatagatgaacagaaacattaaaaatctaaatcaaagagaagattataagaggtgccaaagataaaagacccaaaggaacagcaaaaagactgacagttgacctttcaacaggaaggcaattgaatgacatctttaaagtgctttaaaatgccaacctagaattctttaccctgcaaaaatattcttcaacaattaagatgaaatgaaagcatttttcaacaacacgtaagataaataattactagcaaactttaactgaaggaaatactaaaggtagttctttaggcagagtgagaaaaaaaacaccccagagagaaaaagggaattttaggaaggaaagaagataatggaaagaataacacaggttgtattgttaaacacaaaacaatagcaataaaatatttggggatttaaatatttgtaaaactcaaatgcatgacaacaataacacaagaggtagaaaggagctaaagtgttctaaggttgtagcattattatggaaatgttaatggtaatatttatgttagattataatagttcaagactagtaatgtctagagtaactactaaaagatggcataactcctaaaaactaagtataggtgaaaaattaaataatgaaaataattgattagcctaagcaatgctaagaaggaagaaatgctaacaacaacagagagggtcaataagaaaaaaatatcaagatgggtgctataatcttaaatatatcaataaatatattaaatgtaaatatactaatattccaattaaaaggctaagattgttggtctggataaagacacaaaacccaaatgtattgttgtctataagagatatgccttaaataggatttaaattataagttaagaacaagtaaaatctgttcctataaaaacaaatatagtttttgtagatttgtgatgtagtaattttaatataagatgaggtaatgtttaaggcaggaaacattactaaagataaagggggaaatgtaataatgataaaaaggtaaatccacatgaagatattgcaaagcaacattacctgaataaaataatacagcttcaaagtatatgaagtaaaaattaatagaattaaaaggagaaatagccatatccacaatcacagtgggaaacttttacattactctctggatacatcaatcagatgaaaattcaataaggatatagaatatctatataaaacagttaaaaaacttgatataattgacatatagaatacactccaccaaacaaaagggttttcaaaggcatatagaatattcaatcatataatgattcaaaatgtagaaagtcaaattttagaatgatttgcaattattcagcaagtattgtctgacaactatagaattaagctagaaaatctgcaactgtgtggaaattaaacaatatacttctaaacctatggacctaataggttggaatggagtttagaaagtattctgaactcaataaaaatgaatttattgctaaaaaaaaaacttggtggtgtgaaattgcagaaatgcttagaggaaaaaatgaccttaaagagagatattaaaagagtagaaatcctcaaaactcaatgatcttaacttccatagccagaagctagtgaaagaacaacaaatgaaacttctctaaagtgaaaacattctaataacaaggacaatagcagaactcaatgcatatacaataggggaaaaaaagcaataaagccaaattgctttttagtgtttataaaattgaggggatccttatcaatagtgattaaacgaaaaaaagagtaaaatcaccttttgctaatatcacaaataactctatagatgattggagagagtacattatgaacaagtttaagccaatatatttgcaatcagggtgaaatagacaaattctttggagaccacaacttgaaataaattaaaaatctgaagacctttttattcattaaataaattgcatcattaatcaaaatcttttgacagaaaaaaaaaaccattttgtgttcacatgatttcactgaaaaattcttaaaaatgtttaggaatgttatactaccaatatacacaaattctttctaagaatacagcagaagtgcctcccatctcatcttttgaggccagtataaccttacttattgaggatacgtgtgattgtcaaataacagattactgaactcaaatgtaataggccaggcacggtggctcatgcctataatcccagaactttgggaggctgaggtgggtggatcacctgagctagaccagcctcagcaacatggtgaaaccccatcgctaccaaaaatacaaaaaattagccaggcatggtggttcacacctgtattcttagctactcaggaggctgaggtgggaggatcacttaagcccaggaggtagaggctgcagtaagctgagatcgtgccactgcactccagcctgggtgacagagtgagaccctgtctcgaaaaaaaaaaaaaaaagtaataagaattttaaaatgctgaataactctccataaatttataaataattatgatattatttcccacactgtattgtaatacatatgtacatttccatctctctttctaaacttgtatttgctaaaagaccacacatcatcgttatgcaggagaatgccactgagctactacacagtagtgaggaattatagaatcagttaagagcattttaggtgtttataaataagcccatttgatacatcataaaacaaatgcaataagttgttcttatcaatatattctaattatatgtttccttaactatctgttcttcaatgttggaatcatgttttatgcatccctaggatcaaggaaaatgtcaggcatatgaacaatgctcactggaatgaaatcaaatggtaatagagtggacttcagtaattgtctagatctacaaatacagctgctggggactttttcttcccctccactattgcatggataatgaggtctacatctctcacgtcgattccagcactctgtggtggtagcaagcaaaaggaaagtaatcccagcattagggcacctcaaatcagggctctttaaaactaaccattatataaatcactttgatatctttttaattatagattatggttctcttagagtgaggcctaagttatttcatccctaactgctatgtgattacattcttgttgcctgtcaaacatattttgagttgtaaggatttaattactgggaacttcgacatagggcacaaggtgagttcttgatttctggccatcctttgaatcagagatcctagggtacatcttgataattgcgcataaacaaattcatcacctgatgtatcacttactgctgataccacccaagatatcaagtgaaataaccacttgacctaaggggccacttaataggaaataattcttatgtggaccaattatttcaaggttttcagaaaattacagtggtgtccattttttaaaattcaaatatttttaaatttaaagccatggaactcttaatgctgggtaggttatacccagagctctaaggaaaatttaggcttaaattcttcctttaattcccaagttacattatgctgcttttgtgtggtaaaattcttttagaaatgtccccatcctttctccaaggtggatctgactccaaaatgtatccagacatcctctagtttttctttattttcattataattgaattttcagaagcaaaagatctcaattttcagggtattctttggttgaaaactacaactatgcttgcatatttccacacaaatgttggccttccttactcttgtggttaaaacaatttaaaccatttcatagttctcttgtttcctctcataacttgagttgaattctttccctgcataagatctagatggcagctacagttcctatgactctatgaatgaactgctttaatttgtactttcttactttgacatcttttactattcctaaaacctctttcagattccccagtggatgtcaagaaccccattttcttttttgtgggcctcaaaaaatatgatgggtattgaaagagggtccttccaaacagaagagtccccctgagcatcagcaaagttttggaacataagctagcattatttcttctgggtgactcataggcaccatgcatagaaaatgttcgtagaaggtcctcccaaagagcaatgagagcaggtaatcagagttgtttgaaacttagctgtcttcacaagatgatctgttactcattcaaaggcataccttacccaattactgcaacttcttactctgttctctctggaaatggacttttatggttttatctgttctcttttcaatctgttagtaaaaaataaactatgtgcagtttcccttacccaacatttctttctcagcaaccttttattctctcatagatcaaaagctttggtttcaaagctgttatttctgatgtggtctttgagaggctcttttgaaaaataaaataaaaatcaagcaccaaccatttctttctttttgcattcctactaaaacaatgctaattctctttgaagcaatgaggatattactaactcagaagagaaagtttgcaaaacataagtataaaaattaaaagcacagataataacattccaagatagtatcctgctggaaataaaataataacaaatatgaacatgacgtaagcaattaccatccttgtttgtctctaaagcccactctatggaaattattctaggatagtaatttttattctgtcccccattttaaaaacctgtgcttgtataggtttattatttatggagtcatgtaaaataacaagaatacatttgcattaagagttccatggctttaaatttaaaaataattgaattttaaaaaatggacaccactgtaattttctgaaaaccttgaaataattggtccacataagaattatttcctattaagtggccccttaggtcaagcttgtccaatccacagcctgcaagctgcatgcaacccaggatggctttgagtgtggcccaacacacatttgtaaactgtcttaaacattgtgagttttttgtgtgtgatttatgttttcagctcatcagctatagtcagtgttagtatatttcatgtgatccccaagacaattacttttcttccagtgtggcccagggaagccaaaagattgggtaccctgccttacatcccaaaatagtttcaaaatttacctgaaaagtatgtccaattcctcataccaccccagcccctggtgtgcttttggtctttgataagttctgtgatggctgtgtcaaaatcaccgcctttatttaaactactacccagacatgatccttgggactcatttggaaactaaattaagattggcagttgacaaatttgctttagagggcagaatgtcaattttttttttttttttttaacctgtggattcactctgggacaattgatgctttgatgaaatagggggaaattatataaaaatacaactcaagggatattaaatagcaaaatttgtttctggcatccagggttatttggcaaagaaagagcaaacaagtgactgtttttcatgcctttcatatgatgacaaacctattctattctgctttgcacttaaaatttacattgaaaatgcaattgaacctttggtttagtagttcagtacgctacaggtaaccagggagcaatgttcagtaaataccgtgctactagatgcaaaacaatacagagaaaatgaggctatttagctctctttcttgattgagatttgcatgaagaaatttcgaaatatttaagtttcagcgtagcacttagagtgtcacttctcttccgcctctttataggttatatttttaatttttaataacgcaaaatgtgtatacagcctgatgcaatcagaaaggcatcttagaagggtaaaaagaggaggatgactcactaataaacagtcatttatagaatataattagtttttctcttttcttcattagcacatgcaacctgctagaggaatgagtctaagggtaattgtaggactccagggttttcacactcagaggtagcataatatataaaactgaagtaattaggagctacgtcaaaaatgtcatctttcttatgtgtaaaaactaggcattttgtagcaaaatagcaatattaataccacagggatactctgtttcttttccactctgacagaaaaatctctagtgataggtcctcaaatcttttatttaaattataagtgagaatgagtttggtgccctcaattagtccttagaggggaaccaatagcacacaagcaggcacacttcttgcaattgcttctgaagagatctgtagctatataggcactcgcaaaggctgtgacccccccggaaggtacacccagtacactcgattcaccagaaagcctacagaatgaatggactcgagattttgcactctggttttatgagtacaagtaatccattgagaaatttttacacccagaccccccagtacttattttctaacgcatttctgcagtgtgttaactgcggcatcatagtgtgctacataatgagtccaattcttcttgtctgtttcttgtttccttctcaatgaaaaataaaaaacaaagatagctgagtttaatattgccaaatagccaaataattagtacaactgaatattattttctctttaagttatacctcaataaatataaagctagaagcatagttttgaaaacaaagttaacagaatattatctaacagcaataatgggtctgaaatgttccatgcaaggaaacataaaatgttaattgcttacgagataacgagacaagagtgtttccctacaatcttgtaactctagaaagatgagcattcttagtctgtgactaattccattgtttattaattccattgttttttaacagtgtaagttggtcaagagcagtggctcacacctgtaatcccagcactttgggaggccaaggtgggaggatcatgaggtcaggagttcaagaccagtctgaccaacagggtgaaaccccgtctctactaaaaatacaaaaaaattagctgggcatggtgacgtgtgcctgtaatcccagctactcaggaggctgaggcaggagaatcgcttgaacttgggaggcaaaggttgcagtgaaccaagattgcgccactgcactccagcctgggggagagagcaagactctgtctcaaaaaaaaaaaaaaaaaaagaaagaaaggaaaaaaaagagtgtaagttaagttttagcagtgttgtgttagagttttcttttataaaggtaaaaaaaacacactgtaaatgtgatttatgagggttacaacattttccaagtttatatcacttccctggttgtgttttattttctcagtgattccattctgtcgagtattgcataagatcaaagtctctctaccagggcacacatgacgtgatcctgtttggaaaacattatcaaacagtcaagctaaaatgcaaatgaacacaaaccctagtattttctcttgacaactgtggaattactaaacataaagacatgaagattgagaaaggaagggagtaaaacaattacatatttaaaaataaggagaaactggattggttttgatgataaatttattggtactacaaaaagctctcatgacaaaataccatacatgtttatacaaagtattattaatgaaagaaatttggtttcagttttatattattacaaggtattttataatctaaatatttcatcatatgtttggccgaatttcaagttacattctcccagcgtgtgttaaaaggaaaaatacaacatgaaaaaacaatattttgagtgggatgtgcaggctgtctgtatgtgacatgtatcacccctcagatcttcagggtctgttccatctgtgtttatttttcctgaagctgtccactcacttgagcaggctgcccttcccagatagagaaaagccagtctttgaaattcactagaattgctgttctcaggatttttatgtttgtcttaattgataaactgccttaagagaaaggatactcaagtttacttcacactgaaatgttctctttaggaaacatacattttggaaaatattaaaaaatactttaccctgactaaaaacaagttaccatatatggtgattttgcatattcaatgttcctgtatattccaagtatacttttagtttatgtgtcaaaattaggtacatctaaatcactggcaaatattctttttcattatgattctaattcttgttccattattataaacatttctatacttttctaatatgctttgctgaaaagaaaataatagatatttgttaaaaatttttctgaacattctgggttgatcctcacatttgattgaacttaagcaatgtaaaataactcgtaattttcctcagctttctaaaaacagagtttggatattgttctaagtgtaaggaaacattgaaaaacataagtatgatatgattcaaattatagttataaatatcactatgactgttgtgaaaataactctggcaggagcaagagttgcaagaggaaaatcagtttgggtatttttgcattagtctaagttagagatgcttttggctttgattgagaaagcagtaatggaggcagtaaaaagtatatatcctaatgtcatataagattacatctagttatattctcgatatcataaagttagtgctacaagatttgctaatgtcatggatgcagggtgtaggaagggagtgatcaggtttgacatctaggtttgtagtctgaggcatcagaatttggtgtttccctttgttgacatgagaaagacagggagcaggtttggaaatgaaagtagtatgtgtgcagaatccatggctctattttgtcaacatcaagtcttggttgcccattagacatctcaagcagtgttgtcaagcagggtgtagggtgtgtcagtctttaattcagatgctttttgaacagtagacaggagtttcagtcattagtatgtaaatagagattaaaggcacatgaaagaatgagatttcttaggggagacacttagggaaaggaagagagctgagaattatgccccagggctctgcaacttctcatgtctgaagaagaggatccagaaaaggagacaaaggaggagtgcccagtgacgtaggaaggaagccagggcactagtgttcaagagctttggttaaaacactgacagggaaggatgataaattggataaggatgaagattaaaaagtgaatattaagtatggcaaagagaaagttattgccaactttgctaaaagtggttttggtggaaaaatagtaaagagagctttattaaatgaggtgaggtgagaaaatgcagacagagagtaaaggcggctttttcatgaggtcttgtagtaagatgctgagaaatagggatgcaggaaaaaagacacagaggagtccagggaggtttgttcatttgtttttgttggttttgttgaatacagttattggaagatgtttgtatgctgatggaagcaacatagtgagacggagaaactgatggagtgggagcaaaattcttgagtaacttagagaggatggaaaccagtgctgaagtacagggtttgaccttaggtaagaaaagggacagtgaatctgctgcaaggagaaaatgcagagctgatgtatgtagatgcaggcagactggtagatttggtggtaaggcagttaggaaactcttttaattgcttcaatgtgcttcagtaaaatgagtcaaaggtcatcaatttaagtgaaaaggtataaagagagttttgaaaaaaaaaatggaaaagtgtatatgaatggagtgacccacaagaatctatttgacattaattttctaataatgatgaccccgatgtgctgctccattaacagggttgtcaagtgttacctatgacctatgaaactcatggaagctggttaggttgagcagcaatgatgttagccaacatagccatttgcttgtaactgttactgcatcagcgtcacgctcttttgaaccaattaaggaaattagattcagagacctgactagcgagaaagcttatttagcatcaattttctgtattggtttcttacgcaacaaagttataatttttctttgtttttaaatgttatcagtaattaaaatgcaacttcagagtgtcctgtcctacacataattagaaattaggacaaagtgttatgtgcaaagatgttaaaacattatttatactgggaaaatataacaacctaactatccaacagtaagagaatagttataatatatccctaggtggtttattttacggtgcttttaagatcagaaaattagttctaaaatgataataatatattaatagttctgtaggaaagaatttaacacaatggcatgcaagacactggctgaaatggcctctgctatctcctcagctcattctctgcccactatcccttgcagattcctctatggcattctactttctgctgtccttcaaaacctccaagcagatccttctctcacttcattttttggtgttattccatctgcctagagccttgtttctcagacctcctcatggccttagacatgagacatgagaaaataagacaactccttatcttcacgtaggtctctggtctacggtcacctcctcaataaggtcttcttagattattctgcctaaaacacgtgctccagatcccactcctattacttgtcttcactgctaatcatggcacttatcatagtctggcattactttttacacttgtttacttgtggaatgtctgtctttcctgtgaaaatggggacttacctcttccatatacgtatcaagaacaatgccagtaggtactcactatatatatatatatgtatataaattatatatatatgtatataaattacatatatatataaattacatttatatatattacataaactaatgaattgataatgcgtcaaaggaatagcattttaatatattctataatgataaaattatactttgatatccacttttgctcacccagaaagttctcacatcatttaggtatcagtaaatgtctaaaaggaagcagtacagactttatacaataaagaacaaaacaaaacaaaaactgaggtagagcagataaaaatcagaaaaggtgctccccattcagctgaagaaactatcagctcacgagaaaatgttgttgaaaccatcattttctccagaaagttaagaggttacagaactcagaaagaagggggaggaagacattttttaaatgaagaaacacagaaattatttgtagtcagaataaacaccagacctctatcaagaacctaatggctcaaaaactcttaatcaagtactgctttaatgttacatagagaatactctctaggttaagcctttgcccttagttctaagagacataatgtctgagggtgcctgcacatagtttacattggagtatgaatagagaatgtaaaagaagattctaatagtaggtagcaggaaaggtcagaaaagcaatgaacagttttgagatttgaagtgtttgtgtgggagaaaggtgcaaagaaattgaaatttaattactctctaattggagatataatgttgcttaaaagaaaaaattacaaatgcacaactctaaaaacccaccctgataaatcacatatcatatccacttcctttcagccacacatacatatgcaaagacatagaaaatgatttcttttcatccaagtgtgattaaatgagatttagaaaatggctacttggtgagatttttgtaaggcactgaaatcaacaatttttatggtaaagaacatatgttggttttgatttattatttattttccagtttgaataatgcaagatgtttttataaaaagttatggggaaatgctaagcagacaaaaaatctcatagtgtgaaatacatgagtacattaaaaaattgcaataaagcctcctgcaaggagaattagcattgagtgtatgcaatatgtattttccccaagcaaatttaatttgatacatattttcaaagtttaaaagttttctctctttattaaatcagagaacatgtgacaagtataaacttccctacatcactgcctttgtttaagcttaccctacagttagaggcccttctcacatccagcctcaatcttccctatccaatataaaacagaataatgtgatgcattttagaattatgtttttataaatttctctactataaatatcatttatctgactttgatttttattctttcttggaaaaatgacataaaaatccatgccatttatgatgtttgcttttatctagatgtatcctaattcataaaaaaaagacgtttcctttaaaattgatctattggttaaattctgaccatactccctacaaatcagcttctggatcaacaaaatattcttgatgaaggaactttggtattgtcagccatgttgatggatgcttggtaaacagcaatatattctatcacccatttaaggtgggtttagagttttctgatctatgggactagcaaaatgttgctttagcaaagactttaatatgccatctagatggaagacatattataataatatcactaaaaatgggtgatatttaatatcagtgcattctttgacattggatattttgaaacaatattctacaaatcttcagatctcaccatttaccattattctcttatttcaatctactatttctttcttccttctttccttccttcctttctttcaacatgtactttttgagaatcaattacatggcctgggcccaaggatcagggcagtaagcaagccagacccaggtttcctagtcatatattctaaagcctagcagagaagacagttaattaaagcataattgcaatggtgtgtgatgggtgtaataatggagcgtgtaccagatggacatagcactgggacttaactgaaatttggggaaagtctccaagaagcaatatttcaaatggtacctaaaggatgagtcagagttagccacagaaaagttggagaagaagaaaataatcctgataaaaagctgagaacttcactggccaggagagcaagagaaagaggaagagaaatgtgaggggtgaggctggaggattaggcaggaattatattattgacagctttgaaaattcaccattgaactttaccatgagaagattgaggtaaatggaatgatttttagcgtggaatgacataaaatagtttgcattttaggaatataactagagtgaccctcttcataattaggttgcaataatttgccttgggagtcctcaatattgcctgccagtaataacaggggtccagaaatccatattctcttcacatgagactccagcctcctttctcttatgtatcttggtctccattaccctccagaatcttaagatctcaagagagaagagttgagctttttgaatcctgccacattgtgtcaaccctgctggctgtgtggataccacctgaactatagaagctgagtgaaatttccagtccctgtgtacactattggtgtcagtgtgacttcttgctccagtattctttacacttactgaaggggcccctgtgaagcaggttcactgtgcacccattatcacttcagcccaatgcactttgggctgcacttttactatttgtctgagtctggtgacagaacactcacactccatgaagtgggcttattacttatagataggcagcaagggacagcaaaagcctaggattcatggtgtgtcatttctcaaggctcaggaaagctacccagggtgtgaagagtctcatctgtgcatgtcctactttcaccacaactgaggcaccctggaaagcagcttgccctgggttttataccctatgggcaacaggatacactggggtaaagcactgaaggacatcctgttcctatgagtgactggagcagagtctttgctatactggcacaggccagtttctccttatttcaggatgttgcattcccagtgtattccacagttattcttaagaattacaagtgagaaagtggggagaattggatcagtccaaggccacccagagaacattcctgcagcacccaagcacactggctaggcccttcaggttaataattttttattttgtcactgcgcttcctccaccagcactggcatcttcctggatggtggggaagagaatgttgaggcagctgcaatttccatggtggtgctacagagttatgggttttgaagttctgttcagttaaagaatgaggactgagagcagtggctcacacctgtagtcccagtactttgggaggctaagactggaggatcacttgaacccaggagtttgagtccagcctgggcaacaacgtaaagagacctgactctacattttttttttttaatagctgggcatggtggtgcaaacctctggtaccagctacttatgaggctgctgtgggaggatgacctgggcccaggagtttgaggttgcagtgagccaagactgtgccactgcactccagcctggacaacagagcgaaaccttgtctcaaaaataaagaaaggaaagaagaggagaggggaggggaggagaggggaggggagggagggagggaggggaggggagggagggagggaagaggaggggagggagggaaaggaggaagggagggaaaggagggaagaggggaggaaggagagaagggagagagaagggaggagaggagagaaaggaggagagaggagaggagagagaaaggagaaaggggagaggagagaaagaagggaggagagaggggagtaaggagagaagggagagagaaaggagagaagggaggaaagaagggaggaaggagggagggagattggttttcttcaacatcccaagttcagcttctcaattctttcatcatttatgtaatgaattccctgccttataaatttagtttctaatagtgcaagtgctttctttttttctgaattggccccgatacaggttttatatgcagtaagaataatggcacagcaattctgtgtgggaaaaaggtgggacagaggcttggaaaaggtctagaagtggaagcttacctgactgcagagccagtactgtatttgattatcatttctatgattacaaaacatctctacagaaggaagtatgtgtgatatcatcttgaaaaatccatcaagagttcagttgtagaactatgatgtcatttgcacatcaggaaagacattttgaaaggaacttggcttacctttgtgaaatgttagtatagccccattatcttgtgcaatcccagtgtcccttacctgagtaatttccttgttagtttgactttttgtgttttcagaaaattaacaaaagttctggaagaaaatgccagaattttcactgagtttaccaaggagaagaggaggggatcaggcactagaagggagggagacttttacttttcatttatataccctttgaaactgcttttacatattttcacgctatgcagttattactcttctaataaaatttcaagaagaaatgtgctccattgttgaatagttagtacaaggatcaacagaagcaaggggcagccaccgcagccacactgcgtcccagctattcagtaacgcagcagtattatgactgaatctcatctgtgagggctgctttctctttgttcatttaggttcgggatttccttaagaagtaactatgctattgtcaagatgctgaggttgaaagaatctcccctgcaattcagtgtatatacagcacaatgttagagcattttagcagcaagacaatatttcctagggactatatttcatgtctcacttcttcacatgtagatgtgcccatataaatagttctcaccagtggaatactagcagacataatgtgtgtcatttctgggaaattgatttttaagaattgagtgtgccatccaggatctgtctccttcaactggctggatgtagacaacctgatgaggtcttaaggaggatagaaaagcaagggctggaagaagccaggatctttggatcattgtatggagcagtggtgcaagaagtctcatctggaaactcttggggaaccctgatactctttggagggtctgtgaagtcagaagtatttgtctaatgacatcaagaaaatcagagatattagcagatgtgactttttgatattgtataattaaataaggtaacatttgggagatctgtataacttggcaaaccaatattttccaaatgaccaagacgtgacatagaaatcatctgaggataaaagattcatttgaagttcaagatacaccaatggatttcagtttaaaataccatgaaaagctcattgatatggcccagattccacattgcaagtaacctttaaaagactaccacttgtatcgaagtgtaacttcaaagaagactatctactattatttgaaacattcacaaatgtctggaaggactacgaaattgctcttccctttacttagtatatttccctataagaccagatgcaaatatgtatatattagaaccaaagcaagatgtgacaaaagtataatgaaaaagcatatatgaaatccaactgtcttctattaagctatagacattatagaggtttataaaaatgtaaagcagtgtcactcttctcactaaaatttgtttgaaaatatgtagttttttctaatcaagtgcattacttatgttaacatagcagagttattactacttttaaagaaattagtaaatattttaaatttgttttaatttttatatctataaatattcatagctatcacagaagtaaatcaaaacttttacagttctcagtaatatttaagagtgtaaactggtcttgagataaaataaaaagtgttgagaaccatttatttggaagaaagccatttgcttagtaagaaccaatgtatgagaaataaactccattgagtttaggcactttgtattttgaggcctgcgtgttacagcccttaactataacctaactaatgcaaacccctgggatagctttccagcacctaaaagtgagctatacgtttcatcgaacttctctataacactgaattgtagacttgaatatcttctcgtctacagttaaggagaagacagtacatggagactgaataataaagattagccaaatataaaaggttttgagaacttttaaaaatggaagtttcttgtattctttaatgacaaaataatttaatttctactaaacactgatcaggaatcacaatttgtaaatgttacttttaagcaaaacatgagtatttgtgtataatgcattatttgattctaagcttctcagtgctttagtatgaaagcacacattttgtgttaaagcctaactttaaggcaatgaaaataatatcttctctttgtttcctgtcacatcaaacaaattgatcactttatttactatagtaaacagtgcaaccaaaatggtgtatttgtatttagaggtatctgggagtttagatggtttttaggaacagtatttctttttctctcattgttagatttattattgaggtaatgcaattacccattttttttgcattcatataaaacatgtaagacagatgttttactgtaatcctatatccaatcaatatattatttaaaagactactgagtagaaagaggaaaatgcagtttatattgtttacatccttgatgcacacatcctttctgagaggagaaaaaaggagaaaggagaaattgatttatgaacaatctatattttattcattttccaacttttctctttatatccatcataaatgaaatcagcaacagtcaggcacctagacaaattgaaacaaatgcgagctaaaactctgatgggcccagtcccattctggtagagttctgtgtaatgtgttcctggattgcaagtttgatcttgaagatattctatgataggccttttccaatctgctcaagctacacaatattggggtagttcctgtcctctaattctctgccagattgtcatagctaatggcagacaatgtaaaagcaaggaagtttggtggagctgtgagattttgctatcctcaactatatcccacatacaaagtaagcagaagaaaacagtaccccaaaatctattaaagggaacaaaacatgctatataattaatgcactgtctcaaggtgaggtctaacatttattttgttacaggtttcagacttgtttaaattcatcttgccaagttcagtttatttgtggtgacaatttaatcacaaatgtttgatacccttaactattgtgagagaaagagaaggagaaacaaaattacatccgttaccatggcatcatgatatctgttagttttctggcctgtgcctgaaaccatccaaagtggcttatatgtttcacaagttactggtccttaccacagtcaaggaggtaaatgctattttcctcctcacttttcaaatcaggaaagcaagcatagcggttagcattttttctgtactgcttcactttaattatgttgttcctccaatagtgtcaccattcatccagtttctaaaaccagaaactggggaatccactaggatttctcccccaggcaccctttcctttaacaagccatgttaattttacctcgctagtgtctttgctagaaataatatccatcctcacagttgctggctgacatcaattatcaactcttggctgacccacagataaacttttccaaaccatcttcccagagtttgactctctccaatccatttttttgacactggaaacagggtgatctttctaaaagggcagattgtataaggtcacttacccaccagaaacacttcagtggcttcctgtaagctacggaataaaatcaaacatctagcttggtatataaggcctggcacaattgacctctgcctaactatctctttcttccctcacctcccacagctccttgaacctatacccctgacacactggattggatctggtgggcatgctcttgtggccacacacgtgctgttccctcagcctggcagagtgttccttcattcttactgaccttggataaactccatttacacacacactcagctccaatgccaatctcaaggaagttttctctccacttctgtactagcacctatcatgtacttatctctgttattttgttttcatcactctgtcttccatacctggacttgttaggaaaagcttggacaatcagctagcttggctttaaacctttgttttcattgttctgtattccatacctggacttgttaggaaaagcttggaccatcaactagcttggctttaaatcttggctcttcctgaatgatcttacatttctctgtttctctgactctcagtctctccattagggaaataagaatattaattatacctacattagacaatgcaaatatgagttgatatcagaggagtaccattcttagctatgggctcatatagtgtaagtattcaataaacattaattatcagtattagccattctctaggaacataatagaaatactgctatcccaaagagttgtcttcgttgtacttatcactctctgaaattatcttgtttatataagttaattatctgtctccccagacctggaaagtaagattcatgagaacagtgaacttggtaatgaacttggtaaccttgttcgctattgttcttatcacccgatataccatgggaagtcaatatgttatctgagttaatgaatatatttagtagaatattgcagcaatctaaaaaagctgacatgagcaaggagttgagaagtattcaagcaggatcaaagacagattgaactattgcacaggattactctatatcatcttcaccaagaataagtggggtgatgtaggactttttgagaccgcattgataatttgatgccacttaataattaaattatgtgctttatcaagacacaatggattgtccctattaatcacaaaaattattgagatgagcaaggcctaatacttatggcttgtatttgcttgtgatacacaattgcttacaatagtttgactctcttgcacactttctgtttttttgagacagggtctttatttgtcacctatgctggagtgcagtggcatgattatggctcactgcagcctcagcctcaacctcctgggttcaagcgatccttctcacttcagcctcctgggtaggaaggaccacaggcatgtgtaaacacacccagctagttcttgtatttttttgcggggttttgccatgttgcccaggctgctctgaaactcctgggctcaaatgatccacccgcttcagcctcctaaagtgctgggattaaaggcttgagccactctgcccgtctcttttactcactttttaaattaacgcagtcaattccttttaacttgctttctaactataagccattgatgttactgaatggccatgaatcattaatttcacttttgctgaccatttaaaataatatccctgaaattgcaagaatagattccaaatgagaaaatagctgcagaaaaatagtatcatggtgccaaaagtctcgccaagttaagtcacgtgtcacaaatggaaaaagctcaacacctgaatatattttcttttagccagctatgaggtataaaaagttctgttggacatttaaaggccaattggagggcaatgccatcagcaggactgggcatgtcagggagatggacgaggtgccttgagaagctgtgaaaggagaaacaggagtctcttagccactggcagccctctcataatttcttgagactgcttatagacctgttgggaggcttctcccctctaatgtcattctctactaatgcagccaatctccacctcagcaatgcacgattataaccaccccaaatgcacgattataaccacccctagatctttttaaacataaagatcaccaggatctggccccgactcactgaatcggtgtctcttaaaactggaaatttgaatttttaattctgtatatccacaatgatcataaatccttgtttgcccagttcagtctgggtcttcacttgttcttccactataattcattccaaaaaagctctgtgtttggacaataaattatgtgttcaccttacctataggtgaacacatctatctttatgttctataggtgaacatatctatctcatgagtagccaagatctaccccctctcaaatgctgtttctcatatttatgctacatatttatggagttcttgctaaaatcttccactgatacatgtacatactcatatatatgtagttacttcaaaaaagttcatgaaaaatagaacaaaaagataaaaataaaaaatatagactttatttctcagcataatctccatcaagtttaagacacttatgtaagcaatgatatcagccatttagcccatttctaaagaactgggggtcctgggaatataatcagtcaatgcagtcttttttacattattaattgaagaaaaatgggtgtcctttaaagattttttaagattagaaaacagaaagaagtcagaaggagccaagtcgggactgtaagatggatgcctaatgatttcccgttggaaatcttgcaaaattggccttgtttgatgaaagaaatgaacacctgtcgaggtagagaagtactcgctggtaacgccttcctggatgtttttctgataaaacttggctaactttctcaaaacactcttataataagcaggtgttatcattcaatagctttccagaaggcaaaaaacaaaatgcttgagcatcccataaaaccgttgccatgacatttactgttgactggttcactgttgctttgactggaccacttccacctcttggtaaccattgctctgattgtgctttgccttcaggatcatactgctaaagctaaagttcatctcctgttacaaatgtttgaagaaatacttcaggatcttcattccacttgtttataatttccattgaaagctctgctcttgtctgcagctgatccgggcgcaatggttttggcattcactgagtggaaaattggcttagctttaatttttcagtcagaattgtataagctgagtcaattgagatgtctgtggtgttggcttttgtttgtgctgttaattgccaatcctcttcaattagggcatggacaagataaattctcttctcacaaatctacctggatggtctgctgctgcaggcttcatcttcaatatcatctcatcccttcccaaaacaagttatttatttgtaaactattgatttctttgggccattgtccccctaaaccttttgtaacacatcaatgattttacaattcttctacccatgctttaccatacatttgatgtttgttcttgcttcagttttagcagaattcatgttgctctacttggggctcttttcaaactaatttcttattcttcttagtgcctcagagtagatccttttcatacatgtcctaagttaatgtgagtttattttggctcaacaactttgaaatccatgcatagtgttttgaaaacatgcattttccatgaactttttgaaaacttgtataaaatatatgagtgtacacttacatgtatgcatatacatacatacatttatatctttttaaagttgattttacaatagaaaaatgataagcaagcagtgacatcatgtgtctttagtcttctattctgtaaaaaaagtttggacctaattaaaggttttttttttttttttaatcactgtacttcttgcaaagtgtgtgaaagaacctccttgccccattgcatgaaactgaattcacaaactgaactacttcagaatatttagctcttgctcctagtcatataaacaaagcatcagactcaaaggcaaagaaatagtatgccaatgcctggctgattacctgtcatcctcttatctatcattttatgtccagaaaacaacagcattaggtgaagcttgaaatgacaaaatgatccgcatgataaccaaagcatatgagtaacaaaattccagtctaatgtttgtgtatagcttttgtgtttgcaaaattggatttttttcaaatccagcgtgctaccagctaaatctatagactgatggtttaatctatacaaatcagaataagaatacctatttttcgccttttaaagatgaactagtttgtttctaaaagctatgacctcagagaaaagttaatataatctgtgccttgtatatctctgcatctgtactccaggcccagtctgagacctaattggtagtcaagaaatactagccaaattaagatgaataatttaaaaggcaaatggaaacagcactgttctatgtgggtagttctcgactagaggcaatcttgcctctcagttgatacttggtaatttctggagacatttttggttgttataaggagaaggtgctactatcatgtagtgaataaagacctggaatgctgttaaatatcgcccaatgcacagaagagccctaataacacaaaattatctagcccgaaatgtcaacagttccaaggttcagagattctgctctggttcaataccctagatctagactacttccacattttttaacctgaattattaattttacaaaaaaaaaaccctgcttaccctcttgttactattggataaagatcaatttcattgacttggacatcaggacactgttaggtttatttattataccctttctattcactattatgtcctatttattactcaggctagaaacctctacggtggtggttctctgtaacacactcacctggacagcttgttaaaacaaatgtttctggggttctttctcagagtctttgatttaactggtctggggtaaggactggtaatgctgatgctgctggcccatgtgccccactttgaaaaacactgatctacagtaatgtaatctacctcttcatattccccaaattatttcactcctccccttcttccaggttatttgtaatgcagacctcctacttccttttataaatacaatcaattttcattatttgagggttctatattttcaaatttacttaataaaattttctatagcctcagaattaatactcacggtgatttaatgatcattagtggacatatgcaaagcaaagaaaaatttgagccttttaatgcacacgttcttagctgaggttgaacaaagagatgctctgccttcttattttggctctcatattgtgaacaagtatgccttgtatagtctatttagtgccatttttggcatttttatgctttttttgtcagtgattttcctgattaaaatggactccaagcatagtgctaaagtactgactactgtttcaaagtacaaaaaggctgtgatgtgcctttcagaaaacacgtatgtgtttataagctttatttaagcatgaatgatagtgctgttggctattacgtcaatgttaataaataaataatatgtattaaataaggtgtctgtaaacagaatcacacataatacaaaattatatattgatgaattcacctaaatgttgtaaccagaggcttataggaacctaacactgtatttcccctaggaacaatggttcagtattcactaattcagtgtttgctgtgactttatacacaacattattggaatgagacttaagaactgactgtaaataaatctttctcacccacctcccactactttttctaactgccctgtctcccacagggcttcctttcttcctattaaatagctcctcctatctgcaatttaaaaattctgcctcagcaatgctggtgttatttcataatgccctgctgggttgagtttgtatttgatattgtttggtttattctgtgttaagcataatgttgggtacttgataagggtttactaaatattactgaataagttaattcaaatgcaaatatgttatctcagtggagggacattgcaatgttagcaaggattctttttctaatctcttggaacctaataaagccctgaggaaatagactaccttacaagtcagtgttaagaaaaggtaagatatgaaatgattttttttcccaaaaggtcaaaactgttagatcctcaccctctttctctctatctttctctctcctttcctcatctctgtgtacatttgtgtgtgtgtgtgtgtgtgtgtgtgtgtgtgtgtgggtttgaatctgtgactgtagaaaagaaaataaaagataatttattggcatgttagaaaaggaaaaaaatagacatgacagtaattgctgaacaatgcacccatttccattccctatccgtggcctcacttttgaccccagagtagaaaactcttaggtagatattgcttgttgaagagggcatggaaatggatattcctgggccattaacaagctgtgtgtgagtccccatcttttatcctgaagatatctgaaggcttaggttatgttagcacactcagcctgacaagatacagtagacttaataggtattccaaagctctgaaaaggtacagtgttctttcgtctttgctgccagtgcaaagtggtttttctctagtccttttctagcaaagctctcaagctctcctcctatcaacaactcaaaggcgggtgggtgaggagttacttttcattagtatatttccacctaagactgaagcaggggattttaacaaacgtttcttatttgaggtacagcagcactcagggagcttgggacatggctgtttactaaccattctggaactatttcaatactctagcaattaggcaggctgaagcaaacaagctcgagatcagctatgaagacaagtttactgaatgagaacattattctgtcttaataacgttaaccagtagaaaactggcttttattgcttaatatgctatctgaacactatctggcatgtgtcttttccaaaggaagaaataccatctgcagatgaagatttgtaatacagaaaaatacctggttcctattttctgtaccaatttgaaggttagagatacatgaacagagttcaaagaaatattgactacagaatagattaggaaaagtccagtgatttgcaaggaagatgaacatatgagatctacctatggggctttcccttcttaccttgcccagaaaataatgataggtttctctgtctacctcagcacccatctgtgaactggtggaaggagccatgtttatcaaacagagagtggaagaaagcaccagaactgcaaatccagaatttcagtctacagagtaaggaagggacaaggctggccctgcatctattcctgtagaccctgcaatgccaggggatatagcacaaggccattgtaagttccatgaggaactaggaaagagaaaaaaaaaagagaagcatctaaaaatatgttaaaagttcacatttctggtgctgttttggacattttttatgggaaagttctttgtaagtaatacaatatctttgaaagaaatttttgctttcttgccctggtttccatgagatgaataactatatttccataacctgtgcatagatgtggatgattaacaaatacacattgaatggttaaagccttgctatccaggataaaatgatccaaacatgaatgcttactgagtagtatcaggtaaagctccaagtcagtacaagtctacagtgaagaaagatgtggtaaaaattattcttgtcacaaacttacctgtcagctgatgaagtgatgtttatatgtgtgggcaaaaggggttagcaggtgtctgtaatcactctgtcctcttgcctttttgttttcttaatctgtcagtggcaatttggtatgataggaccttttgaagtccagggctgtgcctctcttgttcaccagggcctgacacagagtagctgctcaataaatatttgttcagtgaatgaggagccctttaacaattgggaacatatacctctacagagcagtggactctgaatccattctgagatcgcttctgcttccttgcctcttaaaatccaaaagagtcagaacacacaaagagagctctccatcaagtaaaaatcccccagtgacaacagagtctaaggttaaatataatttttcaagttgtcttctaagattcagagttctcagtttcaactcactattcccagaggatgttcaaagaccaggaaataatgtgaaaagaccgagtctatttataaattacttttggtggtgctcaaaacttgaacttcttgtgatcttatgaactcttcgacttccctgtcccataccctactatccttccccctacctaagtcagagtgtggacttcatggattctattggttactaatctctgctgagcaactcagcacttctggttgtttgtatgaaactggaatctccaggtaaagagtaatttgtcttgttacttgatgccaaacaatgaattcacctgatataacacattcattgaatatctatgcttctttatacaggcagaactcaaggcaatgtatctattatataaatgatatttttcgttccttttctaatatcactattatatatttttttcctgaatcaaaagtgcttttaaaaactggaaaatttgttggatatcttttttatttctcattgtttttaaaataattagatcttattcagggcagccaaattcttaaaatggtagttcacacaaactgtaagctttgtaaggcccgtattttattggtttactgtaatattcagtacctaataccatgctatggccatagtaagtactcaatagctatttgctgaattaacaaataaatgtcctttgtgacgtttttcacttcctccattacttcttagctacaggcacagagcaataaattggttagaaataacccttaaggtttttaaatcataagcaaagcagagattaattctagaaatatcagatgaggacttttccagcagaggtcatagtgagaagtgtgtgtgtgtgcgcttgtgtgtatttgccctgagccgaagaaaagtttagggctatgctagactgtagcagttgccattgaaaaagctgtggaagcacgctcactacagttggttatttcgtagttttgttccagttgtacataaaaagtgtatttatgatagaaaaaaatacaattcttccttctattgatttttgaagggtagaacaatttaaaagttgctgcatttgacagcaatgccagaaatataaattttataaataattcagtgaaaggctggaggtcttatctcatgtaataaggtctctggtctatgatcaatcacctacttgggacaatatgctcctagttttttcttattttctcattctcctgaaagcttgctacttggcacccttgagcccaggattttgaggctgctgtaagctgtgattgcacccctgcactccagcctggatgacagagtgagactctgtctttaaaacaaataaatacataaatacagtttgatctacatccctttccttttggactgtgtttcttgtcagattgttgttatataagtaaaatcaagaagttatagttggagacagctgtggctcagtagaaactctttggggctaaaagtaaggaaatccaggtttagtctgagtctttcacgtgagcaagaaagaagacttacatttaagtgtgtgaaattaacttttaactataaaatactacagagatattcattagcatcatcgttacacaatggcccaatacgtaagatgcaactataaactgatgagaataattattcatgtcacttatagaattttttttttttggaaatttctcatgtaatgtctcttaagtgatatgtgtacattaacaagactgtgagtagtggaaagaattagaatcagaagacctggtttctaatgctggcaatactgtttgctagttttatgatacagacaaacgcttcttctctctaaagttaatagattcatttatgtaattaagacaaaaataatagagcattgctgaaatactgagtgacggttaaaaagcattctattactaatgaagaattaaaaggatgaatcataataaaatgccaggtactggtacagatggtgaggagccgagtctcaaaacctcaccccctgactccagacaccctatacccagcaagcagctactgtcagttccaccctggaacctagtgttagtcatgcatgcgtaatggctgtataaatatacttgtatgaccacaaaaggaaccatgttttatgtgcatgcgcattatatgccactcagttagaattctgtgaactgtttcatttaattctcactacaaacttcaaaaatagatactatttccccaccttttacaagtgagggaatgaagaccaaaagaagtaaaatccattgattaaagttacacagtttctaggcagcaaagaaagagttgaatcccagacttattgagtttaaagtctatgatgtcacctagtatactcaggccctaagcacctaagagtgtctgcagagatctggacatctgttctgggtataatacttgcattgtctaatattttaaggccatgtatttatttactgcatagatttcctctttattttatttgtatttttcatgagtcattactctgcacaaatgactttgggcaaatcatgtgaaaaaaattgggctccatgagatcatctataaaatggctgggttatgttttctccagcttttgtagttctgtaattctgttaagggagtttgataagcacactttctcaatgtcttcactctttttcttggcttcctttaacagcataatactataggatcaaaaagaaaaaagtaaaacatgacctcctaataatgcatggcccttgtattagtcagggttttccagaaaaacagaatcaatatgagatagatagatagatagatagatagatagatagatagatagatagatagattagatagatacagacagacagatagatacatagacagtataagaaattgactcatgtaattatagaggatagaagtcccaatatctgcagtctgcaggttcaagactaagaagagccagtatttcagtccaaacccaaatggcagaaaaaaaaaaaaaaacagtgtcccaggtcagcggtcagaaggaggaattcagcctttttgttctattcaggtttgcaattgcttagatgaagcccgcctatgtaagagagcaaaatatgctttactcagtctatgaattcaaatgctaatctcatccacaaacacccataatagtgtttgaccaaatgtctgaagatctctcggcccagtcaaattaacatataaagttaaccatcacacccccagaagattgtgcttcattgctcagaaaagcttttcttggccatgcggtgaaggcatggggaaaaagagtgataatatgggcttggacttcctgaacatcgtcagtcaggtctctctaatctctttccagagagccagaataagacctgtaagtgagttaacattgaagatgatttataatacctcctctgtatataattaaaaatagacaaaattaaacataaaataggtacaaagtaattgaaataaatcttctcatgaatattttaatacttcaaatttgaaggtaccccctttttcctgatgttctcaatatgcttgccaacactgtcctattcccacaggatgaacatccaaactccatccaagtcataggtgattccagagagaaatcttctatgaaattcttccatctgtcatattttgaattttgcatttttaccttttatactgaaaattattcctgttatttcatttaccaaatagtgtattctttatttatggttataagtggatatcatagatacacttataacaagttactaacaacattaaaacccataaattaatctcattcagtggtaaacacataatgttgcattctagttttccaaaagagataaaagaaatggttaataaaattgagatactcatggatgtctctaataccagctgacttggaaaggtaaacatctcagtcacaactgaaacttagcatgtgagttagaggaatgtaatattaaattcctctcttaaacccttcagatcattatccccatttcacttttaggtaaagtaacatcagtgatgtttttcatttgattatttctttgattacattcataaatagaatggcaatggatatgtccagtgtggaagcatttgaataaatagttgctgaaattgctttataggaaaatagatctagtatcattccatgctgaaaatattgttatatgtcctatacagagtctcggagtaataagtatcatttagtcttgtggtgatatatttgctcatttattctttaactgtgttcaacaaatacttattgagtgaccactgtgtgctaagcctctaggctctggggctacatcagtgaacaaaacatacaaaacctctgccctcaggagcttataatctggtataacttccatggtactttgcatttatatatacatatctccaggtgccctcagtccagggagaaggcactactggtttgttctctaggactttatcttattaaacagatgaggttaaaaacactctaccactcaaaatgaaacaatgggtatctcccaatacatggtaagatgccatgggcatcgcaagatttaataatatttaataatttaataataaattgttactattagaatagaatatgaaagggggaaagataataccaagatgtgaagaataaatttttcaagcaaagagagtggctgggaatgagagaggaattgatacaataaaatgggtaccaaaaaaacacaaaaggaataatgaataagacctgctatttgattaaaaaaaaaaaaaagaaaagaaaaaaagagattcaatgaggcttggaaaaagtctgtcacctagatttgatgaagggcatcggctgactagtagagatacataaggggaatagttttaatgaaacacgatgagtcagaactgtgatttcagtcatgtcattctgccttacttaaagggaagaaggtctagaatcagagttgctgatggagagtatgtttcagcaattcaggccagagatcattaagaatgtgtatagatggaaaggaataaataactattacagatattgttgaattagaattatgtgtgggagagtgggaggtgtatgaggcatcaaagatgaccaaaaacttgcttctgatgcatcaaagatagtggcatttcccacagtgatggaaaggttacatttaaaagatgaattctatttgtttaaatttatttttaactttaatacaggcattatttagtctttcttatggagaagtattaattatcatcagaacattagaactttatgatttttgtaagttgtggtgaaaatacaaaaaggcattagagaatgattttacttttttatctggaaaaggaacagttaactgttttattaacagtagtggttgatacttccatagatctgataaaataaatatgggcctttgatttttattcatatctctgatataattatttaatatatccctaaatataactctaaatacacataataaagaaaattataatgatggttttaacatttatagtgtagtgttcctgctttgaaattttgctcaaagaaattaacagtttgtataaattgcattgtaatttaaataatataaataaatgtaattataatttttcagtaatttctgataattatttacttttttctagaacacattatggtagaattcaattcaaacatattcagtgcttaccaataatgatgacgtctaagaacaacgataatataattactccaaataatagctaacaattgtgtacattcactgtgtacctaccattgggctgttttacctcatttaataatagatgattgtccctgctttattgattgagatactgtgtcacagagagttttttttttttaattataaccaggtttgcattaagccagattttgaacccaacaatttcaaccaatatgttatgcaatactagagtgggcgttgaaatgtggaaaaaaaagaatttaaaaaaaaactgtttaaattgtatacatttgaaattgttttctcatggaaatttgtccttatccatataacaagcatgtcaggtagtcaggtgttattatctccgtttcaaaccagaaaacctggctcaggaagattaacgaattgtgaaagtcaaaactgtttttcagtggtcaagagggaattttaatgctctttatattttgattttaaaattagattagcttcattggaagaagaatggcctgaagtggacctaaagccaggttctcagagtttatggtgcttaaaaattcctagggaatttatttaaaatgaagatacccggggccgggcgtggtggctcacacctgtaatcccagcactttgggaggccgaggcgggcggatcacgaggtcaggagatcgagaccatcctcgctaacacggtgaaaccccatctgtactaaaactacaaaaaattagccgggcgtggttgcgggcacctgtagtcccagctactcgggaggctgaggcaggagaatggcctgaacctgggaggcggagcttgcagtgagccgagatcgcgccactgcactccagcctgggtgacagagagagactgcatctcaaaaaaaaaaaaaaaaaaaaaaaaaaaaaagatgagcccaaattacagaatctcaaatctcatttgccttttgacaaaataccacttcacaggtagaatttaagtgggctgagacgatggcaggattccatttgactgaaggcacaaaagtggaaatcctaaggtaggttgaagaaatcagacaaattgatggaacagaggttttgcagaggtgagaatgaaaggtatgatggaaaataggctagaattagtctatggagatccaaattgcaagctcatactcacatctaatatgtttatagttcactcataggcttgagaaggcctgaaaaagttttgaacatgttaagtgtattatgatgattaaaactacaggtggtatgaagaacggcttatagaggcaatttaaaattgtgcagttttaagagaaatgttatcaacctaaggtgagtacggtgttacaattggtaatgaatggaatggaaaagacataatcaagcctactagttgattagtcagaaattaagtacaaaaaatagtagaaaaacaaatgcaatgagctttttaagtttgagactaagtatatactccagagggggaagatatttgaaaattatccccatcctgtttcaaatttctgaaaaatgtcaacagcaattatttcttttgccttgattttatttatttatttagagacagagtctccctctcttgcccaggatggagtggagtggtgtgatattggcttattgcaacctctgcctctcaggttcaagtgattctcttgcctcattatcctgagtagctgggattacaggcacgcacccccacacctgactaatttttgtatttttagtagagacagggtttcaccatgttggccaggctggtcttgaactcctgacctcaagtgatccacctaccttggactcccaaaatgctgtgattacaagcatgagccaccaggcttggcctttatttttaaaatctgtttttattttaggttttacttattttcaagtttatgatactcatgaggcttagcagatctctactttgggatgggtttggttcacctagtagttttggaatttctaataattgagggtcaattatttggattcttggttcttcttcactagattatcttcctctgtggccaaggggccccacaacatctacaggctacattaagaaataagagtttgtagggttagagaaacctctaacactcatagagcctttttgtgaaattcaagtttccatgggtgaaaactcccatgtggcctacagatgacaggtgttcagggggtagcataagggtttgagttgggtggcggtgagtcaggcaggcagaacattccagaaacacactgcaaattttggcaagttgtgtctctcatagtatctgtctgcttaagtgccaccaacaaacacagattccttagcgaagcagaggatagaattaaaagaagaacagccggctttggccaagtattaggtacaattaatggtttccgctttataaaaattgttcctgacaaatgctggtagacaagggatcattagggagacaaacagcatcctggggccacagtaatacaaaaattgctggtgacgatcagtgaattcatttatttatgcttttactatttctatgaatgaatgataaacatttagagaaaagaaaaacaaggatgtttttacaggagctttaggaagaagaatgcttcctcctatttgataaaaataaattagagactatgtgagataaattggacttcaccagagccattatatttttcttcctaattgactgcactgaggcaagcagaacattcgcgacttaattatgcatacttctgagggtgccatcagacaggtcagtggttctcaaatctgccacacattagaatctcctgcggatctttaaaaatgcctgggccacaccccaagagaacctaatttaattagtctgagctagatttaggctatggatttttttttaaacttaagttgccaattgattttagtacgcagccagagttgaaaaccactgagagagataagtgtcagcacttcagtgctcactggcagaaaaccacgtttttcatagaaccagtgactcctccaaatatagagcaaaatgcacagtaagagtggaaaaattgggaaaaggaactggattctatctatatatttttttaatttgtaaggttctgttacttggcttgatatagtcacaagcaaagagaaatacttggcatgctgtgaatttggcctaggcagcagtactcaatatcctggcaggagagaaaactccctaatttgagtgtctgctgtacaccaagtttccattatatcaatattcctatttctttcttttttctcttcaaaaaagaagattctaaaatgcctgtaaacatttttaaattatttttattttaatatatagtatagcactttcacacttcaaacagaagtatgaaaatgtgcatgaaacaaagcaaattcttgtgtaaacactgtgcaggtcaagaaatggaagacaggtggcatcccagaacccttccatgctcactctcctaatcagtacactattatcctgatttttatggtcacacctatttttctttattaatatttccatataaattaaagaagcattgctaaatgttagagttttgctcaaattttccttttaaaaattatgtaaatggaatcttacagtatgtacccttttatgtctggcttctttcaaatgtcattatgcttgtttgacacaatgcattggtctgttatttttgttgctgtaaaatcttacatttttaaaaatattacaaaatatgtatcccttttgctgtcagtatatatgagatagtgcttttatttattattaccaaaaagagtaccaataaattatgtacctgtctctcagtacacatttctgaggagtatataatcttagagtgaaattgctgggaaggtatgggtacttctaatttagacgataatgacattttccccccaattttttgtgctaatgtatactcctacaagcaatatttgagcattcctgctgctctacatcaggagtctgcaaactatggctcgccatccaaatccagcctgccactgatatttaaaagtaagattgttttggaacacagctgtgtcccttcatttacccattgtctctagatgcttttgggggacagcagcagagttgaatacttgtgacagagaccatatagccttcaatacctgaaatacttactccttgacacttcacggaaaaagtttaccaacctctgctctacagcatagctcactcttggtgtggtcaggctttttccatgttgccatttctgctgcatatgttgtgtaatttccttgtggattgtttgcattttcctgattactcgtgatgcataacaccttttttgtatattttttggccatttggatatcttcatttcatgaaacctcttgatcatttttctattgggtttttgtcatttttgtattcagtgctttataaaatctggttttgaactccctgctgggtatacaactattatttactcccactttgtggcttacctttttattctcctaatgatgtcttttgataaatggaacttctattttttgatgtagtcaaatttaagattttatttttggatatagcattttgtgtcctgtttaagtaatcattctttatcctaaataataaatactctcctgtactcccaaataataaatactatcttacaaatctttccaggggacatttgttaatgtctgtggacatgtttggttgccacagctgaggttgtgctactaacatttcgtgtgtagagaccagggattctgctaaatgtcctacaatgaacaggacagcccccaccccaccaagacttacctgaccacaaatgtcagtagcactgctgttaagaaacctggacctaaaagatttattgacttacctttcacattatgatgtgtaatctaatagaagtcgataaatctatagtaagttggttttatgagtggcgtgaagtaggattcaagtttcacttttttctgtatgcatatttgactgcctcagtaccatgtcctgaaacaaccatcctttcccgttacatctgtgttgtgataagtcaagtgttcctatatacaaagttctctgggctttccatacgatttaactgttctatttgtctatcctcatgccaaacactttcttttaaatattacagctttatataaggtcttgatataaatagagcatttagtctcaacatattcttactggataaagaaaatgtggtacatgtgcaccatgtggctgtgcagccacacacacacaaaacaaacaatgtcatgtcctttgcagcaacatggatgaagctggaggtcatgatcctaagcaaactaacgccggaacagaaaagcacatactgcatgttctcacttataagtgggagctaaatattgagtacctatagacacaaagaagggagtaacagacactgggccatacttgagggtggtggatacaaggaaggtaaaggtggaaaaactacctatcgggcaccatgcttattacctggggcacaaaataatctgtacaccaaatccttgtgacatgcaatttacctatataacaaacctgcacctatacccacgaacctaaaataaaagttaaaaaaaattatttctcaagagcttgactcttcttggtccttgcattgtctataagttatagaatcaggttggtaaatgtatacaaaatcatcttatttttgtatcagaattacgttgattcatttgttagaataaaattgttatttttagaatattgaaactttaaatgcataaatatggcatgtctccttaggtaatatttcttttcaattttctattttccgttttatagtctaaacatctagtttcatattttatgcatattttacattttgatgctaaacgttctcttttaaattccatttttaaattatttctatatagagatatcaatttgattttttgtgtattgacattatatccagcaacatttctaaatttactaattctaataaattacatatacattcataatcatattgtctctgaaaagcaacatttctttctctctttccctccccagttccagtagcttttacttccttttaccccccttacttcgctggttaggagttattctccaaagttatttcagcatagtcaatcacatttaagcagtgaatatactgtcaaaagtattgtagtggcaatgattatatacatttttctgagcaattttttattcaacaattatttaatgggcatccactatgtgctaagaattttgctagacactagtaaaattagagtgaacaagtcataatctggacacagggagtttatgttttagtgggaggagagaaatcaaaaacagataaattagaaaaaattagttgctccatgccatatacattcttctgaccttgcctttagtttactaatttttatctcaattgtatagtatgctgttaaacacatcctttgaattattaagatgggtaaccatatttttcagttctagaatttcaatttagttcaaatctgttctttcttttatagtttccatttctttagcagaattcataattatgtattttatttctcaagttattttaaagcctatgcaagttaacttttctatctaaagcacctatgtgtgtgtttttattttctatatttatatttattcttgtctgccttcttttataactggttatattttaatatatatgagatatgtatctgaaaatattgtgtagaaataagctgagtcttaggataatttttatcatccttcatcgtggatgtttatttaagtctgttgcttgcctgggggtgctgcaagtttgaatcacctttattcatttccaggcgtggagatgattggaagataggaggatttctctacttctgattaactgttattctcgtggagggggagtcgtctcaggtcccaacccaaaagagagagggttcaccagggatcactttttgttgattcctgagcatcattcactatgccctagccaagagaagctgccaatgtttcctctcagcagccttgtcaggaatcaataaatactgccagaagaacagtggcaccacctccctgagtttctttccttctccaaatcctaaaccagtaatccttccctatgttgtcagatctccacttccttcagatgcttttagaatttattctgcttttttagaggcactcagtaaaagagttggctagagttacctagttcactattactggaagggaagtcttaatgatttttttttaatgtaaacgactaaagagtaatggaattaaaaattctcaaaacacttattttttgaatattttatgtatactttaaagttacaaactatgcatatatgcatatttttgaccctattacatttacatagatttaagttagaatttaagatatgtttgtttactatatcattaaaatataaatcttgtatcttaaatttaccaagagattctttttattcatttcattctcaaatgaaatatacttaatacagaaattattaatatcatgtagtctgtatcttcccattgcaatgttaacataaaacccaggatcttctcttttttgttgactcttatacctcagtacctagtgaagtgtctggcccacattagagaagcaaacgaatctttgctgagtgaatgaatgccgtgtacaaactatttgcttctatagtagtgtccactgcactacttttgacaacttacctgttcagtaaaaatggttgcagatcagattggaagaattttctaacataaagtattaaacatagtcgagtgttagaccatttttcatgatttactgggtactaagtttttgcaaatatgttttgtaagcctaaaattttgcaaaatatggtaaaaccacaaataatctcaataatacttagattcttgatagaaaacaagaaaagtttttgcagaaaatttgtggataattaccatgagtctaagaagcacaaataatgatgtacagtttttgtgggacaattttcagaccttagaaactaagatttccttccctatctagaaatgtaggatgggatatttatttttaaatcctcaatggaaagcttctctgttggtgatatttagaaagtctcatgaattcacaatactaagacaaatataaaaaccttttgttttgtctttttttttttttttcctttttgtggagaacagggtctcactatattgcccaggcaggtctcaaactcctgggctcaagttgtcctcccgactctgcctcccgaagagctggaactataggcgtgagccaccgcacccggcaaaaccttttttattatcctaaaatattaggaaacccaagtgaattatcccatcagtgaaagagtgtgatatccccccaaaatattgttttaaatacaaataacttaaagtttaatacattttgcattgcctggattcggaaatataagacaaagtaaaacaaaacaatggcaaaaagaattcagtaacactacttcattactagggctttgaaataaataatagctgtctaaaattactgagtattcttattaagtttaaagtaagccagcctctgactagcttgatgcagtgtaaacctgtaccctttacccaattcattcattaccaccacggtgtgtgtgtgtgtgtgtgtgtaattctgtacaaatgagtatgttttaaagttttattgaggcataattaacatacaataaactgtacataaagtgtaaaatttggtaagttttgacatatgtatatacttaagaaaccatcaccaaaatcaagataaatatattcctcaccattgaaaaatttctacatatgcctttataatccttcacttctgtcctccccataccacctgagctgttcctaggcaaccactaatcttatttatttctttctctataaactagtttgcattattttatgatattaaataaattgatcatacaatatgtatgtactctttttgagtcaacatatttattttgagatttgtccatgttgcagcatataccaatagttaatttctttttatttctgattagatggatacatgacaatttttcaatccattcagctactgatgggcattcaggttgtttcattgttgaaagtatatgtccatacaaagacttgtatataatgatgctaaaagactatgcacagtctttgcatggttatagactttgtttctcttgggttaattcccagtggtataatggctggattatatgaatggttgtatgtttaatttttagcaaaactgccaagcagttttgcaaaacagttgtaccattttacgttcttacaagtagcatatgagaatcagattttctctgcatcattgacaaaatttgttgtttttttatttgagttatttcaataggcatgtagtgctatataattgtggttttaataagtgttttcattacgactactgatgttgatcatcttctcaagtgctactttccatctatatatctatatatcttctttcatgaagcttgcattcaaatgctttgcccaatttttcttgttctttttcttattattatgtttataattttatgtatattcgatacaattgccttatcagatatatgacttacaaattttgcccccattggtggcttaacatttcatttcatgaacaatgttttgctgatgaagtcaaatgtttttcttttatcgatcaagcttttgatgtcatttataccaaactccaggtcacaaaaattttatattttcttttagaaattttatagttttaggatttacatttaggtttatgatttattctgagctagtttatttttattattatactttaagttttagggtacatgtgcacaacatgcaggtttgttacatatgtatacatgtgccatgttggtgtgctgcacccattaactcgtcatttagcattaggtatatctcctaatgctatccctcccccctccccacatgccacaaccatcccctgtgtgtgatattccccttcctgtgtccttgtgttctcattgttcaattcccacctatgagtgagaacatgcggtgtttggttttttgtccttgcaatagtttgctgagaatgatggtttccagcttcatccatgtccctgcaaaggacatgaactcatcattttttatggcttcatagtattccatggtgtatatgtgccacattttcttaatccagtctatcattgttggacatttgggttggttccaagtctttgctattgtgactagtgccgcaataaacatacgtgtgcatgtgtctttatagcagcatgatttataatcctttgggtatatacccagtaatgagatggctgggtcaaatggtacttctagttctagatccctgaggaatggccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatattatttgcccactttttgatggggttgtttgtttttttcttgtaaatttgtttgagttcattgtagattctggatattagccctttgtcagatgagtagattgcgaaaattttctcccattctgtaggttgcctgttcactctgatggtagtttgttttgctgtgcagaagctctttagtttaattagatcccatttgtcaattttggcttttgttgccattgcttttggtgttttagacatgaagtccttgcccatgcctatgtcctgaatggtattgtctaggttttcttctagggtttttatggttttacatctaacatgtaagtctttaatccatcttgaattaatttttgtatgaggtgtaaggaagggatccagtttcagctttctacacatgactagccagttttcccagcaccatttattaaatagggaatcctttccccattgtttgtttttgtcaggtttgtcaaagatcagatagttgtagatatgcggcattatttctgagggctctgttctgttccattgatctatatgtctgttttggtaccagtaccatgctgttttggttactgtagccttgtagtaaagtttgaagtcaggtagtgtgatgcctccagctttgttcttttggcttaggattgtcttggcaatgtgggctcttttttggttccatatgaactttaaagtagttttttccaattctgtgaagaaagtcattggtagcttaatggggatggtattgaatctataaattaccttgggcagtatggccattttcacgatattgattcttcctacccatgagcatggaatgttcctccatttgtttatatcctcttctatttcattgagcagtggtttgtagttctccttgaagtggtctttcacatcccttgtaagttggattcctaggtattttattgtctttgaagcaattgtgaatgggagttcactcatgatttggctgtttgtctgttattggtgtataagaatgcttgtgatttttgcacattcattttgtatcctgagactttgctgaagttgcctatcagcttaaggagattgtgggctgagacaatggggttttctagatatacaatgatgtcgtctgcgaacagggacaatttgacttcctcttttcctaactgaatgccgtttatttccttctcctgcctgattgccctggccagaacttccaacactatgttgaataggagtggcgagagagggcatccctgtcttgtgccagttttcaaagggaatgcttccagtttttgcccattcagtatgatattggctgtgggtttgtcatagatagctcttattattttgagatacgtcccatcaataactaatttattgagagtttttagcatgaagggttgttgaattttgtcaaaggccttttctgcatctattgagataatcatgtggtttttgtctttggttctgtttatatgctgtattacgtttattgattttcctatgttggaccagccttgcatcccagggatgaagcccacttgatcatggtggataagctttttgatgtgttgctggatgcggtttgccagtattttattgaggatttttgcatcaatgttcatcaaggatattggtctaaaattctcttttcttgttgtgtctctgctaggctttggtatcaggatgatgctgcctcataaaatgagttagggaggattccctctttttctattgattggaatagtttcagaaggaatggtaccagctcctcattgtacctatggtagaattcggctgtgaatccatctggtcctggactttttttggttggtaatctattaatcattgcctcaatttcagagcctgttactggtctattcagagattcaactgcttcctagtttagtcttgggagggtgtatgtgtcgaggaatttatccatttcttctagattttctagtttatttgcatagaggtgtttatagtattctctgatggtagtttgtatttctgtgggatcggtggtgatatcccctttgtcattttttattgtgtctatctgattcttctctcttttcttctttattagtcttgctagtggtctatcaattttgttgatcttttcaaaaaaccagctcctggattcattgattttttgaagggttttttgtgtctctctctccttcagttctgctctgatcttagttatttcttgccttctgctagcttttgaatgtgtttgctcttgcttctctagttcttttaattgtgatgttagggtgtcaattttagatctttcctcctttctcttgtgggcatttagtgctaaaatttccctctacacactgctttgaatgtgtcccagggattctggtatgttctgtctttgttctcattggtttcaaaggacatctttatttctgccttcatttcgttatgtacccagtagtcattcaggagcaggtttttgtttagtttccatgtagttgagcggttttgagtgagtttcttaatcctgagttctagtttgattgcactgtggtctgagagacagtttgctataatttctgttcttttacatttgctgaggagagctttacttccaaccatgtggtcaattttggaatacatgtggtgtggtgctgaaaagaatgtatattctattgatttggggtggagagttctgtagatgtctattaggtccgcttggtgcagagctgagttcaattcctggatatccttgttaactttctgtctcgatctgtctaatgttgacagtggggtgttaaagtctcccattattattgtgtgggagtctaagtttctttgtagtcactcggggcttgctttatgtgctcctgtattgggtgcatatatatttaggatagttagttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccagtttgccagtctgtgccttttaattggagcatttagcccatttacatttaagattagtattggtatgtgtgaatttgatcctgtcattatgatgttagctggttattttgctcgttagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggcttgaaaattcttttctttaagaatgctgaatattggcccccagtctcttctggcttgtagagtttctgctgagagatcagctgttagtctgatgggcttccttttgtgggtaacctgacctttctctctggctgcccttaacattttttccttcatttcaactttggtgaatctgacaattatgtgtcttggcgttgctcttctcgaggagtatctttgtggcgttctctgtatttcctgaatttgaattttggcctgccttgctagattggggaagttctcctggataatatcctgcagaatgttttccagcttggttccattctctccgtcactttcaggtacaccaatcagacatggatttggtcttttcacgtagttccatatttcatggaggctttgttcatttctttttattctttttctctaaacttctcttcatgcttcatttcattcattttgtcttccatcgctgataccctttcttccagttgattacattggttactgaggcttgtgcattcatcacgtggttctcgtgccgtggttttcagctccatcaggtcctttaaggacttctctgcattggttattctatttatccgttcatctaattttttttcaaagtttttaacttctttgccattggtttgaacttcctcctttagctcggagtagttcgatcttctgaagccttctctcaactcctcaaagtcagtctccgtccagctttgttccattgctggtgaggagctgttcttttggaggaggagatgtgctgtgaattttagagtttctggtttttctgctctgttttttccccatctttgtggttttatctacttttggtctttgatgatggtgacgtacagatgggtttggtgtggatgtcctttctgtttgttagttttccgtctgacagtcaggactctcagctgcaggtctgttggagtttgctggaggtccactctagaccctgtttgcctgggtatcagcagtggtggctgcagaacagcggatattggtgaaccgcaaatgctgctgcctgattgttcctctggaagttttgtctcagaggagtacccggccgtgcgaggtgtcagtctgcccctactgaggggtgcctcccagttaggctactcaggggtcggggacccacttgaggaggcagtctgcccattctcagatctcaagctgcgtgctgggagaaccactactctcttcaaagctgtcagacagggacatttaagtctgcagaggttactgctgtcttttgtttgtctgtgccctgcccccagaggtggagcctacctaggcaggcaggcctccttgatctgtggtgggctccacccagttcgagcttcctggctgctttgtttacctactcaagcctgggcaatggcgggcgcccctccccgagcctccctgtcaccttgcagcttgatctgagactgttgtgttagcaatgagcaaggctccatgggcgtaggaccctccgagccaggtgcaggagataatctcctggtgtgccgtttgttaagcccgttggaaaagtgcagtattaaagtgggagtgacccgattttccaggtgctgtctgtcacccctttctttgactaggaaagggaattccctgaccccttgcacttcccgggtgaggtgatgcctcaccctgcttcggctcacacacggtgagctgcaccccatgtcctgcagccactgtccggcactccccagtgagatgaacccagtacctcagttggaaatgcagaaatcacctgtcttctgcgtcgctctttttgtttaagaattgacgttcattcttttaagtatgcagattttcaattgttgtggcaccgtttattgaaaagcctgttctttcttcactcctctgtgcctttgtctaaagtccattgtctatatatgtgtaggtctatttgatctcactgatatatctttatatcaataccacgctgtattgatttctgtaactttttattgaaatcagatggtatttgtcctccaattttgttctttttcaaagatgttttggtgcttttcaaagttttgtgtttccatacaaatttcagaataaaatagtcagtgtctcaaaatatcttgctgggattgggatagggattgcactaaagctatcagtaaagtttgggggaactgacattctaataatattaagtgttctggactataaaggtgatatattgctccacttactttgtcatcttcaatttttctcagcaatggaaaatatacatatctttcagatcatttgttgaatttacccctaaatatttcatatttttgatcatactggaaatggtatttttatttccatatatgattgtgtattgctaatatatagtaattcagctgatttttatattgacattgtaatttatgaacatactaaactcatttattagatccagaagcactttttgtagatctatgggattttctacatagataatcatgttgtctcaaaaagatagttttacttttttctgttgaacctgaatactttgttcgtttgtttttttttttaattacattgcactaattagaacctcagtacaatgctgaataagaatgctgagagtagatatccttgtcttcttcctgatcttagagggaacacattcagggttttaccattaaatagaatgttagctgtaaatttttggtaaatgctctttattacattgaagaagtttccttctgtttcttctttgtcaacagtttttatcggaaatgtgtgaatagatttttataaaatgttttttcttcacttattaagatgatcacattttagtttgataatatcatgaattatattgacttttgaattttaaacagatgcttgctactgtattcttagaatattatccatcttatataatgttggattctatttgctaaaattttgtttagaattgctatatctatgttcatgagagatattggtctataattttcgttacttgtatttcttgtccaatcttgataggaggacaatgctggcctcatagaaggaattgggagatagtccttccacttaaattttctgtaagactgtttatgggattggtattttgcttttgctaaatatttgttataaatcaccagtgaagccatttggacttggagtttatttttgggaaaatttttaactacaatttcaatttctttatagatataggtttatttggttttctatttcttcttaactgagttttgatagtttgtatctttcaaggaatttgcacatttgatttatttaataagtattgaatatgttagtcccaagttgtttatatcattttaatagcagtaggatttccagtgaagctaccctcttatttctgatattgttaacttgctaattttaaattatgattcataattaatctgactgaatatttataatattattgatcctctctaagaatcagctttaaaaaagaatcatcttgaggttttgagtgaaaaaaaaaactcaaattgctttttctatcgtctcactcaacaatagtcaacacagaagacttctgtgagcaaatatttggggatttctctccaccaacaggaaagtaatgcattctgcagcagacaacagctgggtatcatttaatttagttcaatccagacactatccacctgcagatagcatcagattccacagatttaggtctcagtctcataagactgccctcaattcagatgctaatagcaagctcctggtggttttgtctgtgcttctgaccaactgactacaaattggggatcccactctccccttcttgaagttgactaattttctagaatggttcagagaactcaggaccacacttactttcattcaacaactcattataaactatattacaaaggatacagataaagagatggataaggcgaggcatgggggatggagtgtggagcttccaagccatcctggctatgccaccctccaggaacccacatgcgttcagctatccagaagtatccagaagctctgtgaatcctgtccttctgtgtttttatggaggcttcattatgtgggcatgattgattaaaccaatggccattgagaatcaattttaccttcatcccctatttctcctagatgattggagggtgagactgaaagtctcaatcctctattccttccttggtctttctggtaaccagccttcatcctgaagctacctaggaggtgtcaaccatcagtcaactcatgagcatacaaaaacccatcactttagagactctaaggactttaggagttataggcctggaaatggggtcaaaccaactatgtattttaacaatagcataggtttcattgatttttatttgcttttttttttaatttgctttttttatttgctttttttttttttttttgctaatttctcatcacagaatgttaaagtcttatcttctcctctgtgactccaacaacacaaatatttgatctttggttatagtcctgcatgtccctgagcctctgttcattttttttaaaatttaagtttattgcacagcgtttctccttctggaaagatagacaacaattttttctatttctcccactaaggataactaagacctctggacataatacaaacaagcataagaaaaccctgaaaggccaagagaagaggtgaccacctgtattcccaaagaattgcatggccagcatggcattgagtagcctggattttctttgtacttcaaataatttaaactgggtaacaataacagtttatctggatcataaaaacaaagagaaatctcctcacctaagttatatgtgcatttttctggcataaaatttggaattcagtagcaccttattaaagtggtatcaggccagctatggtggcccatacctgtaattgtagcactttgggaggaggccaaggcacaaactcaggagtctgagaccagcctgggcaacatagcaaaaccctgtctttacaaaaataaaaataaaaattagccaagcgtgatggcatgcacctgtagtcccggctgcttggtaggctgtggccagaggactgcttgagcccagaagattgaggttgtgatgatccaggatagtgccactgcactctagcctgggtgacaaagcaagactctcaaaacaaacaaacaaataatgaaaataaagtagtgtcagaggagatatagtgaagagtcatgacattcatcaccactcagcagtgaagaggcaacaccccttctcctgcccctgtgtgaataggggaacatggggagcagtaatggggtactcttcctgtccagccaaggtggtatcagtagagatctagtggggagcctgaactccaccctcatccatcagttataaggaaccctcccctctacagaccaggatttcagcatagggcaagtggagatactgcacttttactcccacttagcagcaatgaaatggtttcatgcatgcttcccccagtggagcagtgtcagagaaggcctgctgaaacccacaaataaacgaggtccagaatcttataacataataccaaataatcttgttttcaattaaagaaatcacttagcatattaagaattaggcagacatcaaaatgtatgagaaaagatgataaatagatggcatactgagaggacagctgttaaatgatttgacaaagattttaaaatatccatgacaaagtgctttaacaagcaattacggacacatctgaaacaaatagaaaacagaaagtttcaacaaaatctgaaagtcttaacaaagatatagaatatagagaatcaaatggaaatttcagaatgaaaaaatacatttaaacactcagtggatggactcaaaagcagaatagagaaaacagaaggaagaataagtgtagttgaagataaaacaatagaaattaacccctctgaacaacagagagaaatagactgtaatatgtaaaaaatatttacacatattatcattttctgctaatcttgcttatttatttatttatttatttattaactttaaagcattttgatatttttactttggttctaaataaagtattctttccctaaaaatagtatacgtgttgtagaccaaacgtcctaataccataattgagattaaaaatctttgtatctgagcccttctactctatgttttgtgactttgtcttcagaacactctttgtagaactcataggcatattttgaacgtgatggtggccaaagtgaacaatgctgtttcctctgtctcaggctttcttcagcctggagttgtcaagtgaaaattccagggtctctttcacattctctattttactttctcttctaatgctgtccagtaggtatcaaggaattacaagacatcctggtggacaatagccagaatttcctcttttttatggtgaaatataaagttatagttaaagggaatgagattcagaatcagatagacagggttgaaattcttccattccccattcttaactgtgtcacactgaacaaggtagttaattgcttgcttattatgacccaggtttgcatatacaataatataaaagttcagcagcttgagagacttattaggcattaaatatatttcagcttcgctttcattcctggccaaaaaaaatgttatgaacaatgtccctgtgtggactgtgtgtgtgtgtgtgtgtctgtgtgtgtgtgtgtttgtatggtgtgtgttccatgtaactcagggtacttaaaagttcagagtaacttgtaacaaaccagtttaaagccaggctaagacaatattttataaaggaatgatttgtctagctttcttgttctgaacacaaaataatattttgttgtatgacataggtcgggtcttccaagatgattttcagatccctgcagcattggactctgaagattacggagcattttgttagaataactgaacccttattctgaaatgggaactatacatatagtttatatagtatatatatatagtttatttatatatatagtttatatatgatatatatactttataaacaaaagggattatatattatatatataaaatatatatataatatctataaactatatatataaaactatacagttaacttgagcaaatcgtatacaacaaactagaactatcacgtagtgcatgccattactgtgctttctcctcatttggaagctgaaatgatttcttacaccttgtgtccaagataatgaggtattgtgtttctttgaactctccctaacaatgtgtttttccagtactgattgttgatgtcctgttagcactcttatcctgttctgtcctgactggaataacggatcatttgatttggttcttttactagtgttcaatcttttgcatatgcgaatgattctcattacacacagtctatatcaaatggtttctcaggggactttacatctttcttacatgctttgcaaaattctttaatatttttggcctaagaagggtaatgattctctctaaaatgactatccattgtctgagtgtctgcttcccattctgtgatttgcatttactctgcctgttttaatgttgttgttttttctcaaactgagagaaaattaatttgcctccacttctaagcatctgggcctcatagaggaatcttctttcactttctctctctccctcttcatcttttctttttgaatctactttattcttctctagtcttgtttctctttctccttaccccaagcttcacttctctgtgttatttgcaaagtaacctctattaatctcatggtctagaagcactgctggtgaagaaacagtgactctgaagtctcatctgatcacctgccatagtatcaaacatgtctaacaccagatctgtcatgacaagttttccaaaattccagtgagaaatgaaactcaatagctaaaggacttcgttccttgtagtttggtgggattcataaccaaggtgctctgctgctagggaataggaacattgcagacacttagttacctaagaaggaggctgctgaattccaaatttcacaccagaaaaatgcatatacagtgtgtgtgaggatatttctatctttctatgatccaaattaactcttactgctacttagaaagcaacaagttcatagtcctgaaatgacccattcattgagaaacaatagaagacataagataatattttattgcaaatagtagtctacattccctctttgttcctttctgaattatttttcagatctagtaatactttcttttttatatgtcatggatgagtttttagaagtcgctcttactaaggagaggaacaaaaaaagtgaccttaattgtgatgtctttgtagttataatatctttaactacaaatacaagattctgaagcactgctgacagtatgaaaattttgcacactgtctgtcttgtcagcaagatttcttccttttttttcccggaatatcctggaatatgatcatttgaatagactgttcatatagggaggagaggaactgattaagaagaattagaaaaaatatactgttaagttagccagggtgagttaaagatcattaaacttggttatatactctttaaaaatggaaaagaaaaatcaaacaataacttcagaaaaatagttacttaaaagacaggcttttgatgacagcttatgaaaaatcaaatattcttttctgtgggcattaatgcattatgaaggactcccttttgttctgacacttgaagtaggaaaccatttcctttgtcttggccttactctctgtattgttgcctagaaacacagtcttttagagacatttgcccatcaaagtgcagataaggtaacacatttacttttcaaatgaaaattactagaaagaagtgaagtgaaggtaggttaaacaaaatgagttttttgttatgtgtaggtagagcctaaaattactcacactacctgcgtacaaataccgaagaattaagtataatcacaaagaaaagcataaagctatagggtgatttcttttttaagaaagcaaaaaataggcttctcagtgttaaaattgttaaaggaaccatatgtagaagctcattatctgcacagtaaaacgattaacagttgactatatgccaagcattttctctttgaatgttccaacattatcccagattgtttgagattggccaactgttgctaatccatttgctttgcggggtcacatcaaagacatccaaagagtctggtcaaaggatgaggttgtgtttgtctatggattattttatattgtttattctgcttttgtatagctttatcttcctttccataagatataattattttttaatactcaggataaaattatcactacaaattctactcactcactaggacgagtagcatttgttgttatgagtagaatttgtactagaaaaaaagtagatggctgcaataaatatttcaccacatgcatacgtgatataaaatgcacttcctgtactcatttctcattagaagtttagccacgaagtagcttttcaagaaaattcaggggatcatataatagctggcactgtcaaaattaaaaaaaaaaaaaaaaaaaacatgttttctctcagttggacccattgtccttgaagaaatatcctgagtgattaattcatcttggttttctctctagaaagtagggttttttccacttctccccactgctattcgtgtgctttactcatggggaccctcactgtaactggtaaccaaaatcatgaccaaaagaatattaactcttttaactcctctcaaaaggttaagatgaaagatggtttatacttccaaaaagtggtgtgtattaacctccaagtaaggaattagtagtgattacacgtggagatgacgtctcagttacccagaacctatccatatgaaagcatttctattagggcacttctttggataccatccacgcacagcagaaatgttcaactaaaacttttgtgttgaatcaaacttggtttattacagtaactctgacaaggacttaactataacattttaataggttctacagtaaataagtcactattactatcttttttttgttttgtactagcaaagataatcacttgtgattccatgttgtaactcacatgagggttaatgatgtgctgtggaaatgcagtgtgagttcacaataagggtagcaaatggtgggaaagtgactaggaagcatatgaggaaaactaatagaaggtaagggttattttattaaggtttgtacagattcattttcaaattgactcacatttccagagatgagtgttctcctcttcctgcagggaagggttctttctcacgggaaacgtatgtccggcgtgattttaggaagaaagggagaggtcagagagcccttctcgcatctgctgtttctcaattgccttctgttcaaaatagttaatttgccaaagtggcgtattttggggtgacatattctggtccccttcagtaggaaattattttaaacaaatgaataattgaattaggagggaggatgaagcaagatgcaaatgaaattgcttatagaatgacagaaaaaataaaagtataatttgagaggtattaaatagtttatggtataaaatattaaataatattaatgtgatttatttttaatttagtatatgtcagttctgttatttggcccaagatactcatttcaattgaactttttatataatggcaactgaattagacatactgataattgccttctttgtgggatctcttaagtaagttaccaaattgaaaagacaatagcaaataattcccatacttttaaaggccaagcagaagaacaataaaaaacttggaatacatttctaaagaaagattgagttttgaaacaacttggatatttttatatcccattgcctgcatgccctaaccattgttagcgtctttggctattaatcctattatctttgttcaaattattactgtgtactatctcagaaagattagtatttttatctttttttttccatctttgttctaaatttacaagtgagattaccacactcaaatttggcttaatagattattcatgcctaactaatgaattaaatggattttgtctttggcctttgcctgaaaagaaaaacaaaacaacaaaacaacaattacaaaaaacagcaataaaagcagcttacttgcaatctggatcacatatcctctttattttactattctcaacagggttagaattgcattgagccaagatgcagcagtgctgtgctgaagttgtttgtcttttaaggttcagtgaaaatcactgtgaggttctgacctttccaacagatagtatgtgtttggggactgttacagtatttgcgatgagttcctcaggatcttattataaatggttgagtaaatctccaaaccctcaacttcatgacatacaaaagaaaattattttcaaaataagaactaattcccgagataaaaataggaaaacacatacatttttgcaagctagtcaagaaaaatcattgaatttaactgcatttcacatctaaatagtttaaacatttctgttgctgatattgattgtcaaatacaaatgcacacctgtgctctttcctgtgagttctcaaagtgatgtaccagtgctggaaattgaattttctattttttcatattttagtgaccaaaatcattgagtgtcatatgaactattactattaattaagaaataataaagaagaatatacaagcattgatcttacagccaatgaagcacagtgagaaaagcaagggctttggagtcagaaagacctagactctgaagtgaatgtaattgttagacatgtaagtttgatcaatacatcttacctttgtgagatttatgttctccatatgtaaaatgtacataataatacctacctcatcaggttttcaaaggagcacatatttatgtttctagcccaatatagggacccaaaaggtgatgttaattttgacactacaatcaaaacaaataaaaaattaaacagtgttgtggtctgaatgtggaaccccaaatgcatatgttgaaacttaatagccaacatgatactattaagtggtggaaactttagaaggtgattaattcatgagggggcagagccctcatggatgggattatggcccttataaaaggatttgaaagagtgggttcctttccttccaccttgtaggagcacagcattcatccctttcaggggatgaagcaacaggatgtgatctttgaagcagagggcagcactcaccagacactgaatctgctagtgcctgggcagatgtctctttgagatactgacttcctttcctgtcctagcctttaaaactgtgacaaataatttttttgttctttataagttatccagtctcaagtgtttccttaaagcagcacgaatagactaaggcagtatgtaatacatattatactgttgtaaacacttttaatttaacttttttatttttttgagacaagagtctggctctgttgcccaggctggagttcagtggcgcattctcggctcactgcaagctctgcctcccgggttcacgccgttctcctgtctcagcctcctgagtagctgtgactacaggtgcccgccaccatgcccagctaattttttgtatttttagtagagacggggtttcacagtgttagccaggatggtctccatctcctgacctcatgatccgtctgctcggcctcccaaagtgcttaatttaactttgaataaaaattgtctaaaggggtataatgtgctgttttgatacacatatacaatgaactgatcactccaataaaaccaattaacatattcagctcattacatagttactactgtgtgtgtgtatgtgtgtgtgtgtgataagtacacttaatatctaccatcttagcaagtttcaaacatacaacacagtattaactgtagtcatcatgctgtacattagaactctagaacttcttcatcctacataaatgaacttttataccctttaaccaacatctcattttcctcactccaacccctgaaccatgactggacccctagtaaccatcattctactctctgcttctattcattattattttcttttttagattcaacatttaagtgagatcatgcaatgtttttctttttgtctgacttattttacttagcataatgacccccccaccaggtttatccgtattgtcataaatggtaggatttccttctttttaaggctgattaacactttgttttctatatgtctatatgttcatctatgatgcacacagcttatttccttatcttggctattgtgaataatactgcaatgaacatgaggatacagataactcttcaagatattggtttcttttcctttgaatatatacccagaagaaggattgctggatcaatggtagttctatttttaattttttgaggaacctccaaacagttttccctatggctataccaattaacattcccagagtagagagcccagaaataaatctatacatatatggccagctaattttcaaccagggcaccaagaaaaagatcgttgcaacaatctttggaaaatccaatctgccacatatttcaagggagaagacagttttaagaagagagataaagtcataagtgtttattaccacagacagcctaggttacatgaacattgaagaaaaagataagtctttcaataaagagtgttgggaaaaccggatatccacatgcaggaaatgaaattagacatgtatcttatgatatacacaataatcaattcgaaatgggttaaagacttaaatataagacctgaaatcttaacactcctagaagaaaatgtagggaaaatttccatgatattggtcttggcagtgaccaaacaaaagcaacaaaaacaaaaataaataagtagggctacaccaaaatgaagtttctacacagcaaaggaaagtatcaataatgaaatggcaaactaccgactgggatgaagtatttgcaaactctatatctgataggggtttaatatttaaaatatatgaggaatttatacaacacagtagcaaaaaaataaataatagcctaatttaaaaattggcaaaggacctgaacagacctttctccaaagaagacgtacctaccaatggtcaataggtatgtgaaaaagtgttcaaggtcattcatcaccagtaaaatgcaaattaaaagcacaatgagttatgagctaatatctgttaatgtggttattaccaaaaagagaaaaaataacaagtgttggagggtatattgaggaatgagaacccttattgtaaagactgttgacttattcacaatatgatttttttgccttcttacctcttaagatttttacttgtattatttttatttacatatgcatactcgtttaacaagacaaattgctcaagccaaaagtgccaataaatccttaatagcaaactactggcctttatcttcaatgttcatgtaacctagactctttgtagtaataaacacttatgacctttatctttctccttaatactgtcttctcccttggaatatgtagctgattgtattttccaaagattgttgcaacagtaactcccatctcacttgccattcttataatatgactttatatttcttctacggaaaggtgtagtctatgtccctacttgtgaaatgcagagagctactgtacttttccagtggaagaaaatctttgtgattttaaatgaggaaaacattttttgataagacactaaaaacatgatccacacttaaaaaatgataaaactgactttactgatactaaaacttctgttcttcaaaagaaactattaagagaatgaaaataaaatccacaggataggagaaaatattttccaatcatgtatctggtaagttacttgtatccagaataagtaaagaaccctcaaaagttaagaattaaagaaaaaataaaacagagataaatgatttaaacagaccttttgccaaagaagatagacagatcgaaaataagtacctgaattagtcattaagaaagtgcagttaaaatcacaatgaggtaccaatgtacatggctaaaatattttttgaagtagcacaccaagtgttgataaggatatagaagaacaagcatactgatatggtttgtctgtgtccccacccaaatctcatcttgaattatagctcccataattcccacatgttctgggagcgactcggtgggagataattgaatcatggcagtgggtctttcccatgccattctcatgatagtgagtaagtctcacgagatctgatggttttataaaggggagtttccctgaactagctctcttctcttctctgctgccatgtgagatgtacctttcaccttccaccatgattatgaggcctccccagccatgtagaactgtgagtccattaaacctctttcttgtataaattgcccagtctcaggcatgtctttatcaggagcctggaaatggactaatacacatacactctggtgagattataaaatattacaaccattttggaaagcaattcatttctttaaaagttaaatatgcacttatgttataacacatatcttggatgttctactcctaggtatttgcccaagagaaaataaaagtgtatgacaatataataaattgtacatgaatgttcataacagtttatttgtaatagccaaatatgaaaaatgaccaaatgttcatcaacaaatgaacagataaattgtgatgtatccataccattcaatgatattcagcaatgtaaagaaagaactactgatatatacaacatggataaatcccaaaataatcaccatcatcctaatcatcatcttgattatggtgatgatttcatacttgtatgcataagcccaaacttaaatggtatactttaaatataagaaatattatatgttaattatacctcagtaaattctttgtaaaatgtaaaacagcttccaggagaatctcattctcttatgccacttaaccaggacttttcagcaaatcattgaatctatgtgtccctgttttcttgaataatttggataaagaatagtatcaactacatagcttgttaatcttgctttagtattaaatgagttaatctctgtaaaccccttagaggtgcctgaaatacgatctaagaattagttattagctacgcttaatatataggaagaggcagcaggttcctcactggtcttatagaccacatatttccctgatgtgatggaagtctatttcttctttcagtgtcacgaaaccacggaaataggtcgttcggggctacaaaatctttgtatttggcacagctacatgttggcaatctaacaatttattttaaaaattatttaaaataaaatacttaaaattaagtattacttaagttttacttcaagaaaatggaatgtcaaagacagatttttctaacacttccaaagacattttccatatttgctcatttccttttggtctgggttctatgtcactatagtgctctttagctcagcagaatatctcctctatatctccatgaataactaaaaaaatagatccagcaggttttcaattgctagtcactactcagaaattttgttgtttttaaaaatctttcattctggaattcctttcactccttccatctcctaagtaccataaactgagtttttaaacatagcttttcatggaatgagtacttcttacaaaatagaaaataccaccgaagagctggagacatgtttcaccccaaccccagattgctggaaataactaggattcttccatactatatacgacactttgttaacaatatctctgggctgagatgccatatctgagagaccaaactaagtatacttggttttttatttagtggaactgaaagcagctgcatttctgtttgaattgctccctgagctctcctgcaaatatataaagggatgttataaataagttagaagttgatgattctcatttgtcagtgagggcagcctaagtaaaagctacagcaggaaaaaacagaagcaaaatattaggaaatccttcataagtgtagggtgagttaatcattcagaagctattctcagagaacctgaggaaatatttaaggctagggacaatatcttttctctggaaaagatagcaagaaggagatatgtcttttccaagattaaatacaggattttgtaacttgattctctgatattaccaaattaatttgaacactgacacttcaagactaaaggtatgtgcatctctaagtatgcatgtgtgtgcccgtgtgctgatgtggggtgtgtataagaggggtaaagaatatgcatagcagggttttaaatcacccagccccttgctttcttgttctcacgggacatggctgtatctgcagttccagcagaactagctactttctgttttctgaatatgaatgttgatatccatttgttctcatgcatgtgaactcatacttttactcttttttttatgttttgagatagaatttcactcgttacccaggctggagtgcaatggtgggatctctgctcactgcaacctctgcctgttgggttcaagcagttctcctgcctcagcctctggagtagctgggatcacgggtgcccaccaccactcctggctaatttttttttttttttctatttttagtagagacgaggtttcactgttttggtcaggctggtcttgaactcctgacctcatatgattcacctgcctcagcctcccaaaggcctgggattactggcgtgagccactgcgcctggcccatattttttctttttgaatttccattatttatttattagttccattgctgcattggctgagataacttcttcaacctccctaggctgatgtgagaagtctctcctctgtgttcccatggcactttgtgcatacttctgttgtggctagccactcagttctatcaacatcagtgtggttggctctctccagatggaatctttccaagactggggtcatattttaattttctttgtatcattggtgctaagactgtatttggctttgtagttggtgtttttcataggcttgtggaatgaaggactgaataaataaatgaagaaatgaaaccctggggcttcaagaggcagtaaacaggtgcagtacttcaggggactttattgtgttggtgctggcactggtgacacagacactggtttactgtgctggtctctagcagctactgctccccttgctgccaggtcttttcacgtccctgggcctatcctgaattgctggggagtctggcagggtgatcagttgaatgtacttaaaaaagtgcaagatgctagaaagaattagcatcggggacagagctgaaataacatgatcaaaataagatgaataaagagacattaaatttaggtagatgaaatgaggcaataaaaaagtcaaggggaaaaatatgagaaagatttcaaaggaaagagctgtgcaataaagacaaatatttcaaaattctgcaacaacccaagagatcaaatatgtaatgtaaattgccaagtgcaattatttttaaggaaaatgaattactggaataattccttgaggaaatttacaatatagagaatttttctgtcaactaaaaaaataaagtcctctttcatgctatgatatttgagaaaatagctcaagttattttgaaaagtttctctagaaatatgtggtcataatggaatcattctcactttgtgcatatgagcacatgttcctatcatatgttgctgtatagcaagctatccccaaattccaaaatttagtgatttacaataacaacaatcattttactgttatctcttatggaggttgactgggttcagcttgggagttctcacttgagtccttcatgtagttgctatcagaggacggtttggcctgcagtcttctaaggcacactcactcacatgtctggtaactgggctcataagatgcaaatagccaggggctgaaacaatccagtatctccttccatctctttacagtatctccatgtggtttctccaacatggtagcttcagatagtattcttgcatggtagctcagagctacgaagatgtatatttcaaaaaaaaaaaatggtggaaatgtatttcctgcttggcttcagtaatcatgcagtattatttccaccacgtgtattccttgagaacagttacaaagactctcaggttcaagaggaggtgacatatactccacctctcaatgggtggaccttttaaaaccatcatatacattttctaacacagagcaacacgtgcacacacgcgcgcgcacatacacacatgcacacacttccttacaagctttcagttacttgggtgtcaggaattttcagcatgattcagacatgcttttagaactgctcatgtcttgctaatatgcatgacctccatagacatgtaaatggaactttattgagtgaaaatggcaataagttagaatgagataacttcttcattgcctatttttagagagactaattcctagagagattttacaaaatgcatatgattgcagtgggattgcgatgcccattctgacactctgtaacaggcaaaggttgcttgggaaacagaaactgccaactgttttgcatccaggggcttgtttgatggaataactgatttttcttggtccctcttctctatttactcgttgcaatatctctggccagattcccacatgtagactttctatttatgccttattttccactctcttcagaaaaatgactgaaactactatcactccactgcaaatcaaaacaaaaccatgaaagccaaagcagtcaccaagattattcaaaacgtattttaaaataattaccaccattgataccattacaaatgtctgatgccagtgttcttaatcttttgttttctattattgtcccgtgagaatttcctttcccatgatagttgaaaccacagatatattatatgctatatgtatatctgtgctttatacatataaaataagatattttaaccccctcaagagccaatttttcctccttgggatgatataacatctatggaaaatatatgacctataggtattgatttaaaccaatgatttaattaattagaacagcaaatgggagatactgccatctcagagattcacatctaaattttgacattttctaagtgtttgtaacacacacacacatatataattgtgttcatatatctaaatatctgtacataacacataggaaactccataaatccttatgtaaagagatatttccaccaccactaacagcaacaacaacaaaaaacaaagaggaaaaaatagttatttcacatatttcagatactgaaatatatctgtaaaggccagaatcgttgttcagaaagaagactttgggaaacaagggaaataaaagccattgtttggcttttagaaatacacaaactttgttaaactcccttcttaatttgaatagggatctgtgagaatagcaaatttcaaaaaggagatattgtaagtgtcacaattgtgtacatgccttgtacatggaagcgctgcatttactgccatgcttcagaatcaaccatgcaatggtcaggtggcccctttttctgggtcagaaagtcagggaatttcaaagtttaaaagttgatgacagtactataagcagtgaaagacagtttaatctgtaatgcccctcacaggcaggcaacatgggcttgatatgttattgtcaagccacatgtgcagtgttttctgttccataactaggttcagttgtgtgcttttatagatcctcagtgtacaaatgtatgcatgttaaatcttaggtagtactaagtgcttttagagagctctatttaaaattataaagctttagccagtcatagtggtgtgcgcctataagtcacagcttctcaggaggctgaggagggaggatcacttgagcctggaaggtagaggctacagtgaaccgtgattgtgtcactgcactccagcctgggcagcagagcaagacctgactcaaaaatctaaacaaataaataaataaaataaaattataaagtttgagtgaaccaccatatagagaaagatttatgtttagattaaaatgaggatgaaataaactgactagatctccagcctctatggccaccaacaaggatcattggtctacttggtggaaaccctgaatcagcttcccagatttggcttcacagtcacctctcttaagaggtctctccagactgcttcttcccccacagtcaaccacttcctcctctgtgtctccaaagcactaatataccccaagcacactataggaaccatcttccttgtgaactggcctgcttggctccccccgacacatccatgaagttgtgatcctctaaacagtcagggcatctagctgtctttgtatccctagttgggaaacacagtatgtgcacgtgtaaactatgttttgaagaaaggaaggcaaactggcaggttatggtaagttagtttaatcgactttggagaaaacctggtatggcctcaatatcagccctcgccattctgaccattcactctcagaagacacaggcactgaaattaggcggtggaagcactgaattggactgggccactttttccacttgcttgttagaaaaagggcataattgtattccataacttcactcttcccctctttctcatgaagaaaactctagagaaaagaaagctaatgctgtgtctttcaaacgggggagaatttgtatttagttgaatctcattggtatttttatggtggcattgctgcccttggaggggcagtcctccccagctacaggatagaacttgtctcattttctgtcaccagcccctatgacttcatatagaattccagaattctgataaactgtcatgtggaaaaatgataaagtgatttatgctcaatttttctggaagggagaaatgcaagggctgtcagtctgggtcttgagaacaaatgagttacagttcatgaggcagctcaataaggctatcatttcccatcagctcctatcactgacagccaagatttactagctggggaatgggaagggggctgagatttggtgccaggtgaatcggcactattattctatcaaccaggctcatatagacaagaggctaccatgaatatttgatggaagtgtcttcccagaaatgttgtgaaacagcattagttttcttccattcgccaggagcctctcctttctatccacgtgcacctctttgaaaaatgaccacttgtaaaccacaaaagcatttgggattgtttgtttttgctgctccggctggtggtatattcctcttggcagtctgtgcatgcagtgcactaattcactgtcctccattctcataggataaagcgaaaaaaatccctcatctactgagatgctatagacattacatctgtcattatccatctgatgcagtggcagtgagcgtatagccttccagccccctatgtgctcagagaaaacagactttgatctatggcatttgctgtgttctccaggaaaacaaaaggtggagaggtgggtttggactcagcataggcctagcaattgctcttgctgatttactctgaagtagaaaaacataactgtaaattctaaaatattatatgtctcttttatttgggacatttgttttcagtgggaaggggctttgcaggggacacacatcagtacatttcatatgggtcaggttattttttaaaaaagacacacttaacatttgcttttttgagctagggaaatgtatttctaaaatctcttgtgggaagtttagtatttagtatttatgttgtattcaaaatcatctgtagatgatttcgaatgcaccgtatctatttcatcatttctcaagtgtaatcttttgtaatctttggaatgttagttccaaaagacaacagtaggtatttggtgaacatgtgggaaatctgggccatttaataaggaagatatttttgaactgctagatattttgtttgtctttctactgccactacataggcagattgcttcattgcattatgaaactttcacttctcttaagaaattgtctaaatgttcagtctagtgaaatattgagcaaaaatgtttcttttatatgagtatgatgccagttgctggctaccagtctttctggcactgtgagatctttccttaatagcagtataagttttgaggctgcccaagccatgccttgtagggtcacgtagtgggtcagtgagatggcttatagagttaagtatgcaaaagatggtcagagaatttgaagctaagacaatacaaattttgagttttaacttattattttactcattcaacaaatatttattcagtaaatattatatgcagccatcattcttgaatagagttacttattaatcaagagaacagaaataaaaataattatcatgaagagtttcagaaaatcacaaatattttgagagaactaatcagagtgagctaaaagagagtggttattgattttagtttgaagtcaaagacatttttctgaggcaatgacttttaagctgaaatctggataactagaaggaatatggcatgcaaacatcttgagaaggtgcgttcccagacaagaaatagctagaatgtttgagaaatcaaggaaagtcagaggcaagactgtagaggtcttggtacatcattaagttgtatggagcagaagacttcaaagctctatttctggccccaggaagtcagatacactcataagtttccataaaaaacaagaaaggaaaattacggttgatgagtattctccgcaaccatcatagctaatgttaaatgtgtgttttttgtttgctatagttctaaatgctgtatatgtattaaatctttcgattctcacaacaatcctatgatgctgtatttttattaatccctttactgtacacctgcaaacagaatcacagagactttaaatgcacttcccacagtctcacagctagtaagtgactgagccaggatttgaccccaagaggtttggctccagagctcgtgttcgtattaggagacttaccactgaggaaacagacttagaggaagtctttgctggatagtttttctgaacttcatgtgagtatacaacttatgccactgagatcaaaataataacaaagtgttatatttttctcaaatgcttctttcttaggcttacctaatcctttatattaaaaagtcccaaagcctaactaacattctatagtccaaacagacacagtattattgggttcttggaaatctattcttcagaaatacaaattctaaaataaaaataccagattaaatataagtagtttctttataacgtttaaattcagaatccccaatgtcaagtgctctacggacgaaatattcactttattactttttaaagttaagctaaccccaatatagagaattaaatgatagacagtaaaccagcaggttttaagttttaatccacgtatctttgtctttctgctttatcagctaacgtattatctgccttaaaggcttctatttggtacactgatggaaatgatatgctgagtattgtatgcatttgtagtctgtatactttcatttgatgacaaaatgttattcattaaaactagctaaaaaagaccctctgtagtatcaattgtttcttctcttaatattagctcagatgcctttctcagctccttcctctaagcatgaagtaagatacaccagaaatgaggacttttccaattaaagcagcactcacagaatttataaatgcttgtttttctatcattacaatatcataaaacaccgtgtttttgattcatgaacttaagaactgatctaattcataatatcaataagtgagaataaaaagaatttcaagtttgtgtttattcatatatgaatgctttgagaacatagaaacgtatttgaatagaacttttaatcccagaactggaatttagtgaaattgaaatttctcttggtgcctctctcccacagcccactccaatcctagagcaaatccccttgcctctgtcctcagggtacacccggaatcccaccacttttctcacctccactgctgccaacctggtccaggccaccaggatctcctgtctggcctctcactggttcccagcttctattctaatgcaacagttcctttaaatgcaggttctttgaaagtttaagccagaacatgtcactgctctgctaaacaccctcaatcaagaggcttccatcttctgctagtaaaagtctgcaatgactatacggttctccatgagctggagctgcctcctctccccatcacctttatcacctctcttcgctctgcttttagccaccctggctttctacactccaggcccacactgtctcagagctttttcacttttggtttctgtccttcgaatgcctttcctctggaacatatgcatgactctgagtcaaatgtcttttttgtgactcttaccctaactacctattttaaaatttcagtctctcacccttgcactgtcagtccaggtggctctgctgtatttttttccataacacttaacaacttaaatcatactgtataactaatgtattaagatgacttaccctagaaaatgaaatccaaaagggcagggaatttttttcttgtttataatatatcatccagtggcgccatgcctggcacagaataggtgctcaagaaatatttgaggaattaatgaatcattgccttttagttaagaacatttgtcagtttgaccaagtaaataattgcaagttttatttttgccaattatttgatcacaagccgttatgttctgtgatactacattatttcattttattctttcttttgctctttttttacttcccttccttccttcctttctcaccttctgatttccattctttctctttctctcctgcttctctttcttctgtctctgtcttttctacctatctcattcaacaatatggaacaagagttaggttctgtgaatatgcaaagttgaatcagaagctgttcctccccataaagctcacagtctaatcctagaaacttagaatagaaactggccattcatgaggttaagtgctatgaggtaaggcatgtgctttgtgcatagagttggaggtgaggttagggaagtagtctagtgggatgatgcttgacttgggttttgaagaatgaataataatttcctcaacgcatgggatacggtagctgaattgtagggaatacgtactgatctattgatttttttttttttttttttcttaaccccaggtaacggtctgatggtaagttctgattttctcaatagttattatttgtacaattttaactggcagctccttatatctggaaatacagaggcatgtggatatagcaagaaagcccattggcatcatattaaatgagtgcatttagacctgggcttcacatatgattatccagtgagtgaaaattttacagaaatggctttctcaacacatagcttgtcattgttttcatcattattggaaaatttgacataatttgtaatctgagaaagaaaaccaaaatttagcttgataatcagcgtcaagctgcaataattgtctaaaaatccccagaatttaattttaacttatttctgcttctataatgttttttttccaaacacttcaccttataaacactacacccactcagttttagaaaagaggggacaggctatttgaatgcattgctatcttctgccatgtggaagataagaagtcactctgggtaattcaggatccttacttatgttatcaattattccttttgtgttttgtttattcaacctctaacttaaactcagttttttctgttgactcttaactgtgcttccttctgagagatagagatagatacagaaaagaaagaagagaaatcattatgaacaaaacaaaaactcagggcttactacctttcacttgtcatcctctctgttccactttttgcagctgaatctgtggccatttcctcatatgttctcactgcttagcctgctctcatgcagcgtgcagccttccctttccagcaaacagctcttgatgatattaccaatggcctccctgtcactaactaaataacattttttcagtctgtcttacttgctgtatcagcatcattcaacaccaattctcacaccctctttcttgaaacattttctttccttgtcttctgggacacaacagccatctgtttttcctctgtaaatgtttctccagtgtatccttttataagtgtatttttacgacccagctgctaaatcgtggagttaataaaggcttgctcctaggccttcctttattcacactatccaatgtgatctcatccatatatggagcttcaattaccgcttattaatctattcaagtggttcccaaaactgtatctcaggcatacacttcttcagatcctagaatcacatatataacattttactcgacagctcttctcaatagctaatggcatctccaaagttaaagtgtgaaacaaacaactcccgattttcgcattacgcttccgctctaaagaaacctagcttggttttcattctgtgttttctagctcatgaatgataccaccaatcacctggttgctgatttaaaaaccagagtcactttttactccctatgttcatcctaaaactaagtactacagatttcacctgctaaatatctctcaaatctctcaatctatccacttgttgttttttttttttatctccatgaaacactctcatctgttttgggtggacgactacacggggcctgctcatgaggttacatctcttatccttatttcttcgtacactagactcagtggtcttttcagaagcaaatcgtatgatgtcaggcttttcctcttaaatactttcccactatccttagggtctgtattaggcctttaaaattattttaatgtctagaaaatccgaattctaacctcttcctgcttgttttgttttgtatttgtttccgttttttttttaatcagatctgtgttttggatgtaaaataagtcattaatgtatatactacaacaaaaaatattgccaataaaacagtaacacaagccttgtttatcacatgaattataaactgcatttcaactttagagatataaaaatgtgaaaaaggaatgtgggccatatacatgatgagaaaatatgatatttcttctggtccccgcacttcatctccttgtctatctccttcctctctcgactcatctcagataggggtctccaggaagcctgctctgaagatttctatgcaggaaatttactggagcacactctcaggattaacacctgagggtgatcctaaaaagcaaatttgggtagagaactatgtctgagatgattctacaaaggactcaggctgggatggcccttcttcagtatcttgaattggacaagaagtctagacatttatatttctgcattaaccaatcatcaaatgtgagctgcctgcccatagagagcagacatgaccttgagtcaatttctagcaaagcaagcagctggagaatgagtgctcagtcctgaggtaggactgatgaatctaggtgacacaccacagtatccgctatagtccacttcctgctttatatagtaagttatagaagagctgctccaagattctactggtcctcttttacctgggcataagttgcaagaaaaagtttaatgggatagacttaagctccttttgctgcagctggtctcaagaccataacttatactttcaccattagtcctgaatttccttcaccctacattagtacttctgaaagtctaggtaacttgccagatgaggtggctcagatcctcatacctgagaagtctgatcctcttgttaccatccctttctagggccatgcctgctgcacttttctacttaccattaaaattgggcaagtgagtaccaagaaatgtccaagtggatcacctagtttccaaactaagaatatgattccttgatccactgtgtagtatcagtttcaccttctaatgatcaatatcatttagcccttccaggatgcagacttctctctttgcttcgtagtctcttagaatgagaagtcctaagttactgggcaaaacctagattttgagatataacgggacacttctttgtcccttggtagaagtatgttctctctcagaatcaagacatgtaaatctgtacagcctagaattatggagacaggaagcagaaattcctccaagtggttctctaggaatgattgtaagtaggtccattcctactttgactccatagtttctagacacatatattctacctagcatggacacacagtgccatatactagtaattgatttcacctgtacattgtcatcctttctgggtatcacctaagatcacacttggataattgtgtcttaaacaggcaatttcttcactatgtataaagctggaagcttatgaatggtcagtatatgatagagccgtgaatctcatgattcacacacttctacccctcttttctctaagataagtcagtttttataatatggctttatgcagaatcctgtgtcaatggatcaaacactgtaaatctctagactctagttctgcagagtttctgcaggcagaaaagaataatccataccatgatatatattaattccaatcaagagaaatgtggtagtttaaaatgtatccaaaaattccttaacagtccttcaccaaaaagtggactttaatatactttctcttgaatatggtatagctttagtcatctgcttttagtgacactggcaggagtgaagttacgtgacttacaaagccagattagaaaaggtgatccagttctcgcctggctctaccttgcatttgggacacatgtctttagagtccaccactatgctctgaaaaggtccacatggaggagtttacccacagactcagctgaagttccagctgagagccagtatctatttccagccatgtgattgagcaagtacactttcagatgattctattccccagcctttgagctgctctggcttatgtgcagtgaagcagagaagtgttgctgatttatgagcaaagcaagtgttgtcattttaagccactagagatggttttctgtgcagcgataaataaacaaaacatagaattactaccccttctaggtggaaggggtttaatatagtcaactttccaccatatctgtggcatgttccttcaagggatagtgctatattgggtgctaagtattttctattctagcaggttgaatagttgatgagggcagtaactagataatttttgtaaatgggcccatgtacatttacatacacataagactagcacttgggctgatgctgagtcttctgtcgtgttggcaggtgcttcttgtgcatgttagatcaatatgaagattttaaatatagtgcctattctcatatagtcattaacatgccaccaatccagacctccttatccctcatcattcaactcttccccttccagatccataatcaaccagctaagccctttgccactgtctgtgagtcagtctaagttctacctaaggccacttttatttccaaacaaagtggacaaccagatgcatgacatgataaccattggagaattgaagatatgttaaccattggagaattgcacctccccactaaattttccagtcacccttcagcagagctgtaaagtcatcaatgcccttttttctttttcttatgtccatgtagtaagctgattgatgcatggcccaagcttgaacgttttcttcttctgccagctagttataaaggacctccctcccattcagccatatgaattgagagccatatgaattgcaataatggtggatggcatggggatctaagacaccggctcctgcatcttatttggaacccctggtctggcttatgcccaatccctgaaataccatttctgtgttacattagattgttactgggtacacctgaattatgatgcagtagttctgatagacactagattataatgggtagttctgacatagtgacctctaccctatgttcagtcacttcatcttttccaaatcccagtagcatgccagaagctctatgttggcatggtcttgcagatagtatggttttgctccaggatcatacagtctatgttatgattcttctttttggattttacataaactaccattaggcttgctcatcaaagatgtttctggcatcataatattttctgggttgtttgtcccaaggagcagggccacttataccacagcctagttctgttttagactctgctcaaagctgacagcccttcatgtcatgcggtaaatgagtttgagcagtattctcaagtatggaacttgctatgctcagaagattgtgtagcctataaggtattgtttgcttttcttggtaatgacagttgcaagatgcaataatttgctttttactttaaggaagtgtttcatgatgtcagagaccattagacccctacacgcttcactcatgtgtggggctcctcaatttttattgggtttttctcctatcctcccacatgtgtcttctcaagcctccaattcatttgctacttttgctcttctgtttcaattagcgggatgttattgatatggttccatcaatatagtgaacaaagatgatattctccaaggtgtccagacaatcagttcccttcagactatattttgacataagaaaaaataattaacagtatattggagtaaggcaataaatatttactgtttctgatcgcatatgacatccagaggcagtactaatctgctctagcaaagatgccatgtctggtataatggttgcaattagagataacacttgtttgtttgagtcttcagtagtttactgtcattgaccaacattctatctggccttagtatgacccaaacctgcaaattatagggggtagcataggaccattataagggtggctttaatctctgctattccttacagggtgagatactgattttactgtcttgacagggtctaatatttggacttcctcattacagtagttcttaccccacacatcaggaaacgtgtcataaatttgtaactataaagtatatccattccactatacagtcatgactaggtaaatgatcatagctgtgagcacttcccttacaagatctttgcagacactgtttcttctccaaaatgctgttcattttcttctttgtgttcttaactcttatctatcctttcaatctcgtatatctgagagacattcctgactatatgaattcccacttcatatactcttatatgacctgtaactctcctttttagtatatagcagagttttggttttataatcatttgcatgaatatttaagtaatatttattttactgactaagctgcaagcttcatgaaataaagggaggattttgtatttacatcatctaccatagcacctggcatgcagtaggaataaaagttattgttgataaattattgattcgatagttgatatagaataaaggtgaatacattaatgaattatggaatgtactagaatttggattagaaaattgatagaaaatctcaaattctatcttataaaaatagattcttaggacccttacaacttcaaaaaaatgtttattagtatctggcacatagtataaattatgtaaatagttttgactgaatgaatgtatggcacacagatttgattctacatattttatccagactcatgtttaactagcttgagtagctcaaaaccattttaaattcctaactgggatggttgtaccgtaatggttgttgctttcaatatgcctttaaacataagacacgcatataacaacattttagagaaataggagtaaccgtattatatatactgttaaatcattcattaagtcaatgtgtttacttttgttcaattttacatattctcaactacaaaacttttctagtattaaatatattcttgaattaggcttttattctgtgtgacattttatattatgtaacatgttagagcatattaaatataagaacatgaatttctatctcctgatctttttttatgtccctatagaattccaaacacaaaaattacaaaaaagaagtaatttctcattgagagaaatgtctgattcaaggagcttttttgaaatttaagaaattgaattttaagaaatttcttattaggaatgaatctcatgaatgcttttaaatattgctgaaggatgtatgtacagaatttagaatatacaattatttggaagcaaaaaaatggaaaatctgcaactcttcatcaaaaggaattgttaaaaaaaacaaataatacatgcatgcaatggaatacatacctcaaaatgcagactacgaggtcattagaaagaatacagtggatatatgagttttaataacgaaacctctgcaaggatgtctttaagtttaaaaagtctttaagtaaaaaaggaaagtatagagcaactctatgtagaatggtatcttctgtgcaaataaaactttctgaaaagatacacaaaaaattgttaatacttcctaaggaaaggattagaaggtggaggaaaagtatatcattcactttttggtttttgctcttctttgctatttgaggttttatgttgtccctatattacttttatcataaaaattaatttgaaaaatactttttattattatatcactttatgaaataaaaactttaaacatccctgtatttgttaagggttgaaattttgtattgttgtctaaattgcattttattgtacattttatttctcaggtcatttaatatttgatttcctctggaagacaaaaaaaattcaaaataatcaataagacttcacactgttttattattgaaaatgtgatcaattttttttcctcacagttatcatgccactgttggatcaggtttcaaaatgtcatgtaacaacactttgtttgtgattaacacctataatcttttgtcatggcaacaatgatataataaatgctgaaggaagcgttgactgaaaaccatgtattactgccaagtgttgggacattaaaagggaaaagagaggaaaaaagaaaaaaacaaaaatgaaaacgaaacaaaacaaaaaaaaaaaacagacactgctgcccaggcttggcatgtcattaaggatgctatgtgacctcttcactgcctttgctaaaaacatacgtgagattgccagtggttcattcatctggctaattctatgtatatatagtacatatttgttttgtaaagttcatcaaaatcaaaataaacaaagtcattttcattcaatttgtgtgccttcaaaatgggggagcgggaatccctgtgcaatgtaattctttacttatttgcagaacaacggcagaacattggtcttgttggctgtcttactctgccaggagtcctgttcaccaaggcatggcaagaccaacatcctgtttattattttactctcattatgttgaaagcaaacactacattattgcttttgttcctccatattgcttctataagagtgtcacatatacaagaaacatttgaaatatttctattggtcatgctagtttaggaatttagaaccactttgaaatgggtaaagctcaagcctctctccacaaaactttataattgcaaaatatataagttttttgtttgtttgtttgtttgtttgagacagggtcttgctctgttgcccaggctggagtgcagtgacgtgatctcagctcaccacagcctcgaattcctgggctcaagtgatcctcccacctcagcttccagagtagctaaaaccacagccatgtgctaccacacctggctaatttttgtatttttgatagagacggggttttgccacattgcccaggctggtcttgaacttttgacctggagcaatcctgccaccttgtcctcccaaagtgctggaattacaggcatcagccgtcacacctgacaaaaatatacaagttatataaaattatataaaacatcagatgatatatatgcttgtattctatgggaaatggggtctctatgaaacgtggcatctcattactatgtatgtgataatatccaaactcctttgtaggtatatacagctcttgtttatctaacttacaccaattttccagtgactttccaaccaggaaagattctgtccacaaggggacatttcacaaggtctggagacatttttattaacacattatgatgatggtggtgggagcatgtatctagtgggtgaacagcacggatgctgctatacatcctacaatgcacaggacagccccaacaacaacgaataattaagtccagcatgtcagtagtgccaaggttgagataccctggatggcttttttctactgccactttccaaatcttattcagcttcttctacacattaaacctcttgtcatttccattctctctacaatgcccttcctctttgaccacataatcactcatgtttgacgtatttccttttgggtaactattcatcagtgtttgcatagaactctgctgagaatgcccccgttgtaatattatgatgtttactagcatatatatcctgcccaccagaccttaagctccttcagggcttctgaaatgctagtgcctggtagtcagtagccactaaataatatttgttgaatgctaactgaataaaaataaatttttaaggttaaaatatatttaagttttgtttgatgttttcatgaaagaaggatggaaatgccttaaccagttattcttgtaattaatccaggaggttggctatgatgaaactaggaggaaatgacctattataggaaataaaatttcggtcacaacaaaggaatactctgcttggaagttaaatcaggccttatgcagttgcaggtgctttcattatgcagaagatgtaaaatacagtgattgaacggcactttcttagcagagagatgatacaagaacaggtcatagaatcttaattgacttcagctatttcaagcattctgctatcctgtaatcattttagcctgacttctgcataattgcatcccatctctgcagggcatagtaaccgtggaagcttctccaggactgaaagtttttaaatgctggtgagtttgtggaggtgcaactgaaactcattctctccactcctcaccctgtggcacatattaacacgatggccctctgtcttcacctttctctgtgaagtgctgtcactccttcaagtcattaggttgccctttgcactagagtaaattccatcgtatgatgtgtgaagggatacagtatgtatcccttaagtatggtgtctccagtttctctagagcatggatgtattttcagtttcccctgcaatgctgcatacattggacttaacataacatgtggtctgagttcaggctctgctgtttgtcaactaaatggcgctatgcatattacttattatcttgggtttcagtttctttacctgtaaaatgaagcattggaataaattatctctaaggacactcatgggatgaatctcctttaattctatgattactattgattaaggaaatctctgctcattatcttctatgtgcacataagggattttatcgtggcatgaccctcagcctacttgatgtttaaacaacttgccatcagacattactgagaactttactaatttaagactactcaaatgaatttgcattgaaattgtgaccaagaccaagagagacttgtcaattcccttcaataatcaaacaataaatgcttttccttaatttggaagcagcttcctgcttcttgccctatctctagcctctacaatccatattcaggggactggctaacagagagacactgctgtccattgtctggctagctaataaatccaatctccctatgagcctgttgtgaactttggttatacttccacaggatagggtcaagagacactaaccttaatgaatagaaagctacacatttcctgtattgggattttttagtgcattatgaaccatttagtcttttctggcagcctacacttaaggaaacatgaattctgggaacaggaatggagcttctaagcatagattctaacctgaggttatttttgttaaatgtcagctaattctgcctatgtatagtgaatagaattcatgattagaatttaaattatcagttcctgttcctacctgctctgataattggcctcataaagataattgatagcttatgcctaaactcatgcctggtcaagccttctccttctatgtacgaaaccacttttaagggacaaggaattgttaattaaataacatcataagtaagtgaaaatatatacataatgttaccttaatgactatgctccataaatttcaaaggcagccacacaaacatatagagaattctcttaatgaatattttcacatttaggttaagcctactaagattctcataggaagtcagataagcgacctagttttaatatgaaaaatatttcaatgtattttaatggtaatctgtatataatgtagttatctacctaaggtgtgttttaatttttttttcctaaaatagaccttaatctgacatcaatatttttatgttcctgtaatggctgcatttggggaaagaactattggagacataaagcaatatctaaataggaatggacaggcatccacaggggcaaaaacatgcaccagcctgagctcaggatacctttcaaatgtaaccagccaacactgttaataagtagaagcagtggagaaccatgcagtattcctacacacaacacaaaatagaggtaagtgacaaacctacagattgaaaggtcaacaggctatcttttaggtcaggcaaaggatgcatacaattagtgctgaggaagattaagtatctgaggctaggacaataacatccacatttagaccttcttgtaattaatccttcagtttgaagacaattttacgtgcatacacacacatacacacacacacatacaaacatatacattcacacacacacccacatgtcaaatttcaaagttttgagtcattataaagttttgttgaaggcatttagtataatgtaactgaaataactgttggcatagtcgtgatggtttggaatacttatatgaccaaaggggtggagctgtagctcatatcaagaaatgctaattagatttggactataaattgttcctatcagccacattgaccatacagctgtgacttttcggttaggctgttttatttggtttattttttgtccaggacagccaaagaatgaagtaattttaattgcataaatttgactttcaatggatgcagtcactaaatactcatctccagaatgaagctttagcttgcaaagctaaatataaatttccttataactgaagagaaaatacgcatcttgaaatgggacaaaacaaagatattttccaatattaactgcaaagtcagtattgttttcatcctttcgtgtttatccccattatcacatttctcaaaatgtgacatttagtttttatgatccatcaaaccaactatttggaagactaccaaatattaacagaataaattcaagacaattgtttttctgtttcatcttctgtccaatagaaaaccttagaatgtatgtgtacatgtatctatatttacatatgtcttctgttagcaatttaccattcttaaagttttgcttattttaatctgaaaactcccttcttatatgtgcatgtatgataaatttttgatattcaagtatttataattaaaagtattattctgaacattaataatccaaatcaacactgccataataatactgttttttattaataatgtaagcctacagttataattttaactctcaattttgtacagatggtgatttttgtatcaaaaatatattcttaacaatagaaattgaaagaaaagatacttccatttaatagactctgcatatcctgataagaatattaattgattctgagattggaaaagcatttaaatacagtgaaaatactaagttataaattaactgttcatatttgaacctgagattgttagataattgaacatttcttttaccaagcataattttaatttaattttgacccaaataactacatttccactcaaggaatagttttcttttcctttttttaaaaatttgaactccactattttctcacctctatagagtttaaaaatttaaacaaatataatccaaattgcttaagctacctagggaagataatgtaaaagtcagtaataatgcataaggactatttaacccagctatgcagtaatgcaaaaaatatgactaaaacatgcatcaatgaaaccagaaatagaaagaatcagttaaaataatggaaccttttagcccaagcacactatctgtaaagtaattttatcatgattattctaggtccctccacctgaaatcacttatctatattcattgaaagaaaagccaagtgcattatctgaagggcccaagtggattcatatttatttttccattttactttaggcccattgatttttattactggcaatgttgttttaataacataccacagcagatttttaaaacacaacattatgatgtaatgaatttgatgtttgcctttaaaaatcactaatatatccacagggttgttaaaaatataaaataaaataaaagttcttaagacaaatatatttctgaggaagaattacttatttagttatataagctagatgactgatgaatggaggctttactcctctgatttcaaaggagtgggaagacccgatctggagtattgtttgcattacttggtttcccattttcagatagttattcgcaagctagggtgctcataaaagaggatgagagaccaattatgatttatacattacacctcactgaggataatcgaagccagtgagtatgtgcaacttggagataatatcagtgcgaagagccttagaaagatttcttcaaatatgtgaaaggctaacatggaaaagaatgaatagatttctttctttatagatatctcaaacctctaatcaccaaatggacttagatcaatataataaggaatattctaacagtgatatccaatgggaagagtgcttcaagggaagagatgggtttcttatactgaattttcctctgttgtggatgtgataaggggatttcctagatgatctcttaaaatctcttcaaacctggaggctcgacatggtggctcaaagcctgtaatcccagcactttgggaggccaaggtgggcagatcacttgagtccaggagtttgagaccagcctgggaggcatggcaaaaccccatctccacaaaaaatataaaaattatcctggtgcagtggtgtatgcctatagtcccagccgctcaggaggctgaggcaggaggaccacttgagcctgggaggcagaggttgcagtgagcaaagatcatgccactgcactctagcctgggtgacagagcaagacatcatctcgaaaaaaaaaaaaaaaactgacgtaatccttccttttttatatatgtgaaattatattgaaataaaaggggtattgtgtactgagttgctccttttgcaaacctcagtttgttgaccagagcattggtcaacaaagtgtaatgagcccaccccatggctatgtatgacaatcagtccattgggacggggcaagaacacattgaaacttctattggggtttattttattgacttttctgtttttatatatttggatgatcaatataatattagtgcagttaattatcattataatttataaatgaatgcttaaagattttaaatgtcaaatgtaaatatgtaacctttttactgataggagtatgaaataaaaataaacatttggggaccacttcaatgaagttaaagcagaggaaagttagtttagaataagtgcactggaatcttttatatctatgacagaaatagagaacaactcaaagaaaacttaacctttagatatttatgttggtcaagttcatgccaataaagctatgctaggattaaaaactgaaagtatattggaagaacaggacttgttagccatattaatgttaaaaatttcatacattgtcacagaattaattgcgtatgtaaattcgggtgcagtaataatggcatcataggtgaagcactaccctttcacatctagggtcatgttacatctaacccaaggttttaaccacaattagttgagtggtttggggttattacctgccaagcagtagttcttcattagaatgaatataaagcacatagtttatcacaattaggcttaattggctatcttagtctctgttcagtagatgccaagaacagagacagcatggacaaaaattctcatctcaatacccagaaaggacagttttaggtcatttcttgccaggttctgtgatggatgtggtctgacttcactttaaagtactcaaacagagggcattcatagctaacaataccatattttattttatcttcctgagagttattgacttatctttatttcttaccccagcttcttccttttttctcattcttttccggtgccatttttttccttcccccactttctccccctcatacatgcatataaacacacacacacacacacacacacacacacacacacacacacacacagttctgaggtcaatcaggaggctccaatcaagcaatgaatacacaaggaggactataacagaatgatatatgatttgcattaataaatgccattcttgcttttatattggattctgaaagaatttttgtatgtagaggatgaaaaaaaagtgaggaaccatttttacctaaatgtttcaaaaatatcctttccaatatgcagcattttaaattcagagactattaaaagagagaaaaacaatcagttttacttcataatgttgagagctcttggcagagttgttagaagcactgtaatctattgtgcaaatgatgctgaaattttgtatcatctctgatcaatgagtgtttctagagtacttagaatcaagagaaaacaatgaaacaaattagtagatgagaggtatagatttgcctcatccacagggaaacatatatttttaagtcacaatgattaatagatctagacccatcatatagttaaaaaaagtattgatttctccttcaggcttacctaagaaaaattatgaacatgagtttataaaagcaaacgtattggtaataaactgagaacagaatgacaaaataactttaaagccagaaaatcctgatcaaagttattcagtaaatatgttattcagtagctatgacacagattgttcctaaatataaaccagaagagtataaaattatttcattgaaatacttagttctttaatatgttgggttttttttttgggggggggggttgctggtttatttgcttttgtgtgttcatgtacattagaccaaacatacaaatagattatgttgacttctgcccttagtgaatattatgtttgtatttaaaggttattttcatcaacttttcatcataaaaattgaattattttcattctttctgttttagtccagtcccaccatttaatttggacattaaatcctctgagtataaatatgacagtaacataaataaaattgtagaggtgaaagtaaattggcatatacagtgttttatgcagaaagtattattgcaactactaaattttcctgtagttgtgctctaaaatataaacatgcaagagtcttaattttatttccattataagtgataattgttattgcttgaggtgaatgataatatatagtaaacaaagagcccagatttctatcaaaactgaaaatccacttatgtgagcaaagatgaaaggtcttctgttttaaaactgaaaatcttatgaatggccataaatgtgtcttttaggtaacaatcagtgtagtgagtatcttattttctgaaaacatgcttggaaatttattgaattattgttactgagttgttctgctaggaattgtgagcccatgagtggaagaagggtggtgtcttgtcagaaattgaaatatatatgaagaaaactgagcattttattaccatttagcttctttcaggactacttaacaggactgatatcccttagcattgaaaacaaatggtgttctctttagttattggatactgcatttaagaatctctataaagataagcactcagccttgacaatgtaaaatctgaaaggagcaactcacaagctatcagaagaaaagaatgaaacacagaattttgtctatttatcagcccatctacctgaaattatttagattatttaaaaaattaaagtcaaacatgcatgatcatcttagcactatcatgtatgttgaaataaggtttataacgctttgaactttaccccttcaggttactcatcggtgttctgaaacatgtgcatacaatattcaggttagaaatcattgagaaaaaagagtatttaatttttaatgagtatgcatgtccttattgtctagaaatagtcactataaagatgttgatgtgcgtgcaaaagtttgaccttcgacatgagctgcccagcactcacatatgcgtacaagcccttgtcagttaacaaagaggatctgaggtaaaactcctaaaacaaaggtactaccagctgaagtgcagacaaatttaggaactatgagtagggttgatctagttttcgaaatgatattgagctcttagagaaaatgaataagtggaaaatgaatagtttatacttcagagaagccctgacaattataaacagtatgaatccacaaaacacataagtgataaatgactatgatgatattaaagaaaatcccccagagttcctttttagtctctttggtttgattccttttataaattattaatatttttattaattatgaaagtaatttttgccataagaaaaataatgaataagagaaaaggtaacatttcccctagttacatgctaatcccaatcctcagaataatgttgacaagttggtattctttggacatttgcatgtgcctatttaaaaatatgtataatatataagtgtaatataaatatatacagaaacatatatgcacatatatctaatgtaacaggtgtcccttcagcctgattggtcccatggctagtagacttgtgagatttccttaattatctgcaaataaaatggaaaccccatttcctacaaggaagtgtgtagtgacttcccacaggagtcactatttttttcagtgaagtgcagcatgacaggggacagggataggatggtgtaacagtctgtgattattgtaagtgacatttttttttctttcaggtatacctatacttgcacacacatcacacccagacctatacacataaactttaaaaaatatccctaaataatggtgcatgtctgtttctgcttcttgcttatttccctcaatacattttggacagttctaatgtcaatacatacaaagctttttatttctctcacagaccagtgggaagtattccattctgtaatgtaccaaaatgtattttcactttccccttttgatgatatcatgccattattccacaataaaaaaaaaacgacatacctaactatacatctatctatctgtgtaaatatataatatagtcctttacccactcattcttatatatctgcagaacaaattcctaatatgggatttgactgaagtatacacaacttaaatatttttaggtatgaagaccaccgttcctttgttcatttgccagtgctggagtttatcattcctttaatttgcttgatctaataacgtggaatatgttatagtttcacttcagaattcacagtgaatatatttgcatatggttactggccatttctctccttaaatatttttttgcccatttcttatatagattgttttattgacttataaaactattttatactttattaatatgagatctttgactccgtgaacattttcttttagaatgccatttgtctttttaatgtgtttatgatatctttcatcctcatgagatgtattattttatgttattttatttttactaaaacttgtggtatgttatacattatattaagaaatgccctctctacttaaatatttttaaaatgtctgctgtattttcataattctttcatagtttgtttgctgattcttgggcccttaattgttctcatttattgtggcagtggtgtaagatgggactttacttgggttcatatatttaaagcgtttagaaaggttcttgggacactagaaactcttcgtgaatgtactttaatttttatttacaattctggatcagggtaagttgcaactccctgaagcacctgctctgtgtgtactgccttcacaggaggtagggctacatactggttggacaccgaatgaaaataagcacctagattctagaactttgtatccagtgactaatttgtaaccccagtaacataacttggttctctaggcctcagtttccttcctgagaagctgagaatcaatccccttgtcatttctcaaattcttctttcacaagcactgattctatagggcatttgtttacttgaagaaaatagaagtgaaatacatcggagaaatgctgaaagctaaagtagtggtatgtgtgtgagagagttttgttttgcttctcactgtaagccttcccgaagtcataaagattacctgtgttgtgaatctacgtgtgtgatacaatattttctaaacttctctaaccacatatccttttgttccctcagaacttctcataaaaattaatatcttagggactatatttttcgtgaacagcagagttagatcatctctaagtcccttttcttctctaatgttctgggaaccgcatatgttctgaggctaagccatgctgataaacagaacttgatttctgaagtcactccacaggatacacattattaacacccatttccaacaattacactgtttctcatgatggccccacatactcacgtattcattcaaagtgttattacttccattgccaggtgccaagatgctgaggactcagagatacttaaaacctggtgccttcccttggagttcttagtacctctgtagtgtgttgggagcaccatttatttcttagttttagaggcatatctactttatagaatcaactactcagtaacctgtgtgtatgaaaggtgcatgatattttaatattgcaagatgctaaagagattgctttgttattttttagataatgactatcttcacagtgtaagaagtatttatgttttgaatcctgatagcctctaaactgaaacataagttgtttcactgtcaaatttgcttaaaataattatattttcatagctctgtatttagcatagcttatgcaagtttattatatacatttttatgaatgcttattgaaaaagtaaagtattgaaatattacagttattaaaaaagcaaataagccatatgatcaaggagctgttctatagatctaatttgtgacttaattattttaaggtaaagtataaaatagccaaagcaaatctaaataaatttgtgcagcaggtttagcattccttttgtggttattgttgaaactctagcagggtaattaacagattgaaaactatactattgttttgtacattttcaaaagaaattgaagcagtgtattagatggaagtagtagctgtaggctacagctctctctctgctgttggatctgtatatcattaactggaaataaaatgacccattgagggaataccatttcctctggattcatatctataccatacttactattattaatcggtcttaaattatgcttacatttaaaataacctattctgcaagtagaaaaatgaaaaacacatagaaaaaaataaaattgaaaattctatgttgtcaggtaacatgagcagaattataggactgtattattttgaggcgatcttctaatactatatctagacactgcaatatctcctgcaaaactggagatttgcctgagacttggtcatctaaccctgaaagctgaggaccagaaacaaatgtgtaaacttgacctttcccctgcctactaggagcgtgttttgaattctcactatagtcatgaatgagtaaatgcagaaaatgggagaaagaatctgcttcctgccgtatttcccactattgtaggaactgagagagtttcttctacaggtccttgtgaccactgactccaacttctgggtcaagccatcagacaaattctgtctgcaatttaatgatctctagtgaatgtcgattgactttctagtttttgatcaccaaaggcaagtataatgtgggtacgctaaaattcccttactaaaatattttagaaaatttgttctaaacgttaccactttctggcccactgaggcaaagagaggaggagtccccaaagacaaataaaataataaattaatttagaccctgggagattgactggcttataaagtcctatgttggcaatttcaatggtctgaacaaagtccgcaaaataagcctgttcctggctctatggcttacatatgtcctcaaaaagagcaacttgctgatgcattgtaacatgaattaccttagtacatttacattaaaatgtgacatgatatcaaaagattataagattgcatatctttgtcatactacctggaaaaaaattatggataagtgtcatgttaaaatcttgttctgtcatgaatataagctgagtgtaatcacaaatgacagctgaaagaggatagaaaaaccatcttgacacctaagtgatgatattgttatctgtattctgaataattttacttataacaggtattgctctgtaagtttgtcttatgatccgtgttttaattctgatgagagaagaatgttggagttgaatatcatattccttaacatttattttccctaatgttaatattgcttcatcagttttctttctgttggtataatataactatagtcatctctttactgtaaaattaattccccatgccatcttgctaaggtttgtcttctataaatcctgtttagatgttttttattttattagtattttgaaaaatcttaatctttcaaaaagcaagtatcatctgtttatatttattgtcattactgatattagtgaccatttattttacgtagatgtatatgtgtttatacattctttccttattttctcttgtcctgacctactttatattggattcatgtttcttaattctctttactgtttcagtggtttgaaagctatatattctatttgtagtctttctagggtttaaccttaatgtgttcacttaatttacagagctatggtagatcaaaatcactacattactacaaaatattattggaaatgtagagttctttagccttcaggttagcctttagcctttctctttttcactccctgtctttgcctctcagctttcagataccgtccttatgttactatttagttttctagttctactttaaaatattttcctatatttgtcctttcctttaacaatgttcatttatttacattaatctataaattgaataatgaggtggtcacaactgctgcatatgttttagcccttcatttttatttggctttcttctcactaaaccacatcctttagaagtttcttaagtgcaggtctgtaaatagtaacatatctttgtctttgaaaatgtctttagttaaccctcattcttttcaatgctagttgtatggaattcaggattgttaggttgaaaattcttttcctttggaattattaaggtattatttcatgtatttacctcttattattgctgatgataaacctgctgtcaatctgttcaccattcctttacagatcatatgcatttttcttttctatggcttttaaagatttttcttttatgttctaaaatttcaccatggtttctctaaaagtgatttgttaactgctttaaatttggcttactacttgaacttgaagacttatgtctttcttcagctctggaaaattattaatcattttctgtgtgattactgcttccctttaattctatctatccttaccctttggaatattttattaaatgtatattgcattgatttgtgtagttctgtttaacttaaccacacttatttcccccccttttaattttctgcattctgggtggttatcttgaattggaagtttctggaacttttctttctcagtaatgtattttttaagttttttaaagttatattttatttaacatatataggtattggtagcaaaagagaggtcacttatgttagttcagtctgccattattttagatttagttgaattctgtatacaaagttttgacacaaaatgtgtctttatactatgctgagacaacatctaaagcttctcaggaatagcaaaactcttttaattccttggtcaaaaaaggtcaacctggcttcgaatgtgctggaagtataaaatgactctacaaaattacagggcacattactattttctctttagtgtagcttaattgtgaccgtgtgtgtgtgtgtagatacatgcgtgtgcacagaaagactgatttctttccacactttaattaattgaagagatgtagattatgcagcccatttatttacttttctcctatacacgttttacttttctaccaacttcagttgttaatattagactgttttcttaatctgtgttgcttttttatctccttcttaattacttttagaaaatttctcttttttactccctatctttgcctctccgttcaatatattttttaaaagtttcctaaattttggctttttgtacctgttacaaattatatatacatattaaaactgtcatcatagtactagaataataaaaagcaatgctattatcatcaaaaccattgagaatgcctttaaattttatttagaatatcaacaatagttaattggctagtgcactcattgaaggagagcctattttctctaaaatattttaccagtagtgggagaagaactgccacatggcttctaaggttttatagataactccttgttaacctcaatcatttgactttagacttttgtgaattcctttttccatctttcttttttcactttattttgtttagatgctggtttgattgaggttaataaaaaaaaaaagaaaagaagaatagtggtcaaaaccaaaaggaatgaatgtgtatcttctgtgtaattaaaagttgatgatatctcaatatttgcatgtaacaatattaaattctaggactaacacataatatttcagcacattttaatgtttaggtgtcttaaaaatacatccattttggaataaatctatcttctacagtcttagctccgtgaggggatacagcttctaaaagcattacctacaaagtttggaacataataaggaatggagagaattgttaaagggaagagaaggaaagagagtatgcacaatgagaaataatatactgtttgaagaaaataaaagcaccataatctaataaaattctcagtcttttcagtcattagagcttagctttagagagcagtcttactttgttgttaatttgtttgagtttttaaaccagacttactaatttaaatattagtacaaaaatattgtaacagcctatgcatatttgagaatataaacctctcatccttttttcaaatacaaacctcacattcttcatacaaagatcacaattttaattcttgttcaaagctttgtgaacatagctttcagagttactaagtctacaaatagttacagatatacaataggtaatgccatttttatatatctcaggctgcctgtccccagtaatctagaatgagtaatttcaaaaacaagcattctgacagttcaatattataatttatttttataccaaatttttaaagtatttttttactttgtaatactatatgcttattcaggactctagagaaaagaactccattcacaaaacaattcctacaacgtttttatatgtacttcgatgtatatctctattgagtaccacatcagagaaaatatagaatgtgaattctgtattatgacttgcagggaacacaaaatactctgacatatgattgaaatctgcctaatagcagtaaagtgaatcttaggaagaaaatcttaagcatttattccacaactctgcaaaacagcttcacactgaacctctgagcctgaaatgtgagaaaataaagtgattgaagcctgtcagcaaagaaaatcagccaacagagtgatgattccccagacaagaaaattgaaacaagtatctctactgcattaaatctgaatcagttaccattcaaaaggaagaaatttttagataaagctgagatttacgtgaattaaaaaactaagtgtgtgtgtgtatgtgtgtgtgttccatttatttacccaacaacctaagtttaaagaataattcataattgagtaacataaaatagcccaatgaaatataataaaagagaacatttaattattgccactactactttaaaatgtttgcactctatttcaaccaattatgtgcatatacatatgcacgttttactgtagcaagtgaagtcctggttgcctttggatcccttaatgcttccaagataaattctaaacctcttaacctgccaataaaagtcttctaccatctgcctctattgtatcactcccacattatctcctatttattccctacaacataacacctgttccagccactgttgttttcatcctgtccctcaagtgttctaccaccttctactccatgtgcctgtgcatcgccctatctctttacctttgccaatgccttcttccctcctcccttccaattatttaaagaggtaagtttgtgctatctcatcgtacctttcttaacttattctgcctcaaattaacacttttctctgaactcccatagcatttaactataaagatatacacatgcctgtacagggctattactaaatgtattatttaaagattgctttgtgtttttattgcgatttaagatgttattgcttttccaagttgtttaaacattgtagtcattttttattgtgcttggattttgattggtttcaatccaaaatatgatctttagaaatgtctaaaacgtctatttagctatttgtaacctctaaagatagtaaggttggtgcaggaaatcatttgaatggcactttgttttgttttgttttgttatgctttgtgacaaagtcttactttgtcacctaggctggagtgcagtggcatgatctcgactcactgcaacctccatctcccgggttcaaatgattctattctcatgccccagcctcctgagtagctggaattacaggcctgtgccaccatgcccgaataatttttgcatttttagtagagatggagttttgtcacattggccagagtggtcttgaacttgtgacctcaagtaatctgcctgcttcagtctcccgaagtgctgggattacatgtgtgagcctggcctgaatggcatttttaatgtgatggtttcagagtccttaacgaagtaagatataatctcccattctttattacatgtctatgattgtgtcaagaagtcattattgccattttttttactttcatggtaaaaatagccatgaattataagctttttttttttctgccagcctaaattgttacttagtgaagatgagagtacaactgatggactttgatttattacatctttttttcctctaaggcatatttatttccaaatttgcttaatgttatagtatacatgccatcttaattagattatcattaattacctaatgagaagagtttgtgtgttgtaacaaagcacttaccattaagaaattcctttgacaggtttgttaaagatctcatgattgtagatgtgtggcgttatttctgaggcctctgttctgttccattggtctctatatctgttttggtaccagtaccatgctgttttgtttactgtagccttgtagtatagtttgaagtcaggtcacgtgatgcctccagttttgttctttttgcttaggattgtcttggctatatgggctctttttggttccatatgaaatttaaagtagtttttttttctaattctgtgaagaaagtcaatggtagcttcatggggatagcattgaatctataaattactttggacagtatggccattttcacaatattgattcttcctatccatgagcgtgtactgtttttccatttgattatgtcctctcttattttcttgagcagtggtttgtagttctccttaacaaggtccttcacatcccttataaacagaaataccatttgacccagcaatcccattgcaaggtatatacccaaaggattataaatatttctactataaagacacatgcacatgtatgtttattgcagcactgttctcaatagcaaagacttggaaccaacccaaatgccgatcaatggtagactggataaagacaatgtggcacatatacaccatggaatactatgcagccataaaaacggatgaattcatgtcctttgcagggacatggatgaagctagaaaccatcattctcagcaaactaacacaggaacagaaaaccaaacaccacatgttcgcactcataagtgggagtcgaacaatgagaacacatggacaaggaagggaaacatcacacactggggcctgtcagggggtgggggctagatgagggacagcattaggagaaatacctaatgtagatgacaggttgatgggtgcagcaaaccaccatggcacatgtatacctatgtaacaaacctgcaggttctgcacatgtatcccaggacttaaagtaaagttaaaaaaaaaaaaaaaagaaattcctttgacaaggaacctcaatttctttgtctatgtaagattgtgctatagaaactacatggtcacctccatttctaaattgttagaatgctgtcaacctgtaaacatcatggcattaagagagcatttgcctaactgtgaaagggttgtatggaaaaataataatatattgcatcaatagttagaaagttttaacttttagaaaatgattttatgaaattagcctgtgtaacttcataaatagatgagttaatgaaattctaaacatgtgaatgtttgctaaaaataaaaatattttatcccctttccactttaggaaaaaatatattaaatataaaaacaaactcacatgtatcaatatttttttaaatcattaaccatccttctttcataggtttaaaatctttattgaagggatcactgtaatgttttacacacaacgtttggctgatagtaactggcaattggatttagaatcccaattcaagcacaaatccctggatgtcacaggggaaccttgatccttgatctaaggcaaataagttcttctccaagttttataaaagaggatcacttatagccaaccatgacgttataactctcatggcatggtgcttagtgagagaacaagctactctaagtagcaaagcattgaaaactgaagagcctcctgtaaaatgtaagctacttttagcatgcagtcatagggagctggattttatttttttaattcagtaattcagctttcaaatgatagtgttcagttgttataaaggtcacctgcccttggcctcatttcagcttaattgggacaggttaatcttcttttctgttgttctttcaatttggaatgaaactgggatctctattagtactgctcatccatcaaatcctatgaccttgaaagaaggcagcagcccttcttctcaggagagagtctgaagatgagaattaaaataggtcttctcagtggagacccacggcaacatgtaataagacatgtaaaaaaagactctatcactgcaggcatcctgtaacatttctccaagttacatatggagtcaaaaagagaatttatttaagctcagagtaaaaaaagaaaaaaaaaaaaagaaatcaggaaaatatgttaaattcttctaaaaatcaactaaaattgtctatgaaaatgttcaatggacgtagattttaaaatatgttttctttccaattatgaaactttccaggtatgaaagttttaactttctcgctagaaatatttccaaaaaaaggaagagtagttatattagcaaaaggtgtggataataatgcccttttcataattataaaaaatatttttgtttaaacaatgagaagacttgttgaagtaaccgtaggataggctgcttgtatgataataaacacaaagtgaggatgaatatataaagatcactattataacagcaatacttcatacatgagtcaatgtttattttgctaggtttggttattgaggaaaattgccatgatcccagaccactatggaaagtttataaaaacaaggtgtaatgcttccttttaacttcacaataagcaacctatgtaagaacacataccgaacaccaagtaaattaccactcttcttctagaattatccaagaaaacaacatcaggaagaaaaattagtttgatgcatgtaagactgaagagcttttcacatgatataggactacaaacattaaatagtctgaaaaaatgttgaattcattataattaaagaccattatctgaaaatgaaagaaaagacttcactacagttacatgttttacatgcttcattttccatgtgatttcatgcttgtaaagccacccagaaggatccctacatctccaagttcagtgctgtgttctgtttataagttgctctatttacaaggaaaactcagagaaggctctccaaaagtgattcaaagtctagggcaatttaatgatcattcatcgaaagttgttatctttacattaatatttagatagccaatcttatccaacctgatattttattaagtataaaattatctgtgacaaacaagtatatccttaacatctggtacaaataaaacatcaaaaggataatgattataatatttcatgttttattcatttttaaagaaaatgtttactttgaaaatattattataaatttaattgatcaaagctcaggctgagccaactgaaaaagaatttatattccaattttatgtcctactagttggtggccttagataaattatttaacttatttaaatttcagtttcttcaagtatatgtttggggtaatagaactcacatcattagatcattgtaagactaaatgagaaatttatacttggttgaagtgaataacaaggtgctacttccatgatagatgcttgataaatataatttttaatgttttctgtattattttgatactttcatggaataacatgggtatatcttattatgaatctaatgtacagattttacatcttccaatattgataaagtgagcaacctatttaatattctttaaaattttcaagataatttagaaattttcaagataagttagaccagggtgatacacttatattggaggcaatctcatagcccaggtccgttaaaatgtcaatgtcaaccaaagaaaatgtaagaatagcaaaatcctgaaatcttgattatataccccatcctttctccttttcctttcaccatcatagcaatctctgctagttggcgaatcttctaaatcaagatttcaaggcagagtttatagggttttgttccacaggtacagttctctaaatttatgatgaaatataatgggaaaaagtggctttacctaaattgttttagttcagattgcataaaatttcgattacacatggttattactcagccctctttatgtgtatatgctcataggatgcacatatatttagacttttgctctattgacttcataattgaaagaaaagaaaaaatataatggctctattaattatttacatattacatttaattctaccagatgctgaaaagagcaaaagaaacactgatcgatgaaacttatatatgggccaagttgctgttgcagagtggagcttgcaacttgaggcagagtacagttgtgttgtagaaaacaaatacactaacattttgaaccaaactcaaaatgtgcctagaaaattctataacataggatcaggtagtttaagtaaagttcctgtgaaaggtggcatatgttttcttggatagtttagtttttatcttttaagtatattaaagctcaagataaagctttgtctaccttacaacattgctctaatctacttatatcaattctgccctttggggacacccacacactgtgtaactccagagacccatattcccagagaacaccatgtgaatggtgcccctggaattgctcgttgcagtagccctgctgctgatctgggtgctctgaataacttgattgaatcttttccatgattttagtaatttatcagagtgactgttgcttacaaagtattcccttaggtgatttctttctttcctttttctttttgatggagcagtgtgcagttatggtgttacaaagttataacattgtggcaataaattttagagcaaacgataaaataagataaaactcaactagccttatgaaaaataattctgctcagcagggtttctttttcaggatagtcaagatttttcttggtaaaatgcatatattaatggaccatggtcaatataattatatgactcaatctgtacatgttcaggaaatgaaaaatactctctctgtttctaattcaagccatttttattcagtgttatcctgataatcattgcaaataacaaaggtctattatggtccttttttattttgctaatgtaaacaacaatcatataaagctatgtagctacttatgaatgcatttaaactggaactgtttcatttaaaaacagaaaattcacactccatctaaactccctataggactcataggattcctcttatagatctcatatattgatcagtttcactgggacagtttttcacagtaaaaatcccagagatccacaataaagtgtaggcttcaaagagggatgacatgtattttccatcccttagttgtggaccctgcactggcctggaattacatgctaattagatgttcttctccccgtcacctcttcttatcttcctgaagaccataaccacactgcatgcccctgagaataagagacttctttgtgcttcacttacttcaccctgatccaagtcctaatggtgcaaggattactctggagttacagtttgagatgctcagggaaattaggaaaggattcactgggaaagcaaaacataagttctgaagaatgaatcaaagttagcaagatgggggcaggtcatgagtgagggtggtggatgctgttcctagtagaaaaacagcaggtgtaaaggtccattgatggcagctagtgtgacaaggatgaggaaccaagaccaggccaccgtggctgcagctcagaacatcaaagggtgctggtgagagacgaggcaggagaagactgcaggagcctggccaggcagagctgtggaagcctcataagggattttaatttctatattaactcaagataaataattcaagcagggtggtgacatgatcagctctgccttttgaaaggaacagtggagcagcagtgtggaggaatgatgggagtgctttccaatcaggtggctttgcagaagactagacaagatgatgatgaaggtgaaaacagatgagtgaggtgtcaggaataacttgcaggttttattatgattataattaggagagacaattaggtgaatgtattgaacacacagcacacatgcacacacacatacaaagaaatagtaaatcagagaaatagtaaatcttttctctgatcatccagatgattactgggcttgtaattaggggaattagggagatttggggaatcccagctttaaaagataataaaggtgttctgcaagccatatagcaaatgatctcatatatgaaattgttaggataatattagactaatggggagatagatgaattgagttatagcaaaaaaacaagaacagaaacaaaacttatctttcaagtaagtcaatttaaacttactcttttagctttgctaaacttatgtttttctttttattaatattagctcttctgtatttaaaactgaggctggtgaactacagcttaagggtcaaatctggttctcagtcagttttgtagataaagttttattgagacacagccacaaccctttatttacctgttgtctatggcttccctttggctacaagcccagagtggaatccttgcaacaacagctgtatgccctgcaaagcctgatgtatttactagttggcctcaacagaaaaagtttgccaactcctgggttgaaggatttttgctttccttgcttttattctcctctgctaaatgttggttgataaggtcatttatatccttcctttcaaataaattttgatatattttgtttttggaatttgatcttttgtatggggcctcaaaacatgaaattctaaatacataataaaaatttttaaatatgatatattctcccatatattattttcttgtttctttagaacaaatatgattttatatctaattttgggggccctaaaataatcactccagtcaaccattcttaccattttgcttttgggattttactctttttctgatacatatctcattagtaaatctctggcatattcaaagacagacatagtctcaagatgattacatatataacttgcaatttttattgcacgcattccatttcagtacatcagctgctttattaaaatatttggaaaatacattaagtactgtgtctaaatgccttactgaaagaataaatctaaaggcttcagcttaaaggttataaagcactgacatgacgtggttggagcctacttttctatacaacataatctaatagtctgtagatgcaaagatactcaatgagaagttcttttaattaagtacatttagacctagataaactcatatgtatgttttctatcatatttgtttttacgtattattttttatgccattaattgtataagttaatggtgacttaatataggagaaaataatcaaaatgaaatactactttatttacatttttgagaatttttaatggataattatagttattattgttccattcttcttccttccttgaatctttttaatgagcaaatagttattaaagtatgttttttctgagtggaatgatcagtagacaacaacaaggatccccaatttcttttcatcattttgatatatttagagcacctaaatgaataggaaattataggtattgtctacccagccattgtcacattttattaaattaaatcttatacattttactgataacatcaaaatatctgtaacacacacctaagaatcccttaagctgtgaaaatgaaggccttgctgaaaggatacattagatgaatttttggaaaaatatctaagtggttttattcatttacaaatgatttgtttagcatctattttgaataaggtgcagtggtcatatccaaaaaatataaatgaagagttacaatcctatactcaagcaccacatagtatatagagagcaaataactgatgcttaagaattatttataggataaatacgaacaattacaacacagaatgctacatagtcatctgtacataagccatctgcttgtggtaggtacacaggcctttgggagcacacatagaacaagagcatctcaccaggaaacggggaggaagaatttcaggacctgagacttgatgagtcagaggaagcttttcatgcagacacagaatgggttcgagcatcgtgattagcataaacaatgatacacgcttgaacaaacgtaaaggtttgggaaataacatttaacgtgtgattattgtgagaaaggagaagaaaggagagagtaggcagataaaaaaaaaaaagaccagattatgaaggaccttgtattactttttaaggagattttttagatagtgtagtattttttatttttagtctagtagatgtacataattctaaatatatatacacatacatatatatgtttattttttatgtaaagaaagagaatgtgtgtgctatctagatatataaataaaatgcattgaggtggagctatgtggtaaattgggagagtttggcttagaatttcatactctctgcctcctctcgctggagaatagcaggactcaccagtgattatacatccaaccagacaggttctgcagaaggatagaagctttctgttagagaacccacaaaggaaagcgcccaaatttaatgtaatgcttttaaaacaattaatttgttagcataggatgatgaaaacaatttgtactaaaaaggaccagggattaatgattaatgactgttcagttttctttttgcaggcaatctttctaaaacacttacattggaacctgttccaacaatgctcattgtaagtctagggcttcattatgggagatgagagttgaccaggaaggtgaggtggccaggcttctgtaattgcactttccttagataaaacagataaaagttcttacaaagactgaatttgaaataaggtacccctttactttaaaatttgaaaaacattgcactacttaataagatatacagattgtgtttttttaattcaagaacatttatggctttgtgatttatttcattcgttgtagtaactagtatttttttcctttgaggtttatgtaggcaaagtcttacaaaaattatcttacttgttggcacttttttagtataagattgtttccttacatagctgttttacaaatgcacaatactaaataaaacatacaaaatgctgttgaaaatgccatgacaattttatgctcttctatatgctccattgctaaggaattagatggctcttcataaaaagagactctctgtagacttcgaatctaaggctttatgacttctaagatgctgattcaccatcatctcacatacaataattcatctggaacccattgagtgcactggtttcacatcagttcagttaagccatgcgtcaaaaccttggaaaaagtaaaacaaaacagaaagtcctcaagacagtgtgcaaacaactgctaaagcagaaattgtatgcaaaaataaaagaatattattcaggtgctgctaaccaataattgatcgtttcagccacatgtatgtatatgagttaacttcaaaatcagcattatcttcttctatacaaaatacagttgcatatcagtggaagccaaagcacaatgtcagtaaatatttatgcttcagattttcttaggactgtattttttttttaagagacaggtttctcgctctatcgcccaggctagcgtgcagtggtatgatcataatctttagagctctatttaaaggaaaaaaaaatacaccttttcaaggtggaatctgccaaatttcatcatcttaaaggggcttttcccctttgtaagtgacattaagttttttatcacaaagaaggaaaaggaaagatgtaagaaattggtcaaaatcagcacagatcatgttaaaacaaacaccctctgagtttgcttctgttgggatttggctatagtctccatgaacatgctgtacaagcttcttaatatgtctcatttggaagaacaaagtgattcttcaaacggaaccactttctgcactttaagtattactggtagttgtgctcaggatacctgttgtagtagtgtgtatgtgcacacacacaagcacacaccctttacatacgcatacatactttcaattaaaaatgcaaaaaccaaatattttaaagatcaccatgactagcacatactaagttttaaatatttgtcaaattttgtaggcatagaaatattttttatataaattttgtcagtaactatgcctaagctagtattagaagcaatagaactattttgagctctctatgatatatacttctgtaccctgtctagaagattatcttacccctgtatatatatatacacacatattagatatatacatatatattttacatacatatataatatatacatatatattttatatacatatattgtatattatatattatatatgtatcatattatatactatatatgtatgcattatataggtatatatcatatatacatatatatataacgtatagacacgcatgcatatatatatatgtatataattttctcatgagtagatccagggttcctttgactcaaccggatataaagtaatgcattggttcagactagatcattctagagctaaactaagaggagttctttgaaagacttgatggatttctcaagccataagagggcaactgattttgatgagaacagaaagcaccaaaattgacaaaatagatttcagttaacataggcattgatcttttgtgaacctgagcagggtggcctcgcctttatcttttcttctctcattatgagtcatttttaggaccaggcatttagagcacatatctctagtttctgctaaaatgaatctaacagttaacacattggtacttatgctacagcatattatcaccttctgaaataacataacagttttttttaagctaagcaagatggttaagcttgaaaatttaacaaaacccaaagatggaaaatgtaaaagacctgtggattttcttccatgagtggatataaatgctaatgaaatgttccttagaacacatttaaattaaaccatgagctaccttcaatgattatagaaaaattgttcaagaaggattgaaaacttaactgccattagataagaaagttctaaggtgctgatgggccacatgcacagctctgtaactagaccgaaggtagttttcctttctctgcatattaataatgacaggtggtgctggagataattttaaccagattatggtgagctgtagttctgattcaaaggcttttttcactgccttacttgaatagagtatgactgaacacactttaaaatttatttctttcccgaaagcatttgaagatttttgtgagagaactgatgaagtacttgcttttctcaaaataaataaataaataaatctttgaaaaacttaaagcgctgatttttaaaaggcatctcagacatttgtgtggtagctttttctaatttctgaatatgaagatgcctgttaatagcttccaaatggcaaagtgtgtgtgtatgtatgtgtgtgtgagcgtgtgtgtgtgtgagagagtgtgtgtgtgagagagagagagagagagtgtgtgtgtgtgtgtgtgtgtgtgtgtgtgtgcgtgcgcgcgcgcatgcatgtaaaggatgcacaggaaaataatttcttatccttggactttaaaacaaagcccttcctaattggcaaaatatggaaatcgttttggccaagaaataaactgtctttggtgtttacattttacaagaaaatttttttctaagctgtgttttgcctatcatctgcctcttggtcaaagtctgaggcatttgaatctcattcagaagcgtcattacctcttaaggaggttttaaatcaatcaaacctgtttcttttactgaattcatatgtatgtatgtgactgtgtgtgtgtgtgtgtgtgtgtgtgtgtgtgtgtgtgtgtgtgtgaacataagaaaaaatatacttttccaatttttgacaggcatgtttaaggcatagtcacatttgctaaagcaatcagaagcaaaaaatacaatcaaaattctcagacaccaagtttagaaaccaattaaatctagtcagtgttaagatttcaaattgacccaacaagaatttccttttctaaagcaatgctaaatgtattgtcataacaagggaaatataccccatgacagcaccaagtcattattttatttaaaaatcatttacatctagtttcctatattctgagcattttgcaaacgtgcacccaatcttgataacaatgatgtgagataggaactgttactgcccctgttttatttctgtgatacatgtgacattgaggcacagataccccaaggtcccacagcatatgaaaggggtggaccctagatatgaatttaggcaagcttctgtttacaacaattatttctgacagcatcaaaattcatgtacttaaccattatattcaactgccttaatcaaagtgtcaccctttgtactgaaagtgcttacaagtacagagcctcaggacttccagccacaattaaataatcctgaagaagaaaggtgagagctatatgactctgcattaattttttctgtcagatttcccaaagtacttaaaatgcatcgcatctcttataaagctttttcaaggggtgatggatttgatataatccttaaccaaagtaaggagaatataagagctattgtgggcataagtcttagtccacaaactcaaatgaagtagaaatattcttaagtgctccgtagcttaatttagtttctaatgcagagcttccctttgtggccctacactaggtttctgctctatccctagagtcttccacagtgtctggacattgggagggagaagggagatgggccatctgctctagtccctgtctcatacaagttgccaatgagatgactagttctgaatgcctcttcacgtcctcttagctttctgctactttgtgtcacctgtgagaaccaaaaaccttttgcaaggctgcatataatctgtctgcctggatctacctgtttggtgcttctccagtggtggtactcctgcatcagcccccagataataatatctctttcctccccctgctgcctttctctcttcttcttccttttcttctttttcttcttcttctcctcccacttcctcttatccttccccttctcctttcccctcccctctccctcatcctctccctcccccttactcttcccccttccccctccctctccttcccccttccccttttcctttccccccctcccttctccttccctcctccctcttccccttcccccctcctctccatctctctctcctccttcttcttcctcttcctcttcttcctctctctctctctcaatgtttgggaaagaatcctagcattttctccaattatctggtcataactccctgtcaatgccaatgaatatcctttacaaagaacttcagtggttagaatacaaaatcagagactctcagtttatttggggattctgtcctgccacacttttcctttgaagcgacaagcacaaagccaaatatctgctaatattggtgaaaggataaaggagaaatactaaccaaggcatacaatttcctctcaaaatggttgcccttctcttcaagaatgcatgaagaactttttctctaaggccaaactattagacgttaagttgaatgtgttttgtcttaacagatataaggaaagtgctctgaaaagaacagtatttatcttaatattagttgcactgtcaggtcagaaaacaatgctgtttaaaaaaagcactgctctatttatcaagccaaaattaaatggtatacccagtatgcagacctttctctctctaatgccattctcaaataaaaggagccagggctccttggagaaatggctgattctagatgtgcaacagggaatacacaaaataaacctggagcatctggtagtgtcagagaaataagaaagtactaaaacatgtacacaatcacacacacacgtgcatgtgcacacacacacaggaagatgggggtatgtcaaagggacattgcagccaaaagaaagggctctaaataaccaaagctaaaacaatttgagcaagaaaataaatagcatagtattagattataatctgaggtataaagtaaatatctctaagtctattctgatataagtaaatgattgaatacatgaattgatgggggaggatagacatatctcctgtgcagcagtattccaaataattgatgtagatattctgccctcaaggagataaggcatgactattcattcctttagtgtgggcttcccataatgacttctttccaaatagtacagtatggaagtgagggtgaaagagtaattttacagtggagaaacctgaaaaacatcactttagccagataactaaggatatatcaacaggggcaaatcatgttgaaagcatttactcttgatatgatgtgataagaatagcactttacctctgttgtctccctccccaaaacatagtaccctagtctgagcatgaggaaaaccgacaaacacaaatggagggatattctacaaaatatctgaccagtactgttcaaaactgcaaaggtcatcaaaagcaaggaaatctgagaaattatcatagtttagaggagcctggggagataggacaactaaatgtggtatcatggatgagaccctggaacataaaaagaatagtaggtaaaaactaaggaaatctgaataaaatatgccctttaattaataatcatgtatcgatattggttccttagctatgggaaacataccataccaatgtgagatgttaataatagaagaactggttgtgggtatatggcaactctctgtactttcttcaaaaccttttggtaaatgtcaaacagactttattttaagaaatacagtggtacccaaacaatctctggatggaatgaatcatgtcaccgagtttgccctgatctgttgccctgtctgcatccttcagctttcacatggtaatgggatgggaaggattctgtctgtgacaataattgaggcatgggcaaatgtaagaatgaaagctgtaacattttaagtttcttattgaatcatttgttggctccaatcaatatacagttagaaattagaaaagaaaatctagaatcagcatattttcttaaatgattattttgccttttaatttgtatttgtttgtttaaaagcctatagtcgcatacaacttgggagcttatggaaaaattgttaatactgttagtgtattttttttcaactcaggcatataaaagatactattgcacagttattaaaaacaaaagaaaaacaaacaataacaacaaaaaaagcagattgaattcagataaatgtattagacctaattagaaatagcattaaaaaacaaagacaaaacaactaagaaacaaaaagcctaagagaaaactttacacttcttagatggaatcacagctgtccaatgccaagacactaatgcattctgcatcaaacagattgcagaggaaaatacaatcttattttagatgcagttcaggttttgggaccatcccccaccttctgaggtcatttgctttttagttcatgacattacatagacattgctcatacctcattaaatgccaattgagtttaagtgaggtaataaaattcttttttatttttttattttttggaatgtctgtacagcacattgagaggcatttcatttcagagtttaaaatatttagtgagcaggtggctaactgccaactacaacttactacttaacagctctcagtgaaaaaactctgaagaaatcaacatcagcaactcttacagctccttcaggccaaggtttgtaggtttctaagtgtgttaggaaaagcctacggtatgtggcaaggaaatgacatgagtgagacgttaaagagcagatatcaagatctatgccagcatttgacctttcagcttgcacctttgactttttcttgtcaattaatactcttgctggttacagatcattttataacttgagatgcaactctagacttgttttagttccaagatgttgaggtattattattattattattattattattattaccattatcagtttgtttttattattagctttactagaagtgggactttgaggtcctctatttgaatttgctttgaaaaagtggctctagaggtatttttattcttaggatttctttggcatttttctatttgctatttgttgccgtgttaatagaaaagtgtaatatctgaaattgattggcagtgtttgaaattattatctgtaacaaatttctgaaactcagtaacttcaggaaaactactaagaatgacgctttacattcctttgtggaacaactgaaataagatatatattgccaaagaagatcctatatacaacccaaaaatgaattcacagattttgtaaactcttattaggagtaacactgggcgtttacaagagggcatctccattctgaaaaaagcacagcctcagattcctaaatttcatgctatgcactgttccatcttacatggagaaatcatgtcaaaaggaatgggggaaatgatcttaaagcaacatcttaattaaactgtttattagtcattgatttcctggcaggttagagttacttttttttttttttttttcacagtggaacacccaatgaaaagaaactatcttaagaattataataagtaggctaagataggaagaaaaaatattatttccaagtttcagttggcattaaatgactctggtaatacccttgggtcccagatgctacattattttttttaaatcagggaagaatggactacaaaatctctcccaggtctaaaattattttattccataaacacagatattattactctctacaaaattgtcagttaagaatagtctaagagtagttaaatcactgtctgtcattatcaatagaaaaaaaatgtgattcactttaatctatgacagtattaccattctctgcctgctaatacatccattggtcttaattctgtttttcaaatcttttacacagacttttatcaacattggaatttagatgcaaagtgtttcttgtttcagagattagtgagatattattttttaaaattctttttaccaggtttttgtattaaagcaagtcatgactaaatttgcatgcttgtaaaatttattttcactttaagaaatttgtttagatattcattaagagagaaactttgaaatctgtggatcctgagagacttgagtgtttctatagatcatgcatgcataacaggggtaatatttttcctaaggggcaaaaaacgtgtttttggcaggcgagggggaataaaaaaatcatagctattgcaatggtttgtggccttataaagagccttagtgcataaacaaatgtatgtatgactgtggcaaattttatagagattcaaaaaaatgttcaaaaagttttcttagaaagatgataataaaactccaaatcactgaaaaaccaaagcaatttaaatgtattacatagttttaaaccctcaaaaatttatctgggttagaaagcagagtgccaagtctcttcccaaagcaaattaaactggctgagttacaaacctctcaaaaattggatttataatgagtatgcaggcagatctttaactatagagactcctgagaagactgagctactctaacattctttgtgagcctaattgaaactgattgtggttggcaccttataataaactttagtttaaatgattttatcttggttctaaaaacagtttggccccatgtgtttctaaaatgtgcaataaaattcctttataattcaataaagataagagatctacaatgttggatttctactgtgttcaacgtccttttaaaatgcaaacatgaactcagccaaagtgtagaccacaaaagtcatgcctctccatcttcaccctatgtgagtgtgtgtgtatacttgggaatttctttgcttttgctttcttacgggcgaaatccttaagagaacattctttctttaattctgtatttaagcaaaaactaagggagaatatgacttgccatcctcaaaactgattttattttataaatactttcaagaaaattaagacttttctatacttaaaaatcatattctgccattcattattaccaggaaataatattggattctgttgaaaagaatgtgtgtccaatacgtgatcaagtagtttaatatggtagcaatttaccttcatgctatttattttacatgttttgctaataacaatggtgatcaactatactctataagaaatgtggtggctgggcgcggtggctcacgcctgtaatcccagcacttcgggaggccgaggcgggcggatcacgaggtcaggagattgagaccacggtgaaaccctgtctctactaaaaataccaaaaattagccgggcgtggtggtgggcgcctgtagtcccagctactcgggaggctgaggcaggagaatggcgtgaacccaggaggcggagcttgcagtgagccgagatcgtgccactgcactccagcctggacgacagagactgtgtttcaaaaaaaaaaaggaaatgtggtaagcaaatgatgataccaattatactaacaaagctgaaattttaacagcatcattgtaaaatgcttctattataatgaatctatcaagttccgatgatcatatgacttattttgccaacatcactccataagtcatagccatgaaagaataagaggcaaataaaatgtattttgcatctatgtgccatacattttgctaagagataatcacatccaaaaatatggggattgagtcacaaaataggaatttcagataatagagcaaatcactttagaaaaataatgaaaaagtattatagctcatgtttacaaccctgatattaagacttatatcacaattttttatttaaatgaaggtaaaaatatttcaagttttgactttttagtttaaacctagaaaaaagataaacctgttgaatttctgttcatgacttgcaaaaatggcatgcagaagaataaggaaaacaggtaaataagtatgaataaaaagataaactattaatacaaatatggacttcatattctattcacagttaataaaatcatcttttaaatctatgcaaggacagacctagaaaccatatgagaatcttgattttttggaatctccaagaaaataaaaattgtgcaattaactgtattataactaaataatcttataaaacattataaataatatttttatataaattgactaaaatttggtaacaaaatacctttgtaatgatataaccaatcgctatgataagaagaaaaacacaactaagtagttattaaaactgcagataattccacagaattttgctatgaaatctttattacctcaacagcttagcacaggctatagcaattttagatcagaaagtcagcagaactatgtcaggagcaccatactagagtcactggcataagtgtacttgctacatgcctgagtgacatctgtggcttgtttctttgtttttaaaggagatagttggactggatgcaagtttttgaaagctttagaccctggtcaactttgagaaaattataaaagctatggaactgctcctcagagaactctacatgtcctaaaatatttccatttcaggaacattctggatatccttgaagccactgtttagaatcctcaggaccattggttctatgaacttggggttcaacaaccttgaactgagattattttgaagattcatctatgcaatttatgcttctttgtttctacgccaagttcattctaagtaccatggattgcctgaccttatattttgaagcagagatcaaatggaatccttttacttaattatatttatgaaacacaaataggctccagcttactcaaggacaagtaaaccataaatatatataactatgttaaactctataactcttatatgattcaggatcacagattggaaagattgtgtaattatgacaatttaatttctggttttaaacttgaattttcttgatttataaaatagaatgtaaaaccaccaaggcaagatatatgtgagataactgaacacatgcatgcccacattcatatatatgtgtgtataaaagccctccaggacatggtttttcataggcaagagaatatatccataaatacatacttgtaaacatgcatgtatgaataaatgtatgtttataaatacacatgcatgcataaatatatacatgcatgtgtgtatgtcctgttgggggtgcaggacttagcataaatgcctgctattgaagttccctacataaggtagcttctgttgttttcagcaaagtccctgctagcatataaaacacattgtgcataataaaaaaaagagccccttctgagtgaatacaaaatacatcaaaagatatctgtttctcctagctgatacaggccagtaccaggggtcagaactggatttcagctcttactcatgccttgagctggccattaaaaaatagatctgcaaaacagtgagctactgttgctctggttcttgctatttcctacatcggtaatcctcaaaggatgggccaggaccagcagcagcatcacttggaaagttattagaaatgcagttctcaggctccacctgtcttactgaatcagaaacttggacagagcccagtaactgtgtttaagagaccctctaggtgattcaaacagctgctaaagtttaagaaccactgccctacatcacactccactccccattacaccaacaaatgataagtagttaatgaaagcagactctctccttcaccttcctcctcttccttcctactacctatatttctcattcaaaaaaaatttaccatgagctgctaaagagaggtggggatatatatgcattataaataaattataaataaatacatgttaaaatatagttaaaataaaatatgttttattatataaaatataacatgcgtctcagcttaatgttatatattttatttcttctaagttttacagcccctactgactacattagaatagtgatagctgattataatttcatggggacccctcagatgaccttctgaccctatgatttttatctgtgtctttctgagcccttctaataaagctctaccagtgtgcagcaggatccttactgtcaagttactcaaatccccatctatagagtaagtcatttaggtaggactgtaatttcaggttgatcccaaagtttcccttccatggtctggtgtcctgtgaggtgtacaggcaactaggttgatgtcttgaagacatgcaagaggtgtagtgaccaaggtcagggtgatgactgactgaaagccttcgaggtgtgaatttctttcataaagctgagtggaagagatgtgccttcgtcattgattctgaaacccctccatcctcaatgagccgactctaaagattgctgagtttcaatttgcattattgatgttagctcctatccagttttcttccctgtcatcctcatttgttataaagaatataaactaatacgagagtatagcttcaataacacaaaatgaaatagaatgaaacataaggagaatgctgtgttttttctaaaactcttgttggctgaaagaaacgtgacgtctgtctcctcaacaacagaatgttacaacagcaggatttcagaagaacccatttattaaatattttgtatattaaactaggattgtttataacatagaaatataaatgagaagtacacaaagcccttcgatagaaaaattgtgaaaaaaacctcttactcctttatttttaatgtatgaaatgtttctggcactgcttgtttttagtaagcgtttgtgtttcagatttctgtgtattattctgtattttggaatattgataatgggacttaccagttctctctactgttttattctaaaataactttttaaaagccaggcaatacaatgatatgagctacaaatatgtagtttaagtgcagtccattcttaatattgtctaatagtctagaaatatctgatgttttatgttactacaatcagtaagtttctgtttgaaaggatttgggaagctcttctttacagaatgctaaaaaggaaagcttattcctggcttcatcaccattcctgttgcctttcatatcccacccctcatgctgcttgttaattccacagagaacccattagggtgcctcactgtgcgcggccttcaggttcaacctctgctctgcccgttccctgaatctaccatcttcttatcctagccttcatgcatcttcagttttgattatgattctttaatttaagacagtggtttaaatgcatcagttttatcaaggtgataagtctttggtacgttaagtgtaaacagttggctcgagactgggttaaaagattcaccaggcacctccaagtagatttcaagcaaggtgtctcaccctaacctgggaagttaaggatgttaaattatttgataaattaagtcattagtacatcctggaaaaacttaatgtccattttcattaataatcagtatttttggtcagtgttcccagagttgtctaaatttctttatatatctagatgctgtgctttcaatgattctgttcactcagagtctctactcaaagagctgataatcttctcatttaccaaagttcctttaatgtatgaaaaaacatattgccaaacaaaaagatgagactccaattattattgaaatagcttttatctgattatagacacttagccatttggtccagtaaaagtcgctttatagaaaatttctgaactgttcaaatattaccattcctaaaatttcaacagcttaacttaggaagaactttaatatattaaccttcccaaatgacatgccattttaaaaagggattttaaatgaatgcctgagatgagaattgaagaccatgtggcaagtccataaggaatacgcatttgaatagttggactgcccattttccggcactcacagctgtaattgttagtaactttttataaaaaagtaatgtccatttttatcaaagggaaacactcacatccttgcctatcggtgatcattctctttttacctttatatttcttatttcctgtttagaagcaaatgaaggattatggagttttgcaatattaggactaggtgacagctcagaaaatatctgttccaagtgtattaagtcccaggggtgtattgcccatggtcagagaggaaattaagactgctgacatagcaccatatcttctccataggtccatttctctctcctttatactttgacaccttttaagttttattgaataaacatgaaaagccaagtgactttgtttttctaactttgaagagttattcagagtgatgtttgtttacgttcttggtgttaatgacaatgtcggataatactactctagaaattccctaagtaactttaccaccatatatagtgcattgtgcatcacttcagttgagagaaaagtatgactaatgcagcatgcatcaaaattaattctgtcaggaactactgtgtatgagtcacagaagccacaatactgtatttagaataataataagacaaggaataatggcatcctaaaatttaatgaggtagtttagtttaaatgtacactgttagtttgtgtcaacctactgcccattgcaagcagcacatttttttaacaaccttgtgcaatggggctgtaaattactataattaaattaagccataaccgtatccaggcaatatgaggtatttgtactttgtttctgtaatcatattatctgctcagaacagaaattacaatgaaaaaaagaaaacaaacattatcatccatgtcatttgtaatttttcaagaagaaagcaaagctatgtttgagattatccacccattttccaggtacatctatcacaaatcccttgccttatcatttaacttatcatttaacacatctttaactggttcttaaacttgtaagcaaagcacaatggtggagggaaggtttcttcaaataagcatatctatatgccatttgatttgcttccaatctcatgttgagatgatgagcagatggagagagattaatagtttgatttcttgggatggtagagattttgatagagaaaaccatgaatcctgcaagcaatataataaagctatcatcttcttgttattactgtcatagcttctctaaaatttgtgttgtgctgagactgttttatgtggattattttattgagtatgtgatggtttccccagggcattatcatggaaattagaaggaggtgctttttgaataaaatgggaagaggtattagtcatttgatcctttctattccttctatcttttgtaacatctgataacacatctgatatagtttaataaatattggtttcagccctgacttcccactagacaataaattcttgaaagttagagctacagtgtattccaagaaagtactaattgtctagaataatacaaggtaaaatataatcggagcttgataaatatttgtttaaagaatacaaaattaatgtaagagatgagatgtgttttgttcagacatattatgctttacaaactctaaactgtattttctcactttcaatccccctgtttacctctttgtgtgagctaaaggataaatggttggaaatgagaagtcatgaaacttgccatgtcatttgtagcttcaacaactattttcactgttaagaaaatatgaacctcaaatgtttatcaccttcaagatctggtttcctaattcatcactgttgccttccttgtctaattcacttatagctcatgttctttgacttacatggtagttacatcacaataactcatcataagttgaaaatgtatttaatatacctaacctatcaaacatcagagcttagcccagcctaccttaaatgtgctcaaaacacttatatcagcctacagttgggcaaaatcatctaacagaaacctattttataatgcagtgttgaatatctcatataatttattaaagacaattctgaaagtgaaaaacagcatggttgtatgggtactcaaagtacagtttctattgaatgcatattgcttttgcaccatcatgaagttgaaaaattataaattgaaccatagtaagttggagtccacttgtattgaaaatctggatgctggtgtcaccaaacatattcataatatattcactaaattttttaacatggtatataattgtgattactctaatttgtcccctatcctctttctccataagaaatagtaagtagggtccagttcatgacctgatcgtcattgcatttccctctttggtcatatgtagggctataattatacaagaactgaaatggacaatatcaatagcaagtgcacaggcatttctagaaagataattgaatgtttggtatggaattgtgaggggacttttatcagttaatattaatatatactgctcttacagccaagttacatttgctttgttagttgatcctgcctaaaccttgaccttattcagtagaacttcagatgcatagagttagttgtaaagagttgcagccagagtgttcatgaatcagccaagttccttgaaacattcaggaaagaaaaaaaaactaagccaattccctgtagggtatgttatcaccaccaattacagaatgtcaggatgtcatcaccaccaattagagaatgacaccaagtaaacactttctagatggaattacatgaatgtggcaaagggttgtggaatttccctcaaaggaaacagaccgtatagaatcatagaggttttttttttttttttttaagaattcttgttcatggttcactgtttccttgatatcacattaatagctaatggcttaaaatgtgaaaaatgcatttaaatacaaatacccaagtatttagtagaggagttatgttgctttgtacattattctttaatgtggtaaaatagcaaatagcaataccattaatttcagtcatgtgagctaaaatgaaccatgatatactatttatttttcttatcactgaatatatcaggcaggagtctacttagtttgaaaatctcatttagaatatcttctactttataatccctgagcatagaaattgatagtatttagtaaaagagaacacagtgtaatacaattagaaaataaatatttttatgtttatcttcctgtaaatgagagcagagggctagagtgcattttatctaatcactgtattattcaaaattgatgatgttttcaaagtcctgaagattttatcaaacatttagctgaactctaggcagaataatattttctagaaacaactcatttattttagaagcaacattattttctgttgttttcattagacacataccaagtatcagtacataattttctatatttataaatttctggttgcaagatttagataaatatttcttcagattaatatctttagagaaaatagatatcatttttaagagaattacacacctgcattctatatgccaagcacttgctaagtgctagcacatgtgccatctattcattgttttaaataacatttaaagagttaccattgtgcccattttgcagatgacatcagagtcacatgctagtgaatggtaaggaagggattagaacctgttagtatgactccgagagcttgagctctgctctactgtgctctctttaatctctaagttctttgttttgtccttggatctgctaccagtttattcactgaagagtaatttacctttgtgaatttcaattctctgattattaatatggatattttaattttgatcacttcagaaaataaatgtcattgaatgttgttgaggtagctatgagaaaggtactaccatgtaccttatttggaataaaaatgaacgcaacatttttaaagagcaatttggaaatatgaatcaaggctcttaaaagtatgtatgcccttttttagcttggcctcccacagctagttatgtgtcctgaaggtatagtcagaggtgtgaataatgatttatgtctagattatagctatctttgaagagaatgttcagcaaaatcaataaatctaaaatttgcaaattgctaggtaagttgatacgatgtggcggaaaatgttctcaattccaaaacatgcaggtagtaaagtctgtagttgaattagtgacagcctatgaaattcaaagtgttgaatattttaattggttgtatccagtaaactaaaaagttactttaagaaacagaaacaagagtagtatctgcatagggatatgcccacctttgtgtgagaaagtcctctagaatttaagcttacaacagaaatgcgttactcagtagtagcaaagagtcacagtggctgaaaccattgaagccaatgacaatggtgaatttaaaaagaatgagattcaaatcagtaaaattgtaagagaataaaggtaaaagaagacctattggctattattgtaatagctaatcttttacttgcatttatagctcacagaatattttattatattttcttcatcttcactaacctttctaaaaaatgatatttatttttctctaaagatattcgtttgaagaaatttttttctgaatatggcaaccagaaatttctaaatatagaaaattttgtgttgatacttggcatatgcctattgaaaacaacagaaaataatgttgcttctaaaatgaatgagttttttctagaaaacatcttcctgcctagagttcagtcaaatttcctacagttcagttaaatgttcctacggttcagttaaatgttagataaaatcttcaggatttagaaaatatcagctttgaataaaatggagtgaattatggcacctaataaaatagttgttacagtgattaaaatagtgtctcttagataatggttttattagcaccattaggactaaagtcagatttctcaggactagatagataatttataactgataaataatatgtttgttcagatatcttggtattatgctttggtatcttagattttaaatgaatgtattattataatgccattgattcttacaatagattttccttacaaactatgatatacttaatgtaaaataaccttatttaacaaatgctagattgaaataatttaagaaataatatttttaacatatatgcataaaatgtaacttgaaacttcgaagattaactcagataaaaacaaacatactgaaaattttgccactagtgaacttctgaaattctgtctctctggtttttttggaaacagcacaccatggtagtcaagaggtatattctggagtcaggcagaactgggtctgtgcactagttagatgagttcaggcaatacactagccactgtaagcctgtgtcttcatcaataaaatggaataagttatggcacctattaatacagttgttatagtgattagattagaaaataaatgtaaagggcttagcaccataattagcacacagtgagcactctcattaaatattagatattatttttattattaatatttgaagaattaaatctacacattatgatattacattggggctttattaaggcatcatgagctatatcagaaatacttgaaaacatatttagcctagatataatatcaggccttcagatgagttcaatgtcagtgaaattgacaactttagcctgtagaaatgtcatagagttatttctgctttgtaaaaaggacaatcataagaaatacactttgagcattatctcagttgggaaatactcctatgaattcagggtaatataaattgaaaatagattttatcatgaacatccaaaccatattagacgagctagcatataattgactgataatgaacaaatgaacaggaagtgtgtcctctgggtttagcctgctaacattacatgaactaatttctatagttaagaggtaattgtcagttgaaactatcttttctttgtacttcttgggaattatttgatcattacatacaggagccattattttatatctctacatctctccactgtatactgtcttctatgctagaatgttatctttctgcacaccaacccccccctccaaaaaaaaaaaaaaaaaaaaaaacagtcaacatcaccaattctgtgcactctcctggacaaaccttaccactgacactggccactcatcttccccattcccaaaacccacaactcatgactggttgacacgaccccttacttcaaaagaaaccaactcaagagcatcctccaaaatcaagctgaaacttattttcagagggagacttcatctttacttagcttccccatttctataatttttctcattgcctttcccctgagagcactttctcaggaaattattttctcaagaatttctgtctcagactctgctttcaaggactccaaccataacaaccttcctgattctccaaaccagttcttagacagcaaactccatcttgatatatctgttccgctacctctattgtaatgcaaaatgaatcgtattgcatggcttaggtgtctttcttccctacaaggctaatcttcttgagaaagggatgttgttttattgtctgtggattatgaaagtctttcacatagtgcctgacacatatcagatgctaaataaatgctgttgaacgaataattcaaaatatgctgctctgtattagcaccaagagtgagttttttaaaaatattctaatccaaatgcacaagaatattcacaaaaaagccctttaaagataagcggcagtatttcaaatataaggagattctagttttccaaaacatcttacactgcatcttaaaatcagaataattggcttttatcaaacctgtgtcattttaataagggctctcatgaacttaatatgattcttaatagaacactgcatgtgtaattagataaactgtaacagctaaagctttgtaaatatatttaaaatcataacagataaatgataacaaagtgaattgtgaattccactgaggtcaaaatacaatgaagagaccaagtaaatttaattttaaattgaactcctttagtattttctaaacaatgcaaacagtgttagtacctaaaagtcatttgattgccacctcagtgtctttgtttaagtcgatgcctatttatttttattagtggtgctttgattgaaaaattcctaattttgcaatccatatttaaacttcagaaaaaacgaaagcaagcattagtggtgataaaacaagaaagtaaggaactcatcatgtgaatacttttctgaggccattttgttctcactaatattgtgaaaaatactatacttaggattttaaattttctctataattgcaatagaattaatattctacagtcattggttaattctatgctttatgataatgttataataaatgcctattaactataattgactagaaaggagcaggcaaccagcatgtctaatgactaatttgggtattctgagcaagtacttatgcactttcagtaattctgtatccacatgacatttttggaaggaaatcaagtacattgactgtcaccttagggtaggggtttatttcctcttttgtttccatcttaattatgcagctttgatttctgcagttcttaaagacattttcaaatttaaaaaattttcttaagagtaattgaatgtgagatttttgcttctatatatttctaagctttttctaatcacagtgaggtgtgaaagggctttttgtttgtttgctttgttgttgttgttgttgttgttatgttttcccttgaccatcccaggcctaagggcagtgcctctcacagtctactatgcgtatgaatcacctaggatcttgttaaaatgcaaactctcactgagcaaatagggagtatggcctgagatcatgtaattctaagtagctccagcgtgatgccaagcagttggtctactgaccacactttgaggagcaaggtctgagctctgagctgcatatcctttgtagtcccagacttagtctttacactaagacattatactaattttcttcaaccaaagaaaattccaaaggattctaagagatgacatttcagagtaattgtcacattctacccagcttggaccttcaaacctgactgtcagcttcagcattccaggatccatctctgattcttttggctttccaccaggggtagagccaacccatagatgacttcagcagtgacattctagcacattagcactcagcagtggccttttgagatgttggtgaaattttctgcctaccaagaaagtggagttggcacgatgtacataaacttcatgatgacaagaaggcaggatagttagtggcagtttgacaagtctctctgcatgaaaacaaattaagatgccgtgacagctctgaaaaaaactgttctttttggcatttccttttttccaatgttctctgagcatgctatctcaatttattataaagctacacatacagcccaggaatttctttagcagccaagtcacacctcagagttctgtcagttgtgaataaccctcaagaatttttactccctcgtcaaatgtgcttgtgtagtattccagccatcagtcctttcatttcaataaaacttttacattcccaagtgctttcacatctttgatcttatttcatcttgccttccgactgagtaaaatagtatggataacctttttttaaattcattgacacaataaacattaattaaattcctgctacaggcaaggctatatgtatggtaggtaccaaggaagatataaagattaataagtcatggcactgccctcagagatcctgagcagagagttaaaatcatgtgcataaattgcaaggtagagaggcataagtgcttcagtgtgctgtagatcacatgggagaatttatcaaaacatgtgatgagttctagcccagagcagtgtgtgagaggcatagaaggcaccacagtatgataacttcataggtggcctttaataatgagtggaattttgaggtgaggtgtgggctgaagctatagcaacacatcacggagttcagaaacaagagatactgcttgaggaatacatagcatatcatctttgtgttgtgcatattgttatttttgtatttaaaatatgaagaaagtaggttgatgttgaaatatggaaagattatattgaaaagatagggtttagacttccattgacgcccctaaacatcctcttttacagattaacagtatgaggtatggaaatgagatgacagatcaagggtcagaaatctcataagtggcaatattgttgctaaaacctagtatctggacctgcggttctactctgaaggacagtgatattctgtatcctaatgccaccatctcactgcggccagaagcccactaaccactccggggtgcccagagggagggagaaaggttcacttcctaccccagggacaagaaggttgaaggcaacaagttacttgctttgatctgaaaacatataaaagatagaatttaatgctcatttagctttgctttaggaatttttgtactaaaatacctggatttttatgtgactttttttgatgcatttttacttttgtaaacattttatctatattcatgcttcatgtgcatgctttttacaagatgtatgacttgccactaaaaaataaaaatgtgtaaattgcattcggctagccatcatatttaatttttttcttaaactgtgttattacctcctaggcactttctgcagcacagttgttcaagatagataatacatcgctagggcttttcacagcgaagaaggggattttaatgaaaatgccacttttaataagaagcctcaataatatgtggtcttggttgttccagctgagatattaatgtctggcacttttttttccctataaatcagtaacaaaaagatggaaggaatttggtttgaaacacaatgctaaagaagttggaaaaataattatctttagaaaggacatatagcctatataaagtaaaattctcaatatttactacattatacactatttcttttatttttcatttctcattgctacaaagcctcaaagcttacataaaaaaaaactaggagttgtcaggcagattttaattaatgtatttctactttttcaaatttcacagttttagatttgtttctagagtaaggggtaaaaaaaaaaaaaaaaaaaaagacaaaaagatttaaagtgattcaaaatctccagaaaaagattcaaaattcttcaaagtgtttcattctgtaggggctttgatttcacactaagggaaacctgaccatgtctaaaatgtaaacataaaaaattattaaaatgcatatttctatatccttctctccccattcctaccaaatgcccaaatcaaccatttgggaagaatatatatagttgagaagaacagggtgagtaatacaccttctcattttttaagcccaaaagacgaagaaaatcgagaaagtttgaaatctgggaaagttatccaagagttacttattcattcctgcactcttgaatacgaactgtgagtcaggtgatgtgtagcagggagacccaggtggaaagattggcagggggcactcatgatgtgctttgtagccgagcaagcagatcggattttattttcagtctagagccctcagcgtacagaaatatccttgattatttgtaaaggaaagggcctggaaggaaaggacagggtggatgtaagcacagagatagcacaagcaactactgaagttagcaaaattgaggtgcagaactcggtgagggcttagctaactgttagcatacagaaacgttgtgaggttaaaggaaaggggctatgtctattttatttaatgtggccctgtctccattaaagcacatggagataattatatcagctagattatgacagaacccacagaaatacatcatacactgtgaaacagagcataattttcttagtgctgtgataatgcaaaacaataatttatcatgataaaaatcaaagaaaatgtgtcttcttggtgaaagatttttctattatgtctgagattatcttatccattcttattttcttttttcactgtatgtcattgcaagagggtcttgtattttacatcagtgggtagtattttgaatatatttggtaattaataaacattttaaagtcatttcgttgtccactaaagttctgctaaaacatattattcttaaaagggcactggacaaacggtagtaaaacaatatttatatctcttttttgtagttgttgttttgttttgttttgttttttgtagagatggggttttgctgtgttgcccaggctggtctcaaactcctgagctcaagtgatctgccggccgtggcctcccaaagtgctggtattacaggtgttagccaccttatccggccaatgtacttatcttttccgtaaactacctgtcagttgttaatccaatctcttcatgtaaaaagggattggattagatgattgctacaagttaatttaggtgtaatatttttctaatcctaatcacaaataaattcactatatttccaaactctttttgaattttttattttatatgtttacagttagacatatgccctgatacttatagacaggccctactggaaaatgttggtcctacagcctgtgcacagttataacagaaaaataaacaaaacccaagtttaaagagctccatatcttaaatagtcattctgggcttaagaaaagttaaatattgacctattattaagttaccaattcattaaaattctttttttctgataattattccagctatatgattgctcttgtttttctggatgaaataaagaccatattatctttggggcaactcagaaacataggtcagctcacacctattagagccaatagttgtatggtaggtgaagggtagaaccactcaactaaagcccaaagaaaatctttatgcattttcacaagactttgagatcccacaagataaaagagattagaaaaaatgggaggatccttggtctcagatttaagagtctctgtgatcatatccaaagctctgtgaggatttatatggcatcacttatatggaaggaagaaaggctgtctgagccaggaattcccaatactgcaatttattttaaaaatactctgctttcaagtttgggggcattaatgatacttcatattctgcctacttggagttggacaggaaaaaagtatgcaaatagaaatcagaggctgagtgtctttatgaatgtatctggatgagcttttcctccaaactatctttctgaaagtagtagtatacattatgcggaaaatagtccatgtgcaataaatattaccaatctattgctattactatgtttcactttttaaagggtgatggagatttgtgatgaaaccaaatatactgtagcctatctccctcctcattattggcatattaaagattctgaaaaaactatttaaatttgttcaactaaatattttccaaatgtaaacagaacttattttcatgaaatgagttaggagccaagttttggaaatatcagtctagcaatagcctgtgagtaaagccatttcagctaactgttaatgtactgacttccaaatgtgtgtccacattgcactaagaacagcagggtatacaaaaaaatgagatgacaaccctttttttttaatctaaaatgggaagatatggccaggtgcggtggctcgttactgtaatcccagcactttgggaggctgaggctggtggatcacttgaatccaggagtttgagactagcctggccaacatggtgaaaccccatctccactaacaaaaaagtacaaaaattagctgggcgcaattgctcatggctgtggtctcagctactctggatactgaggcaggagaattgcttgaacctgggaggcagagtttgatgtgagctgagatcacgccactgcactccagcctgcgtgacagagcaagactctgtctcaatcaatcaatcaaataaataaataaataaataataaaataaataaaataaaatgggaagatagggctaatgcacaaaaaataaagacaacaatgtatagtcacgtgctggattgtttgatactgaatgcaatagttagtgagacatggagaaaagggtttttagatcagtcagaggatttgacaaaaatggaagcagaaaaataaaaaagtttagactagaagtcagtcataagagctcatgaaaacagaggccttgtagaagaggttgaatttgagtatgcctaaaagactaggagacttaccacatgcaaagataagatgtagaaaagatgctaaataacagaagaaaacttctttaacaagcagtgcggagccattgtacaataaaaagcagagcggtgaggtaataaaagcaatgctttaggcagataactttggaaagagtatgaccattgggttgaatgtaggagtcatgggagtcagagaggatcattttgcctttgcaaatgttctggcccacagagaaccactgcacctctacagtgtttctggacacagataactgatcacactccacttccatgacttactgtgggaacttgagcaaattcttgaattttctctgacagttttttcattcaataaatgaggacaggaatgttatctatgtcatgaagtcattgcaagtcttaaataaagtgcatgaagccatgttagaacagtgcctgccacataattagtgtgcagcaaataagttagctcaaattagccgtaatggaagggaaagaaagaaaaaaaacaaaacaaaaacatttcgcggtgttaatggattttgtaacctactgtagcgtggaaggtagttcggtccactatccctcagcccctaactgttccaatgttgccatcttcccagccctttcattcagttttctacactgcagttagagttatctttttaagatgcaaatcagatgactccactgcccacttaaaccttttccatggctctctatagccctcaagtttatgtccaacttccttgatacattatagagccctgacccaccttcgcctctctagcattttgtctcatcgctccctttcccacagtctgaactcctaaaaatgcattagtttcccacctctgggacagcttccttatggtaatattctccttcccttctttgtctagtgtgcatattaacatagaacacataatacaaatttagaggtatggaaacattttcacaatgtatgaagattgtgaaaaccccatttccaattaaaacaaattacaaaaaatagctgggcatgatagctggtgcctgtagtcccagctacggaaggctgaaacaggaaaatcacttgaacccaggaggcggagtttggagtgagccgagatagcaccactgcactctagcccgggtgacagagcaagactgtctcaaataaataaatacaatacaatataatataatgggaagatagggataatgcacaaaaaataaagataacaatgtatagtcacatactgaatttcaagaggtaacttgaaagagatagtagcatgccaggagaggagtttttctttcagacttgggttatcttggttacactgaaaattaaacatgcaatcattccatgttatctcaaatgtgtatgtgcattttctcttaagttactttaaaaaataagtaatgtattcaaagaacaaaaggatgtacagtgaaaagtcttcctgccacttcttgagtgtcctgcaaccactcacgatcaatttcttgtgaattcttccacacatactttgtgtattttaagggaaatatatgtatatgcaaatctcccatgtgcaaaaatgtataatgtgttatgtaatcaaatttcccagtgttttctgagtaatggtttgtgtgtagactttatttactccaagattatagaaaagaattcatgatatcagctggtatatttacgagttattttttacatttaaatttttgatactggagtcagatgtgagataatgatcttccctcatttttttcagaagtctttttctatttctttattaatccattattttgctcttcatttgaaatgttcccagaatcacagactttaggcttgtgtgtactggggctacttatggactttatgtgctttcacagcaatctgtctattcatgtgtgtcatcactctttctatgatttgtgcatcatatctgctgaggatagtggtttcttgttatttacctgttccagaattgttctggcaattcttgtttcttgatttttctatataaattttagaatcatcttgcctgaattagaaaaaaatcacatggcatcatttaaatggcattgcatttactgattaattttgagactttcaatacctttatgatgtttaatctttgtatccaagaaaatagtacatctttcttgtttttttagtcttcactttacgttttctacacataaatgctgcacaagatagttggtattgttactaattttaatgaggcatttaataaattataacttttaactaatatttgtacattatattgaattttaactccgccccaaaaagcaaaagtaaaggaaagtctaaaagaaaaactagaggaatctaattcaagactactacttttaggaatataacttggaaaaagctcttccaggtacattcatagagacatctctgttacagtttctgtttggcacactctttttttcataatgtaaataggagtgttaaggttacttgtgctgatgtgaaatatagcccgaaagtagcttaaaatattttctacttacacaatattgagtcatgcaagacctttcacaaaacaaagactgggatggtgaagcagtctatataggttaaatattgaattagataggaaggggttcattaatttctaaatatttccttttagagttttatgccaattagaagttctgtttctctcttcaaagaatagttcttcaataggcagatatttaccaaacacctacaacctaccagtcactctctgaggtgctgaaggcacaaaaataaaactgactcagttattgccaatgagcattttgcattctaagaacaatagtctaagccttggaaattgttttaaaagatttctgtgtgctttttcaacatcaaagcagaacattgtggctcaaggaaatttgacactctaattgggaaggtaattttgtttgatttactatttactactgataagggcacagactatataaattacatattaatgtgagaagattgataatagcaagtgatattcatccggcagaaatgtaaatggtttctaataaaatcatagaaattgtagtgttattcttctgtagaacattagcctagtctgtatttaactgaataaacttatcccaccattctttacattccacttaggtgtatatatgtatacacatatatgaattcaaatatgtgtgtatatgtctattcacatgtacaccaacaatatacaccagtatagcagtcactaccagtttctcctaccctcttttgagccagctttaccattactgtgattccttcattaataaactaaataaatctttgctgtgttctcactatatttttgcataggagtgatgtttttaaccttattaaaattaaactttaacaacatctataaagtttcctttgttcttcttttccacacttgggctaatttccaatgccattgtgagacagtgatggccctttatttgaagaaacttgactttagctttgcattaaagtgattacaaaatactttaaaattctcttacttctttttgaatacaaatagatagtagaagaataactcatcaacagcatactcacattttattgtttctcaacactgaattctaaattctaaaacaagaccattttaaattattttgagcacaagctagtcatttttcaagtaatcaacaatgcctcatcggattagaatagaaaacattgaattgaagtaaattgaattgaaagtatcagcaggcattgaacacagcaagagtaagcaaatatttctacagtatgtatgtattagatcttttatactgggtttacactcagaaaagtttgaaagccggtggtttaaatattttttgctcagattttagaagatgagtcattgtggacatgtgagtttattctagaaagtatgaactaaatggtcatccatagtttaacattagaatactctgggaaaccagatatttgtagtagcagcagaggcaactgtacttctctctacattcttgtgtattcttcgtgcagacacatttcactacaggatgagactgttgctgaaggactgctttccaactcagttatgatgtgttgatcacagaaatgaaaagaaaggctttataaatccatccctaaaccctatcattacatatcagaatcaaattcatacaagataacatttagatctaaagcgaaaacaaaacctaggccaaagggttctgaaataagcattagagaaataaaaactaaaataaatccaatctcaggtgtgagatggaacaaatgcttttgcttatctatgttttatattcagtgagtgtagtgcagaatactctcctttatatcactttcttaacatatgcttgaggttcaagtgggcatttggccctcttcaatctcgagagctctgtgtagctcctctaacaaattcactgtatttaaatgaagctatgttataaagccgactaggaaaaagacatctaaatgcgttttaactccagaacctcttccatcaaatttccattcgtaactgtggcaccaaattttagtattgcagagaaagaagaagcttttgctgaaataattccatgctgagacagctctttaattgggaacttctgctaagctagaaaatatgttcgaaggtcagtacaaggttccagctggtaaatgatctgcatttttctaagtgactgatttttttaatcacaatactgcatctatctgatactattaaatacaaaaagaaggggcataagtttgggtcctcttttcatccagaacgcaattttattctattgtcactctctagattagtgactcaggatccagagagaagtattgtggatgcatgtgggtagagtgtcctttaattgagtgcctgcccccaacaggcaacaccacacctctaatgacagacttagtgagccactattaagattgtttcccgggccgggggcggtggctcaagcctgtaatcccagcactttgggaggccgaggcaggcagatcacgaggtcaagagaccgagaccatcctggctaacacggtgaaaccccgtctctactaaaaatacaaaaaataaaaaaaattactgggcatggtggcaggcgcctgtagtcccagctactcgggatgctgaggcaggagaatggcgtgaacccgggaggaggagcttgcagtgcgccgagatcacgccactgcactccagcctcggggacagagcaagactccgtctaaaaaaaaaagaaaaaaaaagattgtttccttcaggtgtatttaggtataaaacggaacctttcatttctctgatatggaaggtgttgaattcaaaagttattctggcctttttatattgccctatatctgaactacatccttgtcaagttcaaacttgaaagtggtcaaaagtagtgttctatgaagcattgctgttcagagtgcagagcaataagggctgatcaagagcaccttaaaacgcagtctctgcccaggagtgagaatggattgggctcatccccgaacggtcagtgagttgaagagctattaaatttgccagaatggccccaattgaggttttcataccttcctcctctcccagacagtagaatttaactcagtgatggcggccaggtttaagagtgtttttaggacaattgcaagtggaaactttcccagggcaaagaaataatgagcactaaagcccaagagacattgttttagtagaactattttctctgtaaactactggtatcagattttcacttaggaagaaaaaaaaaagagggagaaggttaagaaataaatgtacctacactagctagttagacttcttatgaacatggctaaagacataacttgagcctttgcaaggtgtctttggcagagatctaaaatgcattgctgatccccaccctcccctctagggaaatcgcttaggcattgtctgtgtagatatcacctggaagctagtcaaaaatgcagaatctcaggccctgtggcaagcctcctgaatcagaatctgcaatcctgacagaagctccaagtgactcatgggaacattaaagtctaagaagctctagttttagtgacatccctctcctattagaatacttgctcaagttaagagttccaaatttataataacaaagaagaaaggataagcatttttaaagttttttgcacagattaccaaatttcactttgggaaggttttactgacttttatttgtaccagcaaagtacgcgagggtttgtttcactgcacccttgaaaatgtggggcatattattctttgagttgtgaaatttgcatttgtagtctatgtgatgtgtgagataaagatctaggcttcctaacaaggaagcagttttctcagaacaagtaaatgactaaagcttcgtttctatattgaattgaaatgctaccttatcctatatttctattacagagctttagaacttcatatttttcccatcagtatgggaaaatttttattcttacatcaggaccatgatattttaattatggtggttttttgcttggtttaaatatatgcttttggtagtcagcgtatccatctttaattgcatctaaacatttctctctatcacaactatgatataaatccctgcagcattttgtgtatgttttcataatatagatgtacaggaggggcagctttacacatgactttttaatagacatgtaataataaaagaggacacttaatcctaatactcaaaatactacatttttctgccattctgttatgtgctgatttatctttacaatatttatgatatgaggttcagtgggacagcaagaactgttgagtccctgcattcagcatggtaccaaacccggggacataatagaaagacattagaaatgagaaaaagtaaagaaatagaattcaagggctccactcttaaagactacaatataagtgataatttatgtttaggaaacagactcaagaatttaagtttagaacacatactaacaaacaggtaaaaacacccaattaggccaggcacaatagcttacgcctgtaatccctacattttggcaggccaaggcagaaggatcacttgagtccaggagtttgagaccagcctgggcaatatggtgagaccccatctgtaccaaaagaaaaaaaaaaaaaaagctgggcacgatggcacacacctgtagtcctagctactagagaggctaaggtgggaagatcacttgagcttgggaggttaaggctgtagtgagcagtgatcatgccactgcactctagcctgagtgacagagtaagatccggcctcaaaaaaataaaaaccaaaaaacaaaaaacaaaaaacccactcaattagtcagagaaaatgaaatgagcttgtattagtcttttttttttcttttcttttcttttttgagatggagtctcgctctgtcacccaggctggagtgcagtggcttgatctcggctcgctgcaagctccgcctcccgggttcacgccattctcctgcctcagcctccctagtagctgggactacaggcgccaccatgcccggctaatttttttttgtatttttagtagagatggggtttcaccgtgttagccagaatggtctcgatctcttgacctcgtgatctgcccgcctcggcctcccaaagtgctgggattacaggtatgagccaccacgcctggccatgagcttgtattagtctttaggctgctgtaacaaagtaccacaagcttaaacaaccaaaaattattattatgcagttctggaggctagcagtgaaatcaaggtgttggaagagccgtattcctgctcctggcttctggttgttgcagacaatcttcgattttggtttgcagctgtaaaggaagctctgccttcatcatcacatgaccatcttctctctgtgcatctatctcatcatatagcattcttctctctgtgtgctttctccttgttttaaaaggacaccagtcatattggattaagggtccgtcctgttccagtatgacctcattttaattaattacaactgaaattatcctacctataaataaggttacattatgatgccctgcggcttaggacttcgatatatctttttaggaaacacaactcaattcataacagttatctttaagtcaaggggtgagtaaataacactgtagaagtagtgtgggatggaattccaatcgctgccttcccaacaagtaataagtgcacattcagtttagaggaagttatctttcactgggcaatcagctttgagacaattttatctgatgattaagattcaagagactatgccattatcaataggacttagaaagggtggatgaaggaaagaattcataattaactctgcaaagtttatgatcctagagaaccgaaagaagacaatgccagctacatgaatgagtagtacactttacccatgactttgctgcatatatactcggttttgttcttctatcagtattagtaatagactgccttattataggtcatcgttgggctaatgtaaattatttttcctgcagtttatcttgctagttagacgtctttatttcgttctaccacaacacttgcatctgtgaacaaaaagtgtttggtgagctcatgacttgtctgaccatctgccactcactcaggaaattgctgcatttatgcaaatacccacccagtaatttgtgagcaagaagccaaggtgtttgattaaagtaattaattttctcacgtcatccttaaaatgagcaagatgcagaaccaggtggtttggctagtaccttctaagttgaccctcacttttcttggtttgtttatctcatgcgattgaacacaattctaagaggcagcatattacaaaggctgtatatcataataaaatggtctttgagaagatatggccatataaatatagacattagttttatgcttatttcaaaatgaagacccaaataaatggaggtttggaatttgaaaatgttcctttcagtcagaagaaatattatctaactgcttacatatacacaaagggatgttattctaaatctattcaaaccaagagcctctttaacacatgaacaattcatttaatttctgttatttttcccactgttccctgactgggaacaatgtcctcacaggaataattaccatgatttttgaaatttaataaaatccttagtgctttgggaaaaaaaaaagataatatttatttttacatcgaatgttggatttcatagaaccttagagaccaagtctaaacactcttatttttaaaaattatggaaccttgttcctttaatttacttaaaaataaattttcattttttctttaagagaatttgaatgggatcttattttccatgctttaaaaattaatttgagaagatatttgactttttttctttaaacaaaacctttaatgctatgttagaatctgctgtatgacattttgactttcatatatgttcgatcaagaggggtccagtgtaatgcttaaatgcgtgctttctcataaatgttagtaagttacttaattttccccaaatgttggaatctgcatgccatctttataaagttaagagattcatgctgttctttatgcatttgatatttacagttgaaaggcctgtatcataagcaatctggttcacagttaggcgtttaacttgacattttataaagcatggacatttgagtcctcaatcctttcagcttgttttgagctaagtgtgaattaaatggtgggtgtagaggctgtgcatgatgttttaattaataacccttcttgttacaattatttttatctggctactcagaaaatgcattttattaaacaacaattctatttttactcacatgtagaaaatatatcaggtaataacttcccacaaaatatcaagggagaattctaacttcattttttctaacattacctacctatcagtaaacctatatatgtgtttttaaaatatacatttttatttggtgataaaacaatacattcatctcaatatacacatagtgtgttattggaagacctggaagcaaattgctgcatatattctgataactatgtgctacccaggacagaattgacattactagtttcaaatgagtcacaaccagcagtaatatgattgaaaaaaacagagaccaattatatatcctgagtccttggcaagaaaaatgtagttgacttataggttatttccagagattggttttaatctgcaaatttatatctattacatatcttgagcattttagttcagagattataaatgcagctttagatcaaatagagagaaaaacaggctaaagccattttttaaaaaatatgtaagcctgataaaaacatgatgaattctaccctagaggagttctgagagctgattgtgccctgggttcaggatgtttttcttcaaataggagaagaaatcataggtcactttgttccttcttccatggactgcccacacatgagagcacaaggcaattaaaaatagaaaaaattattccctttatcgagtttgtcttcagtttactgtgcttgtcatttctatacatttgtaactcttccttcagtcaaccttgccttcagattttctctacctgccattttcctacaacctgtcctgagaaaatatctgacgaaagtaatgtaaactaatacttaaatgcttaataagtcatcacttttctaggttgtggtttaatagagtaaagtctctatgtctttgtggatttcaggcattcatgttccaggtggaggaaatatttggggtgactaagggctcatctatccttgtgctccctaggtttcaccagtcaatttaaatcttgccctcttttcaagcttctggctctcctaacccagcagctgagtacgattaaaagagaggtgaatagtcatttgctcatttgacacacttatgcacccttgctgaccctcaaaaggcctcaccacttttgaagtggttctttcgatgtatttataaaactattcataaatatgagaaaaaagctatagaggtcaaatatcatttccttttgcttccctcactgattttattcttgaattttctccagagaagattaatgtcaagttctactttaatttaaatgggacataggtgatcatttggctaacacagttacataaaagcattttataaacacatattcctaaaatcatcctttggagactaatggaaaggatgtatatttgaaacatccacaaatcatggtacatgttgcagctacacaggaatcacaatggcacccaaatacaccatggggtgatgatcttcctattttatctctgccggaggctctacttcttcccaccaatttcccaaatccttgtctcttattggcaaatctgagaaggatttaagcaagagtagatgtcatttatgtttcaataagactaacattaaatgtaaaaggaggaaggaaaaagacccatatacatttatattgaatgatacacagttacttcaattatctgtattttaaagagtagaacagaaaaccaaccatgagtcacagaaaagtggtcatgaagaaaattaaaatagctctaaggacataaacactaaaagagcatcctcccaccgactaacaggtgcaggactcaactcaaagtagtcaggctgttgccatatggtgtccatttagagccacagcctgtctggcccacggctgtgcaacacagtataccaccacctgtacccagacctctgcaagaaaatgtggtctgtatctcattttgtgggggaatagaggaaatctttgggagaactatgagcaaatagatgatagttgaagggctaccctgataatttttctgggtttgtatattgtgtcattgttactgataggagggacggttagttagaagtgcagaaaaatggtagttccagacttgtaaatctacatgatgtttaaaaatagcaagacattatataaaatccaaaatagaaagaaagaaattatgacatcctgaggctgttgaaaaaaaaattaccaaaatgacaggtgtttttccaactgtgtttcctcttctgagaatgcagaaatgtcctctaggagataaaggcaaaatgaatcagtggaaaagactcacggactctttactgtggtactgaggccacacggactccttttcatcaacaaccaaaatattatgaaaaacattaaactaaaataatgtgaaaagtttctaatacgtgactaaaagcatgttggttcacacttatatatggaatttccatttcatattaaccttacttatattttctactattggataaaattaggactcttattaaaaaaggcgggttctcttgaatttttttcttacaatgtgcctatgtaagaaagtgcttcatttggtaaatgcaacaatatatagcaaatagaaaatcctcatccttgtgcataatacctaccattttgtggcaatattgtatccagaggctattaggatctctggaaactgcttttaactcttctatttagcccttggtagggatactctttttcttctgtttgaagtaatggtcttgtccaagaccattccaatgtaagcagcagtgtcatactatgtgggttatagcatcaagaaccatgcttatcaatagatagatttgggcaaaccatattgtacccccacctccaatggttttggtgggttaaatgaagtttgaaagccaatagtggaaatatgtaatagtaacagaatcaccaaaagtctatttgagaggcatatagaaagctgagaaccatttctgctttggtgagcttttgagctgattataaaaatagatgttgttttaagcagtgctaattctatatcctttaacctaaccggattccacatgaaatcataacccataatgtgggaaccatggatgttgtcatgaataatttaataaacataaaatgtgtgcttgatgttctgcaatgtgggactttgaggacgaaaatcttaggccttgatccaagcagtgcaaaatccagcaagggtgagaaatactagctatgctatatttgtgaagtgtatgaagagagatattcatgaaccaaatattatcaaaacacagaaaggactaaatttccctctagcaatcagaaacagttgaaaacacatcacacatgtgcacaaaactggcatgggagatgattctactggtcactcataatggatttttgactgttccagcctacagttctttcaaagtagttattctcgacctgggccactgttggaggttttgagtcccctaagatttagagaaatcagtttttgagattcactggagatccagaacaagaagtttgaagtaaggattggacaataccccactggatttcccgctgggctatcccagcaagcctgatgagatctatccccaaatccctttctctagggcagtgactctttcgtttacaattaaagcatctggacgtttattagaaagcaaattctcaggctccatcctagacctactgaattagaatctctaggaggggagccagggagttcacatttcaataagttcttcatgtgattcaaggtgtgctaaagttagagacatactgctagtatttagttatgcaacttcagtgttgggtagatggatctaccacaggtaatcattagcccccagattcagaagggttctccagtaagtagaaagtttcaaggactgacaaatcttaattcagtagttcagtaaatatggaattttcagtagttttccaacttggctgcatgttggaatcaacttgggtattgaaaaaaaaaaaaaaaagctcatgcctggatcttacccacggaattctcatttaactagtcagttttataagctacccagatcagtccaatctgcagtgaagtttgagactactgcatcagaaagtggtggttcactgacctttatccactaaaagcctatgggagatagcaaaggaaacaatttttgacagaaaagaacataaagggaaataaaatttttaaatatgtcaaactttattctaggtttaaatcacatttttgagattttctgtctaggaagacgttcttaaagaatcttcctaaataatgactgagtagcacagatatttcagagagactgcaggtcagaatagagaatctttattcacattatatttaaggatatcaacattttgaagcatcaaattaaaccatgccctctgtactttaaatcattctgccttggtcactttgtgttgctgtaaaggaataccttaggctgggtaatttataaagaaaagaggtctatttggctcataattctgatggccagaatgttcagaattaagtatttacatccggtgagggccacaggctgcttccactcatggcagaaggtgaaggggattctggttgtttaaaagagcctagcacctcccacctctctcctcctttctttctggccagtgtgtgcagagatcacatggccagagaggaagcaagagagaggtgagaggtgctagcgtcttttaaaaaaccaactctcggatgattcataagaatgagaacacactcaccagctccccccaggaagggcattaatctattcgtgacaaatctatccccatgacccaaagaccccccattaggctccacctacaacattagggatcagatttcaacatgaggtttggaaggacaaacatccaaactatagcacttccctacttcatttttcttcgctttctctccgtctcgctctgtcgcccaggctggagtgcagtggcgcgatctcggctcactgcaagctccgcctcccgggttcacgccattctcctgcctcagcctcccgagtagctgggactacaggctgttctcgtttttaatctcctgattgcctctacctttagcatctgataacctccttctaccatcaaaaaatgctttcatttagagtcttctgtatttaattaatgcacttttaaatatttactgagcaactgttttgggggtcacagcattttcatagttatgcgatgatttcttcaaattgttcaaaaatgtttattgcattcctactatcttcctcgcactattctaggtacatcacggagcaaaacatccaaaaatcttgccattgaaggagcttaattctagtggagcaaggaataaacaataagcaatatgtaagacagtagatagtgttctagaaaatagagactatgataagtgctataaaaagagaaagcagaatagagtaagggaaattgatagtgcagggctagggaatgagaattttacaaagagaaggcaacatttccatcgaaacttgaaagagatgaggttatttgagggtagaacatatcaattagtatgtttcatgaaatactagacaataacatttttaaaagattttgtgttattttttttcagttaaaagaagaaaaaaagcaacgctttctcctaaatcgagactgctctactttcatctttcagcctgtttcatgttaataggtgtttttagttaattaatttcttccttaggatattcatgtttgttcatgaagattgtaaaatcacaaagttcatgtgattattgttatgttattagggaattatctctctgcagacatttacatttgcctctcactaaacacatttgtgttcctcagcattccaaggttgtgtgtggatatgtctgcatgtgtattttagtcacacaacctgctgtgtatcttaatgagacctgtaccataaccaattagacacctgcagtagaatcacactgtgctcccaaatactcattttctctgctcgtcaaagagttcaaactgagtcaccttcacttcaagtctatgcagctttttactaaaatctcaaagttgcatgggggctttactcctttgctcaaaccaatttttgtgaatgttgggtacgtaaaaacatcttcaaagtaaacatttagtaattaatcaatgctataaatgtgtaatgagtctgttctgcaagggacatcttgttagcttttgagggcatataggatactatttgaattggagtaactttctgtatactctaaagaacagctgccaccctcagttctagatatgtcttgggaggcttatcgtgattagattttcacattatattttcttggtaattatatcttaaagcccttaagttcaaatgaaattcgaacaagtcacaggtgatgcaactaaattattggtcatgagcgtatatgtcacatccgaaataaatcttgttatatcctcggaaattagaagtggtccttcagggagtcactccaaaactgaagagggagcaatattataaaaccattgttagggcagaagaatagtttaatttatagttcttttttatttgatacaataactgatgagctctaaatctctcatacacaaaaatctgatcttttttccctgcaccaatttaacttttacttcccagatttgccctcaaagtactccacacagcagcttccataataatgccctccacctccatcaatgtgctaatcagtttccttactcaggctttaagggagacacagacccttcgaggcaaggcagacaggaagaatagcaaggcctctactctgctcctcctccttcttttcagtcctatcctttgcctcctagagagcccctagttgtcttgtaatattcaccaaaataagttataaccgtaaacttctatgttaaatttttttctgcagaagaaaataatcatattacaattgattctgagtttttaaaatgttaatatgactaattttaaagcaaaatgttgattgatatacaaataaatgttaaattcagatggttttattttctgttatatttccaagaacgtgctaattccaatatttactatcttccattaatttatattacataaagctttctaggagatgtaagtaacatttgatttgaagtaatttaaaccttcatgttacattgactacacttttgcattgtcaagtattttaatggagaaatattgaaataaatatactcaaaatttatcaacatttattttaggatttcaatgaatgtgatttaaaatacatatgttgaatttttatttctttcaaaaatttttattgtaccatgaaagctaagattttttaaaaaaaggaagaatttattttattatgccattacattcattacactatctgtaaaagcatgcgaaaattctctctgcacattttgttgagctagccatatttatataattggcaatatataaaagttcataaagcccacagatcattacagtagtaatcagtgctgattctagttaaaaaaaaaaaaaaagatagaaaaggaaagcaaaagaaaaaaagaggcatagtacaagtgtattagaccatttttgcattgctatagagaaatacctgagactgggtaatttattttaaaaagatgtttgattggcttagggttctgtaggctttacaggcagcattgtgctggcatctgcttgacttctagggagacctccagaggcttacaaggtgaagcaggaggaatcaaaagagagagtgaggaggtgccacacacttgtacataaccagatctcctgagaactcactcaccattgcaaagatagtaccaagccatgataggtctacccccatgactcaaacacttcccactagtcccctccagcattggggattacaatttaacatgagatttgggcagagacacatatccaaactctatcaacaagttacaacacaaatgagattaagattatccccattagtgttctgcatatgtacttctttctgccactgatcgttttgactatattcacatgagcaagaggaacaaattgaagggattttgaaagatatcatttgacttaatcgatgtaatgacatatacatttttgtgatcttaagtactttagaacatgtgaggtactttatagagcaccattcactccacaaacatttaggaattcctaaaagacagtgattctttctggaataagaagtacaagaaccaggatggacttgcctgatgagagcagctcatcaaggcagatgtggacagataattggctgacagtcaagttgggaaatagagcagagtgagtgaagttagatcactacttgtgagatcagttagaaaaaatcaggaaactcgttccatttcttgttcaaaattagctcaagatggggcaaagattgaacaaaacaggaatatgagagaaggggaacctgaccaaaaaacagtcatgaacaagaaccaaaagaagtgtaagagttgttataatatttttggtggataaactaagaagcacactggctggatggtctctcagtaaggtgtagttccaggctgaccatcaatgaggattgaccatgaattgacagaaattaatggaatttcacactggagttagaattccaagacaatgaaaatagcacacaagaattacactactggagaggatttgtgaaatttgtgtgtgtacaagctatgagttaaaatcttatattcgagatatagaaattataaccttactttctacagcacatttagaacaaggttactgtagctaagcaactcaaaatttccaagtgagcgtaatcatccctacagattttgaaagcttaatgcaagtttccagagtctgaattaaattaaggatggctacaatgttgaagaattaataaatacctattcagaagaagatgaattccatattcacaaatggaatgtttaagaattttaaaatttaagcagcagatttgaacattggcaattctattttaaaaaataaaaaacatgtaagaacagatctataatacactttaatcttaatacttgcatgtcttactacttagaccatcaaaagagacgaaattatgtgtaaaatatcgtgagcttttattatgtgcccagtaccgtaatagactctttacagtcatgatctcaattaatctatacagcacctctattggggtaactactgctatccattttagagataagaaacctaaggcaaacatgctcgagcaaggtcacagacaagtaagtatcaaggcacagatgcaagcctgtctgcctctggggtccaggcctttaactaccacattcagctgttgaggcggacagataaacagaaaggccaatacgaaaaggaatcttccctatgtactctcaaagtgtggaatttagcttctaggaagaaatgggaaaaaaaagaaaagaaaaagagagagaccataaagcaagctaaaccccttcttacttttgtttgttttttctcagtgatgcgtgtgatcctgttaacatcatacttgatttaaatgttttgttttactgttatatgtaatgaaagataaacttcttcccattggctatcatgagacccccagaagctgctgcacaagagaatattcttattaagaattttgagtaggctattaataatttctagtaattataaaattgtttaacatttataacattgaggaatttatttcaaaactgcaatattattatcaacattaacgactagtttcacggtcatttttaaaagatgacagtggagagcaagacctaaaatgtatttgccagctttaagaaggcacataagaaaaggaaacatgccaaagaatacagagattcgaatgagtaaaactgtattttaggctctggcactagttttgtgggcttgctaaatcactttaccctctgaattcttattcattatttacataaatggaaatccctatgtgctacaaatttctgtgactcgattatcatatttcaacccagaggaaactagaaattacatagtctgagcaatgactatatatgccctttgttggcatgacctgaattaaatcacttcaaactctcaggagaagataaaagggttttttaaatccagatcttaaatattcaacttctaattgttcattgctagtatatagaaaagcaatagatatttttatattgaacttgtaatctgggtccttgctaaactaatttattatttctagtagcttttttgttgttgttggcagaccctgtgggattttccttgtaaacaaatcatgaagtctgcaaatagagttttatttccccttttccaatttgtatgcttttttgttgttgttgcctcattgcactggctaggacctagtacaatgtcaagcaggagtagtgagagaagacatcgtcgccttgttcccatcactgttccccgtcttacaagagaagcattcatcgttttaccattagtatgatgttgactgtaggtgttttctatacatcttttattaagttaaagaagtttcttttttattcctagtttatggcaaattgcttttatgaagagatgtgaattttgtcaaatgctttttcaacactaattgagaagatcatatgatttttcttctttagtcatcatattttaattattcatgtgcattcatttatttaaatgttcctgtgtcatctagccttgtatttctcacagtgtctgaaatacagtatataattagtaaatatcttttcagggacaaatacgtgaatgctggatactgtgctaggtgctctactgttagaattttctatgttttatgctttatttctcttctctataagtacaattttcatttctgcaatatactttaggttgcaagaataatcgattcttttcatgcgtaattgatggtatgagtttactcttataaccctgaaatcaagaacaggtaaaatatttggggcatgtgctctattactcccttgatgtgttcagttgtaatgagtgaattatggacacagtatatctgtaatactaaaaactccatacagataaaacaccctttctcagcaaataaattttttagatatgtctgtttatgtctcggtgcatggatatatattttcctatccttaaaatcatttccaccctctttaatgatccatcttatgcttagtttcctaatcactaatagaaaatgaaaatgtatcttgcttagtgaaccatcctcagtactaaccctaccgggtatttgaactgcttcttggccttctactctctgtatttccccctctgtcttacaattcacttgcttgtgatggttttatctggaataatggattgttttgtagaattgctataatctattaaataaaattttctggaccagggttcggcacataaagccactaacatatatctgtaaagttatattctattctctgataagaatgatgctatgttcatgtaaaactgctttcatataatatagaatatgttactattcagcatgtatttcatataatatagaatatattaccactcaatcatgtacacactcttcgttatacacatcatgatatttggtgtaattcttataggactccttataggagaatttggtgaaattatagtggtgagcattccttcacgagtagatgtatcaataattagttttagatgaggctgtgtatgaaataaatataaaatgcctcagtgaatggatgttgccattgagcttattctccagctgggtactgtgattttcttgtcagcttattgtgtcacccacttacgtgacagaaaacctgtggtttcctcttatttgctattgcaaatagaaaactaggaagacacaaactgtccacagattttatcttatatatgagtttgcatttccataggactctagagttgatccacgttccaagttttcttttagtccatcactttaaaatagatgcttccacttaaatcaagatggaaaatctatattgataaaaccctatgttacatttcaggggagaaagggtatatatgttttatgaggtttttttgtaggttaagaaaaaaagatctttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccacagcactcccgcctgggcgacagagcgagactccgtctcaaaaaaaaaaaaagaaaaaagatctttaactgaattttttttctatctaactattcatttcccgaatcctcttatttgttaagatagccagcttctataccatgagttcagaattatgttcatatgttttacctgcctcatcaaaatgaatggaatttgtccttccatattgtctggtatacgaggatgtttatcactatactcctttgttctcattccttaggccatgatttttcggcaaattatccttgggaggagccatgttgagtgtggctatacttatcagaattttctgtgtaagatgccattttcgcacttttccccaaggattcaccgagaaaaatcaaaagtgaatcacaatggaaagtaggagagaaatgaaataaatatcacagacacaatggcatcttatcactttatcaatgaaaattacttatggtgagttagatcttggcaaaattaaaaactttaataaaactttatcattttgacgtatgaaagggagactaccaaagggatatatgtagagaggggaaactatgctctgtcctctcttcatgaagcctggccaactaacaaagacccagaaagctaaaggagaggaggagaaggaacaatgctcctaaggttttaagcatggactatggagaccttcttatctcaatcagaaggtcttcaaagaagacacaaatcttcatttattacctatatttaaaatatcctattttaatatacctatagtattgtatgccagaaacaatactctggttactaccaatggattagtttctcagcttcagaacacatcagtaggggataagtgagtgaatagaactctattgaaagtctaagaatggcatgctttgattagaatgtcctggaaatgactaccaatttaaaagagcttagtatttccactaagaaattactactttttcagatgttgtatgtggaagaactgagtctgtcttgacaatgttgtattgatctggatgaaacaagatcaacaggcattagttactcagtgactaggctattaaaaaataaatttgaaattatttttctggcaaacaaacacaaatttataagaaatgcacaaatttgtttatatgttatagtatgtttattgttcatttgcaaataaaaatagtcctttcctcatcttgcaaatttatttatcaagtgctatcattatatagttgctaactattactaaatatgctgaatatatagttgctaaatattaaccttatgtaattcatttactataccttcagtttgcttagcatatcaaactttattgttattttaacaaaaataatgagaatagtaacatgttcatagtctttttatttaatttttaccatccatacttgtttctagctactaatatatgttttccaaatattttcacatgcattgttgcatttgcactccagaaaacccttaagaaaaaagtagggcatatgttgttagccccttgtctgatgaataaatttagatgataaaaattcaaggaaatatcccaaactgacagagccagctggtgacaaaagtagactcctgtttcaattttttgaatttgcatgtgcttgtctaactcgctaacttctaacatatcccttttatcaagatagttctctgtgcttttgaatcaatatgcttttttcacataaaactgattaccataggcaattttgacattattacaagtggtctgtaggtgtaagatgtaaaggaactagatataccttccgtatatgtagatgtcagataaaatccccacggaaacaagatggcactgctgaacacccgtacagccagggaagattcctcagcatggaatgcacaattttctacactgggaagataagaactgcagtaaagcgatacaattggtttctgaagaaaaaagccaagcttctttttagctctgtgggtgtcttttgtagctcagtgaaccgttgacagaaactgagacaatagcttagggagagataggaaaaaagatttgaagggagtatattaatatgaaaggtcaccaacgagacctgtgcactgtatgtgtgtctctctttggacttagaattgttttttccaaattcagtttttaattataactgtctatcttatataggcagcgggagtttaacctttttttttcttagatgatgtaaaagcaataccaaatgaggtattgataaaatttgtatctattattaacggtagaaaagttttatgagtgcagtacttgcgattttcatgtaacgtaatgaagacagcaagactagaatctagctagaatgtgaaattagctctttatataacttttaatttaatgattctaacaaattcataagtcataataacttagtaaggggcagaagcaatgatggaaaaaaacttatatgggacaggacgttttactttacattatcccattttataaacaatggattatggtattatcccctgtcataataatgtataaatagagattaattttaatttcttcacaacaatgtagagttatagaatgaatataattcagaattgtattgttgttttgttttatactattaaattacatatgtagaaaagacaggattaagagtgagggctttagaaagcaccacattattggaagtgttctgagaatgaaaaaatgttaaggacgtagaatctgtgattccaaacctgagaagccttttaaaaaagacatattgagaagataaaataagcaaacagaaaatggccttaagaaaacttaccaagcttcatatcagcaagtgcatatcaacatagcacaaaataaattccagcatgtttacagcgtgcagagatacagtagttaaaaaatgtatattgatgatgagatggatcaggcttacctgagaggtaaatttcaattcaaattttgaggagggcaatgcatatgaagtagaatatgcaatgggaatcttctagatagaagaaatgatcatatatataaaggtgcaaaagcaagacatggcaagcaatatgaatgagatcaacaaaagaagctggaatagaggagtggttctaagaaagaggtagaggtacagaaggcaagtgcatttagcagggcaggaggtggggagaatagcagctggccacatataggatggataaggagtttggagttaatgtggtaggcaagaagaagcacttaaaaagccttccacatagcaactacatgggttaaatatatcttacaggttaaaaaatgtactgggtaaattgaagcccacatgaggttatttctttctgccaaatgaaaatggtgaatgcttccaggtcttccacatgttaattgctactggggtataagagggccaacccccaccctcagatagaaagatatgtatctcagagacaatcatcctgaaaaaaagataatagaacttaatcatgggttatctctcatggactcagagaaaagagaactgtaaagaaagaaaatgaatccataatttttgagcccagggaaccaggaggaagctgcaagtgaaaatgaccagaaattataactctcttaactagtgagtttttattgagcaccatcttgtaaaaggcatagtcccaaatcccaaacattatttatgagtcaaagaaatgtcgaagctagtgttattttttttacatcactatcagggcagtgggagtagtggggtagtgtatgtgatgagtttatatgttaatatatagtaataaactgccaatacaagagccaaaaagatctatctccaggaccagctttctggtctgaatcattttttttccttattagcctcagctattgtaggaataggttttgtgtactttgtgtcttaagtaccacagtacttaactactatgttacctagaaacctggaaaccaacaccataccataccttcttattgaaaaagtacccaactcagagtgatccactgtataacccccactgtgatgtaattagagcaaagaggcaaatcaatgcaagtcttgtgtttacaaaatcactggatgcatagtcaatatggtgcctatggaataagggaataacaagccacaaagatatatatactccgtaacttggattattgttcctttgtgcttactctggcaaaacaccacataacatttaagaatgtcaggaaaaatattatttcaccccctgccattacgtttttattttaagccctgttcaaaacaactgctctgaaataactgaagtgttactagttctactttccaaaacacactatactttttctgaacatctctaaataataaatatttctgaacgtgtatcattaatattagaatttgttcttgactttagtctcatgttacacactttcttattgtgggggtcaaagtgatgaattctgcattcatctgctctgtgaaaaacttggtaagatcaaattattcatttatgcataaattttgctaatggttgagcacctacaataactcacataatatagagtcatgtgcttatatgggagagacaaccaagtaagcaacatgataaagcatgataaatgttagactgaggtgaatagagagctattgggacacttggatgcaaatctcctggtctgagtcagtggaaatttgcagagtcggtggaaatttgcctgtgtgacccaaatttgggtcatacaggataagtggaggttgcataggtgaagggagttgaaaaggcattctagaaagagagaagagcatgtgcaaatataagaagtctagttagataacttcacaattactttggtatacttggcacctagaacataaggcagagagtggcaaataatgaagttggaggactcaggaaccagcagatgattaataccttgcattccatacaaaggagttgaaactctatctgaaggtccttggtgatatgattagctctgtgctgtggaagatcagcagcaatgtgagattcacttggaggcaataaagactggagtagtgggatccatttaagaggctattaaggcaacctagagagagatgctggtcgcaaactaagggagtaccaatgggattgaaacagaaagatgtattcaaaagctgtaagaaatgagaatcaaaggaatctagtttctgccttggaaaacattatgttctccatttaacttcagcactttgttttgccctaaggttctcttatttatgctgattgacatattttctgtttttattaaccagtgggtcacatactgtagtgcagtgttttgtctttttaagtaaacattcacaagaggtttgacagcttgcagaaatgtgttaagtatttgcccacctaatgcagttccttgaagataattgactgtcattggatcattttagctcattgttctacaaaaaactagcttataatagtttcaaaaactgagattaccacatatagagaaatatgatcaagtccttggtgtagcaattttcttcagaatcagtgcttggagcaatatgaaactatctaatttggggagaattaataacactgctgcatctttaaagaaaaaacaagtatgtaaaaatccttaaagtgaaacaatatattttaaaacatatcatttcaactgtacctattacttaaacaagtgaaaagataaactgattttcaatatgcagaacctagcaatgaaaatcaacaaagccagataagattatttttaaagcaattaagagatgccataaaggataaactaagattgcatactcttagaattttacaactagaagggactcctgaaatcaaggtttcagttagaaacatttatttaggaataaagctacagcttctttgaattttaaggtctagacaacccagagaacatatccccctctatactaaaacatgtggcttgaggcatgtttcaatataacattataattttctttgactcaatataaatatcatgacaatagtcaattatgtagtccttccaggtaaagaaataatttcttatgtcttttactaacattagtttctagcatcatcttccaccttaacatttgacattgatgtatacagaacagaaacctcactcaaactaagatgagcaaccaaacaaaagtaggggcaggggatagaatgaatgataacgttactaaaaggtacggggcccaccctgatgtaggctgggcctaaacaatgtcaccaagacttcccttctctttctgtttgtgcattggcttcacttaggcagattttctcttcagttgatcagctcaataacccagcgaacaaaaaccagcttctctttctcagtagtcacagaaaacccttataatttagtctcattggggtgactagagttatatttcatttccctttagtccagtactcagtccactttgcatggtggttcggtctcctcgactaagcattgtggtctgaaggaaggaaaaccctgctttggccaggtcggatcacatgcacactactggtcagcagcccagaatcacctggcccgaggcttaggagaaggtggttcccaagagggagctgtggtggtctttgcagaaaaaggaggaggacaggatgaggcctagtcaagaatagcagatgttttctactcttgaatttcataattctcttactttcttacttttactactcatgttataattttttccactcatgtaaccattagagacaaagagtctctgtgccaactcttatcaaattataatgggctgaatgtttgtatccctccaaaatgcatacgttgaaactgtaatccaaatgtgatggacatttgggagtaattggtcatgacggaggtaattaagtcataatcactgaagaatgggaatagtcctctcataagaagaggccagagagctagctagttttcttttccccatgtgaagatatgtattagtgacagttcttcagagaaccagaaccaataggatatacacagttgacccttgaacaatgcaggggccctgcactgtcaaaaatccacatataacttttaacttccccagaaacttaactactaatagcctactgatgaccaggaaccttacagacaatataaacagtcagttaatgcatattttctatatgtgttatatactgtttgcttacaataaagtaatccagagaaaagccaacattattaagaaaatcataaagaagagaaaatatatttactattcgctaagtggaagtgaatcaccataaaggccttcatccttgtcatcttcacatcgattaggttgagacggaggaggaaaaggaggtggtcttcctgtctcagggtggcagaggcagaaggggtagagcaggtagaatgggaggcaggagaggtagggacattcaatggaactcttactgaaaaaagtctgcacataaatggacccaaatcattcaaaaccgagctgtgcaagggtcaactgtgtgtagacatataaggagagctattatgggaaattgcttatttggttatgaaggtcaagtcccaccatttactctctgtaagctggagacccagaaaatctgataggtgtaatttagtcttagtttgaaggcctgaaaatggtgggagctgccgtataactcctagtttaacaccgaagtctgagaatagggattggtgggggtagggcaggtcgctgttataatttttagagtccaaagctccaagaaccatgaactcttcatcgaagggtcgaagaaaatgaatgtcctagctccagaagaaagaatgaattagcccttcttccatctttttgttctatctgggccctcagtggattggatgatggctgtccacgttggtacaggcagattttctttactcagtccaaagctaatctcttccataaatacccccatagacatatccagatataatgatttaccagctatctggatatcccttaatctagtcaaactgacacataaaattcaccaccacatgatacaaagaaaagtcagcagcctgtgactcagaagaggaacctcattagaacctgaccatgctggtactctgttctcagccttccagtctctagaactgtgagaaataaatgtttgttgcttaagccacccagtctgtagtattttgttatgaaagcctgagcagactaagatgcaaactaggcctcaaaacagactttttttttggttagaccttttctaaccaaaacttattccttgttgaaaaatgtgcctcttggcctaaccctctttgcatccatggggtggatgcaaatcatacttgatcatagtgaataatcattttaatgtactatttaattcagtttggtaatgttttgttgagattttttacatctgtattcatcaaggatattgttctgtgttttccttttttgtagtgttcttgcctgactttgatatcagagtaatgctggccttgtaaaaatgaatttggaagtattctctctttttcaatttttctggaagaatttgagctcactttgaacttggggagataggcagtgaatatttgaaagtttttaagtcattttttctttctttctgtttttttccaagacggagtctcactctgttgcgcaggctggagtgcagtggtatgatctccatggccacctccgcctccctggttcaagcgattctcgtgccttggccttccaattagctgggactacaggcatgcgccaccatgcccagctaatttttgtattttttgtacagacggggtttcaccatgttggcaaagctgttgttgaactcctggcctcaggcaatacacctgccttgtcctcccaaagtgctggggttacaggcgtgaaccacccagcctggcctataagtcacttttaaagtctctggtctagaagactcaggagtgcagggctcagtctacacccagagctgtctgatttagtagccagtccctcaggtgaaggatgtaaacgttggggtgcttgatgtgtgcagaaactgcttccagggagaatgtacagatctagatttattgctggaacaagccgtggaagaaggtgcagggagtgcctactctctcgttctagaaagcagaacttttacaccctgttagcagggacagacttacaatgtggagttaacactgaagcaagctagggaggaaggcatagggagtgttcactctcctgttcaagcaagcaaagtctcatacccttcttgcaaggggaggcttcttttctggaattatggctgaagcaagctgtgaaagaagatgcagggagtgcccctctccttttcaggcacagagaggtcccccaacctccccctagtgaaagattgcagaaatttatctcatctcatatccagagcaagccaggaagacagtgggggaagtaccatccagtctactcttattgacagagaccttcaacctctttccatgaagagatgacaaagctgggattgtcacaggagcaagccagggaagaaggaatgggtagtatggtcccgcctatttaggctccaggaggctaattcgttattttccatgtagactcccagatgctggctcgtcagaggccagaactacaggaaactgctggaaaagcttgcagccaaacctttcctgtaagttggagactaggctgatcctgggagctacagctgctgggaatgctcccatggttccaacgtcctctttgttttttgtgcttgggggaaatcctctgatgctgtgttcctgctgttcctcacctgggtgttttaagagccaagctctccagtagagtctggaaaagttgggaactatatgtgtataagagtagccccttactcttcaggaaaaagataggagctgggtttgcttcctggtgatgaggcgctgtgctcagggtggggttagtgtctgagtgcatctccaattttcctacccgttttgatgtaggtgttttctaggttgtttgttgtgtaggaggatttcagttggtttctagctttctcttggagaaactgatctactattttttatctaggacagtagttaccacgtttacttggtgtgtctgtgataaaaggaagaggcaggagcctcctactctgccatattctcacatcaccccagaaaaatggtaatttaaaaattcctgctgcttggagatcgagaccatcctgactaacacggtgaaaccccgtctgtactaaaaatacaaaaaaattagccgggcatggtggtgggcccctgtagtcccagctactggggaggctgaggcaggagaatggcgtgaacccgggaggtggagctagcagtgagccgagattgcaccactgcactccagcctgggtgacagagcaagactctgtctcaaaaaaaaaaaaaaaaaaaatcctgctgattgataatccttccttggggcaggggagatgacgggcaggatttatgtcctcttccacctctctgtctatatgacacataaatatctcaggatctttatctgcaagtggatctaataagagtacctaactcagaatgtgaagaataaatattatacatgaagtacttagcccaacattcagcatacagatgttcattcctatatttatgggttgtctaggtatgcttaggctgctctaacaaattactatggaatgagtggcctaagtaacaaacctttatttcccacagtttgggaagctgagaagtccaacatgaaagtccccgcagatctggtctagtgaagggcctattacaagttcatagacaaccatcttccctctgtgtcctcacacgtatgaaggactgagaggctctctggagtctcctttataaaggcactactcccattcatgaggatttcaccatcatgacctgatcacctcccaaagatccacttcctgatgccatcaaattagaggttaggatttcaacgtatgaatttggaagggacacaaatatttaatctgtcacatgacccattataacttaaatgtatgactgctagtgcctccacagtgtatgagtagttttgttttctttttttttttccttttttggggggcattgggggacagagtctcattctgttgcccagactggagtgcagtgacacaattttggctcagtgaacttctgccttccaggctcaagctttgcttatgcctcagcctcttgagtagctgagattacaggagtgcaccaccacaaccagctaattgttgtatttttagtagagacaaggttttgccatgttggccagactggtcttgaactcctggcctcaagtgatctgcctgccttggcctcccaaagtgctggaattacaggtgtgagccaccatgccaagcttagtagttttgttttctataacaaattttttaagttgaaactagcccaacgccttgtggggatcaatgctggttactaaatgcacatgataccaaaagttgatatgtatgtttgagtatgacagatagtcggttcgaatttcagaatactttagtgtttcatccaaggaagcaaactttgggatatgtaagaatggtgcttggacttcattgatcttattacttctgcccagagtcttctgccttctttccttagcttgtttcatttggcctctctttttatggctaactccttcatgaagctttctcttttccaacccacattaatatctctcaacacttatgcacttgaaaatctgaccataaggtctgtttttaaatttttttttctaagactttacatgtacagttgtcccttggcatctgtgggagattggttccaggaccctcataaatacaaaatctataaatgctcaagtcccttatataaaatggtatagtatttgcgtataaccttcatatatcctcctgcatagtttaaatcatttctagataggttataatacataatacaatgtaaatgctataaaaataattgtcatactatcttctttatggaataatggcaagaaaaagtctgtgcgcattcaatacagatgcaaccatatttttttttctattttcaatccacagttgattgcacccatagatgtggaagccatggataaggagggccaactacacttattgtatctttccaattagattttaagctgccttaaggcaaggatcatattcaatctatttttttatctaggacagtagttagcacattgctgagttcacaagaggctttgagaaaaagactggttgattggctcactaattaagtcacattgaatttttaaatttgtagttcaatttactagtttatttgtagtctggcactcaaatcagtagttttctttttcagtattacaccactggcctttaaagcatgacaattatgttatagaatgtcagctatggtgtggaatctctgaattgtttattgggatgaaagagtaaacaaagccaacgacttcctttaattagaaggcttttgaaattacagtgcatgaattgccaggttgcccttaagaaatactggatttttttgccatttaaatgctccaaaaccaatacttcattagacttactgtcacttccatgtgtctgtttacactgaaaagtacaatgatagcaccagtgacctgaaataattgccatgtaagtttgattctgatgaaagttcaatttttgctgagagatgcctggagctcaactcactgcactgacagcagcctgtaagtttctctctttttctgaccttgtaaagagggagcaggagcagttcaggaagacagacctgtgaattccctcccttcctcctcactgcttccctcaggcgtgaagcaacagttctggcttcagaatgaaatgaatcattattctacttttcgtgataaggtatgggatgccgatgagcaatctgctgccgatgggcagctagccatggcaggtcagagagcaggcctgcggagactgcccttccgtggagccacgcagaagaggccatccctggactttacaagcagaaaataactactgaactagaaatcgctcaaaaaattcaaacgcccaagtaatgactattgaacacaagaaacacataacaggagaaatgagaaagaattgtaaaaatgtagacatgaaatggtttctctttagcaaggcttcttaactattttctgccctgaagctctttgcaactgagtctttattgagtatgatttatttatttgtttaccccttcagcaggccagccctaggcaaaactcctaaagtagaaataatcgcctcctatgtcctccccagaacctctatctggtctcatattaagcttcctccatgacctcttgttgtccactggataaccaaaccctgcatagggattttccacagatgttctagggggtctcatgccctcagtctttgctacctcctgaccccttccaagcagggcaatccccttcccttgcctgaattacttaagtaattcccttgcctgaattacttaagactcgcccaattgctactaacagaaaaattcatgagctagctaacccaaaaggagaatttatcgtaaggatgcaggggtgtttcatgcacttcaagggctagaggctgctaggcttcaaacacagactggaattacagatgatcagaacctctctcacgcttctttgctgcttctcaacggattttgagtttcagttttttctctctttgactctaagaaatgccttccattctgtggggttcatgtggcaaacaaacaaataaacaataaggcaaaacatgtgaaacaaaaagcaaataagcatgactcacagcaaaagtccacacgacacagccagcaatctggagcaagatttgcttatgtgaaatttcagctttatgggaaaaagttgtatggactagctttaacaacatggataacccaacccaactaatgtaaacacagctgcctgccaccctgtgaccacgtggaagggaagaagcagttcctagaaaatgggggcaaaaagccagtaggtgtccacttttctaccatcgtcttcaaagacaccatgcagtttctcttccccaggcatgaactctatgagctcacagctgcttcactcctgttaacaaaccatatctcagaagaaaaattggaaaattctcctaaactgagaattagaatggtggaagaggaaattaaagttcctcaaatcacagcaagaagctggagagttaatctgatgaccctgaacttagcttgttctacatgtgatgaaattgattttaagtaataaacttccacaaagtcattattgtcctctccttggtgaaagctggttgttagtgtccccagttatagcaccacaagttgttttcctttttcctggaactctgttgcttgctttagtaaatgttttatttatacttttaaaagtatacatatttactttattgtttgcagtatttttataaacacacacagtatatatctatgtctatctctttaggtgttaaaacaggtttgttgtttaaatctgtatgtttactatcttttgtgtatgcttgatttatcagtttctgacactatcattgtgaacttgtcaattgctttgtcaaattctgctggattctgcttccctttcatgcgtgctctctctctctcctctcatctttgtatattaggctacattgttagaaataagctcatgattatctgtgccttttgaatattttcttttgttcatatgtagtatgtgcttttatgccagttgatgctttttgcttaaattctgtatttactgagtttcacactgctacatcttaagggtcattgtcatagttactagtatttgcctagtaaatctttttaattacctttaatattttcatgtaattttgtttttagataaatattttctaagcagtaagtgtggaatgatatctcatttatttgtccattctcataatctctcattttaaatgtgagcctaatccaattattcattgtcattatggctgtattttcactaattctaaatagtttattcaatacattcagtttcctatccttttatagtcaatagttagtttaattttgtatgttccttctttttgtcttacagtccatcttttcctctgtgtctgtttttcatctcggtaaattcaccttttaatttattattattattttttttggtaagtatctgtagggaagactaccttagttattttctgagggtgtctttatttggcctttattctaataacagtttagcttggtagaaatgtcttggttttcttggcagtaggaaaacatctttttcttctaaggtcacttgttgcacgtgaaagaatctgctctccatccgattggtattcctttgtaaatagttggctctttccatctaagagctttatttatttatgtttgtttgcttatttatttatttaatcctaaaagtcattctgatatgtttacatgcagcattcacctaatgcttgaaaagcacttttcaatttaagaacatacccattttgaaaattttcaactattattcagatagtttatctgccattgcctccatcatcttcagtgagaactcactgttttatctctgaaaaacccctcaaactaataattgtgtcctttatctgacttttagtataactttaaagattaaatcgttgggtgctgcactctgaatttatattgcagggctatattctagtatactaattttctcattcgctcggtttaactagactttacccatattttttccccttttatttaatgattgtatttttcgttttcaaaatatgtaattgcatatgttcatagtcagttactcttgttttatttctgcttgctattgttttgtaaacttgctcttttttaatggaaagtattccttcatctatcacatcaaacttcttaaacatacttttacataatctttgtcagactcatccatggaattaatttcatttgaaatgaatggtaaggcaagaattatgtctatccatacattcctaatgtgtagcacatatttgacactaagtagagattcagaaaaatgtttaatgaatgaatatgtcagtgttcactttttgtataatcagagatatttaatggtcatctagagtttagaggttatatgtagttcactactactcttgtccaatgatgagagaactgaaactcagaaaaatattatcacttctctaattaaacaaacactcctttggaaaccaccagtggacctcaggttgcataatatctctcctgctgccttcattctattccatctcaaaatactctctcttttttttttcattcagtcatttacttattcattcatacatgtatgctctcacttaattttaggattttccttttgcatgtatacaagttaatcaaattaatcctcaggaataaatttttcactcaggatggtattttataacgtgcaataaattcagacaatgtttgtattactataaataaaaacctcgttaaaaacaagtaagaagaattttattacattttagttaatttatttaacaaatatttttaatagtgattaaagaaaggaaatggcaagatccattatagatttttaagccatgttgtaatcaaccttaaatatatattttttgtttgttcatttgtttgtttgtttggagacagagtctcgctttgttgcccaggctggagtgcagtggcgtgatctcgtctcactgcaacctccgcctcctgggttcaagcaattctcctgcctcagcctcccgagtagctgggactacaagtgtatgccgctatgcccagctaattttttgtattttagtagagatggggtttcactgtgttgcccaggctggtctcgaactcctgagctcaggcaatctgcccacctcggcctcccaaagtgctaggattataggcgtgagccaccacgcccagccaaagatgtatttaaacaccaaagttttaaaatatttatgcattaaatatgcttagtgtcttctgtagcagaaaggatgtggattttacattttgatttctaagcaaattaatgatgtagccataaagcatagcaggatatagtgggctataaagaaaccaatttaagtaatttgtgcaaatactttaaagttttatgaattaaatttcaaacaaattctctatgacaaggcaacttcctcatagagcacagctctagtcattttgatgtacagataggaaattaaaaaattcaaattaagaaattaagtctcatgggtctacatcagctgatttgtaatttgctttatctttaaaaacagttttcttgaatttaatatgccagcagttataaagctatctttctctctgctatctactgataattttgcgtatctgtaatgatctatgttctttttattttaaggaaatatagttcaccaggatggttgagaacaaaagtattgtggtgaaacaaacctaggttttaaccccactgtagccatgtactactatgcaatagcatgcaagttacatcacctctgtaagactcagttaacaggtctgcgaaactgggataagaatatacagacagttcctgacttacaatgatttgaattatgattttttgactgtacaatggtgagaaagtatggtttcagtagaaactgtacttcaagtactcatacaattattcggtttttcactttcattataatatttaataaattacatgagatattcaacactttattataaaataggctttgtgttagatgattttgcccaactgcaggctaatgtaagttttctgagcacatttaaggtaggctaggctaaactatggtgtttggtaggttaggtgtattaactgcatttctgcttaaaatatccccttttcaacttatcatgggcttatcaggacataaacttgtaaatggaggagcatctgtatatgccacagttttcctctgaaaagaaaatgagataatgtgttataaactatttagtactcagtaaatgttacacagttcttactagagttatttccatttttacatacacacatatacacacacacacctccctctgtcagccagtatttctaaaatatttctactgttattattgatcatttaaagtactttttactgattcattaaaaatctccccagtggggaactgtgcaatattttagggtggtagtctctatattattgaagttaaaatattgagtgttttggtcagataagcaagggtgagacacaaaatagcatgagcagctaacttctctaaactccagtttccccattcatacaacaaaaaggataatagcactatataagttgctgagcgtataatttatatagagggttagtccattgtatggaacatattaagtactcagttaatataacctataattatggccataataataaaatacaatttggagcatgtacacagaaagacagatttgaggaaaagtatgtgctttccttggtgttagagcattggcaaatgtctttaatactgtgacattcaactgtgaaaaccaattattacacaattagaagcatcctcaattagggaaagattaggtcatgtttttaaaacacccaccaatattttctgtcaatcccatctgtgacacgaataagagagaccccagttagcagttgtttaaatcattttcctaatgctggcatccgtctccttggagacatccatcagagacttgtgttaacatctttcaagttgcatctggataggaccagtatgtgatcagtgtattggtacatttcactgacagacaatacaacatttgctttcattctatctttaaacttgtttgtaatatataaatacttcataatatatatgcctatttttattggtgtaaccataaggacacagcatgttgattatcaaaagaaactaccatatatttagcaacttatcttctggatgtaagaaatttatttaaaaattaaattttagtacatgaaactggctatgaatttcaaaaagtaagggaaatagataaatgctataatgtacatttaaggtaaaaggaaaatgggatgctatcaaaaatctttattatctatatttttatatctgtttataatttaaatatgttgcattttacaactataccattcattctgagctaaataaaactggaatttaagaagacaaaatactctagaaatgcttgttatctcttaggatcaaggaagagaaagtctggtgatgggtgggaggaaaacataaaaaataaaatacttaacactgacatccaattctgtagttttaatgtaaattatttcattctttgaatattttgtatttttagcctcaactaaataaacagattcgaataggtgtcttggacaactgctaagtgggcagttgtctagagccaagacacataggcagaaacagagaagaaagactaactcagatcttctgattacaagcactgtttgaagacctccacaactgcctaggaaaaattaaaaagaacaaggtacagctttaagtttaggttaggtaaagacatttctcttaaaatcctcaaagccataacaacactgatggtctaaaatgctaaaggcaggagatgagattggatgatctttaaaggctctttacagacccaagattccatatagcacctgttggcttcagaattgtttatcataagctcatggtcatcaatataatgcaatagttactaaaatttgcacgttcagtaatgaataaactaaataaaaacctggttagaaaaagataatattcataacatttcgaacattaaaagaatgaaaagaagaattaacaaataaggaaaaatttgtgttcaccaaacattttgatgaatagatagtctgaatttctaaatacaatactactagattggtcccctttctgtaagtatttcacagcacttgataaacattaaattagagctttgttcagcatggctgcttggtgaatattaaataataaaaaaaatcaaaacaccactatgaagtcgaagggaatattccttttttctggatattttccttcatgtttacaactttaataaaatttaagtggtatatgctatgcctaccaactgcttaaaaattaaaaaatgtggttgatgttttgtcatcttaatcaaaatttgcattccagtttccttgggaaactccacatgctgttatacaactaatccttccactacctagccaaataattaatacctttacaagcacatcataaaatatagattagtaaataactcattatacacttaatttcgatactaattgcctacaggcttaatgagctcttcattgtaataagaaaactgatgtttatttttattagatataacttctaaacaaaacacactgtatcaatctatgacccaatttgatgtttaattcttacggggaaaatcttaccattgactagtgttaaaagatttaaattattattgtataataaggtgttaaattagaaattttgactgacacaccacaacacaaaagatgatgaattctaaaatggtgcaagattaaatttacacacacacaaaaaaagcagggtaaaactagttcagcttaagtggataagagaatatgattgtgggagctgagaagagaaagtgaaggagatataagtggaaaaccacagacaggagtagagtgggttgtggcatcctccaaaacgagaagggccttcagctgggccactttgaaaacctgaactatgagctctgagatcactggccacaatgggctaatatctgacttgcctataagtataaaaggtagggacaagccaggtagtgcagaccaggtaatgagagaagttactattacatttgaatcagcctgtttcccactgtttgtcaggacaaaacttgttcatcaaggagcagatgcaggctatccctgagagagctatccaaagatcatgttagaatctgtcaaataatgcctcctaaaggttaatagttctcggtagagaagaaactacatgtaggccattaggtttctgagatgaagtggagttcatttgctctagtcaagtgaactttcttgtgagagacccagcagggactgggatccctgaagaaccttcagggagccaatcagctccaaatacctgtcaggcttggagagcaggagccaaccagggacattacagtcgagaaggaaattttcagcctcccaacttcttttccctccacccccacctcccaactagatctccaaccacagaagcctcagaactctttgcaagatggaggagaaggagctgtggaatactggccttcagctctccaccttaccagcataggtcctcccctttagcaggtacagctgtagaaactggaagcaacagcaattttggataaatgtggagcttttgaaaatgacatgaaactaggccttctagttatagaattaaatttgtgttttaccacttagagtgagcttttcagaggttaacaaagagcagaaatgtcacagaatagcctaggttctaaactaggggcaaggaatgtttcccgaacctcaatgcatttgaagtgacactgggaggaaaaaaaaaaagatgatgtctgattaaatacaatgagttctgtctgttcaacataatagttagacatgtttttaaattttaaaaattggtattgataatttgaaatgccccaaaacttgagatccctagcttttaaattaaggaaaatgaggcaatagacctaactttttaaaaaatgcactttaaattttagaacttccccggaaaatttttttggggatctctagatgaaggtaaatataatttgatgataaaaagtcacatgggcagatccttctaaatttgtaaatggcaaatcaagcaaattatggaagaatcaatgattcttctctgggcagtgacctaaaactcttctctgggcgatgccttaaaactcttttcttattaggaaaccgtaaggcctcacttcatttaaagggagagggaaagtattcaaattttacctcaactgaattgcctccagagatctgggattgaattctattcactaaggcacattttgtgcagaattgcttcaatgcctgccctgaaaatagcttaattttaagtcatttgctctttaaatggaagctggaagctttttgacttgaaaataatatcaaacacgtagaaaggagagctagtttcctgattagaaacaatgaaaaaaatcatttgagactgtctcccttttctccctattaaaactataataatccctttgcccataaagacaagccatagatcaaatccagacaagagataagtcattggcaaggtagcatcaaaaacattttggtaacatagctagtttatattaaccaaatcttatggtgagaatctttggatgactatgacaatttacagcataggttattttgtcccttctaagtgtttattatttgaccaacataatcttaaatcaacttatgtatctttttctccattttccaagtttaaaataaataatgcagaaagaatatatgtctaggaatatatatatatgtatgtaatatatatataatatttattattgtagcttattccttgcctttgtgtgcacccatgaaatgctaactactttacttgatgacaccgatatagttgtttatgtgcagtgtactaaatgatggtaatataattggtaaaattggctttcacttacccacaatgcaactacaaaatgaaatgacacaaacattagtctcaggaattctgccatgaaatctgattatttgattctgtgttagtgacagatactgtatactctaatgacacattagaagtaagtagcaacattcagagactgctgtctctgcttcaacttttttaatgttttattttgaacaagctctcctagaaaaaaaaaaaacagtgaagaaaaacaccagttttgtttccgtatttctttttaatcctaatttatggttaaagttccgatgttgttatcgacaaaaaataatatatggactaatgtgcaagttatattgttaacctcacgtacatttctgatttactgtgccaagaatctagaacttaatagaagcaatgttaatagaacaggagtggaggggcataccctgtggctttattagtttcttaatttcctttagttcccagatatggtccctcagttcccaaacatggaaagcagttgctggtgacatgctccatgcagatattgtccacccagagttagaaaaactgctgagtacttgttgaataattgctctttatacgtcatcaaaaaggacatgtcctcaaagttagtgctcaagtgtccttgaacataaacctctgggattcattcacctcctgcttcagagatgcttagcatggtgcctgaaatattatctatccatatattacatatataagatataatattatctattaagatagatagatagagataaaaatagatttatatatatatatctcccctacctcatcgaatatatactgagcctgtctttgtttattgaatttgttgggacactacaaaggtacatcaaaagtagatatgcttccccctcaagaaattttataaagtcttaggagaaagtggaaggacttattataactcaagaaatcaagtcatccacaagcaggaaatatttaaactgggttttagagaagtaatgcttttggttgtgaaagtaggcacggacattggaagtgatagtgaataggagaagaacatctcaggcagagagataaacagagagaaagcagatggcccattacaaaagtgtctgaaaacatgttctcagcatcacagtcctgatacgttgagcactaaagtttctgaatgtgaagtgcacagtcaacctttcctttcctaatgggcaagtcaggtaaactcagtacacagaatagctgaatataaatgaatctctggcaagttatagaactactataaatgaacatcaaggttttttttttcacatttcctttggacacatattaaacagttccttttggaattaattatgtaaagaaaaaagtattttcttttacattttaaagacaaagtgagaaacggttattcattgcaaatggtgttagagaaaattaaatgtctaaaatgcatttgcacaaggatgctataaactgttaaaatatcaccaggttttttttttagcctttgctaaaattcttgatttattagcagttcaagtaaaatagaaagagcattctattgttttttgatggaactaaataatcaccacaaactaattgaatgatatgaagtattcagggtctctaaattatgttttactgtaacattttaaatatgtaataacattaacaagacttgaccattcaattataaatacatacagaaattactttaaagtctagaacattacaaaacaattatcctttacatttgttcagccagcagcttaaaagcaaacctatttggaacagctggagcctaaaactgacatttgaaatcacagaggcagtgttttaaaaactgtacttaaagaagccccagttttatactatttcttcatcaactaccctgtttaatgtttttgtctcctgaaaatgtgggtcagaatttttctttaagaattaaataaggggccaaggtcaatctgggtgattaatttcagatagtaggagtagtgtaatatatctgaagcatttgttcctattttttcctgtttatggtgccaccagtccaattctaacactattgcctaaactaattgcttcttattcctcttccccccaccaccctacacacacgtcaatacaagcaaatttgtagccattcaggtcagtgcaaaataatgaattttgtttcaatactgtcatacatctgtttctaatatgtctcggattcagtattattgttgtgtgaaatttgcagtaaaatcttaaaatggaacctccttgcctgggatatgaaccgtgtagtatttcttttctcttatgaaagcagaaggtgttaatatattgccacaattcttaagcaaaactcaccaaggaattgatctagtccagtctgtagtatatctgtaaatcatcacttgaggaataaagtataaataatctcatccttgaaataaaaattcatttgttaaggaattctactaacttatgcttttagtatgtgtggcttcctaaatatattagctaggaaaatgtttctttgaattttaaatatagtaacaggaagaaataacataatttaccatttgaaagtcttaattggaatgggcagataacataattaagattttgcaatggcatataaaattcttagtggatcaaatcacccttttcaccaaaagggaagcgtggtgcatgatattccagtgatatagccagaaaacccagatgctcctctgtccttatccagcactcattgcgaaggagaaaactaggatccttcaggcaagcgaagagtgttaccttcagagagggaagaggaaaggtcttcacaggtgaagcttgtgtacaccttttaaaacaagagtagtggataattaaatggagagattacagagaaaagaagacagtcaaggactaaattttgaaacttctgaatttacagagaaggaaaaaatgcattctaggagatggggaaggagcacacagtaaatcacatagaaaatcaggaatgtgtggtgattaaggaagccgagagaagataatgtttcatggaagagggagttactgactttgtaaagtacactgagaggtggaggtagattaggacaaagaaggaaccatccattttgccaacatgaaactgaaactgattggtgacagtttttgagaaagagtagaaactaaagcctaactaaagtggtgtggaaaatggaaggtgaggagctggagtcagaaaccacagacaactcttttgagaaactttgatgcatggtagctagaaggagaaatgaggtcaaaggtggcttttaaggccaggcgcgatggctcacacctgtaatcccagcactttgggaggccgaggcaggtggatcatgaggtcaggagttcaaggccagcctgaccaacatagtaaaaccccgtctctactaaaaatacaaaataaattagccaggtgtggtggcctgtgcctgtaatcccagctactcaggaggctgaggcaggagaattgcttgaacccgggatgcggaggttgcagtgagcggagactgtaccactgcactccagcctgggtgacagagtgagactccatctcaaaataaataaataagtaaatagtggctttttaatttttttgaggtaattttaggtttttcaaagaatcacagaaatagtacagagttcccatattccttttgcccatcttccccttatgttaatatcttacttaactatagagcatttatcaaaactaaaaatcaacctttgtacaacactattaaatagagcacagaacttattcagtgttttcactactgcatttttccttgtcccaggatcccacatctcgtttagttgtcatgatgccttctctcctcgaatctgagacaggttttcagtctttccttgcttttcaagactttgaacgtttgaagaatacaagtcagttattttgcagaatgctccttggattgggttagtctgatgttttttcatggctagacagagggtatatgttattgaaaaggatatcacagaagctatgtaccctacctcagtgcttcatatcagggggtatgtggcattgaaatgaattcttggtaatgttgaccatgattatttggttaaggtggtgtcttccatgagtctccgtggtagagttactgtttttcctattgtagttactaaccgttttggaggagatactttgagaccacgcaagtttctgctttctctttatgcttttgcccatgaagcttacctccattggtggatcttgtctggggcaaatatgactgtggcattctaatgctaatttctactttcctcttcattatacatttcttacttgaaagtaaagaagagatatcatttctctcctgtttatttagttagcaaataatttattcagttatttaattacctatttatatcagtaagaactccagggtatttcttggtattcttttgtttataatccaatactatctttatttattctcttgctcaggttgctttaactttggctattgggagctctttcaggtttcctcctatgaccttttcatatgccttcttttaatttttcttctttttgttttctattcttttttttcctgtgtatattcttgtatgtgtatacatttccttactttctggcaccacagatgctcatcttctatcttccctgacccagccctgggttcaaacagttctccaaagggccctggttacttttattggaaaatggtatttagaaactgccatctggcccctggtgtgctcgttactagggcagtgtcagtgcttccagccacaggggttgacttttaagatgaaaggtaaggattttgtatgatagtgatgaggatttcaaagagagtgaaaaattgactatgcaggaatagtgatgcttttaggaacacagttattgagaaggaagtggtaataggttccagggcacaagtggaggggctgtgctttgatagaaacttgagacactattcattgtaacagggaaaaagagagaacatggctcagattcaaatagattttgatttcggtagaaaatgaggaagtttctgtttgtttccctggtgttgttaatgagtgttagtcaagatattagctaagagtgaagggaataaaactgatggaagtttgaagatagagatgatattagagagtagaattcaacctaatagtagaattgcaaggctttatggattggcatttgggaaattcgggggtcataaatataaaatgtgacagcatgcttttctggtgcagatgtggagtaggcagatgtatttgaccaacctagaactgcagttttgccagctgactataattgagaagaaagtgagcaagagaaataaaagtatttgtcagtgttttagtgatgtaatggtgggccataaaattaaactggataagggaacacacaggggaaatggtgttagcattattagtctattgtcatagaaaaatataattgagtttggtttatggtttcaaattcatttatataacttagggatattgcaactgcagctgagaaatgtagagaacttgtagagcattattttgtgttcctttaaatcgagtccacaccagtggtgttgccatcttctctacgtttttcttccctgactttttcagttgacctcctacctcttatacatgtcttggtctctaataccctttttctctcatcgcccttcttttctaccaaatcccaatatttcaagaccacttctaaggtgggaacatctgataatttcttaagcagttaagcaagcaaaaaaaaaatgtcattactgcttttgtcagggaaaaggtgatttttaagcttaaggggtcaaagtgagcttccacaaggtcactaaaataacaaatttgagaatcactgacagcatcattgtcaatcttttatctgaaaacatttcctgtatcccaatcaaggtcagataaatgaagccagaaaagtaaaaataaaacctattctgtaggagactccattaacttatctgaaaacaaattgatgcagggatgtggtttaatttttcactggtcagagtcattactttgtgagacatgtttggtcacctttgatgtgtcagctaaatgactgtttctaaaattactttgaccattattcatgagagtgttagtaattactcagtggttaatgaagttggtttccagttgataatcgttagaaactgagcatgacccgttgcacaacagcatactgaacagaagtctcagatgtggcttccctctgcacggtggacttggttctgacctaaaagcactgataacagctctgaaaagagaacattttctaaacaagacattccttgacatgcagaaactctcatttcaatgacctactatgatactatgagtatcatcctcaagctctctctgtgctccaactaaattgtatacaaacatgagggtaattattagatttacatgtgcctctcaactaaattcaaagcctatggcagggatagaagatggcttgccttggaatcccaaagtctggccgatgctggacacagagcaggcactgaaatctgaatgaggcaggcaagcatctctctggcatccaaagtgagtgaagttggagcaatcttcagctcatatcctttataatccagtagctggtggccaactctgaccgtttctttcgccacatagactggtctatggagattcatggtgttttagatgtagaagagacatcgaagtccatctaatctggcatattctcttatataaaggaataaaaaaactctcccaaaaggttaaatgaatttcccaatattacacagctagtgtagccaagccaatgaagtcactgagttaaatatttaagcaggaaaaaatcttttcaatgtctgcttgttgaacagggggaacaaagctctcagaatcaatgtctaagggttaaaatattagcttgttgggaaaaataattaatcactcagttcccagtctacagagcagagcctgagtatctcagtcgttaaatttaaggataattggtctccaaactagtacacaactagtaattcaaaataatttaaaagaaatgctgctttggcaccattatttaaacacttttattttttgttgtcgtgtactccaaaccgctcaaataacaattatactttaacaggcaaacaaaaggtttttttaatccaatttttcctgtttcttgatttaaagggaaaaacaaaactttcctatggaatttgtttaaggagacagaaatgtctatacaattcttagtccttcttttgtgctcaaaaatgtttaatagcttgtggatgaaaaatttcaaaattggagttgcttgggtaaaatatttttatgtttagcaatgaatcgttattggaattcctcaaaacatttcagatttattgccacaacattagccaattttatattatggtagataaaagggacagaactagcatttattaaacatctactatgtgccaaacgtatacaggatttttattttttggtttttgtttttgagacagagtttcgctcttgttgctcaggctggagtgcaatggcacaatctcagctcactgcaacctccgcctcccaggttcaagcgattctcctgcctcagcctcccgagtagctgggattacaggcaggcgccaccacagccatgtaattttgtacttttagtagagatggggtttctccatgttggtcaggctggtctccaactcccgacctcagatgatccacctgcctcgacctcccaaagtgctggaattaaaggcatgagccaccacaccaggccacatatagaggttttcatatatttttctcacttggtcttcacagaaacccgaggaagtattggaacattaaccccatttttcagctatatttacatcagagaagtaacttgaaaaatgtcatacagcagcgtttaattgaatcctagtctgtccaactccaaagctttacctgcatttggtagaaataaatttagattcagcaaacattgttttcctgggggttgtttgaggaagggaacatatcttgacaggtgctttctataacattattttatttaatcacccgaagcccatcttctctttatcacacacttttaataagctgataatttttatgtgagtcttgagtatgcccttttacaacagaaaagtgggaagataagtgttcacctttatgccaataacaaaatgttattatcataaaccagaagcgttccccagaggcagtcagtcttagtatatagctacaaacagatatattagctcaactttaattcatgcaaaactaagattattgtctttgctaaactttcttcaaaattcagttggtcagttccaaataactctgtcaagcaagtgaattcattctctttcctggaggtacgtttcacagctaactattcttggcagacacactgagaatcaatgctgctttaaatcagacatttcgtagaagacttgctacagtttttctgctgccagtgtgggggactgttctcccggtgtgaaatgtttttaagccaaaaccttttctattgcattctgtggtataatgtgaagtttcagtaaaatgtttatcaaagagcctaaacatatctaaccttcttcctgcagaaggacccaaggttgcttctaagtagcctggctgcgtgcagcagcatagaagatgaaaagagcatttcttccaccggaaatgagaactactgtttagtcttcttgacttctctgagtccataatttatccacacaactcacatgttttaaggagatgaacatttattattttttataattgatcccaactttccttatgagtctcatcacaatgggaagttaatttaaaattgcaataaatggtgtcttgttttggttaaaaagctttggatttggtacaacttttgtcatttcaaaatttaaatcaggaccagcactttttcctttttgttctttcttcttccgagatgtttctgagcatcagggagggaaagtgtgaggttttcaggcatgccaacaagcccgtggggaatctggtttgacactggtctgtgagctacaaggctgaagtgtggcctttctgtgcaacctgctggcatctgctgctgaatccctccagctaatataacccagagcctcctctctgtcttcagggactttggccatcatctcttgtttcctgcactccagatgcccttgggtttgattcccactaggaccctcggacaactccagttaaaccttcagacccaagaccacttttctggcaggacctctagcatgtttcccagccagaatctcaacttctttctaggcccttcctgggctacatgggaatctctagattacttccatgctgggcacagtctgttggtgcaaggttatgccaggtggagtggcaattggtccctgatgccaagcagagaacatggcaaaagttcctctgctcccagctttccactgagcctatcaaacacctatcacatctggaatttgaagcatgaatgacagcctcctgactgtgtctcacaatccccagagctgaagaagttgactttatcccccgttccccaattcctctatgacaagaacttacaacattccctctaactatagcatacaataaaactctatgatatacttggcaaagtctcactcttagtatgaaaatagatgattaaaacaattagaatatcatgttcccttatgttccctttctctaaattatggatttgaaaactagatattcttgtgactcacgaatcctgttttgtatacccaactcttattaccctttctttgtttctcattgtacttctgcttcaagtatcccagtttttcaaaggcaaatggatgatcctgattgattagaagacaaatacagtaaaatacaaaaaatatatatggagatattcaagagattattacacttgcattatcaagatagccctatctaaccttatttccagattatatggacaaatatgctcttactagggtaacaaaaacttatcttctctttagctcatgtcaaaagcagactgagaaggaactctttatccaagttaagtgaaggttggtgtcaccacacctctagtctttatctaaagtgttaagtcatcaggaagttgaatcacacttagtttaacctttactgagttattgaaatggtgcccttggcttttatcaatagaaaagccacataaaaacttcttccaattctccttcaattattttgcccattatattatagagtttgctatgcaaaaaaaaaaaaaaaaaatgaagaatctgatagtaggaaaacatctgtagctttcaagaactcagcctacttttatcctactttctccttatcctgttagactgtataatttttcctatttccatttttgtcctgtcatttacatctttctttggaagatgtattcatattattctgtgtatatccttcttatccactgcaaactcttgacatatagatagggtgctgtggtttaaatgtctcttctacaactcatgttgaaatgtaattgccattgtgatggtattaagaagtggcacttttagaggtgattaggtcatgagggctttgacctcgtaaatggatcaatgttattatctcaggagtaggttggctatcacaggagtgggttcctgataaaaggataagttcagccctcatatgctctgtcttatgttcttgcttctcctttctgccttccaccattggatgatgctcactagatgctggcaccatgctctcagacttcccagcccctagaaacatgagccaactaaatctcttctattcataaatcacccagtattttgctaaagcagcagaaaacagactaagacagtagggtataattaatgtaaaattagtccccacaaaactgtatgagttagttattacatgttttacagctgataaaactgaaatttatgtggtttcatactttgttgaagtcctaaactagtcctataattggtgaggccagggtaagaatccaactttcagactaaatcaaatgctccttcagctccaccaagaacatttccattttaagacaaattaaatccctatttaatcaagtaaacattagctgtttaatttgtaatgtaaaaagtagtactgagaagtgattttgaaaataaagcattttatataatgtaaaactgtctaaaccaatgcattagttaataataagctttgataaacaccagaacaaaaattttgtcactattattttagatgtcaatgcaatgtgcctattattgaacacaaagatgcagaatatttgcatataacattaacataggcaaatattgatgattgttattatgatattatagattgtttctaaaaaataacggtgagaataattctattatggagaaatgcttctacttcttgactcatcaaacagtgtatagtgaaaatataatgttaacattgggaaatttcgtattcaaagtacaaaaaagtagagatttttctaaagatgacttgcctttccctaaaaaaaaactctttgagttacatgttgctttatagccctgcgctaaaaaggcacaattttcctctttcaaggtaatcctacttttccaattgtgtttgtggaaaatgctcccttttgattcaagtaactttgctgattaaggaaaacaaaacaaaaaaagtccctaaactactgtaactgagttttttttaacaaattagtactgtccctatagacaatacagaacctgaaaggaaaagaaagaggaattaagcataccagtgactgttccccacgttttcacagaattctgtttaatctgagtttttattatttactttgcttctcctttgagataatcctgccttatttgaggtcagacagaaagcataatttacgatgcctgactgctttaagaaaaccagaagcttcctacattgttctttcctgtacaattggcttaaagaagaggttttctggttagaaaggctttacttcatgttttactaacagcgcatcactttgacttaatactattaggtttctaaagtgactcattcagatgaaaaataaaggtgctgtgattttaaattatcatagaaatgtgagtttaaatattagtaattacctcaaacttgcacatgacctagtaacccatgtattacatgatatacaatgcattgctttttagatcaaacaaaagagagtgtgttatgttttgcactttaaaatccattaactgttctctctcaggagaatgtagactaaatctcaacctttctctctgcagtttatgatggtgatagcagctagatgggggaaaaacaataggtgatgaagttattttaaaaaggccagacagaatgctttttttccttgtatcaggtttcagtctccttcatgatttatgtgtagcatccatggtttctgtgaaggtattcaggacatcatgggcatcaaatacataattaagacataatggaaggtcttggattgaatgggtgaatgtgagccaaggcttgtggcaacatttatagattctaggttagtcagtctcacccccggactcttctttctactccattttttttcatcgttgttttccttttgaaaaagctaccttcagactttctaagtctctctttctataaaaccaggaagggtttactttgattgtaatttatgttgataaggtaacactcctggccatttgtatctttattcctttaaggtctatttttggaatgaaagcctgatctgcttttcaagatgccctaagagttggtgggcaggaaggagaaagaaacttttctttgcctcaataattatgccagacctcagctggatgtggtggctcaagcccgtaatcccagcactttgggaggccaaggcgggtggatcacttgaggtcagtagtttgagaccagcctggctaacatggtgaaaccccatttctactaaaaatacaaaaaattagccgggcatggtggtgtgtgcctgtaatcccagctacccgggaggctgaggcaggagaattgcttgaactggggaggtggaggttgcagtgagccaagatcataccattgcgctccagcttgggcaacaggagtgaaactccatctcaaacaaacaaacaaacaaacaaacaaaagaaatcatgctaggccttacactgagaggatggttctatttaatcatttaaggtacctaatggaaactggctcagaaagccagtgtataccaggtatagattcgttttcctgtttactcctcgtattctaatacatattttctgccttaataaatatttattggactgatatgaatcttgaagtagcaaggtggggtggaggatggttgaatacagcagtgtcaaagaataaaccaatacacgtttattctctgccttcatggataatatataaaatcctgtgcagaatagaatagataatggccaatataataagtgagaggaatggagactcaggggttttgagagtgtgtagcagggcttttagctgagttttgagtggacatacaagttgtctcaaagaagtgacgagctgaggctaagtgactcatttgtcatggatcaatgttcctagccttcagcgatagacgattccttaccgtctcaactacgcacttctcaacattatggctgaccctgctgggatagtcctgaggactgcttctatatatcccaactttcccttcattctagacaaggagatgaattgtactttcatgccacctcagagttaagttgggcaatgtgattctctttggctaacagaatgtaagagaaatgatatatatcatctctaggcagaacttttaataactggctaatgctctgtcacattttttcctccttctatcatgccacatagaggggatgccacgtcctgggtcatcctgggttctggtctgaggactacagaaagtggagcagagccccctcagctaggcaatgatagatgtggaaggcgagtaagaaataaaccatttttttttttttttttttttttttttgctttaagccatcaagatcatgagatggttcacttccacaagataacctagactattctgactgatgcatctgcccacacttcggcttatgttatctcacattcgccagcacaacgttaacacccagtcaaagcacctttaggtcaaaatatgagattagttcctgtatatggtattaaaatgtggcattatgtttttgaggtttgtattatttatcgacaaggaaatatatagcattgatatggcttggctgtgtccccacccaaatctcattttgacttgtagttcccataattcacacatctcatggaggaaccaggtgggaggtaattaaatcatgggggcagttacctccatgcttctctcatgatagtgagtcagttctcttgagatttgatggttttataagggacttttccccttttgcttggcacttctcctttctgccaccatgtgaagaaggactgtttgcttccccttctgccatgattgtaagtttcctgaggcctccccagccatgctgaactgtgagtcaattaaaactctttcctttataaattacacagcctcaggtatgtctttgttttgcagtgcaagaacgaactaatacaagcatcataattaaaagcatgtaatctttgccattctgggtttgaatcttggatcttctacttattacctatgtagccctagtaaagttatttaacttttctgtttctcactttcttcatctttcaaatgaatacaacgatgaggctaccctgtatgtatactataagaattaaatgagaacagtgcctggcacatagtaagcatgatataaagatgagcaattattatcataatcctaagattctatgtgaaaaaattcaccttcttagcgagttttgttgcttaccacattatatctcagaggaaaagttgaaataatctactttaaatattattttttgtttaaatcaaaacctgaaaaatgaccaagagtgagtttatcattactatagtgcccagatcatttgaaaactttcacctcctaaatgtgactttgcttcctggaagatgctgcagaggtaggcagatgattaaggcaccagacattctagtgaagcccagcaatcttctagacccagaggtgatagaaaagcaggaatttctgggcaggtcacctaggaaaagaggccaagtcctcagcagtgccctcatcagccctgatgtgagtcactgtcttgtttcagggcacagagcaacagtgatgtaaacagaatgattactgaggggaaaagtccgaagcaggagaagtgatgccactgtaggagaccttaggatcccagatgcctacaatacaaaaagccacatttcatccaaatctgtagctaaaataatcagttttaacacatttccttcaagcagtttcgtcaacatatctatacagtgtatataaatatcccacagccattcatcatctctttcccatgacatttgcaatctcgtgttttatgcagccagctattatgttaaacctggccaattttgcatttaggcagcattgtgaagtgtcatagcatttgatggaatggcaagattgtaaattgcaatctggtctgtgggaaaaaatattttaaaaacattaaatttgttttagttgcttagctttctccctccccaacccaccacctcaattcttcatataacaagacttaatgagaggaagatcgcagtgcttaagatgtattgttttctttccttttcttcttcttcttttttttcatctataactggaaaaagaagagtagcagattcaccttccaagctggggtggatgggagacagtctttgcataattccattgcattactttaatggtaaatatatcctaaaagaagaccagccttatactgtgttcggctgaaatagcccgttttgaaaatatactgggtggctcctttgcacttgtggactattaacagtgggaagatccatctgcagctgtcagctctctggatagcagtcaacaaatgcatggccatgaattctctacataagtcaaagcaatgcatatggtaccttacattcaagtgaactgacttcaatctgggcagatctcatattttatctctgtgctgttttagcgtctgtcattgtggagaaatttaccattaagatttaagtctccgaaatctggtgcctttgggagttttgtgaaagctcagttcatagtcatgtaaatgtgtagtgacttttcaagttacttttgagaatctaacaatcaacataaattcctttaaatttcaggacttgaaaattcatataatactgtggaataaatgctgtatatgctacgtcaccaaaaagagaaatttaccattgtaaaaagagtaaaaaggtttcttcctccacactagtgccattgagacaccatctcattcaaataaaaaaatgaagtgcaaattcaccagtatattcagactctcttagatcaacagacttggcctgcctgcaatagctaaggcatacatgtgaaactaattttttcctgtggtttagtttatttttcatagaagaaaataaacagatagtgtcaaatattgaaagctttatctggctagaacagaggttcttaaactttttgttctcaaaacttctttactgtcttgaaaattattaaggttctcaaagaattttggtttatgtttgttatatctattgattaccatattaaaaattaaaacttaaaatgttcaaaatttttatttatcaattcatttaagaacaaaaataaacctactacaagttactgtaagcaaaatattttcatgaaaaataactatttttccaaagcaaaaaacttccatggaaggagtgccatttgttttaccttttgcaagtctccttactctgatttaatagaagatagctcatttgaatatctacttgtgcattcaacctgttgtaatatcatatgccatatagcttcggaaaatgccgctgtatactcaaggagaaaacaggaaaaggaaaatgaaatgttagtattttttgtttcttttttttttttttttttgagacagagtctcacactgccaccctggctggactgcaatggcgcgatctcagctcactgcaaaatccgcctcctaggttcaagcgattctcctgcctcagcctcccgagtagctgggattaagacgctctctaccatgcccggctaatttttttgtatttttagtagagacggggtttcactgtgttggccaggctggtctcaaactcctgaccttgtaatctgccccccttggcctcccaatgtgctgggattacaggcgtgagccactgcgcccggccaaaaatagttttgcatagagttactggcttacactttgagacttctgaactcaactctgtacagatttccaaaaagatctgaatacctggataatttttgaacattagtattattttgattagttgtaaactgagacctaaaacaatcgtagcactaatcaaatactttcaaatattttatttctaattaatttatagtttaaataaatttgcattcaaatgtccgctgctactgtcagtttacctttgcttctttgcgcctcttctcagattgctttcttttggttcaggctctccttttgtactttccaggacaaccctgctatttccatgtccacagggtctttcacaattaaatgcaatcaaggttgtgttccctgtaaaaccagggttcgtttgcctggaaagcagcaaacaactgtccatgagaatgcaggttttaattagtaggagtatttgattgtttgtttctgagatggagtctcactctgtcacccaggctagagtgcagtggtgcgattgcgatctcagctcactccaacctctgcctcccaggttcaagcaattctggattctcgcgcctcagcctccggagtagctgggagtatctccaaagtggtgtctccccgagggaaagtgacagtagggcttcactgggcaatgaagaggggacagggtgtatcatcacatgtagaggaggggtcccagtggcgggaatgcagcgagtcattatgccagcacataggtcgcatgttatggtaatgatgctatagtttctctcagggtggagactttagcatggtaattaggaaagatcactcagtttcatctataaagttcctagggtctgtcaggagctgcttcaaactaaaaaagtaaccacattccacactgggtttgaggaagtgaccggtgaagccagctggacttcctgggtggagtggggacttggagaacttttctgtctagctagaggattgtaaacacgccaatcagcgctctgtgtctagctaaaggattgtaaatgcaccaatcagcactctgtaaaaatgcagcaatcagcactctgtgtctagctaaaggattataaatgcaccaatcagcactctgtgtctagtaaaggattataaatgcaacagtcagcactctgtaaaatggaccaatcagcactctataaaatggaccaatcaatgctctgtataatggatcaatcagcgctctgtaaaatggaccaatcagttggacatgggtggggacaaataagagaataaaagctggccaacccccccctcccccaccagccagcaggagcaacctgctcgggtcccattacacggaagctttgctctttcactcttcacaataaatcttgctgctgcttactctttgtgtccttgccacttttaagagctgtaacactcaccgcgaaggtctgcagcttcattcttgaagtcagcaagaccaagaacccaccggagggaaccaatcctggacacagaagaacaggctgcagggcaggaggctgtaaaagaggatgattgcacaagttgattaaattcctataagccctggaaacactccctgtatgtttacagttgatgtgtttattatcagcaaaatagttgcagaaaggcaagacccgaatcatcttagagaatgattctctactttaaataaacgtaaggtaaatcagacctaaatatttccactccagttactgtttccccttccatttttttttcaggcttttattgtttaacaactaataaaaacttttcacatttcaccactcagttttatcagtgtatgttaaagcttctacctttcccatttttctaactgttgccattagagcaagagcaagagatttgtctgggattggggaggtggcggtgaggggaaaggggtgttgttgaactcagggagagtctcacagggcaatagaggtatcatagccaaggtcttaacccttaactttgcatatccagaaacttgattcttagtgctcaggcagaatgagcacaaactaattggaatgttttattctaacctccccaaagagattggacaacaaccacaatgtcagtgcattacattttacttggtaatatgacttccaaagagacttcaataatttcattaactggttggtacatttgctcaccttaatataattcatatgagagggcaaaatataatccaaacaaaggaaatcagtgggatggtctaaatagacattttatcagactattgtaatgtgatatgtcgattgccattctaaatagctattttatctcaatatggggttaagaccagttttccctggatagtgccagagacgtaatctcctccttttggattcactttccccctgattccgtgcgaaacaccacttagagttccttgattttataaagtggtttcatgcctctgcacctttacagatttaggcactgaccccggatgatttggccttgtgtgggctcttttaggtaaatttaagtaaccaataaagaaatctgaggtgagtgagacaggaaatcgttctaataatggctggatgcaggatttctatgcaagggtcttagaagcttcgatccaagggataagtccttcatatcttatttacagaaggatgggaagtgtttctaacatgttttagccaatcttgaatacatttaatttcactgagagcctctctttcacattcctcatgataaataaaaaccactaaattcaatactaaacgtagatttgctgtgctaagcagtagggcttatagctttgaccaagttacagataatggaagacttagtggccacctctggaatgaggcctttcacatgaaatgctaaccaccactggaaagagatttgcaccaattccgattacctccagaactgaaacttaagccaactggcaattactattactctgtctgtgttcaattattttaaagtcaactacagacatggcaaactaattttagtgttactttcctctaaaagcgttttcttatctttcttttagctccaccataccccaaccacaaaatctggtagagatattggtctacttcctgggagagaagtcagtatgggcctttatttgtcctcaccattccttgtgataatttttcatttgtttgtatctctgtctctctagttagctgtgagtagaggtgatgtcttattccacttcacattcaacggtgagtggcaggtagcaggggcccagaaaatgttggatacatgagtcagtgaatggattgccctgggtctcctcttttagattccatgaatgcttttttcctccttttgacacactgtttcctcagctacattaatacaattaattagcttacaccactgtttactaaaatgtttttctctgcaggatattaatgggcactatgcaataaaagattttggtactcaaaaagtctgtgaaatgctgagttaagcaaagtttcataagactctactgtggacttcttaattttaatatactaatatgcactttaaatattcaagaattaaactaagatgagctcctagggtgacataattgagtactaaaaaaaccttaatttagtatttcacacacacacacaaagatcttccaagaaatgtgtatactgtaacattcagaaagaaagaaatcagaggaggctagagagagaatgaaagagagaaagaaagaaaagagaatgtccataattaagtttgtaaaacactcatcaatgcagacatatgttctgaccacaaactcaaattgttctggcttcgatgtaaaccgcgcttattcaacctgttctttaaattctttagtacttttcagcctctgaccttttaacattttcccaattgaatgtctcttcttggggctcagattccattcatatcgcaaaaactcttgacagtatgctaagttattgtatcgtctggttctgttatcatacccttgctataaaattcaatcctggatgaaaccaataatgtgctttcacccttctacctacccagactgcttacaactatagtgtaaacggcacacaggacgcatgactattattctaaattcatgatcaccaataattgggctttcaactctgtccagtaattctactatgtatttctaatcatttcactctctattcatttcagttactatttcaaacaaacgatttccatttttaacctcctatctcccttatctgtgttcatcgcatttatcttgaatttacccatttgtatttagcagctctccgtctcctcaaccaaaatgtgagctccgtgagggtagggaccatctatattttctctcagcgtttctaacactcagcttttgccacaataatgctgcaaaaacaattaaccatagtgagatacaacaataagcatttagttctctcatgactggaagttggcaggagcagctctgctgatctcagtgaggatcactcatggtctgctggttgtctggatgttggtgatttagaccaagggtctgcaaaccttttggttttaattcagaaagtaaatatgttgggctttgcaggccatatgcagtctttgccgcatatacttctcttttttttaatttttaacaactcttttaaaacacaaaaacttagcttgtgagccatacaaaaacaatcacaagctggattttacccacagcccatagttggctatctcctgatctagcgtgtgttgactgggtccctctgcttcaagctgtgggtctaatcgagcttgactgttagatgcaggtgaggttctagtcatttgagctctggagccagggcaagctctactagtgacaatataaaaagcagaagagagcatatgatgcttatgtttcttaaggcttaggtttggaactgggtcactgacacttcagcccaccttttgttagccaaagcaagccaagtggctgaccccaaagcctcagtggagaggttcactttgccttttgtagaaagcacagaaagatacatagcaaaaagtatgaacatagtgaatagtaaagaattgaaaccaataattcaatctcccatatcattatatattgggtatttagacgagcaattagtgcccactaggcccttacaaatttaacaaatgaagggaggattactgcaataattacaaaattaacaacaggcgtgatatagagaacatgtactcagttccaggagccatgctaaacattttacatatatcatatttttcaattcttacatccgtttaggatggctaatattattttcatttatagatgaaaaaactgagtctcatataaggtaagtaacttccctggggtcaattaatattaagttagacctctttctttcactctccaatttctgggttcaggttattctagccattgatatactgaatttatcattgttaatacaagtcaagtttatcacttctagctggccaccatgaaatccatcagtatagctcattacaaatgtagggtggtcatctagtggtgaaagaggaattctataggctgtccactaaagaaaaagtcaataaaaatgaggaaaaaagactctggttcagcttttgttttccattattattgctagaaaagcactgtggcaaaaaaaaaaaaaaaaaaaaaaaaggaactgcctggaaaatctttattagaagaaactcatacatgtttaagcacttttaaagggtgaatatttctgaccaccatctgttaatctgttctgtcctccctttcctaacatttacacaatttcccatttttggctttattcccatctctattggttttggaatcctaaattaatcctgtcaatattgccctcactggcagtctagagtctcccacttatttgataatccatggcagttcctaccatactactcaaggtgacaaaacgttttgaataatttcaataaactgtatatgagaacacaagtaattcacactaacaagtcttaaattggccttctttcctgctttctatcttggaattcttttctcactaattccttgtaaaatatcctcctgttttatctcctgattgagatagatgccatctgatgccacctctcacagatttttttctacctaaaaaccagaagaaagttcttacttccctatttttccttatttttgcttaaattactttttttcttccctaacagcttataatgtgttctacttgcatcttctgtacaccctccacttttgatatggtttggctgtgtccccacccaaatctcacttagaattgtatctcccagaattcccagttgtgggagggacccagcgggaggtaattgaatcatggggactggtctttcccatgctattcccgtgaccgtgaataaggctcgtgagatctgatgggtttatcagaggtttctgcttttgcttcttcctcattctctcttgttgccaccatgtaagaagtacctttcaccctctgccatgattctgagacctccccagccatgtagaactgtgagtccaattaaatctctttttcttcccagtatcaggtatgtctttatcaacagcataaatatggactaatacagtaaattggtactgagagtagggtgttgctgaaaagataaatgaaaatatggaaacaactttggaactgggtaacaggcagaggttggaatagtttggaggactcagaagaagacaagaaaatgtgggaaggtttggaacttcctagagacttgttgaatggctttgcccaaaatgctgatagtgatatgaacagtaagttccaggctgaggtggtctcagatggagatgaggaactagttgggaactggagcgaaggtgactcttgttatattttagcaaagagacaggtggcaatttagcccctgccctagagatttgtggaactttgaacatgagagcgttgatttagggtacctggcagaagaaatttctaagcagcaaagcattcaaaagctgacttgggtgctgttaaaagtattccattttaaaagggaaacagagcataaaagttcagaaaatttgcaatctgaggatgcagtagtaaagaaaagcccattttttgaggagaaattcaagctggctgcagacatttgcttaagtagcaaggagcataatgttaatccccaagaccatggggaagatgtcaccaggccacgtcagagaccttcacagcaacccctcccatcacagtcctggaggcccaggaggaaaaaatagttttgtgggcttggccctgggtccctgcgctgtgtgcagccctgtgtctcatctgctccagccatggttgaaaggggccaatgtacagctcagactgtggctttagagggtggaagccccaggcattggcagcttctacgtggtgttgaacctgcaggtgcacagaagtcaataattgaggttcgagaaccttcgcctagatttcagaagatgagtggaaaagcctggatgcccaggcaaaagtttgctgcaggggcagggccctcatggagaacctctgctagggcagtatggaagggaaatgtggggttatggggttggagctcccatacagagtccctacttgggcactgtctattggaactgtgagaagagggccaccatcctccagaccccataatggtagctccactggcagcttgcatcatgctcctggaaaagctgcagacactcaacaccagcctgtgaaagcagccaggagggatgttataccctgcaaagccacagaggcagagctgcccaagaccatggaaatccacattttgcatcagtgtgacctggatgtgagacctggggtcaaaggacatcattttggagctttaaaatttgactggctcactggattttggacttgcatgggccctgtagcccctttgttttggccaattgcttccatctggaacagctgtatttacccaatacccgtaccgccattgtatctaggaagtaactagcattgcttttgattttacaggttcataggtggaagggatttgccttgtctcacatgagactttggactgtggacttttgggttagtgctgaaataagttaagactttgggggactgttgggaaggcatgactggttttaaaaagtgaggacatgagattcggaggggccaggcgtggaatgataaggtttgtctgtgtccccacccaaatctcaacttgaatttatctcccagaattcccacgtgttgtgggagggacccagaaggaggtaactgaatcatggcggcctgtctgtcccctgttttcatgatagtgagtaagtctcatgagatctgatggatttatcaggggtttctgcttttgcttcttcctcatactctcttgttgccaccatgtaagaagtgcctttcatcctgggccatgattctgatgcctcctcagccacgtggaactgtaagcccagttaaccctctttttcttcccagtcttgggtatgtctttatcagcagcacgaatacggactaatacaccttcctcacatatgcttaattttagccacgcctctccagctctagagatttccatcaacaattcatttttcttacattccattctctctcctttggcttcttttcttttgcctataaacattcaggtgtatttttaatctagaacaacataattcttcacctcatcactcccacaagctactgactcagaatttctcaatacacttctcaaaggcagatcatttatttcttattcctctcttcttctcccactcactctgcccttccaatttggcttttgtctctagcactctattttatctgttcttttgaaattgatcagtgactatcccatcaccaagtccagagacattttcggagtcctctacccagtggcatagattctaatctgggtctgaaagtctaacaaccaggccttaatatcccagttcatgccatcaagctgagagtgaattcatccttcctccatctttgttctatttaggctcttaacttattgaatgatgctcactcacattggggagggccacctgctacagtcagtccaccaattaaaatgctaatttcttccaatatcctcacagattcatccagaaataatgttcaaccagtatgtagacataccctgctccagtcaagttgatagttaacataaagttagccatcatactaaatgtactaaattatcgtgagaagaaatataatgaaccataactgagcaaaaacaaattagaaatttcctctcaataaatacttctcaaaaaatgttgaatcccagttaatctttccggtaaattatttattttcagagagcagcaaatactgatttcttttgcaacggtagagttcaagtatccaaaatgacaagggtggcgcacacaaaaaagagaagctgcctatcatatgaatagtcacacaaagatatctataaagtcttaccaaatgttatccaattatattagaaggagccataatttatcatgactgtatagagttcatcccagaaacataagtttagatcaatatcaagatattttataaaaagaggttaaattaaataattatatcaattaattccatataaatatttcatacaatttaattctcatttctccaaaaagttatatttgttattttatttatttatttatttttgagatggagtcttgctctgttgcccaagctggagtgctgggggtgatctctgctcactgcgtcctccgcctccccagttcaagcaattctcatgcctcagcctcccaagtagctgggattacaggcgcgtgacaccatgcccggctaatttttgtatttttagtagagatggggtttcactccgttggccaagctggtctcaaactcctgacctcaggtgatccgcccaccccggcctcccaaagtgctgggattacaagcgtgagccaccacgcccggccaaaaagttatttttgaactgtgaatagaaagcatattggttaagcccctgacagtggaacaccatacacaaaagcatgaagcagtacatttgcatgtgctttcactgttatacaatgttgtttggatgttcaggcagcagcatacgcctttccttcactacttcctattggggtggtggaaccgagagctagaagaccaggcaatcttactcaattatttcttccttattttacgcaccaagacctgctgattccctctctcctgatcttctcactattcacttctctcttttgcattcttgttgaactgttgagactaattcctcatatcttatctctttttctgggtattttaagtggtcttcttggtggtggagccttatctccatctaattattaaattcttcacaaattatttttctaaaatgcaaacctgctcataattttcttctcattttaaatctttttacagcctcacattaaattttttttaagatgcaatttaaggcagaataatgtagcgcagcccccactttcagatctgaagctgaagccaggcataatatgtaaagcacccagcatagtataacatggactacatatatatgaatgatgtatagcagactagtgatatatagaagatgttgcacttacgttaaaatctccttttaggtaaaatgcttcactcaaatcctctgagagtgcaactgactttattcagagtcaggctgcgtggaaaaaccacttgtgtattccagtttggataatcaagaaagaggcttatttgctctgctaacagaggcttttccactcatgtgcacttaaagctacaaaaggtagatataaccagaagcagttccttctgcttggataaaaattggaaaagctctgtgcattgacatgcacaatcttaggcattgggggcaatttttaaaaaaagaagtggaaaaagcaagtagcagatgttggactcgcagtggcatgtagtggaggcagctgcagggcaactgttttctatctggagagccctttggaagagcttttgaggttcttcaaatatttgattagaatttcatggatgccaatgctatatgagaaagcttaacattttagtgttctgcctaaagttttattgaaaataaaatcctgctaaggcaaacaaacagaaaaagttaaaaaaaaaaaaataccagtgaggttgggcacagtggctcacacctgtaatcccagctctttgggaggccaaggcaggctgatcacctgaggtcaggagtttgagaccagcctggccaacgtggcgaaaccctgtctctactaaaaatacaaaaattagctgggcatagtagtgcatggctgtaatcccagctactcataaagctgaggcagggagagtcacttaaacccgggatgcagaggttgcagtgagctgagatcgccccagtgcactccagcctgggcgacagagcaagactctgtctcaaaataaaaaacaaaaacaacaatgaacaaacaaacaaaaacaccagtgaaaatggcaaatctatggacttcagagtctgacagacctggtttaattccaggctccaattgcaagtgccatcttgggctacttaacgtttcattgcctgaattttctcatctataaaattgaacacttatccccactaatttttccaagtatacagaatgcctagtacctaggaaagggtgctagtcttttctctactcctcaactgttaccatcgtaaaacatgtaagatgtactgggttatacattcattcagaatatctctcaaaggcagaaggactagaattttttctgtgaggatgaacatatcagagtgccttgataccagtgtataaaaatctaccacaggtttatcttagagatacaagatttaaatgccaaaatatttctgtgtttaaatcacctgtagttaaatctcaaaattctttttctgaaaagaatcaaggaaagcaacttccttttgtaagctttttgtttaaaattggactcctaacctttaggggagatggtggcccttaatttatcctgtcctgcaggatttggagacctcctcagcactggcaaggtctgtcccctatccctttcattatatattctcttagctgtctgaaaatcctctatgtacaatgtatgttatttcaggtatggacaattgtcatactttggataaaataataaattaatcccagcagactgtcttctcttttataatgacatttataaattgctgcctcgttgcaacatttagaaacccacaatggtgcaagcctagttctcaagtcactccaaaggtgtttggccttctgaaacctccttacttttcattatgaagcttctttactttccattttcctttgagtcacaaatttctgccaccctgcttctgcatgaagtgtgtgctctgtctagtgacatagctctgctaacccttataagcaggcattttcagtcttgtgccaccaggcctgcatcctgtgccttctaccggggaattgcttaggccagtgaaaactgacttctaaggaaggttttttccttggctatattttttttcatggactcaagaaatgaagctccaggtgatgttttgaaagctagtactgcttctctcttaatctccttactttttcaatatctcaaagtgtggtccatgaacccctggaagtccctgagacctatttaggaggtctgtgaggttaaaaaatattttctttataatgttaagatgtgacttatctttttcacagtgttgacatgtgcattgaaagtgcaaaagcaatgatgagttaaagtgttgacaccttaacacaaatcaagacagtggcactaaactgaactgttgaggtagaaattgtgttctttaccaacatggattcacatgaaggaaaaagaaagccagttccacttaaaaataaccttaatcaagcattaaaaattactgattttattaaatttcaacccctaatgatacacatttttatgatttcgagtgacaaattgggaagtatgcataaagcatttctgttccatactgaagtatgatggttgtctgtaaagaaaacatttgtgtgattgaattgcaaactgaactagtaacttttttcatggaaagtggtatttaccttaaagaacaactgtcagataaactatggttttacagatttcaatatttggcagatttttttgtgaaaatggacaaatgcgcctgtcatttcaagcggtagaactcaaatttgatgccagtggtcacacttgaacttctaagcaaaagttagaattttggaaaagtcatgcgaaccacactgggctggacagcttacaaatatatgaagatattttatgtgattcttagcactattaagaatcgttttatattttataaagtagtggggcagcgtgttaacatttggaaaatctgcacagctcagtgaaccaatattttccaaatgagtaatacataatttcaaaatatcatgccttggcaaaacaattatgccagatagaccaataaatttcaatgtaaaaaaaaacaatgaaaagttcactgatagggttgtaaatattggcacgttccaaatactctttaagaaacgcacttgtagacttttgtatagtgtcaaaaaagatccatacctcaaactgtatacaaaaattaagttaaaatgaatcatagacctaaatgtaaacccaaagctataaaactgctagaacaaaacagagaagaaaacttcatgactctggttaggcaaagacctcttaaataagacaccaaaagcacaatccgtttgttaaaatgatacattgggatttgtaagaactgaaacctctgcttttttgaaacatgggtaaggaaatgaaagataaatattttcaaattatatacctgataatgggcttaccatcagactatatcaagtattttcaaaactcaaaggaaaaatattcagttaaaaaatgagcaagaaaggagatggagcaagatggctgaatagaagccttcaccagtcatcctccctgcaggaacaccaaattgaacaactatccacacacaaaaattaccttcataagaaccaaaatcaggtgagtgatcactgtacctggttttatgctcatattactgaaaaaggcaaggaagaggaaaggaaagacagtcttgaattgctgtcaccacccctcctgcaccccccagcagcagctgcatagtgtggagcaagaatctgtgtgcttgggggacagaaggcacagtgattgtgagattttccattagaacttggtgctgccctgtcacagtggaaaacaaccctggccagaactcagccagcactcacagaggaagcatttagaccagccctcaccagaaagaaattgcccttcccagacgtcagaacctgaattctggtaagcctcaccaatgcaagctaaagtgctcttggattctaaataaacttgaaaggcagtgtaggccacaaggactgcaattcctgggcaagttctggtgctgtgcttcgctcacagccagtggatttaggggtatgcaacctaatgagataatagctggggcagccaagggagtacttgcaccacccctcccaccacctcaggcagtgcagctcacagctctaggagagactctttccctctccttgaggagaggacaaggaaaagtaaagaggactttatcttgcaacttagataccacctcagccacagtaggacagagcaccaggcagaatcctgaggcccgcattccaggccgtaccttctagacaacatttctagacatgtactaggccagaagggaacctgctatcttgaagtaaagtacttagtcctggcaggattcatcagctgctgattaaagagcccttgggccctgaatagtcaacagtggtagccaggaagtactcaccatgggccttgggtaagactcagagacaagctggcttcaagcatgacctagcatattccaagccatagtggctacagggagagcaaccttctgcttgagaaaaggggagggaagagtgaaggagactttgtcttgcagcttccttaccagctctgtcacagttaggtagagtaccaagcaggatcttggggtccctgattctaggccttagctcttggaaagaatttctggacctgctctgctctgggtcagagagcatcctactgtcctgaagggagagtctcagacctggtagcattcagcacaagctgactaaagagcccttgggccttgagtgaacattggcagtagccaggcagtacttgctatgggcctggatctatgccagccacagagagagactcctctgcttgtggaaaagagaggaaagagtgggaaggacttcatcttgtggcttggatgccagttcagcctcagtagaatagagcaacaggtagatttctaagggtttcaactctgggccctgctcctgtatggcatctctgaacctactggggccaggggcaactcatcaccctgaagggaagaaaacggcatggctagttttgccacctgctaattatagaaccctagggccttgagtgaacgtaagtggtagccaggcaggccttgggtgagactcagtgctgtgctggcttcaggtctgacccagcacagtcccagtggtggtggccagagggtgcttttgtcacccctcccccagctccaggcagctcagcgcagaaagagacagaaagagagatagcagggtggagagagagagactctttgtttaggagaaaataagggaagagaataagagtctgtgcctggtattctagagaattattctagatcttaactaagaccatcagggcagcatctctatgagtttgcgcaagccacagcattattgagcttggggtactccctaatgcaaatatggctgcagtgatcaaaaacttagattacaacacccaaatccctatgaatacctggaaagccttcccaagaagggtgagtacaaacaagctcagactgtaaagaccagtaaatacctaactcttcaatgcccagacactggagaacatccacaagcatcatgaccatcgaggaaaacagaatttcaccaaagcacttaaataaggcaccaggggccaatactggagagacagagatatgtgacctttcaggcataatttgaaatggctgttttgaggaaactcagtgaaatgcaagataacacaaagaaggaattaagaattctatctaacaaatttaacaaagacattgaaataattaaaaacaatcaagaaattctgcagctgaaaaatgcatactgaagaatgcatcagagtctcttaagagcagaattgatcaagcacaagaaataaatagtgaacttgaagacaggctatttgaaaatacacagagcagacaaaagaattaagcccacccaccagatctagaaaatatcctcaaaagtgcaaatctaagagttattggccttaaagagaggtagagagagagataggggtagaaagtttcctcaaatgataataacagagaacttcccaaacttagagaaagaccaatattcaaatgcacaaaggttgttgaacagcaagcatatttaacccaaataagactaccttaagacatttaataatcaaactaccaaaggtcaaggataaagaaagaaccttaaaagcagcaagagaaaagaaattaataacatacaatggcgctccaatacatctggcagcaggttttcagtggaaactttacagggcaggagagagtggcatcacatatttaaagtgctgaaggaaaaagaaaaacttttatcctagaataatatattcagcaaaaaatatccttcaaacactcaacagaaataaagaccttcctagacaaacaaaagctgagggacttcatcaacaccagacctgccctacaagaaatgctaaatggagttctgcaatatgagagaaaaagacattagtgagcaataagaaatcatctgaaggtgcaagacttgcttgtaatagtaagtacacagaaaaccaaaaacacagaatactgtaacagtatacttgtagcatgtaaactacccatatcttgagtagaaagactataaagtaagccaattaaaaatagtaactacaacaactcttcaagacatagacaatacaataagatataagtagaaacaacaaaaaattaaaatgtggggaacaaattcaagtgtgaagtttttattcattttcttttttgttcatctattagttgttagcttatgtaatcaatattaagttgtcaccaggttaaaataaaggattacaagaaatcctttgcaagcctcatggtaactgtaaatcaaaaaacatacaacagatgcacaaaaaattaaaagcaagaaattaaaacataccaccagagaaaattaccttcactaaaaggaagacaggaaagaaggaagataagaccacaaaccaaccagaaaacaaataacaaaatggcaggagtaagtccttacctcttatcaataacatcgaatataaaagaactaaactcttcaatcaaaagatgtatagtggctgaatggatttaaaaaacaagacgcagtggtttgttgcctatagaaacacattttacctataaagacaaatatagactgaaaataaagggatggaaaaagttattccatggaaatggaaacaaaccaaacaactaaacaaacgaacacaaaacaaaaacaaaacagaaatagctatacttagacgaaatagatttaaaaacaaaaactataaaaatagacaaagaaggtcattatataatgataaaggagccaattcaacaagatgatataacagtttaaatatatatgcacacaacactggagcacccacatatgcaaagcaaatattattagagctaaagagagagatagaccccaatgcaataatagctggagttttcagcaccctactttcagcattagacagttcatccagacagaaaatcaataaagaaacattgggccgggcgcggtggctcacgcctgtaatcccagcactttgggaggccgaggcgggtggatcatgaggtcacgagatcgagaccatcctggctaacaaggtgaaaccccgtctctactaaaaatacaaaaaattagccaggcgcggtggcgggcgcctgtagtcccagctactcgggaggctgaggcaggagaatggcgtgaacccgggaagcggagcttgcagtgagccgagattgcgccactgcagtccgcagtccggcctgggcaacagagcgagactccgtctcaaaaaaaaaaaaaaaaaaaaaaaaagaaacattggacttaatctgaattatagaccaaataaaactagtagatatttacagaacagttcatccagtggctgcagaatacatattcttcacctcagcacatggaccattctcaaggatataccatatgttaagccacaaaaaaatcttaaaaatgtcaaaaaatatcaaattatatcagctaacttctctgactacagtagaataaaactagaaatcaacaacaagagaaattttggaaaggatacaaacatatgtaaattaaacaatatgctcctgagtgacctctgggtcaatgaagaaattaagcagataattgtaaaacttcttgaaacaaatgacaacggaaacacaacacaccaaaacctgtaaaacataccaaaaaccagtgaaagcagtactaagaggaaagtttatagctatacgtgcctacatttaaaaagaaaataaacttcaaaaagacaacctaacaatgcatcttaaataaatagaacagaaaagcaaaccaaacccaaaattggtaacagaaaagaaataatagagatcagaacagaaataaatgaaactgaagagaagacaataaaaaaagtcaatgaaatgaaaagttggttttttttttgcgacgataaacaaaatcaacaaacctttagccagactgagaagaaagcaaggaagatacaaataaataaaaccagagataaaaaaggagacattactactaataccagaaaaactcaaaggatcattaggagatcattagtagctcattagtagactcattagtagcttctaatgatcctttgaatttttgtgatattagttgtaatgtgtcctttttatatgagcaactgtatgccaataacttgctcatataaactggaatatttagaagaaacaggttaattcctagacacttgcaacctaccaagattgaaccaggaagaaatccaaaacgtgcagaccactaacgaatgacaagagtgaagctgtaataaaaattctcccagcaatgaaaagctcaggacctgatagcttcactgctgaattttaccaaacatttaaagaagaactaatatcaatgctactcaaagtattctgaaaaaaatagaggagggggaattcctccaaactcattctacaaggctagtattgtcttgataccaaaatcagacatgggcacattaaaaaaagaaaagaaaagaaaactacaggccaatatgcctgatgaatgtttatgcaaaactcctcagcaaaatactaggaaaccaaattcaataacacattaagcaaatcattcatcatgatcgagtgggatttatcccagggatgcaaaaatggtttgacatatgcaaatcaatcatgtggtacaccatatcaatagaatgaaggacaaaaaccacatgattatttcaattgatgctgaaaaagcacttgataaaattcaacatccctctattataaaaaccctaaaaaactaggtatagaaggataatacctcaacacactaaaagacatatacaaaaggctcacagctagtatcatactgaatggggaaaaaccaaaatcccttcttctaagaactagaaaataacaagaatatccattcttgccactattattcaacataataatggaagtcctaactagagaaatcagacgaaagaaataaaggtgtccaaattggaaaggaagaagtcaagttatctttgtttgcatatggtatgatcttataattggtaaaacctaaagactccaccaaaaaaaaaaaaaacattaaaattgataaacacattcagtaatgtggcaggatacaaaatcaacatataaaaatcagtagcatttatatagccaacaacaaacaacctgaaaaacaaatcaaaaaagtaatccaatttacagtagctataaataaaaataaatacctaggaattgacttaaccaaagaaatgaaaggcttacacaatgaaaactataaaatattgccaaaataaattgaaaagaatacaaaaatcaaaagatattctatgatcatgtattggaaaaatcaatattattaattatctatactacataaagcgatctagagtttcaatgtgatccctttcaaaataccagtgacattcttcacaggaatagaaaatacaattctaaactaagtgtccatcagcagacatatggtatatggaaccacaatcgacctagaacagccaaagctatcctgagaaaaaggaacaaaactggaagaatcacattatttgatctcaaattatactacagagctaatagtaactaaagcagcatagcactggcatgaaaacagacacatagaccaatggaacagcatagagaacccagaatcaaatccatacatctacagtgaattcattttccataaaggtgccaagaacatacattgaagaaaggacagtgtctttgataaatgatgctgggaaaactggatattcatatgcagaagaatgaaactagacccctatctctcaccacataaaaaaatcaaaccaaaatggattacagtcttaaatctgagatatcaaactatgaaactactaaaataaaacattgaggaaactctctaggacattggcctaggcaaagatttcttgagtaatactgcagaagcacaggcaacccaagcaaaaatggacaaatgggatcacatcaagtaaaaaatcttctgcactgcaaaggaaaccatcaacaatgggaagagacaacccacagaacaagagaaaacatttgcaaactacccatctgagaaggaattggtaatcagaatatataagaaactaaaaaaattaaataggaaaatatctaataatttgattaagaaatgggcaaaagatctgaatagacatttctcaaaagaagacatataaggccaggcatggtggcttacatttctaatcccaacactttgggaggctgaggcacatggatcacctgaggtcaggagttcgagatcagcctggccaacattgtggaaccccatctctactgaaaatacaaaaaattagccaggtatggttgtgggtgcctataaacccagattctctggaggttgaggcaggagaatcgcttgaaccggagaggtggaggttgcagtgagccgagatcgtgtcattgcactccagcctgggcaacaagagcgaaactccatctcagaaaaaaaaaaaaaaaaaagacatacaaatggtaaacaggcatatgaaaaggtgttgaacatcactgatcatcagagaaatgcaaataaaaactacaatgggatatcatctcctacttaaaatggattttatccaaaacacaggaaataacaaatgctggtgattatgtggagaaaggtgaaccctcatactctattgttgggaatataaattcataccatcactatggagaacagtttggaagttcctcaaaaaactaaaaacagagctaccatatgatctagcaatcccactgctatgtatataccccctcccctaaagggaatcagcatactgaaaagatatctgcactcccatgtttattacagcactatttgcaataaccaatattttgaagcaacctaagtgtccatcagcagacaaatgggtaaagaaaagtggtatttatacacgatggagtactgttcagccacaaaaaagaataagatcctatcgttggcaaaaacatggataaaactggaggtcattataataagtaaaatatgcaggcacagaaaggcacacttcacatgttgtcacttatttgccaatgctaaaaattgaaacaattgcactcatggggatagagagtagaacaatggttaccagaggctgggaaaggtagctggggggagagggttagtggaggtggttaataggtacaaaaatacggtgagatagaatgaataagatctagtgtttgacagcacaacaggttactacagtcaacaataatttatggtacatttaaaaataactaaaagagtataattggattatgtcaacattgaggtgatggatttactctgatgtgattattatgcattgtctgcctacatcaaaatatctcatgtactctgtaaatatatgcatcaaacatgtactcacgaagattgaaaatgtttttaaataataaaaataaatgagcaaaacatctgatcagacattttttcaaggaagagacacctgtgacaaattagcatataaaagatgtccaaaattattaatcattagggaaatataaaaagcataagttattattacacacttattaaattttttgttcttttaaatgtattactaaagtataatttacatacagcaaaatttaccctttttagtgaacaactatgtgagttttgacaagcagaggtttaagtttggacaaaattcaatttatcactttttaaaagtgggttgtgctttcattgtctaattatttaaaagatctttgcctaaagaagaggcatgaagcttttctcctatgtattcttccatcggttctatagctttaggttttacatttaagtctatgatttattttagcttaatgtttctattcacttctatctattgtcttcaagtcaatagatagaagatttccatcgcctgccccaaaattcccctgtatctctttgtcaaattccttcttccatcatagcccctggaaactatggatctgtgtttttgccttgtagttttgcctttccagaatgtcatataaatagtaccacatatatagctaaaatgtttaaaataaagaagaaaagacaacagtgacaggtactggtaagtatgcaaagcaaatggaactctcatacatcagaatgcatattggtacagccactttgaaacatgtttgttgtaggaacagaaaaccaagtgctgcctgctcttacttataactgagagctcaacatagagtacacacagacacaaaagaacaatagacactggggcctacttgagggcgtaggctggaaggagggtgaggatcaaacaactgcctatcgggtactaggcttattacctgggtgacaaaataatccgcacaccaaaccctcagagacacccgattttcccatgtaacaaatctgcacaggggccttctgaacctaaaataaaagttggaaagaaaaaaaaaaaacagtttgagagtttcttaaaaaaaagttcagtacatagctaccatatgacccagcaattccactcctagatattttcctaagtgaaataaaagactatggccacacaaaagtctgtgtgtaaatatttatagcagctttatttgtggtcatcaaaactgaaactcaaatttcctttaactggtgagtggataaatcgtgatacctctatacaatggaacattactcagaaataaaaagggacaaactgatatatgcagcaacatggatgtctctcaagtgtattatgctgagtgagagaagccacactaaaaggagaatggtcccatttatacaactcctcttatattacattttggaaaaggcaaaacttcaaggtaggaaacagatccctagtttccagggactggggtgagaggaggagttcaacaaggggaatggggaatttgggagaataatggaactcttctattaacttgagtaccacatgcacttgccaaaacactaaaaaaggtaaactttggtagatgtaaattatgccttactaaagatgttaaaaagaaccaaaactttttttgttaaaaaaggaggggtaaagtagaggtaggatccaaactcctctttttttttgagatggagtctcgctgtgtctcccaggctggagtgcagggtgctatctcggctcaatgcaacctccgcctcctgggttcaagcgattctcctcctgagtagctggaattacaggcgcatgccaccacgcccggctaatttttgtatttttagtagagatggggtttcaccatgttagtcaggctggtctcgaactcctgacctcgtgatccgcctggtttggcctcccaaagagcagggattacagatgtaagccactgcacccagcccaaactcctcttttttttacagctgaaactgataccagataatgtagtgtccctttgtggagaagttattgaagttagagactgtgcccaacaagagctggccccaggcccagggccaggtttccatatctaagcttactgcatggtgagaccagtctgaacaatgctctctgcaggtagaccacaagagacgggtgatggaagaagctgagctacaggtattctggtcctctcccaaaccctccaatcaggcaattcactccacttccgtcagaggagtagtggtgggttttcaataaatctctccttgtagaaaacagaaatgggaaagaaaatgtgtctgctcatattgccaatcaacatttctttcatgaaaaatttaagcatattggaagctaacaaagtgtaactacaggattttttttaaatttattttccagcaagtgcccaatcctcctaaatcaccatctctagaaaactcatttttctgcaagaaatcatcaaatgagcatgttccactgcttatacatgttctaaatagatgatataggttccgctgcaatattcacttgactctgtgtcatttaagtctccgtgactttttataggtacagattttatagcagccagggatcatgtctgtttaattattgatgcatagtgcctaacatagcatcgtggagatataatcagttaaatattacttctgattgatatgacgatgtgtacacatcactttaagtatgaattttttgtaatttagtttattcatccatcatctctctgctctcaagaatttttctttactaaaattctcataatttaatgcaatttttatttaaaaaatatccatgcacaactagaacctgaaaaaattgactgtaataattttaaaatttgaggcctgcgttaacatgtttttcggtaatgatcatacacttattcacctaacctatttatgttttctttggattcactatttttgaattcttgctaccattttaaatggtatattaggttctaaaatgaacctgtaggagaggtcagttcaataaatgaaattcgctttcaattatatatattaataatttggtgagctatggtaaattatttgggaatttgggtctatatattcttctcagaaagtaagcccagagatactcagaggtgctaccaattggggattgtaatggagctcttgattctattacatgcatcacagactttctggtgtacccccaactgaaagttcctttaaaataagcctcagggaccatagagagattgatcatttatctgaaataatgttatttctgtggtttagtctgtttgtgcaacctctggaaaatattttctatcttatcttataataaaaatgtattgttcaccattggaggaatctattttagtgacctattttgggtattttcccgttatggcaaataatatacttttaatgtattttttataatgatgctattctttattcatttttataaggaagtacataatctagtacataatcatttaaaagcaaaaggcaaaagattagcttatgaaccagaaaagtatatacttatatagttacatatagtacgctaacattttataaatcaatatgaaagaaacagaaattgtgcaaaaaatatgtatgctttaacagaatataggccgtttggcagagtgttttctttttacttgttaaaggagtacactgaagcactaggttttattcatcatcaagcctcatttttctgctattgtatgagaattcaataagtgaattttccagataactgaagtataattttaatattcttcactgtacttatttaccgttctaccctcaatgggaagtactctaatattcgttaaatattatatgaccttcctaataaaacactttgaacacaatataaacttttcttgataacgtggggtcactattaaaaccatgttacctcaattgtaagacttcttcctattagggaacaccactgctacaaaaataagacttccagggaaaaaaataaagcaatattaaatatactaattgacaagatacatacatctcaattgcaaaacattaaaatgtgggcgagaagaaattacatattcaaatgtagaaactgtgttgatattaattttgtttttttattttactttaagttctgggatacatgtgcagaatgtgcaggtctgttacataggtatacatgtgccatggtggtttgctgcacctatcaactcgtcatctaggttttaagccctgcatgcattaggtattatcttaatgctctccctccttttgccccccaccccccaacaagccctggcatatgatgttccccttcctgtgtccatgtgttctcattattcacctcccacttatgagtgagaacatgcagtgtttggttttctgttcttattaattattaaaatgttccctcaatatgcagcaaaattcttttgctgttgggtcctctcctcattgctggcagactctgttatcacttttcacccacatcacttccagtgtcaactcctgtccattcctttctattgtgctgctgccctgagctgctggctgtgagttgtggaaacccaaagagcaagctagtcactaattatgttaaataatgctgaataatggcagtaagattcttcccttaggccctaaggccgtactttagtgctgaggttttgcaacaactgctactgtgctcagaggtggtgcctcacatctagtgtcaggtctgtgttgtaatgaaccggaattgccaggaacttgtactttggatgaatgatgtgtcaagtgcattaagaatcttgaaatgcatcctatatagactacttactaaaattccacaatcttgcattctcatagcttgaaagaaatatacaaaatgcagatactaccacaccctcatttcagagctgactttatcaggaaacatactgagatctcaaagacaaggggatgtggcgttgaaacgggaacatgagagccgatggatactgccctttgctttgctgtaagggccagtggccttgaggccccaggcacagtcacccacatctgtggcaagcatcatggtggcatttccaggtgagtaggagagagtgagaaataagtcagagaagaaatccaagtcttaggtgactgtcagtcatgaagagaacactggcaagagttcttcataacaggaactcagttacaggcttcgcaggggtttgaagaaaaacgggaccttctgtaagcccaaaggaagtatatggcaactggcccatgtcttaaagctccagaggagcaggctggagttccagctgataattggagtggctgaagggaaactctgggaaggcccagatttcaaagtggatcaacgggaaataagtagagaatacaatcactcaaggggtacatgatgtttggatttctcccttctatgagagagacaccatgtatatcaggaacaaagatcaactgcagccatcaccaacaggtggggtttaggagcccgatttgctttttgtgagggacctggtaagtctgagcctgaagatcatgaacacatatgccaacttcccttgtgagaaattaggaaattctagagaagtcaagaagtgacaaacacttcattgttttgagcatttgtggtgccacgaattggaatgtaccatcacatgatttagccaaaagtctgtttaaaagtcaactatttgccactcaagactcttctggcccgagacaagaaattcttgggagaaagtggacagaaatgtacatgtgatagacaggaaatgaactgatcggaataagtgtgaggagtggagaagaaaattctatggaaaatgtgaaattgtatggggagaggatgcagaaaatatggattgagaaactgtgagagccaagccttcaaaccagtatgttcttttggggatatttcaaagcctagagccatttctactccctccctccctttgcttccaatgccattgatttatctgcttgctttccatttcaatacttgccactgtccactgcaaaaaaataatttttttgtacctctcttctggtatcaaagcaatttgaaagggttctattgttcatatagtttttgatgctgttgtcaaagatatcagtacaaataatagagagaaccagtaaggtaatacatattttcttctttcccttctccccatcattgtatattccacagttctttcacatattctgtgaataatatactctgccaagctttgagatttaaaaaaaggaaacgtggttatagtgtcctcttggagcttacagtcaggacagagacatgaacaggaagaaaatcttgtccttagagggagtggagcagtagagagaagaggaaagaattgagcaggatgtggtctcaggtagtcctaaccacttaagaaattatagcttagagttttagtaacctgcctaaggtcacatagttaataaagagtaaagttaatgttaggtattgatgaattaaaaattcatacactttctataccaactttttttctgcagagaatagacctaagagactcaagattttatacttactcaactatgttgatgatgaagggccattctaatgaggatgtccttgactttagagtttgagctaaacttggagtttgatagaggttatattcattagctttgaggacaaaacaaaagaaacaacaacaaaaaatacttgaggttattagctagttttcagaattttagataattgtttttatatgatcatgtattcatgcacataatattttcttcactggtatctattacaagcgagaagatatttcagagggggtttacattaatacacggcttgtgtcatcaggaaatgaaagaattgaggaaccccttaaccctggaaatttacaggccactatttaaactatagtagagtcattttgcttaatcttttgcataattattttgattcctaacacttcactgttgaaagggcatagaatgggaaagctaaagtatgcctgggctataaagctttagaaatctctcctttagataattttaaatagatctaattcaccttctgtattcatccaaagtgaataactgtagaggcagtgaaagtatttattcatcaacatttggacccaaaccatgctaacaacaagccgcttcacaatacagtcctcttatcatgtagtggttaagttgacacttggagctgctgttgtgtagctatgtaaattaggcatgatcctctgctttggttttcttgcctataaaataggagcatagtattccgtgtagagtccttgcacaagtgctgggcatggaatatgaactcaaaaatgctaagtatcatgattgctttgaacttcacgctagctgtttttccattgcagttcaaaatgcaagtctctccaaacctctctactttcttaatattctgtcaacaaatcattgtaatcttccccctactaacattctcccactgttgcccattgcccccatcctattccctttgctctttgaaacttcggtttcaattgtaaacaaacacttgtaaacctttaatatttcccctgacaatttttctacctcaatttcttgtcttaattgaaatttagatttactctaatgggaatgctttctgttcagccattcaaaggagatgagagttttgtgtgtgtgtgtgtgtgtgtttgtgtgcgtgtgcacctcatgatcaaaagacaaaatatgaataaagaattggagagttttcagcattcttcttattctgcattactcttctttcaccttacctaaaaactttttttaaaacaattatgtcatctggctggaccgctatgcatatatcctaattcttagcatattctggtcttttccctaagttcaccaattagtttgaaaggagaaagtgggcagtggaagcagaaggcacagtcttccttctcctcccctccatagggctgaggtttacagtgtgtggacctttagggatgctgaaagaggaagcgatacttccttccaaagtgagaaaattggctgagaaataggaagagatcagttcatgaatggacttcttaagcaaagaaatttgaactttatcctaaaagctacaggaacctactcaaggattttgagtaccagagagaataatcagatttgaatttccgatcactgtagctgcattttgaaagcttttgctagacatgacataaggctatatccaaccagattaggtaaaggaaggatttaaaacatattatggaagtagattaactgggacttggggaatgtttagggtaatagtgggaggggagcctgaagaggcctccaggcttctgttttggcaactaggtaaatttggatactattctatattgtcataattagaattcctaatgtatgaggttatcttaaagattaaatgacttaatacgtttaaagtcccgtaaaccattgctgatatgaactcttttatttgcagaggcactgactgtagaaatgagtttaagtacaatgtgaaggaggagaggagaggtgactaacgatcattagtttagttttaaagttgagttaggagtgggtccactgtaggacatccatttagagatacagaactcagcactcaacacaatactttagcttgcagctatgaactgaagggtcttaagtacagtgaaagtcatgaattttaagtcattaaatttattcaaatgtaacttctgtaaatagagtgcaatgatgatcgaatcaaaaaacaaatccctgagcaagtctgttttaggaaagaggcagagacagagaggggagcctaggaatgatgaaacttggtagacagaaattcaggggacatccacagacattaaaagagttgaaaaaaggagggaatgtcagcactgtaaaatgttgccaaaagttcattcaatataataagtgaagttcaattagaataagcactgaaatatggattaagtcataaagaggatgttggttaatgtgtctagggatatttccataaagtagtaagagttgattcctgacttacaggtgtgacatctgcagaaatgaagaaatgagagaatgagacctctttttccaaagtttggttgggagaggaatgagacagagatgaatgtaccgagagtgaaatgtaaccttcttattaattatcattaggtggatgtactggagtatacttatatatggaggagcaagagagaggacagtgaggggatccaggcatggaggagaggagggaaataactgacttagcaaggtatctcaaaagtggggcatgctgggatcagaggaaatgggttacattagacaggaagaatgcatccttcctgtcacaggagggaaggtggaaagataggcacaggcagtgataggaaagtgtttctaagggacaaaattgaggtaatttctccctgaagggctcagtgaagtgggagtcagagtcatttactgagagacagaggaaaagaggttgtgttggaagtttaaagggaaatctaaaagtttgaaataaaagcagaataaaagagctgtctaggtctatgtaagaaggtgtggggaccaccccaaggccctacctgagattagaaatcatgaattcctggtggcttgttttcacaaggctggttgttactccgtaagaatcttctcactgcaaacgtcccatgatcgttgctcagatgtcttgcctagatgctgatctctgcacttctccatttcaccttcagcactccctttgactgatcccagactcacagatctgaactcttcttcaacactgcttcaaagtgggactccagaccccttatctggccattttcacagaccctgcctgctcggtccttgggctaacattgcagaacctgacttctgatgcacctgacattctgacaactgcaggaaagcttttacttggtagccaggcttccaattttaatcttacttgaagatctggatttgaaagaacaaccgctttatgagcaagtgattaccaaacctgatttggtggaagcccagcttgtctctagatatcctcagggaacttgttgaaattattttttgccaagacaatgtaaaattcactttaacatatataccttgggcaaagggatgggaaattaaaaaccatagggaactcagcttctaataaaactgaccctctttttggtaatagaacattgtgaattacttattgagatattctccacccctacaaatattaagtagtgcagcgattacagcagagacagcatactttaagaatgaagatgttactgagttctgcagagctaattacacataaggtctatttcttaacctgcagttgccagggtttgcagcaactagtaaggccaaactgatttggcagctggggcttggggagcacgggtaggggatgggagtctgcagagttctccatttagtagagtgccacattgccgaagagcgactctcctctcacattacctcctggaggctggactggatgttctccttgaagagaaaaaaaagtaaattggaaccccaacagaattattaagaatgttcaggttgtctataagaaggaaacactgatgccttggtcttcatgttgatatttacttagcaggacctgcagggtctgccgaggtactgtctgaatgttggggtggggaacactgggaaggtacttagggggcatcagggattacccctggggctcccagtgctggaggtggatgtgaggtgagtactgccatgtgggccctgaatcaggtcccagagtgtggataagatccagagttgcagaattgcagtggaaaagaaaggctcacacatgagaggaatactgtgtgagagccccacagggccgccaactctagatgtggctgagggtcagaagggaccgcctgtgcttaggaaggttgcatgaattaccccagcagcagaatagcttgagatctccatccacccacaactagtcgatacataataagtgaaattagcagaacagatcaatagagggcacagaagctttgtgatcatcaattatatcaacagtggagatttctcttgttttatccatctgtattattcaggattctccagagaaacagaacaaataaaccatagggtgtgtgtgtgtgtgtgtgtgtgtgtgtgtgtgtgtgtaagtgtgtgtaatgtatatacaaataaatataaatctatatatacatgtatatacacagaggtatatatgtatgtatatctctatataagagatttattataaggaattgcctcgtggttatagaggctgacaagtcaagacccagagagccaatggtagagttccagttccagtacaaatgtccaaaggcctgagaagcaggagagctgatggtataaattccagcctgagtttaagtccaaaggcaggagaagaccgatgtcccaacttcaagatagtcatgaagagaaagtgaattctccctttctcagccttttggttctaatcaggcattcagtggattggatgaggtccactcacattggagagggcaatctactttattcagtcttctgactcaaatgttaatctcatccagagacactctcacagacacacctacaaatcatgcctaaccaaatatctgggcacttcatggccagtcaagttgacacataaaattaatcattgcaccatcccaatatgagacatttaaaaataaacaggatttctctttataattaggttgaaactttatatagctgtcaatgactaaaaacgcatttaatcaggccaaaatgttaagggagccatgcaatatttgggacacacttatactaaaatattaatattaatatactaatataaagtattaataaataatattatttatctgaaatccaaatttcagtaggcatcctctatcttatctggcaaacctactaccttcccctataccagaataagtaataatttcagttaggaaattggagagacataattgatttcattcttttgacacactatatatgaaaaataccatttcatttgctgcaatggaaaatgccttgggaatagcaaccagtaaaacatgttagtgtgttgacatttgaaaagaaagttataggattctttaactctctacctctaagccactcacagaattccaagggacctgatacccacatttctagttcagaggaaaattatagaattcaacttctggcttcctctaaccctgaacaaatggtttcagcttgtaaaaaccatggagttttagagctgtaagtgatattagagatcttcatttgattaaaaccattcttgtacttttaaatgaaaagttactggttttaaagaagtgaagttatttggatgatctttcagttctgctgcctgacattcaataaagcagaacatctaagtcttactatcaaacagctatcactgtgctgtcaagtacaactttttaaacctgtcaaacagtcattagtcttcccttcttaaaacatctaactttgaagctgtctaaccttttcctgagaaaattcaagcataagttcatttcaagaaaaatttcctagatggataatttcttcctctaaaaatacttctgagaaactacagttggaaccattttaattattacatttctaggaaaaactagttgtgaatcttgctgattagaatgcctctatgttttttagttatatcccccaaataactgtttaaaattgtaattatcatctttctctctcataagggatcaagagcataaaacttgtttggttttatcatgatccataaaagtgtcagctctatatcacttcatgaattaataaatgtccaaagtaccagtaagtttaaaactcatgagaccaatgggctttgttggcatcttttcacttcatagttaataccctcatactgtgatatatggttcttgatgcagaggaaaagggagttaatggtagaaccatgcaatgggtcttaaagtttctgctggatacagcacatatcacttccacttgcatgctattgcccaaagccacagctaacttcagtaagcttggaagtacacccctttcatggggaaagccaccgaggagggccctggataggtgagcccaatagagaagtacagtgaagattttgaaaaaaaaaaaaaaattatactatttcacatagaacactaaagcccatagcacttaagaacctaaaccacatgaccaacttcacaagttgattattaacaaagccatggttggaacatagcctcctaattatcttttcatagatattctgtgtatttgtacttggcctccttttatggatatatgcccatgtgttcctaaatgcaatgccttctcaagtttctatcttagagcccctacctcatcttttgttcagaaagaaactgagtcaaatatttcatcactttaagggtactaatattccaattcatagaccagtaaaggtaatgaggtacacaaatctatttttttttttttttgccatacaacctgatttcccactgtagttttttcaaaaaccgaaaatatcatcacagggagtgaaaacagcctcttgccaaactgcgatctcttcttggaaaacctaatgattacttcctgtctttggtgcctcatcaaacccttaaagtcctggaagtttcatcttactctttttttatttcaatgtagataatactgaaaaataaaaactcaaaaaaaaagcaataagataaaccaagattaaatcaggtaaaataggttgatgtatgaaagataataactgattttgaaatatggagatcctctgtttaaaaaaaaatctgtttacagctaaagtgattgtggattttggcaaaatgtttaattggagcaagacatcttagttgcatttagtctattccctaagcctcactatgagattccacagaaatcacctgctgaaaaagagcacaccgtgctgaagctccaaatagaaggtacttttaatctgcgtgtgagggcaaagatatagccgtgatccttgtaccctgagtacccttcaaaactgagcatctcttaagatggtggatacttcttgggtgaaggctagaaataagaaaagttagagtagttgaaatgtcgtttttataaaaggtgctctttgctcttctgtgaatatcattgaatggctaagaaatgatccacaatgcattaagtaactttcttttgcagcccaaaggaagcccagctgtgaatagcagagcacatctacctctcttgttcttttagccgtgcatgaccaagggtgatgataaatgacatccctggggtatgatgaaatggaacaaaaggcaatggaatatatgaggcctgctctgtttgtgtcagaggctctgtctaaatcaaaagtggtgcagagcatcaaatagcctgtcaagggtctggcagcatggcttctcaaatctatgccagttaaggtttccagagctcccaaatggatttcattatcttgggaaagaggtgtgaaagcagaaagtctgggccactgagagggaaccatgctacagtgagtaaaagagaatgttaataatcacttcagtgaaccaagcagctgcaatatgactgcacaccatcactacagttccgggtgttgtttatgggaaaacataataaatgactgcttatggacacccacagatatattgaacattttgaggttaacattggctaagttctaaatgccatccttgtaagtagctttttcaagtggaaacaactatttttcaaggcaagccataaaaacatgtgaaaccaacagcatatttatatgctcttataatatagaagcggtcaatctgattgaacctaaattttatttttacaaataaaatgtatttttgaattatgatttatatcgtatgaaacattttatgtgacagtgagctggcccagaaccctactaaaaatatctgttttcagggattcatgtttataatttatttcttatattcgcttctttatgcttagttctttaaaagaagataatttgctttgaaagtatttcagtattggaggaatccatgggtagcagcaaagagaatccaaagggttaaatttctctaacatatatttgatatttggaattttacaattgcagaatactttgatggattctgttttatttgtcacagaaaaatgtcatgtaaacctcctatagataaaagtcagttatagtttttttggaaaacaaacatttttatggttaaaaattgccttagggtagaagagtaaaaggtattctctcagttttgaccagaaaaacttttaatgcataacagcactctgcacttaataggccttctcgattttttaaaaaagaattgatcaagaagacttatcagacaaaatgatctagataaaagatcccaaatgccattactactggtgtctgaatcacagagtgaaagcactgaccttctgctgcaggtgctattttttaagtctccattgagtttcagtttgaaggacaaaattatcatagagataggaaggataatattgtactcatttacactagaggaaagagaagaaatttaagttgctctgatcaagctctatgcataaggctgtgtcaatagacacaacatgaggtagatccagttgaatgctaatccttccactttaaaaaggttacaagtatgttagcttcacggcttccattaaagccaatgggagttgtaccattaccatgctttggaaagaatgccctctaatgctattgattttgatcttttgaactcaagctctgatacctgtgttcgttgacaactactctgcctattgcgtacacaattctgtgctactgaagtactggattagcaagtcagctccttttttcaaattaatcagcttgtctgagacaaatgtttttatcttaatactcttagaaatgccacatatcaagcttatttcccatagttagagcatatagttcaaaagtgccactgatgggttttgtggaagtaaatgaaaggcccagcccaggaagaggaggccattgtgatatggtcagatttttactgtaggaagtgcattgtgtctgaagagtgccttatatgattaggaaatgtgtaccagcagggcaagacatgaaaccaagagactagtaagaagtctgctgaacatatccaggctgtagaaaatgcaaataatggactagggtataaacaacaaatatgtaggaaaaatgaagaaattccagtgattcctgggttgtagaatttacatgagccaggcttcttaagcaaatgagtgagaagggtgtcattagcaatcatccactgggaatttgtgggctatatagcaaactggagagcctaaccaatgtccagtaacttaggtccaaccatttatttccaagctgtcagtctttttcttttcttttttaagtgtacacttggatattgatgttaatctccccaatttttagatattataatcattgtgtaggcatcacaggacatatctgaaggctaaatctgtccattagctaccctttcgggctccctacatttttccctagcacatgattaggactcaataaatctaaatgtatgttggatggattaatgaataaattaatgaagggaatatagtggccttaaggttttacatggcctcaattggtttgtaattttaaacagagcttctatcagtccagtccatgcttcctactaactgcatttgagagaaaaattcctatttgtaagtgtgaagactaactcatcttatagcattttttacatgaaagtcccatttgtattttgtatttaaaattttttattcgggttcatttatccagttttttatttggaacaagtataaacgatgattatttaacagctagttcttttgaaaataactttcctttataatctgttataaatcatgtttggaaggactttgagaattgaaacaaaggcataggtaaaatgagtgtcgtgcatcagaaataaatgcaaattgtggatggggggacaaaaaaagagatggaaagacaaaatacttgaaggggaaagaaacgaaaaagctaaggaaaagaccagcaactatgaacgtgaatacttggttttattttacttttttcttttgttctttgttctacttttaactttctactttggaaactcaggaattgttgatccagatttctttttctaatgtatgcatttgaggtcaaacagtatacttgtatgttcttctttacctttctcacccacattctggaatgtagaactttcgttttccacaagtagcatgagaacaaacccccttgcatccccactatgtccaccatgaccttatctgcaataattgtttgctgctgaagatatttgatctaaaacctggccacctaaacagaatctccaaataccatcacatctcattaaaagatctcacctaatgacaaaaaacacagtcataagagcacatgaagattacacagcctcatgctttgcaaccagaatttatagagcatttataatatgtgctacattatttcacttgcataattcaattagcacaacaaagctgttaggagatattatccccattatacagaagaagagaaaaaaacataaaaacaaaatgagtagcccaaagccatacagcttttattcacaagatcttataacttcatgcatcctagtattttccctgttccctgctactgaaaatgattctgtatggtaacatgccatgtctgtttttaaagtaaaatcatcaaagtatatatattctcatatttctactgtcatttgaaatggttttgttgatattcagctttgatactaatatagtattccttaaattcctgcatttctattttcatcatatacatttagttaacaagtttcagttctctttggaaaaataaatcaagaattacttgcttcacctatcaggagcccatgtaattaaaattaaggaattacttccttaatttaactctttttctttgtctatatgtcagttcaaaatgattaaagttacaaaatagtagaacatttgattaactaagctgcctcagaatttactattcctcatggagctgctccacaaattagagtttttgcagttcagtttgccttctgttatatgtaaatagggtgaccatataatttattacccaaactgatacactgagagttaaagggacaagaaagtgggaaatagggctaaccagactgtcccgggaaaacccagatgtgtagtcaccctagattgaagtcacgttagaccaaataaatatggtcatttgcctttacctgagctgaaaagaactgtcaatccaagatagttctcagcaaggttggtctcaggacatgaaatgtcacaaaactgtaacttcaaggggttttgtcatcttctcaagactgtctcagctatttgggttttgctgccatcagagaacagcaatgtcacaattatagctttgagagtataaaaggacacagttttctttgagaatcaagaagatattaatagctttctcccggagggctagacaggagcaaagtattaagcagtgtttcttgaagctctcatagcggaggatgactgtgtgattgtcaacctctaacacatacccactgagttagaaactcctggacaaggcctacaaacacgaaatttcaaccaaatccataagtgaatcatatacacactacattttaaattttacccactgatttaaattaaataggaatactaaaataatgtgatataattgctaactgctcccttccttatttgctccctttccttagcttatttgctattttaataggtgtcaaaaacatctgctaatttatgttttatctacatatttgggttgacttaaagcattttcagggttttaaaaattatttctttcccagtgtctctgtctctctccctcacatcttttctattctccttttacttctttttgtgtcttcttcctcacctcatcagaatagatgaatttattagatctttctctctatgcttgataattcttcctcattatctccaccagaaaaaataaaaaatgtatttttaataaatattaatatttaataaaattaataaaatggaaaatggaaaagtgacaatacaaaatccgttccctcaattaaaaggtacttctctagcattttacctatttgagtggagcaatgaaatccacgctcccagttactttattctttgcatgtaatgctgtaggaaatctgttggttacagatttgtaagctctaggctcagtggccttaccacctggctttgacattattccctacaacaaagcatcgtaagacttgagggcaagatctctgctgattcattgctccatcccaaatagctcctggcagaatgtcttgtacaggaaagacacccattaatatttgtcaaataaatgaacagaggaaaagaaaaacccgggcttcctctaaacttgtcacactaagctcatgattgaatcaaacacataaagaaaccctttcatgatataaatgagaatactaacccctgctctgtgtggctttgtaacaatatttttaacaactaagttcaatcttttgtcagtgttatgactctgaaaattaaagaaaatgttttgtagaaacaaataattagaaatattgccaggaaacttctgtactggttgttgttacttttattcgctgggtctgtgagaaggttggtggtatagagagagttgtaagaggcatgattaacaagggcttattgagcccttactgtttgcataggcactattttcaaacggtgtagcaaatataaaagatacaaagtatatgacattttcttcctctgtagcatgcaagcttggtggaagacaagattcggagcacaattagagaacaatatgagactatgtacaatgaagtggtaaattgaatataattaagcacattttccataattccaaactgaaaaagtcagaggggaaaagaccgatgttggttgccagtataataaaatatgtcaaaattaacagaagatggaatacatagaatttcaaattctattgtgatgaatattatggggtatctccgcagtatatgtttacttcaagttttcctacataaaataatgagaaaatgtaattttatgtcagaatttcccatcgtagatgatcttgaagaactctcattttataaatttaggacaggctgccatggctacctaaaaggaggacaaaactttgtattatgcaaaataatttcctttaaagatatctgtgtttgctgacaatgtttgtactgtatctgtcccttcagtttacagatattagggagcagggggacagtctttttagtggaattactatagcagagagcgcaaggccacctgtgcctccaatggttttgtttctgtgcaatgttcttaaagttgacatattttcctcagtttaactcctttgggatataaaggcatttgaaagataagggtttggactttaggaaagactttaaaagtaaagatctgaagttgaggttggtgccattttttgtcacttacactttatatgaattttaaatttcaatttggcctcattttaaatcctctcaaagtgatagtacctctcctcacctctcacaattctgtattcataaatattctattatttcttggaaatatcttgatctcagagaaaaaaaaaatagcatcccagggctgacttttctcaggagacttctccttttttttgcttttttcaaatttcatgtcaaccacatttttttcccaaaggagaatgtctttttacagagagaaagagtagaagtgaatggttgaataagtttacaatcacacctctatctgctcattgcacttatttagtaatatctcagtgctatagtctttaatagtatatatatttttaaaatacaattggtaaaggagttttgctttgaagtattaaaaacatcacaacatttatctgcaacttcttttattgtacatccattagaaatatccaaatgaaagataatttttaattgaagaaaattacaatttcacaatttctagtatttaatgtaagtgataaatggagaataataataatagaaatgatatatgcattaaaaatactttattgatgaaatcactgcaattaggaaaagtaaaaggaaagagaacaggatgacagtctatcttcattaagtagcatctatactgatgcatcggtttagtaaatgagtgaacttgtcatctggatcactctgttcacatcatcagcccattcttgctccttccaaagaaggggttagaatccatgtttataattttgaattaaatttcaagaaaggaccacaattaaacagaacaacagttggttcacataaataggagattaataactttctaagcagatggctcagtaaggtcattcatcaatgtgagtaaagatgaactgtcagcaatgaagagaattgaaaatatggagtggatagtttagtttgttggacatggagttgttgctggaaaacaaattcaaggaaatctagaaggagaaataaacttggaatgctataaatacctattgtcaaacttagaatttatactggttttggaataatttaatcagtctctgtaaagacactagacttcaaagctcattttaaatactaataaagtgtgatttaactatatattatttaaagaaatattttagacaaattaaatttagtgagagtttatttgagcaataaactcttcatggattgggcagcatcagaaccagaagaggttcagagagctccacccagaagtgtgagcagtgagctttaacaggccaaacatagaagcaaagcaggaaagtaatctgattggctacagctaggtgtctgccttatttgggcatgatacaatgagttgtttgcctgctattggggctgttcactcctaaattagatttcaatttgtttacctactgttaggttgcagttcattgtgtcaaaactcaaaatatagagatagtctcaagctaatggcctattgcttatttaacaatatctatgatattcaccttatcattgcccctactgtattgcaaaacttatccatcttcgttatacacacacacaaacatatatatatgtgtgtgtttatatatgaatatatatgcatatatataaactgttcacaacttacaatggttcaacctatgattttttacctttacaatggtacaaaaatgatatgtattcagtagaaactgtactttgaatacccatacaaccattctatctttcactttcaatatagtattccgtaaattatataagacatttctttattacaatataggctttttgttagatgattttgcccaactgtaggtgaatgtaagtgttctgagcatgtttaaggtaggctacgctaagctatgatgttaggtatgttaggtatatcgaatgcattttcaacttaaatactttcaacttatgataggtttattgagctataaccccatcataagttgaaaagtgtctgtacaaagatagatttattgatagatacatatatcttgctcacaaaccgaagccaaaaagaactagcagtgatgacatccatgttttcataccaaatgaaccaaactttttggctttaccattgtctcttacccatgttgtttgtttttcttctaccattaatctgtatgctcttttagggtaaagaatactttttactcatggtgactccctctgcctccagcactttccatgttatcaatgcagaccgggcactccataagtgtttcataaattgaactgaattgtcttccttatcatccccttcaacaagatagaggtagtaaatggcaatatatttggagggagggaggtataactatctaaagcctcaaaagcaacaaaggacaataattcaaatatctgctagatcaggctacatggtcatgaggtgggacactggtgaagtgaagggagtgtgccctccctacagcagtgctgtggccactcaaatccaataatttcctgcagaacatgagccaaatctctatcttgtcaaatcttccaagttttaagaagctagaaactcaaatattgatgtggaaacttctgattttataatgctggcaaacgattggaagtatttttttaaacactgcacctgacaaataaaatatttctgtgggtcacatccctggagctcacaattttcgacctcactcggggcaacagaaaagctgaccaagaaggtcaagatgttaattaggcagctctgttgaccacaggcagatgcctgtggactataattctccacctcaatgtcacttggctacagggtggtagtgttaatgacattcgaggtaggcaatatatgtatccatgaaggtttgtcaatctgcggtgtatacacataatggctgaaaatcagctgtctcttatttgttgcggtttgtttggtgagactctgtgggagtatttgtggcttaagagcttggaaacctcagtgtccatgaacataggaattgttcagggaggagatgtaacaggtgaggcaagaaaccagaatgccacctttaatttcagttgttgtctggaatgcaaacaatgctcctagttacctgaccaatatttcccctcaatgtaaatgatttggtgaaaaatgatactctttctcacagccccaagaggaggttaaaatcctcttacagccttatttgaaaagtaaaatttcaaaagaaaaggaaagaaagacagccaaagcaatcattataaagcttgaggctaaagtcagttttactttattttttcatcactcaccctggaattgtttgataggatggtttgaaagaattcgggatgaagtgtagcatctccaaatgttagaaaatgtatactagaatatttataaatcttgttccattttacgcaccctagatgtcacgatatatgggaaatttaaaaaagtatcagaaaaactcggcatgggggatgagagtaacgagtgaagatgatgaacatgtgtctgatcgatgtgtctcccactctgtcctccacctgcctctcacctcctcccctgcctctcccactagcttgcccccctccggaagccccacacatttttttttcacttttacatgaacgcaacatgccacttttgaactcacagacttcacatctacctggaaattctgttctttttctttcaaaattcatctccaaaaggtaccgtaaatagacagagtggggtagtgatagagagctacgacgccggggccagactgcctgaatttgctctctattgtcatctcttttctagctgtgtaagcttgtgtctcctttcctttgtctttgcaatagagacaataatagtaatctaccttaaaaacgaggtttgatgtttaaatgaattagtaaatatacagttcattggagagttgtaactatatagtaaacacagtgtagtgttaattattttattatcactcacgacctcctcctctgtgaagtcatacctgagctggaggctaaagaagtgtcatggcaccttcaagcacctactctgtaaaacattctgctacatttgacttttattcacaaatgcttatgacaatgtattataattattgattgataggatatgtaatattgtatctacttacatatacatctaagctgtaggctactcaggggcacaaacaagatcacattattttgattatatggtattatctagaacttatcccagtacttaacacataaccgtcagtcaaaatatgtcaatttcctgaatgaataaggatgtgcatgggagtttatcctagtactatttcatgacttgtatctggattaaatatgcattggaaaaagtactgtatttttgtgcttttgacttaatatttgtcatagcaaagggagaactaatatctttttcagagtgatactgtctatgctggttaatatattaatttatgctaccacttctctctgcttacattagtaaagcctgactctctcaattttaaatacagaattatcatacactttgctagacacgcttcatatttctgggtttgacactagttttctggagtacaagagtgtcattatgtccttatgtctcaaatgcaatcttgccccatctggattcatgttagaagaggaagcagataacaacttttcctacttcacacctgtgagatcagtaaatttgaccacagattagaaattttaaaatgaataaaattttaagtggcacttctgatgcagtgtattttatgacttttttttaaagaaatgtacttgaccaccaatatattatttataattcaaaaaatctgactcagaacaagttctattgtaaccttatgcatcatcattatcctattctagtaagtataagggatagaatttccttaccgctactgaatgcttgacttcaatctaaaacactcttaatttgcattaaattaaaggccacttagaaaaatttagagaacacttttttgtgtgtgcagaaaacattaatcaagcagttttcctctgacttttttaactggaaatagctcatttaaatattatccaaactctacttcttttaaaataattttttcttagtattttattactggtattagtgtagtcatcttctttagtgatgttaaagcatcagggttaaagggctagaaatttagcttaagacataaattaaaggtgtgggaattatttactttggagaagaaagagattaagaaaataaatgttattaaaacaaaataaaaggtaaacgccattttattttgtttgtttgtttgtttgtttatattactttaagttctgggatacgtgtgtagaatgtgcaggtttgttacataggtatacatgtgccatggtggtttgctgtacctgtcaacccatcatctaagttttaagccctgcatgcattaagtatttgtcctaatgctctcccttcgcttgcccccacctcccgacaggccctggtgtgtaatgttcccctccctctgtccatgtgttctcgttgctcaactcccacttatgagtgaaaacatgcagtgtttggttttctgttcctgtggtaaacaccactttaaattatagacagatttggtggattagaataaaatagttgttactgtgtgtgtgtgtttgtgtaagaaaagaggtaagtgtttactagaagatattagatgatcccctagatgtttataatataaggagtctttgctaagatcgcttaagtgtgactccgccttgaggtatacatgtcggctagaccagacctgccactaggactcaagctggggagaattttgagcactttgttgtcagcaccatttagaagacaattttttttatcagctttatattctacaatatgtgtagacatcactgaatttcaatctcatttgcagctgaataaacaaacggtaggtatttccagttttttttaagccctcttacttagaattaccactcattctcatatactaagattatatcatttatgtttttaaataaatatccaacccctccccagactatataggtattttgggctgattatataatattatataatatatgctgagtttttatttgaatcactctatgtttttggaatagaaaaaaatcttaaatacaggaacagagtttttatgtgaaaactgctagggggaaaaaaaaataaaaactgctagggggaaaaaaagcaaaaacagttgctttgcattaataaaaacataaagcctccttttttattatttgtgatacagcaccaatttatcttacataaattaaactcatataactaatagtaatataggctagcttgcattaattttttatatgcattgcactatggtagaagtatttaaaaaagagaaatattcaaagatggagttactagcctgaagaatacaggggaactctatgtggagatctaattcttgaagtcttatacctgtaaggtggcagaaaataggggaggctgaaagtcagtgaaccccaacttcagtttccacaatgtacaacttacatattgtatggctcaaaaatctctggagcagcactttctttgcctataaaatgaaactattgaatcaaatgatccctaaggtcacttctaagctttatgaatatatagattaaaacttagaaataagaatcctaggaaagatataatcacaatacccaaaactaagtagaaatcttaaagagcaaatagtttcaaatcatttccaactatgtatccttatatgatatatgatgattactgatgtggttattatctattatttgcatgagagagtttggaggaacatctgacattggggaacaccaactctgaaaataagggaaataagatagtcttttgggaattacactgttaaactgacatgctcaagagccaagaaatacaaagtcaactaaaagagagcaagtgactctcatgccagcaggactagaatgtcactttttgaatgtttcaatatacccaaagcatgaacgtgttgaacagtagtggaattaatcagccttggaagaatagaaaaagaagagtttgtgcacaaatgatagcagagctcttgcaagcagagtccaatgggaagtgaggctgagtgatttaggtatttccatatcaatagcaagaccactgtgagctgaatacatcaggttatcttaccctgatgctattagacagtccattcattcaactccccttgttctgacttcctgctcaccaagctaccttccgaccataatctagcctttcatgcatgtcttcctactgagagaaagtacactgaggatatccactttgaataaatatctcctgttcctaaagcagtgattttttgtggagaatcaatatgggtttctgattatgatttggcttcccatgtgctggatcacagggaagagattgtgccagtgtgactattctaatctagatattgtttcttatggtaaattaataaatacatgccctagtctcatatgccatttagaacataaatcagcacttagggcaggaaaaagccatggatgccaagaaatgtctggtccttcaaagcagagggtcaaatttacagatggggcagttaataaaagcgctacctagtgagttcttaccttcatcaagctaacctttccttacatgacactctattcctcaacctataataaatattcaatttctttttttcattcccacatgaatgcaagattcagaaaggcaaaggcttggttgccttcatcactctttgtctagtgcttagtaccctgcctgaaacctagaagatgccattaaatatatgtggaataatgaagcttattcacactagctaccatttcagtctttcaacttcattgctatagtaattttaagcaagtaaccacaattcacattccagtaaaatgatcaggtcatttcagcctgagtaccttaattctcaaatcctacacctcaagaattcattgaattatgattttccctaccaaattttttctcctctcttatttttaaaaatgaatcatctgactgggcacggtggctcatgcctgtaatcccagcactttgggaggccaagaagggtggataacttgaggtcaggagttcgagaccagcctggccaacatggtgaagccccatctctactaaaaatacaaaaattagcctggcgtggtggcacgtgcctgtaatcctagctactggggtggctgaggcacgagaattgcttgaacctgggagatggaggttgcagtgaggcgagatggtgccactgcactccagcctgggcaacagagcgagactctgtctcgaaaaaaattaatcatccacccatatcctttgtcatatctctatttttccttagtcaaccatttttctttatatcttaaatctcttagtctctatagaactttctccttagtttacatgctcaagtatcttgtaaactcacaaaataattccctgcatgtgaatattattttaatcccttctctcttttccaaagccttcaatctctgaaacacagctcttccccaaggctggatggttgtctttattcactcctcactctactctttcctttaatgaagatgttggtcccaaagacccccccaatttcttctctggcccctccattcctcctgaagtcagatttgcatttctaacagcctcctgaaaatctgagagtatgtcacagagatatagctcagaacctcacatatagcgtgtccacagctgccttctttcaaaaactgctcttcgtttcattccctaatttggtaaagaataacatcattttatcatttgcttagtttagaaaatgtgaagattttccctttttacaaagcaccttgaagtcagggcctctatcacactcacagttgtttacggtgctgaacagtgtcttcggtccatcttcaattgattgaattgattaaaagaattgttttaaaattccatttcatttatctgttggatttctgccttctactccttcgcactaatttctatacttgtttctgcctatatatgtatttgttacttttcacagtctgtcatgtatcacgtcacataaaacgttatcttacatccataaagatccattgcccatatatccccctttataaaatagataccatgtgtattttagttacacatgttacaagcctcaaaacacaattttaaaatttgacttaaaaatcataaactatttagaaaaatttcagctactgagcaaagcgcaatatttgatttgtagtttgatgccaacaaagttaattgtgtactaaaactaacaagcaaatttaaaaaatactcttcagaatacgataacagaatcctgagtctctacaatataaaaatgacaatatcaaggtaaagtccttaataaatgcacatacaaagatttcggaaaatatgactcattcttaacagaaaaacaagcaaccaaaatcagtcctgtagtaactcacattttggaactagcatacaggattttaaagcagttcttataaacatgcttaatgatgggaatgaaaatatgctcagaataaaataaaagatataaaattttagccattatttcttcaaatattttttctgaccctttctgtctttcctcttcttttgggattgcaattacatagatattacaccttttgatattgtcctacagattcctgaaataatggtcatttttatattttaattatttctgttcagattgaatgctttgcattagtctcttttcatgttcaatgacttgtttctctgccatcttcaatctgctattgtgttcagtaattttttttggatattacggttgtagttccagaattttaatttctcttatagtttctactactctgctaaaattttctaaatatgccacatacacagtagctcaaatccccatttgtttttttaattcttaattctgctgcttagagttttttctgtgcatgtgggtataatttggggatatttctctatagctgtctcctttttcttttgtattcttcccttacttctcaacacctgtagtttccccaaactctatcctcttcttctggctggaaactctgcatgttttatacactacatgcagcattcccttcttgtaagtgtcatctcctccactttctgcctgtgtttgttccctgttcaatgccttcaggctttttgcatttcacctaaagtttatagttgttatttgcaggaagtgttggtctggcagtagctcacttggccatatgagaagctgaaatctattgataattttttaatttaaagtattttatactacttttgttttgttcttattatttttttcttttttctttttcttttctttcttttttttttttttttttttttttttttttttttttttttttttttttttttttgtgagctctgtcacccaccctggagtgcagtggtgcgatctcggctcactgaaagctccgcctcccaggttcacgccattctcctgcctcagcctcccgagtagctgggactacagccgcccgccaccacgcccggctaattttttgtatttttagtagagacggggtttcaccctgttagccaggatggtcttgatctcctgacctcgtgatctacccgcctcggcctcccaaatgttcttattatttctataatatattctctgctgccatctttctgggtaaaacttttcttactccatgttgaaatttattgaagccccttgcttgccatcccgcatagcactgatagtgctatgcatacatagctctgtatcttgacatatgcgtggttatcctatttcctaaagattgtataaaagaatgactccagtcatgatatgcccttcctcagaagtgttcaacagctctctgcttcctaaacaataaagtcccagaaatgtgttataatggaagaagacagcctttggagccaggttagtttgagttcaagatctgtcactgaccagctttataaacttaggcaagatgtttatctgaatattagttttattatttgttaaatagggagaataatatctgtctcaaagaatcattgtaagaattgatagataagttacaaatagttgctcttttagggcttagtacttagtgctcagcaactggtagctgttttaaaataagggacataaaaacaacagctctttctccgagattcaaagtcttccttcatctggttccaaatcagttttctatctattctcgcatttttcttattcatcaacaccattcaaatcacactgttctctaaaacccatgcatgtctcatgcttgcccatgacaatggccttgctcaaatcattctttctttttcttgtttctgcttgatgaatttctaaatattcctcaaggaccagcttaaatagcatatccacaaagaatccttctatgatcttccttccttgtaaaattctttagcaaagttttacctgtttatgcatctatcaggttccagctcatattatggtatttcctaggcatacattagctgccttatttgctgaattatcagctccttcagtgcaaggactcactcatatccaatatgcttgctgtatgaatggacaaatacactgcttataaaaatcgtgactgggattatgaattctaaaaccttactgtggtcagacaaatagttactaccatagctctctatgatttgagtattacgtattagaagcattgtatagaggtaacatattaattaaaattagtttgataaaatattatttttttcatttttataactaggaataattcaaataaccagttgaatctagaccgtcaaagatagaattctaagggatacctgggcttgcttaaggaacagtttaatttagacagctttggagtgagaaaggcaggtgaagcaattgttttttgcagttgcacaaatgaatacaaaagcgatattttattcaaaaataaacgctctgtttaatacaatgcaatttctgtgcaaatttataatagcaatagcaactgttctaaaatcactaattctataataatttttagttaaccactctggtagtaagcttatttataccttattttgaattacttgaataaagaacaaattctggctgggcgtggtggctcacacctgtaatcccagcactttgggaggctgagccgggtggatcacctgaggtcaggagttcaagaccagcctggccaaaagggtgaaaccccatctctactaaaaatacagaaattagctgggcatggtggtgggtgcctgtaatcccacttactcaggaggctgaggcaggagaatcgcttgaaccagggaggcggaggttgcagtgagccaagattgtgccattgtactgcaacctaggtgacaagagtgaaactctgtctcaaaaataaataaataaataaataaaaattctgttttgcatttttctacaaatgactttcttacattcatatttagatacctgaaagttcctgctagtatagtttgctttgtaaggttgttctccaaatgaaaagagccattacatctaaaatcctcttaatgatggacctaaattttgaatggaacaatatatgctacagttctaaaagacaaagatatttagcaggagaaacttaccggcaatgagaaccatattcatagattattttaatgcctttatgagtgagatgaaaaatagttaatggaaagatagttttgagattgtggcatgtcaagaaggtatctcattaaatatggaaggaggcagacataaaagaggttcatatgttatattcacaaaccatttcttctcaatagtttgttttggcattattaacatgataatcctcttctgggccaggtgtttctgtgtaaatgagttttttatataagacaccagtttcctttggatgaatttaaaataagacactaaatctaaggtttccacaaaattgaaaaaaaaaatcactctcctcccaaaagttcctggaaacatttccacattaatcatcatatttaaggaagagaattacattacataattagaacatgaagaccaaattattttcaatttgtttcattacctaagaatcaaagagacataataggtatgtgatttcagggggaaaaaatgcatttccttagctttgcaaagatgctcagcctatgtcatggaagcatgatagttaaaatggaaaaggaagttttctattaaatatttttctatgatccttggaggccaataggattacttggagccggtaggtaaaggaatggctttcactaattctgagagatatcacattcctaagtctcaaatatatttgttgaaaaactataaaataataaaatattttattttaacagatggcctctgaaacaaatttaatagatattaaagcattcagtcctttgacctggcaatttcatttcacttgaagaaaaaacaaaagttataaaacaagtatttgtgctcagaaactagaatacttacatgtttgtaaagtcctgcccttttacagagcccagttctctgaaaagccactactctggtgatgacagcatcatagagatgctaagatcatgacaaatgatttggctaggggaacaaggaatctttgaattataccttctacacttgccatataaaaataattagtaatgtaatcattacaaaaatatgtaatgattatcagtgtctcctatttccttttagatgaaaaactatctttctgttagaactagaaatcagtgtgacatcactgaagaacacatggctatggagttagacttgattttaaattttagctctgccgcttatttgcaatgtagccttacatttcttaatatctttgtgccatgggttcctcacctgcttgttgtgaggattaaataagacagtgcctggtacctatcaggtactcaaatacaacatgttaaattagtaaattatgttttaaagctacctggctcattatagatgcctgtaaatatcagagtcctttccctttgatgtaactgacatagaacagaaacagatgcacagttccatagacccagatgatttctgtagctttctgatttttctctggtccatgaggtgtgctttttagataagtattacttctttagtgtttattgcaccatctttactcttcaaatgatgcaggcaaaattcacatacagggtaatcttatttttccaaaaattctaacatacttgtatttttattttggtttacaaacctcatctatgcaagtaatcatagtttatgtattgtgtatgatttttagacaaaacatttgctccattttacaaatgagaaaaactgaagctcacacgatgaacacagctattcaatggcaaggacttcttttatgactctagatacaatgctaacttcaaccatatgctaacttcaaattcccactgttttaggaattaccagagattgtcagaagtggctttcattgttatatgattgtagagtatgagacccaataaatccattacacacaatttaacattggctattaatgtaacactagtacctttcataagctaaggttagggtttaaagattacactgtccgttggcctgtctcatatggaacactaagctttttaacagtgtgtatggtcaggataaatttattagttcctaataaaataacaagctcaaaagcttggaggggttttcacagagtaagaataaatgagcacagcctacccaagctaaaaagatattctcttaactcctgctaaagaaaacttgcaacaatttgccagagggaacaaaaacaagattagaaactgtctccacagaagtagtaaacttcaaaatcttgacacaataaataggcaatacttagggttgctatttaaagtaaaagttgcttttttctctctcactcactacaaatcctgtttgtgtgttagtcctaaacagtgattctcagctttggctgcacattggaatcacctggggacctttaagaacgtagcgaggcctgagtctcattcccagagattctgactcaattggtaaggaatactactgggcagcagcagtttaacaaagctgtttaggtaattctaacatgtatccaaggtagaaaaaccactactctaaggcaatttatttgggactacgctgatggaatttcagcttcataggatactaatatttataaagtatacactgcatttctggaattatactaagtgccttccgtagtgtatcaagacactttgggttaactgtcttggacaaaatgtaatttattgactcttgtaactaaaaagtctgggggatacagcacagctgaattcagtctttcttctctcctactcttggtttcaacattgcctccattctaagactaggtgtcttttcagagtcagaaaataagtcagcaactccagaccctacattctcctcacattcaaatccataaaaggagagctagggtttctttctcagactctggccaaaagtgtcatgtggctctgctcaggtcagagactgtctgtgatccctgagctgggctgaagctgtcatttgtccccaggcctgtccaattacagggtccatgcaccttttaacgcctccaaggaaagattaccagtttgattggaagaaaatgtttctctcccaatagagaatttgacaaatttaactatctctaaataagagttttcttacctttgaaaatctctcccaactctgcagctggaggcacttcctttcctcactgctttggatctagttgtccttccctccccttgcaatacaaccagttttctccaaggcaggccaggcctgtgtcccaggctgggaatctcagtgacaaaaatctatatattccttggttctgaatgtgaataattaatctcacatttaagttttataatgcctaattttctgtgcctgctataacaaattaccatgcactttgtggcttaaaaggacataaactttttctctcacaattctagaggtcagaagttcaaaccaaggtatgtgcagaggcatgatccctctaggactttagggaagaatccttccttgcttcttctagctttgatggctccaagaattcctttagtcttggcacagttccgatctctgcctccatctttgcatggctttctctttgtgtcttctcttcttccggtttttataagaatacttaccactggatgcagaccctatgtgaaaaattcagtgggagagttccctcacaggatatgcgacaggggtgtgactcacctattcatctgcttgcctcagctgctcaaactccttgtaggaggtgcagagaccaggtcaagtgctttggtctccatccccgtagtagtgtctaggggtggatgcctgcagccccagtgttacaatgctctcttagccttgctgtcagcagacagctttaagagttaactagctcagtgggcactctgcctttttgcaagggcagagggccagtgtgacagctttctgtatcccaagttactgcccagcgtctgggaagaattggatcacattcgggcttaaaggatgaatgcgagatattattgagtagtagaggtggctctcagcagggtggatggggagctggaaggggagatggagtgggaaggtggtcttcccccggagttgagccatccagcagccaaactcctctccgacaacccccagctgaaattctatcagcattcagatgtttctcctcttctctctttctctgccgcatcgctctgctgttcatctgcttatctcatctcctcatctgctggcctgctctggagcctggagttcagggtttatatgggtacaggatagggggtgtggtggaccaaaaggcaactttttggtgtgaaaacaggaatgcctgtactcattttgggccacaggtatccaggcttgaggatggggcttttgccgggtaactgccctcttctacccagcatttccctgcctcctgtctgtatcaatctcaccttgagatccttaacttaattacatatgcaaagacccttttttctaagtaaaatcacattcacgggttctgggattcaattatggagataattggggaggcatcattcaacccactgtaatactcattgccctttagtttctgaccattttatcttaaatatattttaagtgatatcattcacctcagaactattctttgactcatcacatgtatgatggggctgcaaaggaaagaccacagtggacatttcatttgtaaagaaaaggaatactaaattatgagagcaggaaactctctatgcatgtgtggcttatcagtagaaaactaaaattaatttcttagggcacaacacctagtattgaacttaaaaatgtaagtatgaaaataaacagaaaagaaaaggcatagttccacagatcttaaagttgtagggaaagatgaccatttgtaataacaagtacagttagttgtagaaaatttgaagatgcaagcatagtatgaaattgtattaaaactctaaattcaagtgacagaaacccaactcaagctttgttaagaacatagcttggttcatgctctggaaagtctaaggaggtgtgttaaattcaggatcagcagaattcaaggatataaacaatgtgcaaccatcaggaatttggtttttcttttcttccttgtcttcctggtttgttttccatgggtactgtttcacgcccagacatgcttcctgatgtagaaggagagatggcagtagatctttgcaggttttcctggcctttggtacattcagtctcaaaaacacagacactcttttctgagattcatttcagtccccagaaatggatcttgactggccctacttgaaatagatcttttcccttttacaaatctctgtgtctaggggaagaatgtactgtgattggttagcttgacatcatgtggaaagatagctcctaagacaaaagtagtattcctgttattagaagaaagaaatggagacaccagacaggtaacaactcatgcccacttacatgctcttaagaaggaagagcttcctgggacccttatgttaagtaaagacatcagtctaagggatcagaagtaatcagtcagcatgcttgcatatagcgaatcccagatgctgaagaaaggaagagaaatgggagggcattttgcttgaataatgatctctgtgaggccaataggatatgagtgcattatttgtccactctagaagaataagagcataaaaaggaacactggggtaagatctgggagattgggaacctccatcaggttctgctatttaccagccaatattacaacttctgagaccctttgtggctttaaggccctaaggattacaccaattaaagtgatggagcatgagttcagttgtaatgtttaaataccagttttcttatgctgtcatgaggtggtgggacagtttgaagtgaaagtatgtgaatttaacaaaagatatcatagataaacatttatttttcaaaatcctaaatgtaaggaagccttccaaattatgaccagaatatgatttattttctgcaccttccccaaaagcaggaaacagaattacactttttaggataagactcttaattctggcaacatgttgttctcaagaagtttaagaacaagattaaatactctaacacaagtctatttgtggtttgtgtttgtcttgaattagagtatgtacctgttaaaattattagaagtttgaatctgaaaaatatcgcttgagcaaatggttataagttatttaaataaaaaataaaatgcatcattgtgttttctcactggttcttttaaatagactaaagtgtctcattttttcttgctaaatttatccaactttctaatcttctagctttagcaaatctagctttcctgcatttatttagttctatactaagataattaaatatttaagctgcatcattcatatatctaaaatactaagtaggaagaacaagtcattttcttgaacatcctcctcaatattgatctgtgtttgccccctgtcttcctgacactagagttttcttcattccatttaagcacttaattacaataattatcaaagaaagaatatgaacataaattgtgaagtgatagttgagtataatttcctttttccctgggacatattttctctacaaaaaaaacaaaaatcttactttcaaacgacataggcagctgtggtatgggaggcttgattacatgtcagtttcttaaataaagtgtctctcactgccacagcaggggagccaggtacccagaggagatgccgctcttcacttatgctgtgactctactgaccagggcaggacaatgcgagagcttatgattcaaaggtgggaaatcatagtcctttgtttcatttttatctggggaaagtcagttgcttaaaatgagagcaggtgggatatagcaattagtatgataataataatagggttagataaaaaccagtggtgcagcaagagtatttttcaaactcttaaatagcttatcttacttcactttttacaatgtaaaaagttattatgaaaggaggagagaagttattttcatgagcacctactttgtgctgaagatgctttatttatttatttatttatttatttattttttggtcttttacagaaaatcttcaaagtgctatgtacattttaaagagaacagtatggttaaataactgggctaaggtcacaaagttagaagtcatcaaatgccagagtcaaacagtgtgtttcgttccaaagcttctactctttctcctctaacaaacaaacatattgtgttcctttaaaaaaattatgaccagtttttgtttttttaaaaattttattattattatactttaagttttagggtacatgtgcacaatatgcaggtttgttacatatgtatacatgtgccatgttggtgtgctgcacccattaactcgtcatttagcattaggtatatctcctaatgctatccctccccactccccacaccccacaacagtccccagggtgaccagttttaatgtatttgtatcaccactttaaaatagaaaactgaatctttctttgcttcttgtatcagtatctaaggaggaagtaattgccatggtctgaacttagtggaaatatagtaagtggggtaaatcaaaggtgaggggccagattcccaaagtcctattcaaacagctttttcctgcatttgtggagtgttgggatcagctttgagttgatgaaattctgaaacttctgacaaaatatgccatcaatgaatcacagagacatgatataatcgtaacaagaagcaggtcctgtgatacctaaactgttattatcagctttatacaatgcagattcatgggccaaaatgcagcattcacacagagaggtatgtaaatccatctatttagtacacatttaaggatgcattcaacatccaggaaatccattatgtgtaatgactcatgctttattaaatgcttcccacatgcaagtagtagtcaaaaagggaattactgatatcaagacaactgaaagccgccctctattattctgtgaaatgcagtattttaaaagtgtgctagatgacgttagtgttgggggtatattcagggccaccacatacacactttggtgcacaaaatgagttctgccccgaagcaccttcctgaaggggtaagtgggggcttaaaaacagacctagttttacttatcaagacctatgttcttattcaaagttgagtcaggccagagcccttccagaggagaatgaagccccttttttgccgtgttatgtgaagatttttaaatttgtattagaaaagtgtaaccactgcatcaactaatgattttattttcctttttaaaattattaaactagaccaggcatggtggctcacaccagtaatcctgacattttgggaggacaaggtgggtggataacttgagtccagatgttggagaccagcctggccatgatggcaaaattccgtctctactaaaaatacaaaaattaggtgggcatgatggtgcgcagctgtaatcccagctactcaggaagctgaggcacgagaatcacttgaacatgggaggcggaggttgcagtgaaccaagatcacatcactgcactccagcctgggtgacagagcaagacacggtctcaaaaaaaaaattaaactacagtgtgattaaatcataagtgtgtttaactatgagaaatgcatttttaaaactactacaagaggtgataaaacaaatcaaggaagaaagtatgcaaataattaaaatttggaaattactggtcctggggaaataccataagctttggagtaagacaaataataggatgttcaagcctgctcctgttgtgctttagcaagtcacttggttgttcagcttcagtgttctctcattctatgtaagaatgttctctccaaaggactgtagtgagaatgaaatgagatgtctatgaagttgtcaacagaccttacttttccatccttcatttttctttgtgcaagtctgaattcttagtcatcctagctggcttccttgacggtgttaactcaaaattctgagttcttgtgggtatcatactcagaaggataccatactggtcctaaggtactcagtcgtcttagttatttcagctttagtgccccatgattttcatctttcctattgcacatcccactcacctcaccacccccacggcgacattccagggagcaggtataaatacacacagtcagtcacactcacatgcattcacaggttcacacacattcacatactcacatacactctcatgtacactcatctgttcacacacattcacataaccactcacgcacaaactcacatgcatttttcacttacattcacatacatacacacgtgttcacacacacattcgcatattcatacattcacactttcacacacatacacatacatgagaaacactgcagccacacagagctactcaccatttcctgtttcccttctgtattcctttgttcattattgtacctttgtccacaattccctcttacatctccttctacttaaatctttccgttcctttaggtttagttaacaaatcaactcccctgttaagtcttacatgatcactcaaccagacatgaccttacctttaagtatttttttttaaatctttcctaaggttgtagatatattctaccctaagatgtaattacttatgttgtttgactaaatatcagactgtaaagtttttgaaggctatgatcatgtcttagttatttcatcccccacaatgattgtcttcattatgttgaagaaatataatcttagttaactttaatgaaatagactctttcaggttccaagcaatggagatgtatttaaaatagttaagtcacttggggatagatgttttagtgatatacaacttattttatctggatttactattgtcaatcaaggcaaaagagaaatctgactggttctgttgatccatctagtataaggtttacattcataatctaattagtaataaacagatatttcatgtcccaaattcagcattcctcaaaagtgggaaatagatatgctgggtccttgaaatattacagatttctctccagttccttccttgggccacttgtttccatacctcttcttcaggtcagtattatttagcttccaggcataaattctgttgagttgtatatctttttataaggaatagcaatataaaataataaacatatctttataaaatagctgtacaaatattactacaaaaaagatatagtatgtgtctatgtgtctgtttctaccccaaggagtgtgagcattctacagatcagctagctcaaaagtaagagggaaagtgtgaatgagctgagtgtgcccagtcgtttttgcacttatccatcaagtcagtcatgcattgtggagttggtggggctaagtgatgggaaagagaaaagcaggaggtatatttctcccatctttttccctgaggaggaatgaaatggaaattctttctcatctctgaaaaacctgaagagtgagaaataagtaccttttcatttcccctcatctattgagtctaagaattaaaccccaggggtataattatcctgcagaggtgaggggattagaagtgaaccaggacagtccttcttccactttcaggtacttctgcaccaaaaacttacttttgcaatgcagttttaggtactttcctagcccaatgattgacagacagtttagctgttgcctttagaaggctctgaaattatttctcttggaatccactagcccccagatttatactcaaaactatttcccatctaaaattaggcccccaaaaaactagtatatcaagattttggaaggaggcccctggggaggaataatttatcgatgcacacaggagaaatattgttgtctctttacgttgaggaagaaaataagtgcttttgagcttaagagaagtaaaactattttagaatacaagttttttattcaattcttttagccactctttgtttatagtttaaatctgatatccaccaaaacattttcccaatgtagagatactataaaaaataatttgctttccagaagcccattttagtcaaaaagaaacgttaaaccaatttaggaaggggcagagctcatatgaccacagtacttttattttaagtgtataaatcctattaacttgacaaatgtcaattgagaagctctactagatacttgtcatatccaagagatacttatgctagtaaacggttgttgaatatatttagactttaggttctatgctggtgtgcacttggccatggaaagtggttgggtagcgaaggactacaaggcccaggatctgaagccaaatcacaatggcactaagttacaggcaggaatacagttggcataggaagaggtattacataggtactgcaattgcatgggaagtgtctggggtgttgagtagagtggagagaagaaggtttaaagtaaagcaggtaagccagtattggtatttagaagtatatacgggcaaataaatccaggctccatacacttcaggattggggagtgaggggaatactgtgataaagttataaagcagagtggctaagaaacaagatctgggcaataatactaatgtcctcagtcaaaggaaggattattcagataaaaaatggctaatcattacacatggtcacaaatctcattaagattcttcagagctttggcactaagaccaaattcatcgtattaaaggtaaggatttcccttttacttctctggtactcaattacttggaaaaggatggtcattaacttctctgtaatacagaatgaaaaagcaatatagagaattatggccatggtaatgagcttaagtcttctcactcactcatagtcttttacttttcccaccagtcctactgtcttagtttgcactgtaaaatagagcagagaaattacataattacctgaattatttagactaaaaaaaagtgattgctatgaattacaggagctctttcaaaatttcctcaacatgaaatatttttactcttttttcttatttttagtgattttagacaggctcatacatctctctttatggaaaatgattaacatggactcaactggggagaaatcaaattatacagttaataaaaactaaaccttcagtccacgcgaagtaacaatgtagcaccagggaaaattaattactgcattttagagtgaaaggagtcagacatgtcaagtttgaatttagccttaggagctacaacaaattttagttcttttgtgactgaatttttatagtacaaaattactcaaaataatgtagccgtattctacaaatgtaactagctttttaaaattttctaatgattaatgcttaaattgcttgaattttttgtaggaatcttttcagattcattgtgtaaatttgagtcattcctttggttctagctgtgaacaatcactgatcggtgaaaaattattaaaattgctccatttcacgagagtgtttaagtgtttttgatacttctaaagagattctcaaagtgccttgatgctgagaatttatatgtaatcattctcaaatacagcatagtgcagtatttaagagctcaaatgagtagttgtcaatggaggcagattactaacaaacaattgggaataaaccagtaatttatagacttaaaattatagtgtatttttctgttattttgtgtgaactagatagactgatatcctgagaagtttacattttcctgtctatttaagtggtactgaataaacctaggcaacaaaaaaattatataatatgtgattgttagtctctgtcttataatcaccagatcattttgaaggaagaggttatacaggtctttgagtgcaggcttctctcttgtaggaccattcagcctttgcttgaacacaagctgaatgaattcactactcagcacaccgctttttctaccagggagcagctctaatgcttggtgactggtctgacttaccgtccagataaagtcctcagcttgactctttggcaaactcccaggagttaactataaaggagtctgatccctcagacttttgatgtctctttaattatgaggatcccacttatttctttcttcaccagacagtccaacataaatgctctcgaggttccccatttaacataatttttagatctcacaactaccccggacacagagtcaggatgtagtttaatcagtgtctgatttcaaataaaaactccgaaagagtctgatcagacaactgtaaaagatcccttaagtaagtgtatgagatttggtatcacacaattccttatgtccactgcaggaaaataggtggttactttattatttcttcattgaggtaggttaacaaaattgacatataaattaaaattatatcacaatatttttctccatgtgatttccaatttcatattggtgataatgacatacgtttaaatagtgtaaattcagatagctaatttgattacagctgtgaacacacatcttaattaaaattattaaggtaattcttttcacaagacttctcaaatcactttctatacgcttaaggcaaggatcatcaatacacaggaaaaacatattgatagataatgatcactttgtatagacaaaatgaaataaaaatgagtaggaaggaagtgtatattttaaataagaaggcataagttatggctaatgctgctgcagtatcagcaccattactgttagagaatgagctgctattttgcccagcacccccatccctaccctcatcttgctaccattgcaacgaaatgattgaattgtttgtttctttcccaatatttgtgccttaaacttctaattctatttttccttatacttcttgagtgaataccccctcctcttaaaagtgttccttaaaactgataatgagtacttttctttgtttcttaacattctttttgtacagtgacctttccaccagtagcctcttggctttgtatgttataaaagctgcaaagagctttcctttggaaacaatccaaatgaaatagatacatatacttaaaagtgttttatttagacttagaagtttatatttgtccccacaaattctaagcagtattgatctatgtccttgccaggctaaaaccagacaggagacaaatcttactttaaaaaattctcttgtaagaataaagtacaactaaaatatctttaaaagcttcttcatccaaatgcatgacaaatgtaactctattgtaaatgcaaggtacaattaattttggcttagaattggaaaactacctaagaggacacatcaaggtcttttatggtgctgggtaggtttctaaagagcattaaatttttttttgaagttaattatgtgaattatgtgcccaccattttctattctagtgcttcttcctaaaagaaattctgcaaaataccaaatatagtgatttggcaatgattgatagggtgacaaagggaatttccttgagaggcaagaaagtacagtgggaagtcagagaataatcgatttgaaatctagtcttatccttaataaaaataacttgatgcagttatatgtgcactctcatcttctgttaaataagaataataatctctacctcctaattttgttgtagcatacactaggtaatgaatacataaattttatttcttttgtagtacacattgcctcaaagttaacaataagttgcagacttataatgaagtaggagatacacttgtaatctttaaaatgaaaagatttatagagattttacaaatttattgctaattagtatttcatttcttctccaattatagccattcttaataactaaaaagtgaccatgaaattcatcatcaataacatcaacacttggttcatctctatcttgttattaccatcttgtggtcatgtttccataaattattctcttccagagaatataataaacatggaaaaggtcataaaactttattagcatctctggaaacaaactgaaccaagagacattttaaactgtgtatcaaaatgagatcaggtttcaattcaattttattgacaagttaaaatctttggagcccagtacccgtgcacaccacattacaactgatggcacctagagcccgaggaccagtcctctgagggcctacctctactaccaccagcaaccttgcttcctccactggtagagtcactgcacaaccatgcatgtgcctcaggctcttgagagccagctttttcagcaacgcttccccagcaaagatatgccacagcctccacaaacagccacagcttaggccacagaagcactttcaaacaccactaacattgattacagccaaagaaatcataaggagattatactactgtgcccacacagaacaaaagccaaagcactctacccaatgaacaccatagatacatctacaggggaaaaaaaaaaaatttcctagaaaaggttctccatacaactggaaaaaataacggtttcaccagatgtgcagatatcaatgtatagacacaagaaacataaacaagcaagtaaacatgatacctccaaagaaacacagccactaacagacctcaagtaaaagaaaatatattgaaatgcctaaaatgtaattcaaaataattatcttaagggaactcagtgagatacatgagaacactgatagacaattaaacaaaattaggcaagcaattcatgatctgactgagaaattcaacagaaatagatctaataataaaaaaccaaacagaaatcatatttgaagatttttgtgaataaaattaaaagtacaattgagcacttcaataatagactagatcaagcaatgaaggaatttttgaacttgaaaaggagtcttttgaaataagccagtcacacacacaaaaaaagaataataaaagcctatgttacatgtgggatacaattaagtaaacaaatatttgcattttgggaattctagaaaaataaaagattggaaaagccatagaaaacctatttaatgaaataataactaaaaattttccaagttttagaagagatatagacatccagatccaagaagctgaatgattcccaaatataatcaacccaaaagtgttctctatgaggtatattataatcaaattctcaaaagccaaagagagaattctaaaaacagcaaaaacaaacaaacaaacaaacaaaattcaagtcacatataagggaatccccttcagactaacaggagatcttttagcagaaattttacaggtcagaagaatagtatgaggtaatatattcaaagtgctgaaagagaaagaaagaaagagaaagaagagagaaagaaaaaagaaaagaaaaagacaaggtaaggaaaggaagaagaggaaggaaggaaggaaagagagaaagaaagagaaaaaagacaaagaaagaaagagaaagaaagagaaagaaagagctagccaagaatactatgcacagcatggctattcttcagaattgaaggttaaagttttactcagagaagcaaaaactgaataattcattaccatcagaccagccatacaaaaaaatgcttaagggagttctttatcttaaagttaaaggataatatctatcattatgaaaacatacaaaagtatataaaactcactggtagaacagatatacaaataagacagagaaaagaatcaaatgatatcactacagaaaaccagcaaatggcaaagataaagaataagagaggaagaaagagtaaagaatatacaaaactaccagaaaacaattaataaatgatgggagtaactcctcacctattaataacaaccttgactgtaaacagtttaggtttcccaattaagagacatagacaagattcaactatctgctgcctacaagaaactaacttcaactgtaaagacacacatagattctaagtgaataaatggaaaaaatacattctatggaaaccaaaagcatgcaggagttgctatatttggacaaaatagacagtaagtaaaaatcataaaatattataaagaaggtcattgtatcataataaaggggtcaattcagcaaaaggacatatcaattataaatagacatgcacccaacaatggagcacccagatacataaagcaaatattattagtgccaaagagagaagtagactccaataaaataatagttggagacttcaaaataccacatttggccttggacagattatcccgatagaaaatcaacaaagaaacattggacttgaactgcactatacagcaaataggcataatagacatttgcaggacatttcatgtaataactacagaatacatattcttctcatcaggacatgaaacattctccaggatagagcatatgttgggccacgaaacaagtctcagcaaatttttaaaaatttaaatcatgtcaagtatcttctcagaccacaatagaataaaactagaaataaataacaaaaaaaaggaactttggaaaccacacatgtccatgaaaactgaacaacattttgctgaatgaccaatgagtcaatgaagaaaaaaaaaatcttgaaacaaatgaaaatggaaacacaacatacaaaaacctatgggttacagaaaacgcaatactaagtagaaagtttatagcaataaatggctatctcaaaagaagagaaagttttcaaataacccatgtacctcgagcatccagggaagcaaggaaaactaaacccaaggttagtaggagaaaagaaatgaagatcagaacagaactaaatgaaataaatacaaaatacaaaagatcaacaaaatgaaaagttgctctcttgagaagaaaaacaaaatcaataatccatgatgcagactaagagaaaaggggagaagacccaaataaataaaattagaaatgaaaaagaagacattacaactgataccacaaaaatacaaaggagacagactattatgaaaaactctatgccaacaaattgaaaaacctagaggaaacagatacagttctagacatatataacctaccaaaattgaacaagaaagaaatagaaaacctaaacagacccataaaaagtaatacgattgatcaataataaagtcacccaacaaagtaaagccaggcttcactgctgaattctaccaaacttttaaagaactaaaaccaattatcaaactatttcacaaaaactgaaaaggaaggaattctttctagctaattatacaaggccagcattaccctggtaccaaaactagaaaatgacacaaaaatatgttcatctatgcatttatgtgcatctggtgaacatggatgcaaacgtcctcaacaaaatactaggaaactgaatataacattacattaaaagataatagatgataatcaagtaagatttatctcagggatgctaggaaatttcaacatatgtagattaataaatgtgatgcattatatcaacagaagtaaggacaagaaccacgcgattctctcagtaggtgcagaaaaagtatctgatcatattcagcatagcttaatgataaaacaactttcaacaaattaggtataaaagaaacataccttgacagaatgaaggcaatataagacaaaactacaaataacatcacacctaattgggaaaagctaaaagcctttcctctaaaaaactgaaacaagatatgaatgcccatttttacctctcttattcaatatagtactaaaatgtctagcaattagataagagaaagaaaaagagggcatccaaattggaaaaaaaggaagtcaaattgtccctctttgcaaataacatttttgtgttattttttatttagaaaataaatttttgcattattttttctttagaaaaacctaaagattccaccacatgtctcttagaataaatttactaaagttacaagatataaaatcaacatacaaaaattagtagtgtttctaaacaacaagaacaaagtaggtaagaaagaaattatgaacacaatccatttaaaatagctacaaaaataaatacctagaaataaattcagccaaaagatgaaagatctctacaatgaaacagtaaaacaccgatttaaaaaattaaagaggacccccaaaaataaaaagacattccatactcatggattggaagaattaatatggctaaaatgaccatcatatccaaagcaatctataaattcaatccaattcctatcaaaatatcaatgacattcttcaaacagcaaaaacaattctaatacttgtatggaaccacaaaagacctcaagtattcaaagcaattctggggaaaacaaacaaactgaaggcatcatactatctaacttaaaaaatatatatgctacagtatagtaaccaaaaccaaaacatagtattggttcaagaactggcacatagaccagtggaacagaatagagaacccagaaaaaaaatccatgtattcacagctgacagatttttgccaaaggttccaagaacatacattggagaaagaatcggctcttcaatacatagtgctgggaaaactggataactgtatgcagaagaatgaaactagacccctctctctcaccatatccaaaaatcaactcaaaatgggtgaaagacttaaatgtaacacctgaaactataaaactattagaaaaacatagggaaaatgtttcatgacataggtcaaggcaaatattttatgggtaagacttcaaatgcacagtcaatgatatcaaaagtagacaaatgggagtatgtcagactaaaagccttctgaacagcaaaggaaacaaccaaaagagtgaagagataaccagtagatgggagaaaatatttgtaaactattcgtacaagagattaataaccaaaatgtacaaagaactcaaatgactcagcaacaacaacaacaacagcaaaaaacatataattcaattaaaagataagcaaagagggccgggcgcggtggctcacgcctgtaatctcagcactttgagagcccaaggtgggtggatcacaaggtcaggagatcgagaccatcctggctaacgtggtgaaaccccatctctaataaaaatacaaaaagccagacgtggtagtggacgcctgtagtcccagctactcgggaggctggggcaggagaatcacttgaacctgggaggtggatgttgcagtgagctgagattgcaccactgcactccagcctgggggcagagtgagactctgtcaaaaaaaaaaaaaaaaaaaaaagataagcaaagaatctgaatagaaactttttaaaagaagatatacaattggcccataagcatatgaaaaaataatcagcaccactaataatcagggaaaagtgaatcaaaaccacaatgaaatatcaccacacccctagttagaatgactattatcaaaaaggtaaaaagtaaatgctggtgaggattcaaagaaaaaggaactcttatacaccattggtgggaagtaaattagtacagccattgtggaaaaaccatgtagtttcctcaaaaaactaaccatagaactaccaacaattcttctactgggtattaccaaaaggaaaggaaattagtatatcaaagagatatctgcacccccatgtttatttcagtactatccacaatagtggagatacagaatcaacctaaatgcctattaaaagattaatagataagaaaatacggtgtatataggctgggagtgcgatggctcatgcctgtaaatcccagcactttgggaggccaacgtgtgtgggagttccagaccagtctgaccaatatggtgaaaccccatctctgctaaacatacaaaaattagccaggcatggtggcgtgtgcctgtagtcccagctactcaggaggctgagacaggagaattgcttgaacccaggaggcagaggttgcagtaagccgagatcacggcactgcattccagcctgggcaacagagtgagactccgtaaagaaaaaaaaaagtatatataatatataccacgaaatactattcagtacaaaaagaatgaaaccttgtcattcatgaaaacatggatgagtttgcagtgaaagttaaatgctacttgttctcactcgtatgtgcgagctgaacaagttgatctcatagaagtggagagtagagttgcaattattagacactgagaagagtcgggagagaaggatagggagaggttggttaatgaattaaaatttacagctagttgggaggaataaattttagtgttctatagcattgcagggtgactttagttaacaatcatttattgtatattttcaaatagctagaagagaggattttgaatgtctccaacacaaaggataaatattgaggtgatggatatgctaatgattctgatttgatacatgaatcaaaatatcactctgtatcctataaacacatacaattactacgtgtcaaccgaaaatagaagcaaaactaatttctggagccaagcacagacactatacgagtcataatttctgactatcgaaaaatgataatgacagtaccaggggtgggtttcctattcagggacaatagtgactggcagtaatggtggggaactattgaggaggacattgccttgtttcttaaatgtctctaagccttcaatatcttcagcatgtctgtgccttcatgctaattaaaaattcacataaatatgcttttaaaattagtaaaattgtggcctcaggtgagttcttaaatggcagtaatatctctggaaatacttaacctgttcattgaaaactgagcctctagagtgaatgcagctaacttttcaaagctcttagggaaaggaacactcacaatatgggaaaagatacctgtggggagggaacaaacaggaaagtgagaaaacagcaggaaaagctctgccaaaaaaggattcagtacattggaaactataaagtcagtgagaagttgatctttcattatcgtaaccagctgagaaaattctgcctctagcatctgctagtaaaggcgtgaaagagagaagactcattttgccaaacttagatcccactcatagctgatgagttctaactttagaggtggaaaataaaattgagattttgagcctggaagttcgatgaactttaacatagcatggagatttgcttattgaattttttcccgtttcctattttttcttttcatttccatccttccctccttccctctcatccttcctttcttctttccttccatctttcttccttgttttccttttttacctttcagtgaattacaaggatcaccttaaaacaaaattctttgtattctagcagcaaactttcttctgcagttgagagttgatatgcacttcttgagaaggaactgtgaacatatcgggtttaacatgttcctgtacccttaagaaaaaagcaactgactaagacaatgttgctattcgtacatataaagaggtaccaggtctaacactgtgaggtttgaaaaggaatggaattaatcaggaaaagctgttgagaaggggtaactcaaagtattaattcaaacgaagagagatacgcagaatgttaataggaagttataaggaggctttcataaaaatgcaatatttgtagcaatactcagaatgcaaaaagaatagaccaatgacagacaacataaaacatttatctggaccaagaaggcagtcgcgataagacttggaaaaaagaaataatggcctttgttggtacatggacatgagaaacctgttttcaggcaagaaataattaaaacatataatagcaatgaactttaaatattttacattatatctttagtgaatctttccacataatcagaagaaatacattttgttgttaaaacactagctttttttttttttttttttttttttttttttttttttttgagacagtgtcttgctctgttgcccaggctggagtgcagtggcaagatctcagctccctgcaacctccgcctcctgggctaaagcgattctcctgcttcagcctcatgagtagctgggactacaggtgtgcaccaccatgccagccttatttattttattttgtatttttagtagagatgggatttcaccactgtggccaggctggtctcaaactcccaaggtgatccacctgccttagcctcccaaagtgctggatttacaggtgtgagccactgcacccagccaaaagattagcttttagaaagacaaataccactggcctttacttatatgtttttagagcaatggttgtaatgttttccatgctcacagaaatattttataaactctttcctgaataactaatgtcaggaaccaagagctggagttaaccctagctatggtgtcatattgaattatgatatataatcaaccagatcccaaagttacccatagttgaagactctaacaaagtaggaacaggagtatatatctgatcgcccttcataatatagtggaatgaatcacacctttgaattttttagtgggtagatataaattttttgtgttctgggctgcatttctataaaggcagctttcattcaacctgttaaataaacatatttgtaattttggttatcttctcaaaaccatactttctcagctgttcttcctcgcatcttgaacaatataatttgctttcactgcttttcatatgctaccaggataactttagcattgggggttttatatgtagaagtggatttgcatagatctatacaagtattaccagaaaaatgctatacttagaatgataaattcaccagcagaaaacaagccatgactaataacaattttaaagaatttttcagggttttctatgagtgagtgtccacatgtagatattggcagtgcaatacagaacagtgctttctgatgataacttaaaatttaatccagtatatgttgattgtaaataaataagagttcatgaaaatacgtgattcttcatgtcaaatacagcctcccccactattccatctcctgcatcctttgctaattacaggatgttattcatcatggattttcctatttctctcagttgtaaagatgaaatgcatatagttttgttaatgtaaatattgatacttcccagggtatgttttgtttgttaaaatttgcttttttcccttaaatgtacttgcttggcattcctctaatgtcatcaacataaatatgttttaaggtaaggagaatgctgacttggtcccattcttaactctgaaaatattaaaagcactgctcctggtcatagtttctgcttctctgtatccttgtagaactcaggagagtagtctgggtataattaaggtcaagcactcagaatttataataatggcatctgtgttaccaacttcctcatgactactattaaatacagcacctgtactggttgcaccacatatctcctgcacagcccacccaatcctacaagagaaggattagttttattgtaataactcttggcttatatttaatggtgcttgtggtctcttactgatcaaaaacctttcaataagcaggatttattgatctggcacttaggtccctcttcaatctagccgcagtttatctttccaatgctattctatactactactaacaaaatcccatctcataagtataaggctacatattgctacttagaaatacaagttgtatatctatagttttgattattgtttcactttacttaaaattgtcttttttcccctggctgtgggtctatctaagcctggctctttcaggttccagctagagttcccaggcaccataccatttgaattcttggacatagattgtccacatcacttattaagtacttatcaaatactttcttatatcggtatattttatttttatacctagtttcccaaaagagacaatagccccatgatgtcatatatgctatcttactatcttatatagattcacatcacatcattatggcctggtaaggtgatttacatatggtataggaattattaatatttgtgtaactaacttgataactctaggcttattgccatttcataaggagtgcatttctagccttttagtaaccacactgcctagaaatgagaagttatccatttttaatattattctaaaagaagaaggtaatagaaaactccagaaatctaagaaaatatttcatatttttaaattgcaactctcacactccatcttcaaatctctgtaatctagcccccattacttactatcataacagttatatgcatgtgtgctttgctcttcaaataccataagctggaaaagtaaattttagctctttattgaaattctgaaatgtcattagtatcattttctcatttacttatcaattctttttttaatcaaatgcttattatttgttgagcaattaggcttcttacattgacctgaatacatacaggccctgtcagaaacaaattttagtgctaataacagctttcatgtaacacatcatcagaccttgttattttgaagaaatgacatgactaaaaatggggtcctttaatctgaactttctgaagatttactaggagagatgaataaataaattaacaccaagattttttatcactatgctgatgagaacatataattatgaaagttttctttagatttaaaagttttatcatgttaacaattctgagtccctttttcatgtttttcctatgaatacatcccgaatgcatccagagtgtaaaagattttgtttgtgcttttcttttcttttttttttttttgagacatagtctcgctcttttgcccaggctggagggtagtggcacgatttcggcttactgaaacctccgcctcccgggttcaagcgattctcctgcctcagccttcggagtagctgggactacaggcatgtggcaccacgcccagctaactttttgtatatttagtagagacggggtttcaccatgttagccaggatggtcttgatctcctgaccttgtgatccgcctgcctcggcccccccaaagtgctgggattatatggcatgagccaccatgcccagcttgtttgtggttttctaccttattttgtgacattgagacttgtggtttgtgtcaaaagtcataattttgagctgaaaattacaaagcatacaggaattaaataacctgctgatatacatggcacagatcacactgaggaattcctgttatatttaaaaggggacttcaagaaaacccttatgttgtctgttttacaagaagaaatttatattttgtagttaaaacattgaatatgtgcacatacacacagagacttcttgtttaaatgtctacaggaaaatagatgaaagtataaaataataccagaaattttccatttaatgatagctggttgaagatatacacttacttatattttatcctaaaataccaacaaattgatgttaaagaattaacagtgagacaagaagtttcagcaatttttagaagattgaaagtagatagaggattggcaagtgagcagaaaggaaaacccaaaaacttatgaacatgcagaggaggattccaaagtacaaatttggcaggtaacatcctctaacaacaggatttggaagtggaaggaatgtgtgaggtagaggaccaaaaactggaataggttgaacaatctgtttaaggaacaggtagcttgccttagcctcttccaatggtctccacatcaggcttctcccccaaacaggcaagcctcttgaggcacaggtcagcatcagcagtttctaaacagaagattaaattaaaatttgcatactgaaaaattaaaaactgcatactatgcagcaagaccaccagctccttcccagttcagccccaaaatgctgtggtttggtgcctaataataagaagacttgcagacccaaagcaaaatcctacagactcctatacatagagcatttggaaggcactgccccatcatcttatgtgagagacaacaaatgaccagcacactaatgtataacaaagcaccaatcaagttttagctcctcctatttaatatgaaaagacaaccagggatcaccagacttttaaggaaggctccaacatgaaagttaaagataagaataaacataatagaaaatctttaagtcatcctcactggctgttcccagtgttgggaattctctttctcatctttgctctgttcactccttcacttcattcactggctgctgttcaaatgtaagatactgagatatcttttcttaccattacatctagaatagtgttacccactgcctcaccctcacccagttcttggtcattctatttatttacttgaatttattttccttattatattaatcactgcacagatattttggtatatttatatatttgttgtccatctcctccattacaaaataaacattcataaggggaaggaatattgtttatagacaataattgtttttaatatttacttatttatttagtgaagatgagtaacttgaataaagcaaaagcaatgtagaaaatataattttaaaactctgataattcagagaactaagaaaacttatagccaagacacaattaaaataagagctatataaaaagaacaattagagaataattagctcttggaagttcaaaacgttaaaaattttaaaatagttcactattagactcgcaagacttggtaaagaaaatctcagagagtaaagagaaatgagaaatatgaacagtgggaaagaaaagataagaaggtgagagatcagtcctggaagtcaactgtctgactaacagaatttcctgtagtaatagaaagagtggaagggaggaaaaaattaaggatataatgcaataatattgtctagactataattaaagggcccatatattgaaaggcccaaagatgctctacaagctaaatgaaaaacagcaacaacaacaacaaaaacacccagttacttcctttagagaatttcagaactgggagctgaatgtatttcctacataaaggaacctcaggctaggtgcagtggctcacacctgtaatcccagcagtttgggaagccgaggcgagtagatcacttgaggccaggagtttgagaccagcctggctaacatggtgaaacctcatctctactaaaaatacaaaaattagccaggtgtggtggtgcatgcctgtaaaccatgatactcaggaggctgaggcagaagaattgcttgaagttgggaggcggaggttgtagtgagctgagatcatgccactgcactccagtctgggtgacagaggaagactccgtctcaaaaaacaaaaacaaaaacaaaaacaaaacaaaaaaagcaagaaacctcaaatatattaaaggaaaccaaaataaggtgtagagtatatatatatgtcttaaaacctaaaaaatacccctagtattttatattattaatgggtatggatatgtaaatatttaggaaaactgtaaaaaaaaagtcacgtgaacactaattctaaaatcatgatagtaattatccctgaagaagaagtgaagaaagtaatatttaggagaagtacagagaaggcatcatttatattgtataaaatattctattaaaaatgacttcagtctgggtgtggtggcttacacctgtaatcctagcactttggaaggctgaggcaggcagaccacttgaggtcaggagttcaagaccagactggccaacataatgaaaccctgtctctactaaaaatagaaaaattagccagacgtgctcacttgaacccaggaggtggagggtctagtaagccaagattgtgccactgcactccagcctgggcgacagagcgagactctgtcaaaaaaaaaaaaaaaaaaaaaaaagacttcaagcaaatatagcctaaggattaatgaaactgggtggtgggtataatgacgttattataatatcctttatactcttcaatggttttggaactatatcattgcttttttaaaaacagatgcaaaataccaaaagaaagaaagaatggaaacaggttacattttttaaaaatgtagggaagcaaaatgatattggacttctcaactgcaaaaacagaaactagaaaataacggagaaatttccacatgattctgagagaaaatcgtatttaaccaagcagtataaatgtgtccatccaaaatatcagtcaattaatataaaaatgtaatgaaagcacattcatcagacttaagaaactagtgactaacatgctctgtaaaacaagagaagaaaccaattaagagaaagacacgagaaatgttaaagagaaattataccaatacttgttaagaatggcaagatggattttatttgaactactgtagtagggaagagagacttcaatattgaactgacatcatctccaagtaaaacaaacaaagaacactttactcaagaccattgcaatgggagagaagaccactgcagaagagagacagactgaactcagctccactgaaaagaaagcagaaggattattaaatgctgacatgaaccagtagggagtacattagtggggaagttggtgaatgtgtttaggccatctgagtttgctaaatgtcacttacctgagttaggctcctactctcctacacagattgaaatagaggtgctatcatttttcacaattacatttcaaagggatatctctcatgtccttgagaaagacattcctgagttgtagaaaatttacatctcaaaaatagggagaaaaaattgataattgcaaaatttctaaagtaaatgctctaagaaaagggaagttagaggcccatattgaggaagaaatctctttaaagtttagtcgagctgataggaacattaaggtcatgttggtcagatccaggaaactgggggttcaacatgcaagagaactgatgatattgggtggaggcctacattaaattatgtgcatcaagttcatggagtgtgatggaagccaaagcctggaggattccaagtcatagttcacctgaaaaagaacaaacaaaaaaggcattaaatgatcctgaagtattggaccatgtagaaatgaatattgaatgagtccttacagttctattggtcaatttgaaaataattagtggtagatatgccacaaagagatgatgaaaatctacccaaaaaatgtgaagaaatcaaaaaaacaaagatagctggaaaatcccaaaatacatggagattaaacaacacattctaaatagcacatgggtcaagaataaatctcaagacaaattgtaaaatattttgaactaaatggaaattaaaatatcactttttaaattttgtagaatgtagtgaaagcactgctttgagggaaatttatagcattgaatgcatattaaaacaatctaaaatcaataagctaaccttccaatttatcactctaggaaaaaaaagagcaaaggaaatccaaactaagcagaaggaaagacctactacaaattagaaaataaatcaataaaattaaaaataagaaatcagtagtgaaaaccaacaaaactataaactgcttatttgaaatgattaataaatcattaggcctttaggctaagaacaaaagagggaagttaagaattactaatattatcaatgaaagcaggaatataactacagatatctggacaagaaaggataataatggtatattgttaacaattctatatctacaaatttaacaacaaagataaaatggaacaatttttgaaagatgcagtctaaaaaaacttgtagaaatagacaaattgaataggcttttatctattaaaaaattgaatcagcaattattaactttttaaagcagaaagcaccagacctagataggttcactggtggattctaccaaacacgtaaagaagacattataccaattctctaccatctttttcagaagatagaagcagagacactaacttcgtaacacagtctatgatgctagcatcaccgtaataccaaaaccagacaaaggcagcacaaaaaaagaaaactgtagtccaatatccctcatgaacacagatgcaaagactttcaacatataacagtcagtatagcaaattgaatcagagaatgtataaaaaaaattatacaccacaacaaactgtgatttgtcccaggtatgcaaagctggttcaaaattcatgtaatacatcacatccacaaactaaagaagaaaaattacaatatctatagatgtacatcgtatcaatagatgtacctcacatcagtagatgtataaaaagcatttggcaaaatccagcatccattcatgataaaaacaaacaaaaaaactctcagtaaactaagacagagaaacttcctccactggataaagagtacctataaaaaaatctatagctaacatcctaacagtgagaactagaagcttttctactaagatcaggaacaaagcagggttattccctctcactacacctcttaatattttactggaagttgtagctaacacaagacaagagaaggaaataaagttacacagattaggaaggaagagataaaactatttttgctcacagataaaatgattgtctgtgtagaaaatctgcaggtattggcccccaaaatactcctgtagctagtaagcagttacagcaaagtttcagggtacaaggttaatatgcaaaagccaattggtttcctttgtactaccagtaaacagaatttgaaatttaaaatacaataccatttatattaccacacacacacaaaaggaaatatataggtatcaatttgtcttcaactattttgtgctgctgtaacaaaatactacagactaagtaatatataattttataatttataattgtgcatttaggctgcatcataatatggcaaaaggtatcatatggcagaaaggcaaaaagacagggagatatatgaggggaaagagaacaaaaagaaggccaaactcacccttctgtagcaaacccactcccatggtggcaacattagctcattcatgacagtggagcaacgcatggcctaatcacctcttgttatgccccacctcccaacactgttgcactgggtattaaattcacatgcttttggggtgacatactcaaaccatagcacttctggtccgccagaatctatgttcacctcacatgcaaaatatattcatttgatttcaataacaccaatgtcttaacttgttctagcaccaactcaaaagtccaaagtcaagagattcatctaaatcagatatggatgagactcaaagcacaattcttcctgaggcaaattccctctagcttgagcctatgaaatcaaaacaagttatctatttccaaaatacaatggtgggacagacataaggtagacattcccattccaaaagggcgaaataggtaagaaaagaggggtgacttgtctcaataaagtccaaaacccaatagggcaaacaacattaaatcttaaagctggagaataatctctgttttgaccctatgtcccatctttttagtacactgaggtaggagttaagccgccaaggctttaggcagccccacctctattgctttgctgggctcagcctgtatagcagctctcacaggatagggtgtcatgactacagctctccgggtggttgttgcagactggtagctctgcagttctgaggtcttggggatggccccactactgtggctccatcagaccttgccctagggaggactctctgcagtagcctcactacctgtattccactaatcattgcttagtgactctgccccgaagcaggtttctgcctgggccccaggctgcctaatgtattctttgattagtggatgctgccataactccatagctcatgaacttggcacgtctgcagagtcagcaccacataaatgcctcaaggcttactgcttgagccctcaggaacagtggcccgagctgtacttgaggctgcttaagccacagctgtgggagacaaggagacaagcttcttgaatgtggggaacagagttataaacacagggaacagaggcccaaagtggccctagtcaaggagcttgtggagggcatcctagacctgtctcccaaaatcattctgccctcctacagctctgggtctatgataagagggaaagtctcaaagatcacagaaatgccttcagaatcattttccattatcttgatgaataacacctgtctttcttctagccatactgatctccttatcaaatgtgtacttggccatacccttggatttctttcctaaaaaaggtcttttattctgtaccatatggtcaaggctgaaactcctttaaatccctaagtgtgtttccctttaaatcattttatttaaatctagttttgtctttaaataatttatttcttcttggattttactgtatgaagttaaaagaagccacacaactcctgtaatattttgcttagaaatttcttctgccagatatcctggatcatcactcttaaattccatcttccataaagccctggggcatggatacaattcagcaaagttctctgccactttatatcaaggatggcctttactccagtttccaaaaagatgtttcccatctccatctgagacctcatcagaatggcctctactgcccatatttctaccagcattcctatcataaccacttaagtaatctatatgaagtttcagactttccctgtagctctccttcttctgagttttcaccagaatcgtctgtaatcctccatttatagcaatacaagctttttctagcattcatttcaaaactgtttcagcctctactcattacctagctctcaatcgtttccacattttcgggtattcgttatagtaccactcaattcctctggtaccagttttctatcttagtttgttttgggctactatgacaaaacaccccagactgggtaatttacaataaacaagaatttattttctcacaattctggaggctgggcactctaaaatcaaggggccggcatccatcaaagtccttcttgttgtgttataatatggcagaaggcatcaccaggtagaagggcacagagagtgcaagagaggaagtgaaaaaaaggccagtctcacccttttataacaaacccacttgcatgataatgaagccccacacactccagtcatagcagcattagtccattggtgagcctggagtcctcatgacctaatcatgtctcattaggcttcacttcccaacactattgctttgggggatgtttcctacacacaattttgggggatacattcaaactacagcaaaatctagcaaaatatgtacaagatctatatgaggaaaattgcaaacttcttttaaaaggaatcaaataaataatcgtgtgaaattcaatgtttatggatagaaagactcaagattttcaagatttcagttaatcccagcttgatcgatagattcatcacaatccagcaagtaattttatggatgttggcaaactgattctaaagtatatagagagaggtgaaagatccagaatagacgaaactatattgaaggaaaacgataaaatttgaggaccaataacacctaacctcaagagttaatataaagttacagtaattaaaacagtgtggtattggcaaaagaagagacaaatagatcaatggaacagaatagagaacctagaagtccacccacacaaatatagtcaactgttttttgcaagagaggaaaggcaatgcaaaggggaagacagtcctttcaataaatggtgctggaataattgcacatccacatgcaaaaaaaaaaaaaaaaaaaaaaaatctagacacaaaccttgtgtccttgacaaaaattaactcaaaatgggtcaaagacctaaatgtaaaatgcaaaactgtaaaactcctagaaaatgacacaggagaaaatctagatgaacttggatttggcaatgacttttaaaatatgacaccaaaggcatgatccatgaaaaaaagcattaacaagctgtccttagttaaaatttaaaaacttctttctgaaagtattatcaaaagaatgaaaagacaagccatagactggtagaaaatattgcaaaagacatatatgataaaagactaccaggtatggtattttaatctatattttaacaatataatttttatctttttgagtctgaaataggcaaagaactcttaaaactcaatgatgaaaagcaaacaacccaatttaaaaatgagccaaagatcttagcagacatctcactgtagaagataaacagatggcaaataagtatatgaaaatagtctcaacatcgtatgtcatcagggaaatgcaaattttgtaatattcatacaaccaaattttagagaaaattatacagaatggtgaggaatagaaagggaatatttctaaaaatgttacttcacacatttcatactagaaataggagataatacttaaatgataaatgaataatgtcaacatgagcatgatatttacaaaacaaaagtaaatacttaaagaaacagttataaaaaatgaaagtggttgcctttcaatagggtactatgaaatggaaagaaccgtggacaagaaatgctatttttggctacagctttatggtaaatgtaattatttaaaatatatgtagttaattgattttctaagtaataaataatatagaaagcatataaataaatgtatgaagtaataaaatattttacttgtcatccagacaataggttcaaatgacctttagaaatctcaaacgtaagttaaaagagaaaataccaaaaaagtaaataaatttaacaaaagagaaaacttagaactgaccctctggagaaatgaaaaataaaataaaaaagagagagagaaattagagtttggtgttaccatttggattatgcctgctcccctaaacttatgtttatggcctaacccccagtacctcagaatgtgacttcatgtggaaaaaggatcatttcagatgtgactacttaatgaggtcattagagtgggctctaggccaatacaactggaggccttatattttaaaaacagaaatttggatacagcttggcacccggggaagttgctatgtggaatgaaggcagagattagggtgatggttctacaagccacagaatgccaaatattaccagcacaccatcagaggcatgcaatggatccttcttcacagaaagccccttgaaagaaccttacttacaccaggatcttagaattttggcctctagaactgtgagaaaataagtttcttcttaagccaccctatttgtggtactttgttatggcagccctagcaaactaatatagttactgtattagaaagaggagctaaagatggctcagatgtctgttaaatccagcataattcgctgccagtattcttgaaattatggaagaaaaatcaattaacgataccatccaatatattataaatattttatatgaaatatttatataattgttaattcctcttaagaaattagtattaggaaagaagagattgtctttcttggggccatggtattcttcattcttttagatgatgatagctgtgttcccattgtgtctccattattaccaacaagtcagttctgaattgagtatccaagtgaggcacttactcatgtcttggtttcctggctcactagctatcatctccatttttttggttcttattttttacccttgttttaatggtatatgtttgctttattatgacaagactcttttttttggcagtagttaggatataaataattagtaaataaatgatcacttctgattaccatagctctagtggccaacaaactcaactaacatcaatgctttttaaaaacttgtctctgcagctatggtgactaactgtcctggtgtgcttgggactaaggggcttccaaggacaagggactttcattgcaaaattcatgacagtcccgggcataatgggatagttacctatctgaaccacttctgtgtctaacagctcacaagcatgttttcactgtcactgctttgggctctggtccctgtttgcaattatgattacccctaataaactcatacatagttgagttgattattgaatcatcttgctttgtatgataaattttgcttcaaccaatgagaagcaataatgcaaataaccaagttctaagtctcagaaaatcctccttaccattgtttcaaatggaaacttgtggttggtcttgacttcctgtgagagagggaggtttaccgagaccttgagctatggatattagatatcaccagggattagggaactggattgtgttcttgctgggctgtccaagcctggctgccctcatggcttagtctcttgttggttgcccttttgaatggttttctcttttctcttaggccctggggatttatccagtttgctttggtaaccaaacattaaatgatcatgattttgagaaaaataacataaaaaacattcctttctcatgatttcccccacagggctccccatggacctgattcttctgctaccattggataaaataaatagcagatctcctacttttgtggttacttccagataataacaagttatccaaagtcactatagtttccaaagaagtctgtgttcagaaattaatgtctgacattataataaaaaatccaaattgtattcaaaattaaacttcttccttcctgtagggaaagttgtatgctttgtgtttcacttcgatctttactaactaaccccatccctatctcacaactattatctgagatctcagaccccaccatgcttggagtatagcaatggagaggagataagggagcaggagagatatctaggctaacagaatttggtggctaatgagattgaaaagtgtctcgagacacttttctggggttttcagagaccctgcattgcattaaatatctcatctgtaggtacatgatttagttggtgtctcttccatacttactatattttaacactccctccctcatgccctaagaataggtgatggtaaagattcagccatcacccccctacccaccagtcttcttagaaatccttggaagaaaacccacgttagctctctctcatgacagcccacatctgctaccaaggatcattactttagatccatgatatgtagcagtgcactttcctttctcatactgcctaatttttgtttgaccacttctcaggtagctctagccacagactctattttgagatttatcaggcctgagtcagacactagctgctgtgtttcctaggttccaaagatactttgaagcttttctcaacaggcttgcaaaaaaaagagatcacccctaccccacccaaccaccaccatggagatgatgacattcatagcacacctttttccaaagaagttctacttgcaatctccaaattccctggccatttcaactcaacctttccatatgttcaatgtgagtgtgtggctccacgtcacaaacgatgacttaagacgttatctgtacagggtctgcctagtccatcagaacctcactttggagtgagtagttggcacctattatcttgtggccataactatcactgaaactgatagagtgcaatttcccataactgacctttttttcttagaacttatcttccttcatgacttgctgaataataaaatgcttttgatgcatttcctttagccgttctttccctggaagacaacatttgcccatgtgccattgatagctccaagttggcataggtgattgcaagctctctgagtgcaaaattctacttttattccatttacagctgggtatcacctaacatggtgaacttcatctaaatagttgatttattatctccaccctacaagaatttgataataatatttcctaaaaaatatttacttcttaattcttaagaaacattatgaccaatttcacaaaaagtgataagattgaagagacactgatttgcccaaataacaggaagagggggaagcaagtaatattatgttttcttaagtaagggtcttacaaattcaagcattagccacaatattatgttaaatgttgcagaattgaagtatagctttaagatttaaaatgtgtgaaaagtaaacattttgagagaaaaaaataaagcagatttagaatagcatgaacttcacttgataaaagtttaaatccttccctttgtaatgggaaagacccttgaaaggtaaagactcttcagtgttacaatgaatataaatcattagtaatataaatcactaggaatttctccaataaaataatttgatctatattattatagtcaggaaaaaccttcataagtaggatgaatccatagatgcataattaatttagctgtgtcctcgcttcctgtaaaatacagcatggggtaggaaaaaaaaaacaaacaaacccacatttccaaatgggaaagtcaaagcaagtcagtcccaagtaagctgactaacatttataaagtaattctcatccttgtaaattgccttcttgcaggaaacagaccttatcctgacttttaatatatcaatgcaccgatcttggtggatggagaatggaccaggatgtacggtgacgtcagtgacacctgccccagactgggccccagaagaccatcgctacatcacggtctcagggtgtttgctggagtaccagtacatagaagtggctcatagttccctccagattgtcctcgcagtaagtgttggcagccaaccgctccttctagtgcctctggggttgttttatttctgtgcgaactcagtgcacacaaatggaatctgtgggtaaagtgtggcctttttgctttttcctcattaatgcgacttttaacaggaaatcctcaggttaaactaaaccatcctctggacttagtgtgctgattttcttcgacaattagtaaataccctttgttatcatcagcattttacataggaaatccaatcagtcaagatgtgattacgtgacttttggtagacttttccaaggattctgaagggatgatcagagatttttttcataacgttctacagtactcaaaattataagatttccataagtgttttctcttttagtgcttcttttggctgtgctgctagccctgggatttctctttttcatttgccctatctccttcttccttcctagatttctcccaggcaccatccatcacctttaatctcccactttttttccagaaaaaatcacattttctatagattctaattctaagacattcatgcccccatttttcatagtactgtaacaataaaaaaaaaaaaaaacctccttctaccaggaggcagtagcacttacaaataacatatgtgtacaacatatgcctattttatataaaatacatgatttaacattgtattactatgacaaagagataaattaaaacacctctttctcaagaaggccaactgcataatatcatgagatgtataaagttaaggcaactttatgacacatgaatccatttattcattacagatcttaaatgcagaactgcatagatttttcttagattctatgtggatgtgcaattgatgtgcatagtattaaaattgttagcaacaaatgatgcaagcagaatctgctttttacctctttagttaattattttggaaatgatattgactcacagttcttggataacaataaataatagtttctgggtagagtggcatacaattcagagaaacataaaattcttctggaattaaaaaaaaaaactatgtgagtgtgtcagtgttagatgatataactaatatatccttgttatatttttaatggaatgtgtgtgcttatgtgtgtgtgtgtgtgttgtgatagactaaggaagctaagtatgctatgttagtaaacacttccaaattctctgtaaataaaagtcatgaaggtttcttcttgtgtgtcagcaggaggctccactgatcactgtcagtaaggaaacaaggctagttgagtagccagtatctccatcatcatgggttactgtgccagaaagtaataatagctgtggagggtctacatgggcacacacatgcttctgcttgggaggaaggctcattgttcacagttcattgtgcggaattggtcacacagtcccacccaatcacagaatggacagtaaagaggaagggctgtttatttggaaatcagcataaatgatgtccagaacatttgaattatgttctttgctaaaacactaagtaatatcccttgaatatgttcaaccatagacactccttccaattaacaaactcttctgtaatagttttaaatctaaaagtgcttactttgcttatcctgaagtaaaaataagttagacttgacaggatggaagtagccatttcattctttaaaatccatttaaatcaagtaatcattatcacatgagaaaagtgaaatatttctgtgatttggggtcagataaaatatctttatatatgtattaaaaggaggttttaaacaaaatattccttctgtagaactgcctatctttactgtacccacaaaattttggaaaatttccacctatgttttaaggatgaagtgaagatacagtttatgtgcatggatatttatatatgactatttatagagttttttgaattagtttatgtgtgtatgtgtgcgtaaaatagattcacagatttattaaatgccacataaaatgctgacacatagggaatgtgctaaaaaaatacatttggacgtgggggcatatgttgaagttgacatacatacccaaagaaaagataattttccttaagtagaaaccatctgtaacagcaaggtggctagagtgcaaagaagatggatgggttattgctaagaacagatgtgaccaatatttcatgctactggctcttgtttctcctgtctgcattccccccagtggagtgaaggaatagtttgagtaaaccatcctaggatgtgacatcttcacctctaccttttccacctgttctttccaggggtgtactacttttgcaatgttgactgtggaacaccagagttagcaatggcacagccacggcattacttggagaaatttcaacacattttctacttttgagcttgctcttatctagccagctttgggttgaatgtgtctgctatacagaaaacttagcaaatttgaactcgagttttataatgcaaatcaaaaaggcttatctttaacaacttgctctgcaaacaaaatttcctatcttcattctgatcactgatgtaatgattaattgatgaaatagtgtcttaaatctctgtccctccccttttgtgttacccagatcatctccttgacaatcaaatgttccattaaatcagtctagtggaaaattcctcagtgcttgtctccttctggcatctagagaagcaaaggtgtcaggacctctgaccttgaggctgtcacagtcaaatatacagcaacgttccccaaagcacaaacgaggtgcaaacaggcacatttgggggatgtggtagacaaagaatatggcttatgcagtttaaggcataatcttggcttcttagctccatgcagttttgtaaagtcagctgaactctcactcttctcactgttttcatccaagtctttgaaactgccctctcttccagcatatctggcttagatctgctttcataaactgctgctttctcagccactgctcttgattaactccaaatctctccagctctttgtctccaccctcattcagcctttctttcacagattcctgaaccctggcaagcctgtcaccctgttgttcggttttctgccaatcaactcctggctgattctgaaattagcattcacaaagcccacatttgcatcacacatacataagatatctccaatctacagccaaaggaagacaagtataatatccatataattgggacgaggggctattaatcacacagcttccagccgtgcagaaaagactgccagaacaccataatgatgagccaggtgtgatatttcgagctttctccttctccagccatattttcttctggttagcatcagatagcacattcaaaaagaatacagatgtgcacagatttaataaaaccaaaaattaaaaaaatccacattttcaaaatagataaaataaatgtatgtggggagagccaaggaggagatcaattggggagatattattgttcacgttacagaaaaattaatcggatcctttcaatgtgtgattggaacagcatggattataaaatatgttcacatgaattaaatcttttgattgtgtaacagtcctctgagggcagcagaataggttaaaagctcttcctaagatattttagctaataaatagggacaatgaacatgctgtcatagcaaggttgggaaatagtcttcaatctgaatgccagcagcagctgatggataatggattcccggagtgtaaaaattcagggttcttgagcagcaaaggatgccatgattgattagctatgtctgccacaggtgaggggaatgaagagggatgtgcctcacatttattatgcacatattatactttacttcctgtgataaaaacaatgaacagggagtgtgttttacaaacaaatgtgcagaaagaataatttatatatatatatatatgtaagctttctgttttcccacagccattagtgttgacttagaaacagtgtacaaatgagcagggaagccatggatgacattagaaaaggttctaatatctggtacctggttcatagctaaaaatagtttaaagtcaagttctccttcggttatatctattccctattcagaaaactctctactttgtagagtgcatgaaatggtaaaaattatttttcaacagattgaggaaaaaaatgtagataaaatgcatacattggggtcagtaaagtcacagatgtgtttagttatgttgttaataatttatgtttgccatttgtctggctaagacttactgaggataccgttagtgaagaagttttccaaactttgaaactctttatccaagtggacttgaggttgtgttgggaatggcacatgggtgtttctttggatgtagctgatatgtatgttgtatgcatgggagtggccttattgtgcatgttgctgtttgatgcctcttttaatctggaaacattcacaaagattttatttttaagatttgaattctgacttccacgtcacctagaatattgccattcacgttttacatgttaaatctaagttgtgaacttgtgtagtttgaaagggatgagtgggaagtgatatgagctgatactagctactcagcagtcagaagtggtgtggttgccatggccatgggactatcctttgttacatttatttgaattaaaaaataaaacagtattttaaaggaaaaattagtttgatttgaattgattcacagtagataatgatttcatcatttaaaagttatagattttggccaggtgtggtggctcacgcctgtaatcccagcagtttgggaggccgaggccactggatcacgaggtcaggagttcgagaccagcctgatcaacatggtgaaacccatctctactaaaaatacacacacaaaaaaatagccaggtgtggtggtgcacacctgtaatccccgctactcaggaggctaaggcaggagaatcgcttgaaactgggaggtggaggttgcagtgagccgagatcatgctactgcactccaacctgggctacagagcaagactccatctcaaaaaaaaaaaagttacatattatgccatttttcaaaaactaaattagccagatctgcagcttcacagtttgacaaaaaatatacccaaaacgcatgacttcttaaacagatagaaaatattatttcaaaaaacatatattgaaattaaataacatttcagtatttcccaaactgttattatatacatcagtttgaactaggtgactataggagaaagaagtaggaatataattaataattgtttgttatgtcttggtagtatttttggtgtacttcccagaaattactgttgcaaattgggcaattttcaattctttgctttcattaaaattgaaggaagacctaatagatttgtcagttggtagactatctgaaataaattttgttataaataattatgtaaactgtggcatgcaaaaagttgctgccgttgagtgtcatcattataatgaaaagccttcaatgcttctctatttagagaacaagatttttcaatgcttaaaccttaaggagaaaaaaaacctagaaattgaatcgtccttaattctgtctcattctagtgctaatgcttggtggctcatgcctataatgccagcacattgggaggctgaggagggtggatcacttgaggtcaggagtttgaaagcagcctggccaacatgctgaaaccccgtctctactaaaaatacaaaaatttgctggacatggtggcggatgcatgtcatcccagctactcgggaggctgaggcaggagaattgcctggacccgggaggcggaggttgcagtgatctgagatcataccatttcactccagcctgggcgagacagcaagactctgtctcaaaaaaaagaaagaaaaaaaaaagaaattcatatcaaataaaattttattttatacctagtagttttaatcaatatttataataatgttgttttgatcaattttatataacaataattgtgttgataaacaagaatacattttcaacacaatgccttatggacatgggaaaaaatcaaatttaagcttatacatatttaacatatatacaaatttatacctatacatagatattttctgcaaagaagtgtgatagaattatcaatataaaaatttcttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaatttcaagttaaaaaacattagcacaagcagtggagttcacaaagagaagaaattacataaaatgtttgatctttaaacaagaatgtatacgtgtatctttaaataaaagaaggtgaatttcaaatcacagtggtattcaaatttcattggatttatttaaaagaaaaatgtagtaggtccctttaacatctattagtattgataatgtgccaaaataaacagaccttttgcagccaattattctagtccatactacccaaagaaatctacagattcaatgcaatgtttattaaaaatctgaatagcatttctacagaaatagaaaaaaaaatcctacaattcatatggaaccacaaaacaccagaataatcaaaacaatcttgtgaaagaacaaagctagaagtatcacacttcctgatttcaaaatattaaaaaagctgcagtaattgaaacagtatggtattggcataaagacaaacatatagaccaaaggaacagaatagagtccagaaataaatccacatgtaatggtcagctgatcttcaacaaggtaggcatttaaataatgtttaaaaatatcaagcatcaattccaaatgtacatagttttcaagtgtttaattctttccaaatatatgggagcagaagggggcagtactctaagtcagtagttctctatactggctgagaataggaatttcctattcagttgtttaaaggattaccatgatatgacctactcatggaagtttgttttccttaggcttgatgtagggactacatggtacacttttcaaatttttcatcagaaatattagtgccttccctttctcttcactactgattcttctatgtcctaaattgctcagaaacacctggtgtctactcaggaaagatgattctctaataccagaatggcatcacagctctgattgctccattgactcctttttaggccctgagagtcatttcctttctgagactgcaggatcaagcctttcacacaactagccttttatcagataatgagtctgtgtatctatactgtgcgtaccgtacttctcagtaaatcgtgagttggtgtagatctggaattgaaaactaagtcttccagattcttcctagtccagtatcaaagactctacaactgttttcttaggacaaactgtcttgtgcctgcaatagaaaatagacagaatgactagccctgggcttctttccctgttcccatggtggttcaatagctttgttacatggcttcagttatgcctactactccaactctagttctcctgtgtaccagaaacacaaacctgcttgtcaaaagatagtaatccagtaaacaaaataaatgtgtttgtttttctgtaacatcagaatagtttataaaaatagtcacaaaaatatgggaagaagaagcaaataccaatgtaaatagagagttttccctatggcaatgttactgaaataggagaatgaaggtggtaagtagaacagggaaaggacatttctgggcacagctcagagttgcaaagcatggataaataagcgaagtcccacagactaatttcagaaccttgactggatccatccctgaatagtaaaaaatattattattactgaatagtaagaagtaagttgttgttacttctgaaatgggcacaaatttaactttccaatctattctctattcctctaaataataataaattcatgtgaatatcatcccctttggagtgtaacaccttgattgtaatgtcaatcaagttttggttaaagtcaacagtatacaattatcatgttctaaattttatttcactttactactgaaaagtgcagttgtaaattggtgagtggttctgtgagcaaagtgcaagaacttaaacagcctctaaagtcagattacgtttaagatttttttttgcttttaatattctcaggtattccctatatgcaaatttagtaatataaggtaaaatattcacagtctgggagcaagaatccttaaatcttatacccagttgtataacaagctgttttgtaattatgaactaaatgagataatgtttaagaaattgccttgaaaacaataaaggtaatgttatttattttctctttagctcagtttcttccactgctcattgagaatactattagcttttcaggccaactcacagtgacatacaaaaattaactaaatcctactaaatttacttactccccagatagaactgtgattcttaaagctagtgtaataatatttagtgtagttcaccactatcctacacagcagcaaattttatcccatatcaaccattattatcaggatgcaatatatttttctatgtgtactgtttgaagcatatcacattctaaggaaatgtttggaaacatcagggaataaaaatgccaacacatttaagatagtagtaaggattatatgttgcaaaaaaaatcaccaataattgtgttttcttagtaatgtgagatttaaaagttgaaattgtttgcatacaatgttgtgcaataaacaatgtatgatcccatttttatatttgattttataatcataaaattatttcaggaagaagtgaagtacattaaattataagttatttcagaaataagtaaagtatatgaagatatattaaaatacagtattttttgaaagacattacaagtttttggccttgaataaaaggtcagcatccttcttcataatactgtatataatattattgccttttaggatgattttccagtcatgatcagttattatgatacaaatttcttaaaaatatatctttgatggcaattttctcttcatgagaacttctaaacatggtgataggacaataatagtaggatatgttagtgttttcaaataagagcaaggaattctcaaaggaagggtataaagatgacagctataagatgagggataatttattgttcagtatgttatacttgagggaaaaagaatttaaaatatgggcagacacacttaagctaaataatttttacacagtaaaaaaagagccattggtgacattccttctgtaccttttgcttttaccaatcttataaataggatcgaaaactctactgttcccaacccacacattcttctatataacaagatatctgattcctagttcttattattctcttgccttttcctctcctcatggcactgtggctgcttctgtcctgactgccatttgtttctctctgacacttgtcccgactgccgttcattttgttagactcctatcaagcagtggccctgagagtcaaggccataactttttatatacatatgtttactacgtgtaatcttctaacttagttcatactattacactttattatactcaaggaagcagttatttgtcacgtgattattttggttagtgctaattgcaaatatggctctagagtcatggactgaagtagagtgtcctgtcttcaaggatattttgagtttctttatctcctcttatatcctgaaatttatgagttattccattctcctttattgatttccaatagctctacctcttaagtttgattagcttatcatcaacaacgttataaatagagactattcctttttcctctcacgacctagtgtcttctagcaattcgtctttactttccctaccccctgttccataacctaattgatttcttcatcagagaataatagcaggttctattttattttttaatgtcttagtttttcaactcatacgcattctaatttcatgccatcttcttagtttaatgccatgtttaggttgattcagtcctaccatacgatatgttagcataaaaacaatttttcctgaaattatactgtgaggtacggaaaacttccatgtcagtgattcaataattgttcacgtatttctcttcagcaatgtcttttttcgcaaacagaaatgtctgtgttgcttacaatttaaaaattagaggcaggttgtcaaaggaagcttgataataaaaatatagtaaagaagtcaccaaaatagatgacaaaatgtgtttggccacatctttattgtcctttaattgtgactctgggatctgaattgatatgacatagccatgtggtactcacatgttctttggttcaaacttgtggccttaaaagcttcaaagttgctgtgatcatttatctgggctgatttggaagacccacatcccggcagtagtatggatttttcttctgggcaatatattgtggcaatataatagggtgcacatgacaacttatcaccaggatagtatatggagtaatggatcatagttgctgtcttggaatacaggcagaaacttcattagagtctggatttaggataaccaatggcattgtattcttccatactgttcaactgcttagagttagaaacaggtttacattcattcagtcactcaacagatattcactgagtgcctctgccctgcattggtatgaagcactgtacatacaggggtgagtcaaagtctttgctgtcaggtaaattaaattcttgtaaggagacgcaaatgaatatctatagtatgttcagtagggtagctgctctgctgatgaataaaataggataaggtaaaaaagagccaaaagagaatggccagggaaggccattctgtgataggtgactttagagctaaaatctgactgcagtgaggactggcccatgtggatatttgcggaaggagtattataggtaggagaacattcagggtagggaactctactcaggccagcattatctggagctctgaccaggtatagcctagtctgcagtcagtaaatacatattactattcttaaaaggaagctagcttacatatatttttcttcttccctctttctgacttcttaaattctcctctttcattaaaagattccccacattctttcagaatctaatcattctctccacctccgtttctcacattttttggcattacatttatttttcaactttttctatccacctcaccatattccatttatctgtttccttctgcctgacaagcctgacattgagcgtactgctccccctctcaagtcttcccctttctgtcctcctctccatcactgtcaggataaatatcatcatccccatttctgaagactggaatcatgctgtcatcttcactctgttttctatctcctcccatgtaggttggtgcaaaagtaatcgcagttttgccatttgaaagtaatggcaaaaaccacaattatttttgtaccaactccaaaataatccaaatgcattactatgtaactaaattttagagaaatgttagttacttgattgctagaagccaatatttttccaagtgtttctagaaaatcactgttgttactcatccattcgattataaaacctattctccagaatcttgttgatgttaagtaacatttttatggtagacaatgccttgccaaaggttgattggcatgactcattatcatcactcttccctctgtacagatgagttcatataaacattggaattttcaagagtgtttttaaaagattcattcagtgagaaaagtatagaataatattaataaaatttgattttgtatagcattattttaaacatagtttatagaaatcttcacatacaaattattgtgatgtgttcaacaactccataagtgagattaaatctgagtgccatgagcatgtgtctggaaaaattatttgatcatttaagttataaattaagaatcactgaaagcacaattaaatatatctgcaagaacatttacctgagattaatctttgctttctgtgtgtgtgtgtgtgtgtgtgtgtgtgtgtgtgttgcataatagattttttcttttatatcccatatgcttacagatgttaatctccagagaagaacaataattctctcaagaaaggtggtttgttgcctggctttgtttcactgacacccagttggaagctctgatgacaaatagtctgcccatcagctttgcttcatgaatccaaagaaaatggaacttatcagaagctgagcctcaagctttacctgtgcctgttatttgggccttttcacgctaggtttggcaggggtcttagtctttcatcatttggttcaccaatagaaagagaagggagcagttgcacttttaggtaccactctgcagactgctatattgcaaaataaacaaacaatatatttttagggcaccacctgcagcaagcagctgtaccaaacagagcagaaccacgaaggatgtgatttgttccatttaacacgaagccttaaggtttgagaagagagggaggagaaggttctatgtatacaacccacacatcacaatttaaactgaagctgattttctctcttttttagattggaattgaggtatcattatatctctcctcctttcccaccccacaacctctggttgaaaacaattctattattgaggttataacgttaactgagaaaattatttttctctgccagcaaactttcttttccattcaagggcaattttctctcatagcaaactatacttaaatgccaacatctgctacatctaagctgtatataaaatgatgtctggcatttacatgatgccaatgacatggttagagaaactcatacacttggcttacacaggattttcttctcatctatagctttcctctatttctgtccttccttaggatctgtctgcctctctaaatgtgccacacaagttcaaaatactctgaaagctgaaccttcagctcttattctgatcaacaatctgtttttgccttaatccatttctttccaggcataaaaactatatagagcctcatgataaaaatttcaccatccctgcactctctgagtatatagcagctgatgcaagacatattttaggtacttggttttttcttggatttaaaaatctcttcgttctcttaatggctattgattctggcctcacaaaccaaaatcaccatttcattttcagttctaggtgagctgggataaatataattaaattatagatgactctggaggcaatccagttagttacaaattgaggtcattctaagtacagaatggggcagttagctttaatattagattggccaccaagaaccatacaatattttaatgtttttcctgtcaatgagcccattttaaaaaacaaaaaagagagaagaaactgttctaaatatttatgaagtgaactagaatgccattcttaagtcttctaccacttactagattgttagtctggggagaaaattacatttcatagtactttcagatattgctctaggactcagagaagtgagatgaaagaattataagtctgcaatgatgcctccagataacagaggaaatcaaatcttgtgagccgggaagcaaagttgccttcactgtcatcatcaaggggatgatttgtaagaatattgggcatgaaataaattcttgccaaagttgtctacaggagtgtccaatgtgggaattgttgtcatctctttcacccttctaacattaaaaggaacttactgaaaaagttctcagactggattttgctaaattgtgtctgctttggaatctttgtccatcagtcaagtctctatgactattggatagtgcttttaactctgtgtggtcaaaactttggaagaagtaagagaaatatctttcattccaaagaacaaaagaggaccattagtcagagcatctttatttttcataaaaagaaaagtcagttagattgatcattcatgaatatttataatatatcagatattctttggggctctctggaaaaaagtagtaagcctttgacaatgaggctgtgtggaataagggaaaggaatagatataactgatattaaataaagttaaaaaatggcttgacaaagaagaggattcaacatctcagattattgaaaccctatgtaaaagatacagagacaaaggttaggcatcttctctaagcctcagtttcctcatctgtaataggcataactactctctaactcatttggtatttttaattgttgtaaaaaacacatgacctgaaatccaccttctcaacaaatttttaagtgtccaagacactgctgctgactgtatgcacattgttgtaaagcagatctccagaactttacatcttgcatggctgaaaatatacactcattgaacagcaactcctcattttctcccttccccaagcttctggcacccaccatcatactctctgcttctgtgagtctcactactttagataactcttgttaagtggaatcatgtagtatctgtccttctgtgatgtgcttgtctcattaagcatgatatcctctaagttcatctatattgttgcctataataggatgttcttctttttaatgctgaataacattccatgatatgtatataccacattttctctatccattcacctgtcagcagatatttaggttgatttcatatcttgcctactgtgaatagtgctgcagtgaacatgggaatgcagatgttcgttcaagattcaattttcagtcctttggctaaatatccaaaagtgaaattgttgaatgatatgatcattttacttttaattttttgagaactgtatactgttacaccattttacatttcaagcatcagtacactagggttccagtttctccacatcgttgtcaacacttgttattttctgtttggttgttgttgttgtttaataatggccatcctaacaagtatgaggtgatatctcactgtggttttgatttgtatttcccggatgattagtgatgttgaacttttttcatatacctgttggccatttgaatgtcttttttgaagaaatatttacttaagttctttgcccattttttaattgggtttttttttcactattaaattttagaggtttatcatatattttagatattaacctattatcagatatatggtttaccaatattttccactattccctaggttgccttttcagtctgtttattatttcctttgctgtgcagaaacttttattttaaagtctaacttgtctattttttgtggttgcttgtgctttttatttcatatcaaagaaatcattaccaaaaccaatgctatgaagttttccacctatatatcttctaggagttttacagcttcttaagcctttcttccattttgatttggtttttgtatatattagttcagtttctttcttttgcatgtggatatttacttaacatcatttgttgtgaagactatcatctcaccattgtgtagtcttgacaaccttgtcaaaaatcatttgactgtatatgcataggcttctttggcttattttggggctctctactctgtttcattagtctatatgtatctgttgttatgccagtaccatactgttttgattattgtagctttgtaatatgttttgaagtcaggacgtgtgaggcttctgctttgtttttctttctcaagattgtttgggctgttggggtctttttggttccatatgactattagaatattttttctatttctgcaaaaaagagccattgtgcttttgatagagatttcattgaatctgtagattgtttccggtactattaacatttttaagaatagtaagttctttcaatccatgaacatgaatgtctttccatttatttatatcttctttaattacttagcaatgttttatagttttcagggtacaagcctttcatatcatttgttaagtttattcttaagtattttattcctttagatgtgattataagtgagattttcttaatttctttttcagattatttgctgttaatgtatagaaatacaactgatttttttgtgttgctttaatatcctgcaatgtttgtgaatttgtttctaacaggtttttttgtgagacctttagtgtttgatatgggttttacagattatgtcatctgagaacagaaatattattctttcttcttttctgatttggataccttttatttctttctcttgcctaatttatcttggtgaggacttccaatacaatgttgaataaaagtggcaagagtgggcatccttgccttgttcctgatcttcaagaaaaaactctccatttttcaccattaagcatgaggttagctgtgagtgagcttttcatatatggttcttgttttactggcataatttccttctattcatagtttgttgagtgtttttatcatgaaaaagaggtgaattttgtcaaatgcttttttctgcatccattgatctgatcttgagatttttaaattccttcattctgttaatgtggtatgttacattaattgatttttgtatgttgaaccatctttacatcccagggataaattctacttgattatagcctatggtcctgttaaggtgttgttaagtttagtttgctagtatttgttgaagatgtttttgttttgctagtatttgttgaagatgtaaacatcgatgttcatcaggtatattgacctatagttttctttcttgtagtgtctttttgtggttctgatatcaggacaatgttggccatataaaatgagcttgtaagtgttctctcttctttaatttttttgaaaaagtttgagaggcattggcatgaatagttccttaaatgtttggtagagttaatcagtgaaactgcttgttcttggacttatgagttattgctcagttcagattttctatttcttgataattaagtcttgatagattatatacttttaggaatttattcatgtcttccaagttatctaatttgttgctgtataattattcatggtagtctcttataatcctttgtatttctatcacattcataatgtctccattttcgtttctgattttgagtcttcttttttcttttttatcctaagtgaatgtttgttaatattgttgatcttttcaaaaaacagttgttagtttttttgtttttttaatatttttttccattctctatctcatttaatgtttactacttccttccttctgttcaaaattgggcttattttttccttctttttctggttctttgagttgtaaagttacattgtttgtttaatatctttcttcttttttaatgtatgcatttaccactgtaaactgctttcttcatactgcttagctgcatctcataagtgttgatacgttttgtttttatttttgtttctcaaaacattttataatttcccttttgatttttcctttgtcccgttggttgttcgagaatgtattgcttaattctcacttattcatgaattctcctatgtttcttttgctgttgatttctagcttcattccattgtggtcagaaaatatttttggtatgatttcaatcttcttaaatctgtcatgacttattttgtgacctaacatgtgattcatttggagaatgttgtgtgtgtgcttgagaagaatgtatattctgctgctgttggacagaatgttctgtatatgtcttttagctccattttgtctatattgttgttctagtcctctttttcttatcgactttctatctgggtgttctatccattattgaatgtggggtattgaaatctcctactatcatttaattgctgtttatttctcccttcagttcgtcagtaactgcttcatatatttgagtgctctgatgttggatgcataaatatctataattgttatatcttcctcatgagttcaccctattatccctatatagtccttctttgtctcttgtgactatttattatttatttatttttagagacagagtctcactctgttgcccagcctagaatgcagtggcacaatcatagcttactgcagcctcaaaatcgtgagctgaaatgatctcccaccttagtctcccaaagtactgggattataggcatgagccaccacaactagccttcttgtgacaatttatttaaagtctattttgtattctataagtatggcccacccctacacttttttggttaatatttgcatggagtatctttttccatcctttcacatttagcccatgtgaatacttaaacctaaaataagtctcttgttatctcaagatccagcattaaattggatcttgtggggtttgttgttgttgtcgttgttgttgttttggggtggaggacagtgtctcgctctgtcgcccagactggagtccagtggcgtgatctcggctcactgcaacctctgcctcctgggttcaagcaattctcctgcctcagcctcccaagtagctgggattgcaggtccacgccaccacacccagctaatttttgtatttttagtagtgacaaggtttcaccatgttggccaggctggtctcgaactcctgacctgaagtgatccacctgccttggccctccaaagtgctgggattacaggcgtgagccaccgggtctggccagatcttgtgtttttattcattcagtcatttcccatattttcaaaaaggagtttaatctgtttatatttaaagtaatttctgaaaaggaagggcttactattgccattttgttaattgttttctcttggtcttgtaggtttttttcatcttctttcactcttacagtctatctttatgtttcattgactttttttagtggcatactttgacttatttctcctttgtgtgccttcaatattttctttatggttactatgagatttatttaaaacatcatataggtaaaacaatctattataaactaatcacaacttcaatcaaatacaaaaactactttttcatcacatacacattatgttactgatgtcataaattacatctttttatactgtgtatctattaacatatttttatagtaatagttatttttgtaattttgtattttacttctatgtcagaattaaaattgatttatgtaccattacagttttacagtattctgtatttatcccttatgtatttacatttacccatgatctttctattttcatatgcttttgtgttgttatctagcatcctttcatttccacttaaaggacttcctttaacctttctttttaaggcaggtctagtggccataaactccttcagtttttctttatccaggaatgtcttctttttccttcatttttgaatgacagttttgtcagatttagcattttttgctggtagtgttttttttctttcagcactttgaatatattatcccactcccttctgagttgcaagatattttttagaaatccacttacagtcttatagaaactaccttgtatgtgatgtctcttttttcgtgctactttcaaaattctgtcttcatttgacttttaacaatttaattatcatgtgtctcaatgtggatttatttacattaattgtagttggaactacagctttttgaatctgggtgtccatttccttacctagatttagggagtttgggggcactattttttcaaataagcttacttttcctttctctctctagtctcctcctgaaactctcataatatatacattggttcacttaatgatgtaccataagttccttaagctttcttcaactttcttcattctttttttattttctcctctttctggataatttcaaataaccactctttgagtttgctgattgattttttttctcatacctgatcaagtctgctgttgtagctttctagtgaatttttcaattcagttattatatgcttcaggtctaaaattcatttggttcgttttaatatttttcatctctttgttaataatctcattttgttcacccattgttttcctgaaatactgagcatctttatgacagttattttgaattctttgtcagaaattttatataccaccatagtttggagttcatttgtggaaattttcttttgctcttttgattgtgccatgtttccctgtttcttcatgtgccttgtaacttttgttcggattcacacatttgtcaaagtagccacttctcccaaactttaaaaactggctttgtacagggaaagatctttgttaatcaacccacctacagactctgacaacttctcaaaccttttctatggatgaatcttctctggactagtgtgtgtaaatttcaaatcagagcgatttactagtttcattttttccagcagtttgtgttctttcactcccttggtgcatgtcagaagtaccaaaggttctccggagtgatcatcagatgcctagctgttttattctctgtggtccacaggcttctcgagtatactaggtctcattaggactccaagacagtcaagagagaagccagtccctggacagcccacccccaaaaaataatcctgaatattgcaaacacatttcaactctttccctcccctggaagaagccatgtcttggggttttctcttgcccattctaccctgaacccgggacaagggtgggactatgatgcataagggtgtgctagtcctaagcatcacttttttttcagtgacgctcaaattggtgcccttttctgtcagtacttacatttagacaagacagaaaccagtgccttgggcagccctccaaaaagtatgaatgtcggacatatttcagctttctccttccctacctaggaagaagccaggagctggaggtattttcccaatcatactatactgagccaagtggaaggactgtgatgaatgagtgccatcgatttttctggctttgatgcagctagttttgcaatcacctggggtttagcagtctcttaactggtttgttgattactcacagaaagaatggatccatgtgttagtcattttctccacagaggaaagagagcctgagaatttttattctaccatctgatgatgtcactatccctaattcattgtattttgtgggtgagaataaaataaataatggtttttaaaagtctctatttttttcacagaataggtcttcagtaaatattagttgttttgttgtaattattgttaataatgtgtgacaggaactaggcaggtttatatggaaaaagtagaagtagtgaccattcaggatttttacatgagagctgggctattcaaagttgtcagttgataaatgagtctgaaatttaggcaaaatttttaaatgtgatgtgaaagataacagaaaccactgtaagtgtctaaatagataagaaagcaagagatatcattatttattacgatgagccaccaaaattttcttataattctcttatgtgctatattttctattaggcaataataacaaattgttgtttctactatactgaaaattcctccataataatctggttgtaaagtaacctaaggaagaaccaaaacttgacggctatttgaatatgggaccttaagaaagaataaatcaatcaataataatgtttaaaatttaaggaatgtgtttcccttaaagatttactgcagacctccttataaaggagaagccaagagatgctgtggcagttgatgatttgatgagtcaaagacagaatcagtatatatctatgagtggaattgacatctagttttagtgtcaaataattagatagcttctcatgaactcattcaaagctggttgagagccttttaacatagaacactccgttttaaaaatgtttacctgagaataaatgttttgcatccgtctttacagtccacctaggaactggcataaatgtcagagttcctacatacaggaaccaaagtcttagattttatgtcttagtggtatttggctatcaggtggctctccctgaacatacaaattaaaatatatttattgattcaaatactgtatatatgcatatgaaaaataatgcaaataataagggaattacaagacagcccaggattttttcttgcttttacttcatactctcaatggacaaaataaaggttaaatataacaaattacttgaccactgcagataatatttgcgctgagacagaattgtaagcaaattttaaagtgaccgtcctttcccttaaatgttcaatgagatacctaactttaattagataatattcataaaataaatgagaaagaaaggaaaaactaggcatatttaaaatatacttctacttagtacttttcttaatatataaataaaaaataatccaaaatatgcaactagatagtagcatatgagaaatgattctagttaatcccattctaaatattactttcaggatgcaaaaactgagaacagtccatagagattatttagtataatttctttgttttatagatgagaacactgagtcatacagctgaatccttccagggttaggacgataagcactttacagatctatattcttcccatatcaatcattgtattgactctagtgttcacatattattttattagcatctaagaaatataacctagggctctacttatatatttaatttcaagtccacctataaaacagcaggaatttattttaactttttttaacatctgtcttctatcctttctacctcccactaagaatatcatcttctttgatataaatcacacatctaactgtcttccacttctttgggggtaaatgttattaaaaataaacaaacaaacccctgattgaatataaattatatgttgttcaaaatctctaagttcagagaataattaatagcttgatgtatcatcttggtgtatgattaatcttgttacttaattgctattttcagataaatatctttgtaccctttgacttatgcttgctgcagaatgatgtagttttcagaggggtgattatttattgttatgccattctggttactttgcttattgccaaagtatatgcatagtgtatgtgctctgctgctatagataggaatgaagattggagattgagacatatggggatagagaaagtgaatgtttgggaaatctaaaattggatataatatagaatcttactggcttctatgtgagaaaatcttctatgtttctgataattctatccttctaagcaccctcacctataaacaggtgggaaaccagaaatagaaataaaaatttaagagatcatttaaatgcagaactgataccttgagcaccagtgaagcaaatttgcaaagaaaccatgaaagaaaggaacagagggagaagaaaatattacaggaaaggcaagagaagggtgagaaaaatagaaagagtagagcaaatactggggataaaaatgtaatgtacatatttttcaaagaatcagagatttacttcaagttccaaaaatatttctgaacatatataaatccaagcttttcattttcaccagtaaaaaatgttttttttttacaaataaaaattattagtaacacagttaaatgaaatggtgaacagatttaggggacaaataaatgatcatgaaatggctaatctttaaacagccagagagctatgatcagagaactaccaaattttaatgactagttcccattataggaaggatgaccttgtagtcataagttagaaaacttcaaaaagcttatctgaaaaagatgctggcactatataattgaaaaaggtcatggtattaatctgttaaaacattcatattctgtaggagggtcacaatgtttgagtaggagcataagattaaaaatattttattagcttttagattttgtgacgtgaagtactgacagtagagccagtgtttttgtaagaactcacaaccacaggatatcattattttaactcagtattaagtctcaaaaagaattgtataagtaaaatagtatctaacatcaacttcaatccggaaggaaaatgctaccaatatttgtgataaaatacaaacaaaatgtgctgaacttgagtaaatttttccacttgatctacatttcaggacagtatcaattaatgctctccaatattaagattgatatattggaacttaaaaaaactcatcagagaattataaactctataaaacaacgtcttttttttattttgtgagtagagattaatggaatcacttcaatcaccctacatatggaaggcccagctaaaaagattacctctttgctttactcaggttctcacttgacatatcaaaccacgtctgacgaggaagtggctcccacagctctcctgtcatgcttccgaagtcgtgggcagtgataagttttgactgtgcagccagcatatgtcatgataaattttcaactctctaaataaagaaaatacacactgttcttggatcaagattaggcttggttttccacccacctttgtcctcaaacacatttgtaacaaacataagtaaatacttgacaggtgaatatcaccggtgccattaactgaaataaaatgaaccatgagtagaaagtgttaattcactatttcaatcacatcccattcgcagaaaaaggatcacagattctcaaccctttaaatgtaaccatggagagcagaaaattccgttcctgtgggcaacaagataagtctatgtgatgccattagggactttttaatgagactttctctatattgctatgtgttgtcaaacgtctacgtttatctaaatgatctccttggccagacttaaattcctacattatttctctgctgcccacatgtcaaaatctcctccactcagagaagttgcttttcctgcacacagtttactggaattagggaggttgataatgcatctaccaagtagagtccatgtgaagggctcagagaaatagaaaccccatatagaggagaagattctgcaaggctgagcagcacattacatgctttcatcagcctccagggtgcgtgcttgaccagtgtgcgtgcttgactagtgtgcaagcaccttgtttgatcccccccaccctgctttagcacatgaagagccaacaccgacctctctattcactcactcaagcataagcattggcttcaaatgcagagacaaaaggggcagctgttcttattcacagcaagtaggaaaaacatcactatgcagagagatttgggacttggcagtaatggcgagcccacatggttctggctagtgtgtataggattcagcatattgtggaaagttgaggctccctgcaaaccaataagtctcactggatttctaaaggagaacaggttctttacatgtgagtccccataagaaaccattaagtttcaaaacaataacaacacataaaccagtaaattaggggtgagcatttacatcataaaattaattctttcttgaggattcagctaaagattttttcttagtgatataatatggaatttaacatacaacagttttaggcatgtaccaattccataacattggttacacctgcaatctggtatcttcaaaggcaataggaaaataaatacatgtctgctcgaaattttgtgtttgcatgaatctgttgaagatattttccattttttaaaagacataacagcagttaacagcctaatgacttgtagtggagtttagtaaatagagatttgttaaagtgtagttcttagaccaggagcaacagcagcaccagggatattgctaaaaatgcaaattctcaggctccaccccagactcctatcagaaactgtgtgatgcagttcagcaatatttttaaacaacttctccagataattctgatgcaaattaaactttgatgtccactaccttagcaaaagaaaaatgttagtaaacaatttatactacatattattctaaaacatttgctgggattaggggagtgaatagagagaagtctcataaaacatataaaaacccattaaaatctgacaaatttaatcattgtaatgggtttcttctagccaagaggatgaaagcataagttccttagtctgacacagagtctttacacaatgtttgccgtctatctctgcagcctcattcattagttcagccattcagtcacttaactagaattcattgagtgcttactacatctggacaccgagtaagtaaatagggaaatgccaataacaatagcaaaccaccctaacccccaaatacctaacatccagccccaggcattccattccctgccctttgggaattctgaaatgtgaacatgcttttcctgttctaaaatactatcctattcctccttcttgtttccttatcagaaagattcttatccatcccataagatccagctcatattgataaagtcttccctgacttcctgggtaaggttagttactttatatattggggtctcacagaaatacattcatactactatttttgcacttatcacatggtattggaagtcatttgtttacatattttaaatccaattctgaggatcagagactgacaaattcagtaagtaggaatttgagatatttctcatatgatacacaagtggcttgaagtaaacatgtggaaggtcactatagaaaatggagtaacattaaaaaaattttctacctattttagtttctgtgaaaaggtgaacaattctactttaaactaaaaaggcagagaataacaataattagtagtgaaggatgcattaaatttgaaatgtaattgcttaatgtagtggtttctcaaaatttgatccacttttcattgctcaagactgaccactaacaatttgccaatgatattacatatgagattatttgcaagaagttgtacaaagaaaatcctccaactttggtatttttatgaggataacaataaagaattttgggatatcaatgtgacagttaatgaaaaagtgattatctttgtgtctagcacacgataaaatgcacaatgaaaaaaattctatattggctatattatgaaatgctatcctaagaacccttcatctagatccaattctggtcagaaaaggcatgagagacattctagtccaactttctcatgttatgagtaaaacaaatcaagactcagaatgataaaaatatcttgactacgaaaattcagttctgctttcactaggctagaaacttcttcaccatatcttcatgtctgtattagttatctattgctgctatatcaattaagagtaacttagcagcttaaaacaacacacattcattatgtcacagtttctatggaaaagaatttcaagcccagcttagctgaattatctgcttcagtgtttctcacaagatgataatcaaagttttggccagggctgtgttctcagctgaggcttggctggggaaggattaaattccaagctcactgagattgttggcagaattcagttctgtgtgcatgtaggactgggggctttggtttctggttggctgtcaaccagcagactctttcagctcctataggctgcctgtagttcatggtcttgtggacttcctaacataggcagtccacaatattgcagcttgtttcttgacatctgcaagcaagggaaagactcccgcaaggcaggccttacatacaacctgtattagtctgttctctcgctgctataaggaaatacctgaggctgggtaatttataaagaaaaaaggtttaactggctcacagttccacagactgtgcaggaagcatgacagcttctgctcagcttctggaaaggcctcaggaaacttatgatcatggcagaaggcaaaaagggagcaaacacccgacatgaccagagcaggaggaaaggggaggggtgctacacacctttaaacaaccagatctcatagaaccctataacaagaacagcactaggggaacagcactaaaccattcatgaaaaaccaccaccatgatccaatcacctcctaccaggcctcacctccaacattgggtattacaattttacatgatatttgggtagggatacagatccaaaccatatcataatcttatgcaggtaatcctgtatatgcatcacatacatcctatccccttttctgtgttctgttggttaaaagcaagtcatatggccatacctgtgatggttaatactgagtgtaaacttgactggattgaagcatacaaagtattgatcctgggtgtgtctgtgagggtgatgccaaaggagattaacatttgagtcagtgggctgggaaaggcagacacacccttcatctgatgggaccatctaataagctgccagcaaatagaaagcaggcagaaaaacatgaaaaggtgagataggcctaggcttccagcctacatctttctcctgtgctggatacttcctgcccttgaacatcagactccaagttcttcaggtttgaggctggaattggctcttcttgctcctcaagcatgcagacagcctattgtgggaccttgtgaacatgtaagttaatacttaataagctcccttaaatatatatatatatggaatataaatattctctatatatattccatatacatatatacatatggaatgtatatatgtgtatatatgtggaatatatatagagagaatatatatattacctatatatattctctctatatatagagagagaatatatatattctatatatagagaatatatatgtaatatatatattccatacatatacatataatatatatattccatacatacacatacatggaatatatatattccatgtatgtgtatgtatggaatatatatattccatgtataccatatacatacatggtatatattccatatatacacatacatggaatatatatattccatacatatacatacatggtatatattccatacatatacatacatggtatatattccatacatatacatacatggtatatataatatatatttataatataaatatatattatgtatatatatttatatgtgtgtatgtatttatatatggaatatatatagagagagaatataccatatatatatttgggctatatatatgaatatagtgaatatatgaatataatatatataatataaatatatatgatatatacacacacacacacacacacacacacacacacacacacatactgttctattagttctgtccctctagagaaccctgactaatacaatacccatacttataaagtatgcaatactggagagaggaatcatgggggccctcctagagtctgtctgccacaggatctgatagaacttccatttatttaaacatcctgcctttttatcactgattaattcttcttcattttttgcttccagcaaccagctattatgcttttgaaaaacaatttactaaccatcattattcatcacaggtcaatttttttctaccctgaggatgagtgtcatttggatagaaaacatttctaatctcccaaatttgatgataacactgagtttctgttaatttactttttttctgctgttctgcaagcgttaacaaatataacagtataactaagtgttaatccgttaccacattcagtgctttacctcaccagattttatatttgtatcatgtactctgtcttgaaatctgaatgtatctttttgagccattcctttttctgattctcccaggcctgttttttcttattaaatacatttttagagccattttagattaatagcaaaattgaagaaaggtacagagagttcccaagtacccctgcccctccacatgcacagcctcccccattatcagcatcctccaccagagtgatacatttgttacaattgatgaatctgcattgagacatcattatcacccagagtctatagtttacattgtggttcactgttagtgttgtacattcttttggtttgtaataataacatgtatctaccattgtagcatcatatatggtattttcactgccctaaaaattcaccatgctatgtctacccagccctccccctccatcctttctaacctctagcaactactgttccttttactgtctctatacttctgtcttttccagaatgtcatatagttgaagttatatgttgtcttttcacattggcttcttttactcagtaatgtaaatataagttttctccatatcttttcatggcttgataattcatttctttgtatcactgaacaataatccattgtctggatgaaccacagtttatatatccacttacctcctaaagaacaacttggttgcttccaaatttgggcaattatgaataaagctgctataaaggtctgtgcacagattgtggtgtggatttaagttttcaactcatttgagtaaataccaaggagcacaattgctagttcatttggtaagagtgtatttagttttctaagaaactgccaaactgtcttccaaaattgctataccattttgcattttcactggcaatagatgatagttcctcttcctccacatccttgccagcatttgatgctgtcactgttctggattttgggcattgtaaaaagcgtgtagagctatgttatttttgtttcagcctacatctccctgatgacatatgatgttggacaccttttttatctacttatttgacatctggatgtcttctttggtgaggtgtctgctaaaatctttggcccatttttaccattgagttttaagagttcattgtgtattttggattgcagtcctttatcatatatgtttttggaaaatgttttcttccatactgttgcttttcttttcattctcttgacagtatttttcacagagcacaaagttttaattttaatgaaaagcatcttgttaattctttctttcatagattgtgcaaagacagtgtcatgtctaaaaagtcatcaccaaaccaatgtcatctagattttctcttatgtcaccttctagaagctttatagttttgcatttttacatttaaatcttgatttattttgagttaatttttgtgaaaagtaccaggtctatgtttagattcattctagattcatgtggatgtccaattgttccaaatccatttgtggaaaagactattcttcccctattgcttcgtctttgtttctgtaacaaagattagtttgactatattatgtggctctatttctggactctttattctgttccattgatctacttatctaatctttcactagtaccacactatcttaatcaatgagagtaagtcttgaggttatagtgtgtcactgctccaactttggtcttttcctccaatattgtgttgtctgttctgagtcttttcctctccatataaagatttgaatctgtttgttgacattcacaaaataatgtgctggcatttctatttgaattgcattgaattcatagatcaagttcagaagaacagatatcttgaaatattgaataatcttatccatgaacatggcatatttctccatttatttacttctttgacattttaacagagttttgtaatttttctcatataaatcttgtacatattttgatggatttattcctatgtatttcatttttgtggtgccaatgtgaatactattgtgcttttaatttcaaattttacttgttaattgctggtatataggaaaacaattgacttctgtttattaatcttatatcctgcaaccttgctacaattgctatgagttcccaaagttttttgctgatttctttagattttctacatagagaatcgtatggtttgcaaagacagttttatttcttccttctcaatcagcataccttcagtttccttttcttgtctcatttcattatgacttccagtaaaatgttgaaaagaagtgttgaaaggggacatatttatattcctggtcttaggaattttctagtttctcaccattaaatatgatgtagctttttctagatattctttatcaagttgaacagtttaacttacatttctagtttaatgcctcaggattttttacccataggagaaattgttcttttcatgtcatttttttgccacagtttggctcttagtacgtattctttctctacactgtatctcagatggaatcttcctccctactgccaccactgctgtctcatcacatctcacctgaatagcatagcagctttctcctcaattcaattgaatgcacttcctctctcttctgttctgttgttccacacattaaagtcacactttcctcctaaagcactggatttattttgtcacatggctttcttttgcctgtcatattagaattaaatatttaggatctgttatccattctctccaatctaccctcccagcttttcaatgtgcctggagtaagtgtttaagatttgtaggaaggaaggaatgaaggaggaaggagggggaaaaacagaatgcaaggaaggcaggaggttaaaagttgtaactttttatatttgttttatctccacctatgctttccaaattgtgcgatagaaaacactgcttttattccaagcatgtcattacacttgtttttacctccattattttcctatgccacatttggattattcaacaatactggatcacttctgctaagaaaactaaaaatcacctctctatccccattgaccagatggcaatctctgctctaatcactacactcctggaccacttcaacctaatttccatttaacctcactactctcagtctatgtcctttctaatcagcagaaaatactgctgccaaaaccagctttattgcctgccagtcctcaaaccctgtgtttgctccctgtcactactgtacaaaattcaaattcttcataattgattttctggctcttcagatgagttcctctgccgagaattcaggcaaactaaggtccattaccgccccccgccccacgtgttgtctccacttttattgtcaggttgaatagccactggttcccaaattaatttacagctttacatttttatttttcttctgaattatccaagtttactttcatttatacctctttaaaagtctactctggccaaataagaatggaaaaagtcatccacccaggattatccttagaaaaaaatgacctatttgatttttccattccaagattatcaccttactggtaacaggtgaggccctctctcacaccacctcctcctacaacacagaataagcatagccaggaaattaaaaaagaaacaaacacacggtaataaactgaaatatactttacaatatagttttttttgacgataggtcttaagaaaatcacatcacttctttctaacttctttcctgtgtcagtacactgtgatttcttcatgatcatcaaatgataaaagtgcattgttatattttgttaaaggataaaaatataaaatgcgatattcgaataaaactgaatatttggctatctttctattaaaagggcctaaaatcacttctattataaaatgtattactacatgtattaatatgttttacctttgtttaaatactggtttaactcctattagaactcataagctgtaattcacaatgcatcagaaaagaaatattccactactattttttaaataaatattttcataacggctaaaagtaggatggaagtaataaacaaaaataactttgctgtttttctcagctcttcataaatttgcatcagagtttgtagatgatacaaaaatcattgagacaaagtattctcataaaaacactatttctcaccctcccgttttgttatataaaaataaacaaagctctgtgagataaatgagcacaaaataaattgcctttaaataaggtagttatttttttcacagtcactcagaagttttattattttaatgaaggtcattatcacttcacatataaaaattacgtaacatgagggccgggtgcggtggttcacacctgtaatcgcagcactttgggagcctgaggtgggtggatcaccaggtcaggagatccagaccatcctggctaacacagtgaaaccctgtctctactaaaaatacaaaaaattagccgggcatggtggcaggcgcctgttgtcccagctactcaaaaggctgaggcaggaaaagcacttgaacctgggaggcggaggttgcagtgagccgagatcacaccactgcacacccagcctaggcgacagagcaaggctgtctcaaaagaaaaaaaaaaatatatgtaacatgaaaaagtcagttatgtgatgccagctccagtagtatcacaagacgaactatgcatttgatacaggaaacatttttatggttttaaatgcccaacctattgttggagcatttagtataatttgaactcatcacagtgaacattatgcatcacaatgcagatgttaaagaaacctgatctggccagtatttacactgaacttctatctcaaatcacattctttaaaattatccattcagaagtgtgctaagtaaaaacagggtcgtttgtatagaattctcctgccttggggagtacatttatgagccacatgacattttggtcaaccacagaccacatatacaatgttggtcccatagattataatactgtttttttctgtatgttttctaggtttagacatgtttagatacacaaatagcactttgttacaattgcctacaccattcagtacagtaacattttgcacaggtttgtagtctaggagtgataggctataccacatagcttaggtgtgtagtgacctataccatcaaggtttgtataagtacactctgtgatgttcaacactgacaaaattacctatggatccgtttctcagaaccatcgctaaatgattcacgactgtttactgtaggttggagagaggcatttaaaccaaatattccaaggtgatgtggtaggtagtgttatcgaaaaaagcccagataatagggtgactcagataaggaacacttaactcacccttggaagatgagagaaggcaaggtgaaggtgaggtacttctgtctgagccttgaaggctgaggagttattcggagtagtaggtgaaggggagaagggaaagggcaggcatttcaatcaaacacagtttggcatttgtgtggctggagcacagggagtgtcataccagaggaagccaaagaggttccagatgctggatgtggatgcattagcacactgttctttacatctccagttagttagacccttcctgtcttaagacccatagagaaaatgcaccttatgaatccaagcgggaacagtatacaatataaagtcctctaaattgcatctgtttcagtcctgcctacttgcttgtaaactgtaagaaaaataaaggtccatttttaaaataatttgtaaaacacatttttataaaagctgtccttgccataaaaatcagtaacccaagtcaattaccctaaatctgcatcttgtacacccacattccaagtgtttaaggcatttgtttaaaagcacgtttgcatatatgaatatttaacatagagtatgtaattaaacaagtctatgtgtgtgtgtatatatatttactgagcattatctttagcagaaaataatggaatgttcttcaccctggcattcatgattctgttgtcctggcacatatggtgagtaggaatagtacttgaggctcactcaagcagtcgctttaatgaaaccatcacaatcaggcactctgcaaagcagtattctgttcctctgttcattaaatccaccccccaaccctttcaactttgcataaattgcataggcagtgttatttaccaattggaaccggcaggagtaaattagcaccggctgattgagagacttttgcccagtgaactttatgttcccccattgaatccatttattgttgccattcctgctttggaatatgacttccctagaaagcatttcttcattcagcctctgtgctggaaacagacaacagcttgaatccagcagctgctcttgaacaaagcaggtagagaggcaagaaaggctgttgaataagcgcatcatgacataattacagtaaatctccagagtgacctgcacacattcaatgccatatggttatttttggtgctagaaacgtgtagctggaagccatagtttaatctagtcactttctgaagcttcctgctagcatgaaattgatttttttacctagaaaattaacatgaatatttattgacagaagtgaagactatatttgcacagtcagctaagagtgccagtaaatttaataaaaatatttgggttttgttttacccaaaagtatacaaataggtgatagaaggttttgttttcttttgttatggagttattgactttgtttgttttgtttttcaagctctagcagtacctttataatatgtcatatatgcccttaaaccatctcctcttcctcttcctccttgtttttttattggatagtgttttttcagtagtgcatggaaagactgttctttgcttcttttaatgtcttcatttgtctttaactaggtaaacaggatttactgctactgtagcctacccagaaaaaaaaaaaaaaagtagaacctcagaacagattttcaatatggatgataccttgtggtccatcagggattaataaacaaccctttctgcctctgcttctgaaaatactttagactgcagaagatttagatacaaacgtatatgtcagagagattgaccagctcagaacaccagccatcaaaactcatttaagggtttcttagggcaaatctattcttaccaggacaatagcatgaatctcagacaaatattttaaagatctcataactctcttgcaagaattttccttgaactccacttattgatttgattctgagagctttatgaaggttaaatattgttctgtgcattcacataatgcaatggtcttatattgataacagtagcctgagtaaccaaattttaagccatgtctattttaaaacgagagttctggcagatatgaagaaatctgctttgtgacttgaaaggacatttattttcagaggactatgttgcattaaaaaatatttcattttcctattaccttaagtgaaaaaggaaatggaatgcaaactcggctaaagtaggagggttcaaagaacacataggttcatataggaaggagggctgcaggaacagaaagatgtgctatcttttctcacccatcataagggccatggccaacactcctctaagtaaagactggttaacaagagaaaggcataacaaatttatttaagcaaaattttatgtagcatgatggcattcaaaatgaagacccaaagatgcaggggaaactgcttttgtgcttaggttccttgaagaatggacagccttgtagacatgtgattggacataatggtgggatctaatggcaatagactgagagggcaaactcatctgtctgttcagattcttcttggtctctctgtgtagcatttcatcctctcaggtaggaggaaggacctctgtgagagtcttcagggagaaggtaaagagtgatctttctagatttgattgcttgctttggaggagaggggttctagcttccatgacctaccttggagaagatgaattctggtttgtatgaatcactttgcatgcgaatgtgaagtgggagacaggaggaaaggagaagctcagagagagagtttgcttctgaggctgcttctgaggttttccaatttcctttcattaaaagtactcagtatgcctaagtgccatattttggggcatcattttccgagccccaaaagggccacatacaaactggttttgcttcagagttttctccctgccgcaagccacctcccatgccctgagacctgcgggattgaaaataggcctccagatttgctgtctaccggacaaaaaatggatgttcctcttataagcctgatattgcctcatagctggtctttcttgtgctatcatcatgggaaaacacataaatccctcataacagaagcaaatacttagctatctgtgtcaccctgacaagttaaattgctgaaacctcaagcatgtttaggtgtcttcttgagaatcaaacccaattgatatgttgttttctgcgcttgattgtataaatttacaaaaaagtaaaaggatctattttttttttttttttgcaggaaaataagtagctgtataggtcaagaagattgaaataacagaatttagggaacttgttccacagttgaaacaatcagtacttatttaggctactgtaatttgtttgacacttgcatgaataggggttccaaacaaggtcacttgcgatttagtaagtgcctcagtagcaaagaaaactaaaagatggatttttttctattgactccctgcatgaccttcaatgagttatttgcgcatagcttttgttacctccattataaaataaaaatcataatattaatcgtttttccccagggttttctttaaatcttgaaaagtttttaaaaattaaagtgcagtataatcattaagggtctaagagtcagaacacataacctgggcatctgcagaatccctaggtcttaaaattcccaaaacaaatcaactagattttcacaatgtaaaggtaatgaatatgacaacagtagtggtgaggtgagatgtaggaatcagaagaagaaggaaaagatgtcttgtgttgaaaaacacaattaaattaattagatgatggtgtttctggcttaatccttggttactcaacagattttttaatctagtggctcattaaccatgtaatacctaacttatattctaagattttcatcacaatttgtttcttcatataaaacatctattattttttcatatcgcagttatgagtacacttctgtgtctttatcacactagagctctcctaaatgataaacattatgacaatttaatatttactctgtataagctatgcttttataaagtccagcagaaactgatgcaggatttcagcctgcaaaataagtgtaggttaataggcatttgttttttacttgcagcacttcagctaacttttccagtctatattgtttctgtttcaaatgctacattttattattcctataaagcaaacattaggtaatatttctattgtatactaacagggatcagcaaaagatgtatgtactagaatatattctctaagaagaattcagggtttcatttagtcctgccgctaaaactcctatatcttacacactggcaccacatagacttgaaatccatcttggtggctggtctgtctaaatgagtcagcaaggatggtgtgtatcttacattcagaagtcttagtttgatggggttgtacgatccctgacttcattacaagtacacctgtgactgaacaggtgatgaaacatggagcaaatacacagagacagatggattcagactggcataattgtagtcttacttcattattattttcccaggctccaggtgatttctatttttctttatagcatcacttgtctcaggaagtcccagtggaccttgaaacagaagagaaagatgcatcctggtttttatctaagccagtttgcagtgtgggcacttcagagggttgtgctatgaaaaagcaattagcttcttgagtctagggtgccatttaaaatatctaagctactgtgcttcatcataaaattgacctttttaattttttatgttagaaatctccactaaaagtgttagcataaaaaaatgtgcagctccagggaaaatatgaaaggcttgggaaggagtagtgaaagtctgtgttaccctgaagaaaatttgaaatcagctccacttggatataataaataccatgtcatgaagtaccctgtgcttaatttttaaataattggtatcattaagtaacataacaatgacatagcaacaccagttttgcataagtaggcaggcagtgtatcttagatttacaaccgacttacaatcttgcaggataattactttgctctctagaaaagaagtccttttctcattacctttgactgtcattcctatgccataatcatcttaatgtgattgtaatttatgtattgtgtttttcaaagctatatcagatttgccattttaattttcctgtccaactccaaagtttcagtgggaaaaagtcaacgtcaatttacaaaacgtagggggaagttatttaggaacaagagaatttccacagaaggtcatcatattcatttatgcatcccatagttttgtcactgccagtaataacacagaatgttttctagaggggtgtagaggttagtgcagggtaaaggttgagagttaaattacttgtgatccaggcctagcaattccactcattaactgtagggcttttggcaaattatttaaccttttggtccttcagcttccctgtctataaaatgagattgcaatctagttagttgtagttgtagatccaccccaaagcttagtggcttaaagcaataatttagtaattacctctcagagttctgtaggttaaccaagtttggctatgtggttctggcttgaggaactcagtcacatgatgtctgggcctgaggggaagtcatgtggactgagcattcaaggtggctcacagttgatgctagccattgttgaagcttagctggaatgtgaaccagagtgcctcctgatggccctgccatatacttcagcttctcatagcatggcagctcagtttggagggggacggcaacccaggaaagtgccttcctagtgacccaagaggaggctgcaaggcctttatgaaccagccttgttatacggttttgatctctgtccctgaccaaatctcacgtcaaattgtaatccccagtgttggaggtggggcctggtgggaggtgattggattacagaggcagtttctcataaatggtttagtgccattcccttggtgctgttcttgtaatagagagttctcatgacatctggttttttaaaagtgtggagcaccttccccactctcttgctgctgctccagccatgtaagacatgcctgcttccctttgccttccaacatgattacaagtttcctgaggtctccccagaagcagagaagatgccagcatcatgcttcctgtacagcctgcagagtcgtgagccaattaaacctattttctttataaattacccagtttcaggtatttctttatagcaatgcaaaaacggactaatacaccttggaagtcacagattcatgtaatgggaaattagactctacattctgatgggaagggtggcaagatcacattgagaagagcatatggaatgggagaaatcattatttttgtcaacaaacaaatgggggaacaattacatttccttttctttttctttctttcagttaagtaagatttagaatccagcagaattctctgctcagaaaaaatacataaagaagtgtgtatttataaagatgatttatcgatatatttttaatttcacattttgatgacttccaacacacctcattactaatattcagaacaacctgcttaagtgagtgactctaattattgttctacacatgaatattatgggagttagatgaaaaatcaggcaaaatcttagaagtcacaagggaaaataactcatgcattaaatattttaataggatctcaccaagatgtgggaaagaacatttaaaaatacacttccctctgaattgattagtattacttctgttcgctcagaatctcattaatgaaaactcaaagtgttgagttacatcagcaactttttgccaaagcaagaggttcataacaactgagaagtttattatagtcacagttagaagactttatgtccaaaacacagttcagtcccttgtaaatgtcagattacaaacctcagtttgcaaatgggtaacagtattttatttctgccagctttcttcaaaaatgaactaataattaaagataaatgatagaagctataactgaccaaagacaggaagttgtgcccccaaaacagttactagccagctcactgattttaacctagaggctaacttaacttataagcatttagagcaagaggaacataaaatttctgacatgaacctagagagaaaaatacacctaaaaaaattgagtgccctaatacagaagctcattttccaacctcagataacagattagggtgctttccttaaattccaataaaaaggaatctactaggctcttcatatagaaattgtctctttcctgacacacacacacacacacacacacacactctctcatcatgaaagagacaatttctatgtatgcgtgaatatagaaaatacacacacatataaatattgtaattagaacattttaaaataatgccctagaattctgaaattttggagactaagttctgtaacacttccaaaactaagcttattataaaatattttatttattcatacactgtgatcatctagaatttttggcataaaaattctagttgataaaactaaggagagagatacacacacacacacgcacacacacacacacacacacacaccggatgacatacatataaaaaactgagctaaaactttggaatttcatttctttttttataatgttttaccttctcttgattatttctgttgtaatactataagaaaggatgttaaattgtgtgatctttcaaagtctttcttaaggacaattaattaatggtgactttctttgtttgagctgctcaacttaaacatctgtccatatgagttttatacataatgttgaaaaatatactcagaagagtattaagtatgtatttttgcgatttgttctctgtcaactaaaaagttgatatagctttataaaaattaaacaatacaaactggcacaataaataataaactgaaaacaactaattaaaggaagcagagaagtaagtgataaagtgagttaactgggatctattacctataacactgatataataattgtttctcaggagaaaaagaagcatgacaatagatataaagaaaattttatttttctaatcaacaggagcgtacatacatttacatgtgtttctcttctttgtgtcattatcaaagtttgagtcttagtattttttacattaagaacctagaaattttttggaactacttttggtcagaaccagttttgccataaggatcaatcacttcatttttttatttatcaagattattgcatggcctaatagaacatgttttaataaagacatcacaaatttttaggatattttgagagtaagattagtcctgtccctccatcccaggttgggctgggcatttgtgctaacctctggaactacagtgagcccataaaggagaactatgcagattcaaagactttggacatggctacagtttgaactattggtatgttcaaaacattcctcatggaagaatagtttgaagttgggttacattgaactgacagatacaacaatttcaaatactgctatatatatatttgcctatcaaatatgcatgataaaaatgacaaaatatcaaaaccaggcatgggaagcattccaactccattagaatcctttttgaatatttgatattcatttttttgtgtggataaatagatcatattttgaatttcatgaaaatgccaaccttataaatcataaatatgaaaccttgtaaatcataaatccaaaacttttttgagtgtgatatatttacagttaaatataaggacaaagagcaaaaagatatttatattgacttgaatgatgagtaagcattgtgaattgtctccatgaattccatatctggctgagatgaacagccagcaaattcttgccaacacggttttcattttctttcttaatggggcttttttagatacattacagtgtttaagtaaagtgtcagaagaagtcaatttgtggccaagaaaacgtagaggagggggagaaaagaaatagtctcatgatgcttgtttcccacttccatactcatcacactccccatttccccaccttgatgctagtattgttctttctccattaaatcatcaatgcttattagccttctgagagccacagaatgtaaaattttgaaagcccaactgccagcacaaatgccctgacatcggtcattacaattccacgccctaaaggcaatcagagcttttttagtcattaaaaatgcaaacatagcattgaaactacagcgacattatttcaatgctatgtgggtaattttccaaatggaatatattccttaaatatatggtttcataaagttaaatttggctcactgctttattcacatgataacatttttatttgaaaacaaattaaaagtaaactctgtgggcttaaaagtcatcttgagctcatgtgctggatagagtaaaagttgcatgcaaaaaaagggcattactacttgtttccatcattctactgggtatatttaaattcagattcatccagtactttgtcagcaaagtcataaaccttttacaaatgtattgtcaccaaaagacaaaaactacaatctggaacaaaccaatgatccttcaagactacctctgactggatttactctgggaattttcaaaagtaggtatgatatgtcctccaaagtgggaaagactaaaggaaaaaaaaacaacaaaaaaacaaagacctacatgagaaattttcttccagaccttagagaatcaacataaactttaaatcatgagtactgattaccgcttagcattgtttccttacttgggcaactttggaaggtgcctatgatgattgtatatagcacaaaattctgatatttagtttggctatttaattcacacatttcttgattttcatataatgtttcaataattacattaatccatgcattcaactgtactttttagtctgtggtactgtagacaagagaacaagagaaggaaaaaaagatacccagaagattgtacagactaaacactggaagctctgacaagtgtgtggaaaacacttatcagtcccacgagcacaagcctagtcataaaggttgatgccttttgctaagaagtaaagaagtgactccgtgctggctctgacatatctgttaggaaataaacaatcttctcagaatacaagtgtgagacataattgagcatctgccaagaaatataaaatttaccaacagatagggatttgtgccagtttgtgggtgaatctggaatatgccagcagagatctggaatatatgtttagtaaattcaatgtcatataggacataaaaaggctttttcatgtatatctgccatctgaaatgtatgtctctagaaaaaaaaataaaaatagaaataaagaactaactaaatttatggtaccgaagagtagtatttgttttccagaatcataattgcatgtataccaaaatgggagttctggaaaaacgttggtgtagatcatgagaaaggcccaaaaggcaagtcacaatgacaaaagaactatttataagaagaggctcactaacacattgattgagagaaaaaatgcactgaggtaaaaccaatttgaaatgtgtcatagattgaagaataaaaattaatatattcattaaacatttcttgaaacaataccatgtagcagacactctgtttagagcttcctagaaaaaaaaatcacaaaagactatagaaagaagaaatacagagcattggtcacaaatgttataatttctatactcaaattcacagcaactaaataaacaatgtaagttgaaatttaagtacagggttacaattaaaatcccacaggtacttatacccaagacagaccaagatggctgatgaattctgaatagcagtggaaggctaacttgttccaaataataataataaaaaaacatgttggagaagagcatatgtcacaaatacatacctataaggaaaaaccataaccctactgggagaaaataatagacaatgtttgactggaaacaaaaagtgagagagagaggagtgagaaagagacagagagagagagagagagacgtgcatatgatacaccctcctggttggatgtttgcattatcctaacaccaattaaaggcaatataccttaattctgagagactttcattatctgaaaatctactatgatttatatcctgatagaaccagagcgtctaatacactctctacttaacttcctggtgattttacctctcagcaggaaatggaaacaacagagggagtgctatctgcatttaatttttaccacccaagaaaaaccaattaacaataaaatggaaaaatggaaactttctgtgaatatatttatttaatacttataatgaccataggaagaaataatttatttaattacaaatctaccctcttttctttaaaaaaagtttctgctaaaagatagatgtcatccaatggccaaaagctcttaaaaggaatatggcttggaaagaaactagatgcttccaagaacaagatcatgatcacacaaagacaaatgtgataaatagtactaggaaggaataactaagtagataaatgaatctggatgcacagagttttctataagctcttaatgaaaaggaatacatataaaagattgggagtcctttagttattattaagcagtgcaagctgaggcctgtgaaaaataaacagaataataaaaatgactttttagtatgttcagaacaagataaaaataagagaggaataatctgctgttagatggcttataaaatgataccacatgacacagaaaatgcagaaattcccagctgctttcttgttgttgtctgtcacagactgatgtggggatagtgaacattgtaagaaagaattgaaccctaagtggagaaaagaagagtgcctgccatgggtacaagtctcctgtttggtaaaaattgcatcccagggtatttaaaaagtttgtgaataagatggttgagatgttatcagtagcatttggggaattatgaagatggagtcattgggagactagaaacaggcaaattatgtcctgattttcaaaatctataaaaacaagctttctgaagggaacgagtttttttgtagagtcacagtaaaatcataagacatactgttaaaccctgaattttgagcacctaatgcagagagcagtcactaaggctcaaaatagtacgggttagaaaagagtttatggaaataactcaattaagcatatgttattttaaaacagacagtcaaagaagtagcatgaagagctctgaagcagcagaggaaagcctagagagaatgtagacttcaccaaattgagggacccacaaatcctccacacatactgttggtgaccattatgttttttgagagattgataatgatgacaacaaagagaaggttatcatgactatggcgaccttgatgatcacaatgataatgattgtaggatctctggagcgttaagttcccgaaaacaagaaccacatttggtttttccattggtctgttccagtacctagtacctaggaggatatccacttgttttaattgaattgaatgataattaataataataatactcaacaaatgtctaaacatcttatgagtctttacttcactttattattacaacaagcctatgaggcctaggtaatattattatctctatcttacagatgaagaaatgagccttaggcaggtccttagccaagattactcctaataaatgagaaagttctagttcaaatccaagcctatctgattaaagggctcttcattgctgttattatatattgaattaaaataagcgacatttccttctggctgaaatatgattctatgtcagctgagacagtttcttgctccatggaggtcctcaaaaaaaacaaaaaaaagattgaatcaagtccaggcagagctatcagaaaatctagaaaatttagagaacaaaatgaataaactgagaagttccaaacagggcagactcaaagagctgaatccaggaataaaagatgtgaaagcagatagaaaagtctcagtataaataagtggtcaaagagcagcaagtcacttagaacatggatgccacaacaacatggcacctaatcgtcatttgactccactgcttaatctggcatgtaatgactgtccaactgaaaaactaaaataaaataaaacagactgaatgcattaaaggatgttttctttatttatagttggttttattttttttttattatactttaagttttagggtacatgtacacattgtgcaggttagttacatatgtatacatgtgccatgctggtgcgctgcacccactaactcgtcatctagcattagtatatctcccaatgctatccgtcccccctccccccaccccaccacagtccccaaagtgtgatactccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcatattttatggctgcatagtattccatggtgtatatgtgccacattttcttaatccagtctatcattgttggacatttgggttggttccaagtctttgctactgtgaatactgccgcaataaacatacgtgtgcatgtgtctttatagcagaatgatttatagtcctttgggtatatacccagtaatgggatggctgggtcaaatggtatttccagttctagatccctgaggaatggccacactgacttccacaatggttgaactagtttacagtcccaccaacagtgtaaaggtgttcctatttctccacatcctctccagcacctgttgtttcctgactttttaatgattgccattttaactggtgtgagatgctatctcattgtggttttgatttgcatttctctgatggccagtgatggtgagcattttttcatgtgttttttggctgcataaatgtcttcttttgagaagtgtctgttcatgtccttggcccactttttgatggggttgtttgtttttttcttgtaaatttgtttgagtccattgtagattctggatattagccctttgtcagatgagtaggttgcaaaaattttctcccattgtgtaggttgcctgttcactctgatggtagtttcttttgctgtgcagaagctctttagtttcattagatcccatctgtgaattttgtcttttgttgctattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattatatagggaatcctttccccattgcttgtttttctcaggtttgtcaaagatcagatagttgtagatatgcggcattatttctgagggctctgttctgttccattgatctatatctctgttttggtaccaataccatgctgttttggttactgtagccttgtagtatagtttgaagtcaggtagtgtgatgcctccagctttgttcttttggcttaggattgccttggtgaagcgggctcttttttggttccatatgaactttaaagtagttttttccaattctgtgaagaaagtcattggtagcttgatggggatggcattgaatctgtaaattaccttgggcagtatggccattttcaggatattgattcttcctacccatgagcatggaattttcttccatttgtttgtatcctcttttatttcactgagcagtggtttgtagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaagaagagtttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttctgcccattcagtatgatattggctgtgggtttgtcatagatagctcttatgattttgagatacgtcccgtcaatacctaatttattgagagtttttagcattaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggatttgttttgccagtattttattgaggatttttgcatcaatgttcatcaaggatattggtctaaaattctcttttttggttgtgtctctgccaggctttggtatcagaatgatgctggcctcataaaatgagttagggaggatttcctctttttctattgattggaatagtttcagaaggaatggtaccagttcctccttgtacctctggtagaattcggctgtgaatccatctggtcctggactctttatggttggtaagctattgattattgccacaatttcagctcctgttattggtctattcagagattcaacttcttcctggtttagtcttgggagagtgtatgtgttgaggaatttatccatttcttctagattttctagtttatttgcgtagaggtatttgtagtattctctgatggtagtttgtatttctgtgggatcggtggtgatatcccctttatcattttttattgcgtctatttgattcttctcttttttctttattgccagcagtctatcaattttattgatcctttcaaaaaaccagctcctggattcattaattttttgaagggttttttgtgtctctatttccttcagttctgctctgattttagttatttcttgccttctgctagcttttgaatgtgtttgctcttgcttttctaattcttttaattgtaatgttagggtgtcaattttggatctttcctgctttctcttgtgggcatttagtgctataaatttccctctacacactgcttcaaatgtgtcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaatgtatattctgttgatttggggtggagagttctgtagatgtctattaggtcttcttggtgcagagctgagttcaattcctgggtatccttgttgactttctgtctcgttgatctgtctaatgttgacagtggggtgttaaagtctcccattattaatgcgtgggagtctaagtctctttgtaggtcactcaggacttgctttatgaatctgggtgctcctgtattgggtgcgtatatatttaggttagttagctcttcttgttgaattgatccctttaccattatgtaatggccttctttgtctcttttgatctttgttggtttaaagtctgttttatcagaaactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctgcttattttgctcgttagttgatgcagtttcttcctagtctcgatggtctttacgttttggcatgattttgcagtggctggtacgggttgttcctttccatgtttagcgcttccttcaggagctcttttagggcaggcctggtggtgacaaaatctcttagcatttgcttgtctgtaaagtattttatttctccttcacttatgaagcttagtttggctggatatgaaattctgggttgaaaattcttttctttaagaatgttgaatattggcccccactctcttctggcttgtagcgtttctgctgagagatccgctgttagtctgatgggcttccctttgagggtaacccgacctttctctctggctgcgcttaacattttttccttcatttcaaccttgatgaatctgacaattatgtgtcttctcgaggagtatctttgtggcgttctctgtatttcctgaatctgaacgttggcctgccttgctagattggggaagttctcctggataatatcctgcagagtgttttctaacttggttccattctccccatcactttcaggtacaccagtcagacacagatttggtcttttcacatagtcccatatgtcttggagtcttctctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcatttctctgtattggttattctagttatacattcttctaattttttttcaaagttttcgacttatttgcctttggtttgaatgtcctcccatagctcagagtaatttgattgtctgaagccttcttctctcagctcgtcaaagtcattctccatcaagctttgttccattgctggtgaggaactgtgttcctttggaggaggagaggcactctgcgttttagagtttccagtttttctgttctgttttttccccatctttgtggttttatctacttttggtctttgacgatggtgatgtacagatgggtttttggtgtggatgttctttctgtttgttagttttccttctaacagcaggaccctcagctgcaggtctgttggaataccctgccgtgtgaggtgtcagtgtgcccctgctggggggtgcctcccagttaggctgctcgggggtcgggcgtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccgcccagttggagctttctggctgctttgtttacctaatcaagcctgggcaatggcgggcgcccctcccccaggctcgctgccgccttgcagtttgatctcagactgctgtgctagcaatcagcgagactccgtgggcgtaggaccctccaagccaggtgcaggatataatctggtggtgtgccgttttttaagcccgtcggaaaagcgcagtattcgggtgggagtgacccgattttccaggtgcgtccgtcacccctttctttgagtcggaaagggaactccctgaccccttgcgcttcccaagtgaggcaatgcctggccctgcttcggctcgtgcacggtgtgcgcacccactgaccggcactccctagtgagatgaacctggtacctcagatggaaatgcagaaatcacctgtcctctgcgccactcatgctgggagctgtagaccggagctgttcctattcggccatcttggctcctccccctaaactctagttggttttattttaagaagctctatttcttaagcagaataacattgcatctcactatataatagagatcaggttttatgttacatagtgaaaagaggcttaggtcttaaattatagagttttttttctcagttatagtcaagatatttatctctgccttgtatacagaaatagtacagatgaaaggagagcataactaatatgttgaatgacagagtaaacatttaaaataataataataatatcatacatttatggagtgttgcctacatataaagcaccacaaaaaaataactttacataactcattaatcttcacagcaatcctatgatataggattatgcttcctgttacatagatgaataaagtaagactcaacaagattaaattctttgtacctggtcatagctatcaagtagaggagcaaatattcgaatccataaaatatttttcttaatcaccataataaaccagcaataagcatggttccttcctaagaaagcctgtaagaatggcctgaattatagtacagagtagggtggtatgatttaacagatactggaagataaagcttcagagatttctagttgacagcaagtccactatcagtcaacgctgtgctaaaactttccaataaagacaagacaagcttaaagttgcattaaaggatctaagaattccaaataatggagggggtagagcttacatttccatactcgtagctttgtggtttcattttaggaaatgaaaatgcacccaaaaaacggagatgggagaaaggttttagagccattgtgcataaaaaatcagagctttgagcaaacttagggtgttagggtggctgtcttcacatgttagaaaagcagtcttttagaagaggaataagtttactctctataactctagaaataggagggtaaaataaagaggcagaattttactctaagaaatatttccaattatcagaactatcccaaaatataatagaagtgatcactctatcaatgtcagcattcaaggaaatgttgtctggccacctgtcagagatgctatagggtcaggggtgattaaaggaccttcagtagtttttatctccaagaagtttatttgctcatctagcaactttaaaattggtttggacaaagtctagctgttcctagatctgactgcagcatccttaagacattctcctgaatgcgtcctttctgtcagtgtaatttctacccctatgggatgtatacctgaccctaactcattgtttccagccttttaaatatgtgctttatgcaccccttctcttgctgtagtggctctaacttccagagattcggatgtaatctacataaatattggagctgagggctctaaattaagctaaagcttcccagttttctttcaaaacagacgagcattatgaatacagccataaagcacagtcatgagttattcaaccagaggcagctatttgattgataaatctatttgcaggaatatattaaatgattaatgaatctgtcatatcaactaggacacttgctaattattttcaaggttccaataaatgtgatggcaattaattgcacctgctacaatccacttcatgcttggagctgacatggaagtttaactttcatttttcactggtgaaaagccttttgtctattcttgggccttctccacacctgccagatataggaaaacaacatttgtgtgtggcagagtcctacttattacgggctacacatttaaagcctttgcagtcttccctacaaacgaaagtaagagaagtttcgcaggccgtctaaagaagaaagtggtgtacttacagatctaattttcatctgagcatagtacattgtagttccctgaggcaggctttgatatcacaaaagcaatttctggcagattggaagggctattcccttctgggtttcaagcatctgacaggagatcagagtggaggtcctcctctcaggggaactgacaggctatttccaagaaacggaggctctgaagcaagaagcaggtatgcctgactgagtaatgggagactcctcatttaaactgggagagccacagcccagtgatggcagtaggcatttattcatgtcagaggagccttgccagctgtcccagaaaccatgagaatgattcagagagtgctgagcacccgggtcacagaaatcattagggtttaaccctataaatgccacccactccctgaaaatgctgggaagaggtagatttcattccattaccccttgtggcaattcctctctggagccctctagaatacagacattttctccattttctcttctagccagatcacactggttatcctccctaacttgtagctgctaagaatgaaaatcagctatggaatctcccttcatgctccacatcaaggtgtgacaaagcttgagagatcttgtggcttgccatcccaaacatgatgcttgaccacatattaggagaacggggtcacatgggagatacaggtgaaaggctgctccaggacctcattgttcacgcgtcttctgacctgctatcttcatgtccccttctcctctcccctccctgtggggctagaactagacttagccttgagctctgctccgtgagccactctcccctgagccactcttccctgatcactctgtaagcagatctaggaagaatccatgccccttctgaagccaggctggtttgacaccatagaacagtctcacccaaagcagccagcaatatcaccaggtgggagtcactgaggtggacgagcttggagaatcaaggaccacgatgtacattgctagcagctgcagaagaccatggaccatcccataaattcctgccccctgtcactgcctctgcccaactccacaaaactgctacctgatttcttcctcttctttttctttagcctccttcactcttcctcttcctcctccatatacccaaaccaaagggaaaatataacatctagattctggctaaagcgaatgctctagtgccattttttggctagagttaaggaaatgtggttgatagaggaggcacaggtgaaatcactctactacatattttcactccagaataagaacaatgtctcaaagtaaagccccgtgtttgggctgttctttggtattttcctatcagcttgataaagcttatttttgttctctcttttcacagcaataggctctgaacccagagatttaaagtctattggcaacaagagttatttattaaaagatacacagagaagttacatacaatggtaaaagaatttggagacctgtataattaagacctcatcttgctttgtgaccagggttcaaggttcagaacgtaatttttagataatagacattcctctcagctctgtgcatgcctactgcacccaccaactttgcaaattacagggtagttgccactttagcttttgagtttcccaaacaagttttttatctgccctctatgggaacacccatggaatctgaagaggcctttataaataaacaaagcaagagacatctgtatccaagatgtggcatggagagcataaaaacagccagagtctgagaatatcagttgagatcatagagtgatgagatggacccttaggaaacatgcccttgccccacatcagctaaacacagcagcacaacaatcaacatgagtttcgtgacatcccttctctccttagaagcctacagtggctcctaatatcacttagttaaaggcaaattcagcacactatataatctgaccccttttatccctctaaccactttttcttgaacatgccaagaacactccagtcttagggcttagcacctgcccttcccgctgactagaaccctcttctcctgattaacccccatagctttctttctcacctcttgctttatttttctccattgtgcttatgtcatctaacatactatatagtttactaatttttcttgtttatagtcatcttcatattatatagtttactaatttttctagcctatagtcatcttccctgctaggggataagctccatgagggcaggaaaattgtgtctgtttttgttttctgcagaattcccaatacctacaacaatgtctagcataaatacttgtcgaaagagtcaatgaatgaataaatgccatcacatatgtgtaggtgtttgtaagcaaatgttcttttacaaaattgtagtgcagacaatattccaattaaaaagaggatccagaactacagtacacacaactagctttgagccccaccttgacactttctcattatttgtataagtgaacctcatgttcagttaaaatgggattttaaaaaattggagttcttataatgttctaagataaattatgtaaaattattctataaattgtagcactattaagtgttaattactctcctcttcataggttgtcactttatatatgtaacattttcccactgtctaagacaattggtgatactcaataaatatatgtgaaatatcaaataaattgcacaacaattactccagataattaaaaatttccctttggaagaacccaggtaggtatcaatggttgaatcccagtggcattattcagtgggatttctggtcatattcattcgtgttgagttcaaataacttttggcataactaaaaaacaaaatttgtccccaaataattagttagtattattattccagaaaaaagtattaaaagttttaaaaataattccagaatgacaataacagtaattataacaataataagccttaatatgtgtagacatattttcagagtaaataaaaaccatcccttcgtaattattgtgaaaggaataacactagttcagccattgtattaaaaaacaaatctcttcaactaagatgactgtaattccaccattaaaggcctactttaatgagtgaattgtgtgttctgaagattcataagcttgaaagtttagcccactctggttctgcccgttggtaggtcactatgcctattctcctggatattttccgtaaaacaagagaataaaagggagcagaatagttgctattctggaggaggtgttatccccaggcatattcaaaagaaaaccctgagttaaatggttttatctctaagggatcatctaattaacagaacaaaatgaagaaaaagcatgaggtcactgtgatgtaacaacagagtcattgcacgttgtcttttttttaacatcttaccaaggtataattccacatactatgaaattcaccaaaacaaaggttgaattcaatgatttttttagtataatcacaattgtgcaaccatcacaacaatctaagtttagaacatttttattactctaaagagaaaccctgtacccattcgccatctctccccatctctcccttctcccatcccctggcaactacaaatctttctttatatacagatttccctactctgtgcttttcgtctgagtgcaatcatacgacatgttgtctttagtgactggcttcttttatttagcataatattttcaaagttcattcatgtcatagcatgcatcagtatttcattcatttttattgccaaacgtgttccagtgtatgaatgtgtcacattttgcttatctgttcaccagttgatggtcaactgggttactcccactttttgtctattaggaacaatgtgactatgaacatttgtgtacaactttttgttcattgtcttttaatatttctaagattaatattccccatagaatttcctatgaagaaattcacaatctttgcaacttcacagtctacacacaatcaaaccccaccctcaccacacttactgtgtgattatgcatctgcttaacttctctgagcctcggtttttttcatttgcaacatgtgctggcagaaagttaagtgcttgaaagtgacgcttatgcagaatactaaaaaatcttccgaatcttctatcctgtgtctatcttcacagccaccttagagatggcagatttggagtgcttcctttctaagtcaatttcaatatctaaaaaatccaggtaaaatttgagtaataaaaaaaaatgaactacaattcataatatttgttaatagagaaaaaattcaatttaacatgtcatttctgtcgaatgaaggtgactgactagtaaagaagacttaaataatacttatgagtttaaatgtaatttttattgagtttttctgtctgctaatttattgatataaaagaaaaaaggaaaaatgttggtatgatttatcatctatcattagtcaaatagactgtttttttccataatattcttaggataaattgctaatttccattttgtggtaaaaatccatttctatgtaaccattctatcccaacctattccataaaattgggatttactgtagtcaagtgctgacactggttcaaactttaatggtagaatatatagggaatgtttcttttctttttttttctgactatggtacattaagtccctagagggggcaaatgtttagcaacatgttacttatcactatatgactatataggactctaattcagaaatgtcttttgcaatcatcaatgacttcttcctgaattgtgcctaccaggcagccattagcaaattctctacctttagaaacattctgtagacaaatatcaaatagttttctttatttatgatctgctttgctagcatagaaacagtcccaaaggaaggagtttctttttcttttgttttgttttgttttactttcccaaagacatctttcttttattctcttctgtaccctaaacagctttcttctcctagaaagtaaataccatggctgacctatgagccagatacttctgttcattaaactgaccctgctaatcaaaaaaaaaaaaataggaaagtttgtatgcgcaggcatagtattaatggtatgacttatttctgcttgttcatattgtaatggaacttttctcctatggttcattcatcactttaaaaaattaagccaatttagaaatacaatttgaatgtataattgaatttgtcagttgattttagcctttacaagttaatcaaatagcagagactcaaggaagtttctcacacatgctctcttttatgggcagccaatcattccccaaagagaatgtcaaattctttcaggaatttttgctgattagatcctcattctttctttagaggactgaatttttttttcctagcaatcaagattcatgctatcagtcaaactgaaaggaataaaatggcataattttagctaaaatattagaaatgacaaataagtgaaatatgttaactggagtggaaaagaaatgtgtaattaagcaacacaaagaccatatgtcagacacttctacagtcatagatgggaagagagtgtagacttcttgcaaagacccacacagctgtcaggaaacttcagtcctctttaggattcactagacttattggggatatctcacctttacccgcaattgacaagttagttgttgtttttatttttgctgagtattaggatgcttgattaattaattttaacatgtggtaaattaagtaaattataatgggaaaaagatatttgcacgatttaaatgatttaaatacacacagaaataggcttatttgacatgttgaaaatctgaattgctacctttcaaatattactcggtcctgtttcaagcatgttttgaaatttttcatggaaatctgtgtcatacttaaaatgacatttatttctctatgttctaatggtgctgaagcatagagccctatttggatattctctatctaaaatagactggagattcagatagccacacgggtgttgcaaacctgcatcgtgggactgggcgacacctcagtcccagtgaccacatctgcagagcccagaggatcccaggaaccaggtggttccatttggtgaaaagaatgggagaatctacaggattcagtatgagaatatttctaaactctgaagaagacataattaaatctaggtcccagtattaaaatcagtcttccttatcctcagcagtatagtgggattgtcaagattattatattttgaaatactagttgccattttagtcatagaatcaatgtgataacccatttcataggggtgtgcagtacaaaaacagtgatgtgaacctcttttacatttggcatttctgaaaacttccaacaaagcattcagagctagcataattccagccagatgaggacttttaaccatgatactgacatggcttagaaatatgaaacgttggccgggcgcggtggctcacgcctgtaatcccagcactttgggaggccgaggcgggaggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactcccgcctgggcgacagaacgagactccgtctcaaaaaaaaaaaaaaaaaagaaagaaatatgaaacgttacagtccatcagacatttcaacaaattcactttctgatgcagagtgtacactgaaggattcaagatactgagaacccgctggctgccaagttttacttgtgaattacaaacatatgtaatatattttatataatatttaaatggcttgcattatcaacatttctctctccattgagttctttccttcagtttagcgtctctttcaagtcattccaagaagtctttttatctttgtccaccttcaaactgccacccacccccacttcctttcacagccagtgttttttgagaacagtggcaatggcccgttcacccattggtgcctcaatgtactgtcaccaatggccccagcagcagctatttttttaattgtagtaaaatatacatagcataaaatttacctttttatctatttttaagtatacatcagtattattaagtagtattaagtacattcacattgttatgcaaccaatctccagaactttttttgtctgtaaaactgaaattctatgcccataaaataacagctcttcattatgacctctccccagcccctggcagccaccattctactttctcctccatgattttgactactcagcgtacctaatatgagtggaatcagacagtacttatctttttgtgactggcttacttcacttagcaaaatgttttcaaggtttatcaatgttgtagcatgtgtcagaatttcctttctttttaaggctgaataatgttccattgtataacagaaattctttatccattcatctgttgacagacacttgagttgctttcaccttttggctattgtgaataatgcttctatgaacatgggttcaaaaatatctctccaagactactttcagttcttctgggcatatatccaaaagtggaattgctagatgatacagcattttatttttaatagtttaaggcagcagtcctcaaactttttggcaacagggaccagtttcgtggaagacaatttttcaacagatgggacagacctggggtaagggaaagaatggaggggaatagtttggggatgcaactgttccaccttggatcagcaggcattagagtctcataaggagcatgcaacctagatcacgtgcatcgcagttcactatagggtctgtgctcctatgagaacctaatcctgccactgatccaacaggaggcagagctcagatcataatgtaatgctcccttgcctgctgctcccctcctcctctgaggcccagttcctaacaggccacagactagttccctggggaaagggggacccctggcttaaggaactgctatactgttttccatagctaccaccccattttacattcctgcaaacagggcacaagggtctcagtttctccacatctttgtcaacacattactttctgtttttttacagtaaccatcctaaaaaatgtgaagcagcagctcatttttagatctactattttagagtctttcaaggtgtggtttgcagatatgcctcagagtcacttcaaaaacacatgaggaacatctagattcctgaatccaaagctctagagattgggcctcacaatatgttaacgggtgcctgagatgttgttttcaatgacttttgatacacaacctaccatattggatggatatgatgtgaaagtacctcaagataagaaagaaaatttgcagagaatcatacagataccatatagaacagaatagttgatataataattgtcactttgcatgtgaatacataaactaagattatgtagaaacaactagcaacttgttacctctagatgtataattttgcaaatataactaagtcccaagccacacagtgacaatttacatcacggtgctgaacgttaccattatcatcactgaattgatgggaaactataagcactttcattgtgttcaatgggaggggtgagtatcacatatataatgatatctgcctcactgctgcactggcaaatatttttatttttatctatttcccttcttttaatcagtaaaagtcagggttggcatttcagttattttatgattatttgaggcttttagattgactactgtgctaggcactgtttattttctgcagggtagacagtgccttagaccttagctatttgggaaggttccagtttattatgggagaagaccttagggaccaaaatgaaattgtccaaaatgacagcgggtaggaacataaactgaacaggaagaaaatcagtttttactgtaagtaagaaacaagttaaaaggtgcttaatgtcaagatttgaattaagaagctttagcttatgccaaagaatttttaaaattttaaactacttgtgctgattttgcttcagcaaaactagatttataaaatcatgtataagcagatcttttacttccaaaatgctgggcatctttccaatcctactctttagattttgtgtttctatagttctgtgctggtatttttatgcttctgaaaccctgtctgctttcagcaattaataaaaatactatgggttttgatttgcatcactgcagcatatgaactaaattactttgcatctgcaggtttaaagcagaataaaactctttgtgataaagtttcataatgttcagatgtaagtcactgaaccatggaatccaatgagccaacaccaaggcagcaaggaagagtggctgccgtttgttccagtttatatcattccagctaaactgtctgccattctagagaggtttaaatactaagcccctacgttgcttttaaaatataatgagtaatttcctgaccaaaagcaaccactgagacaaaccagagcacagcacaagatggcaccccaacttgtccatcatggcttaaccatggtaggtgccaagtcaatgcagaaaagtttgctctcacagggtatttaaagaatagctattataagttattatatcttcactagaatatatctcttattcaccattcagtgcttccacccaagggtaaaattaaagtgatttctcctactacagtttattctgggtgacctgcctgccttcattgcttcttccctttgttctagttcagtccactgcagtacaattcacacaggtaagatactcatctacttttcactatagtgtaaaggagtacatagataatctcctagaataaaggatagaatgagttatagtgatataacaacttcaacattgtttcaaagatagggaatagtttattaataatataagaattaaggatgaggattatgtttcattaatatgtacaactcttcagtctttagcacagtttattacatgtaaaaagactcaaactctaaatgcataaatgaattaagcccagttttttgggttagttccatccaggtttaaatatttccctttggcccataaatatgttcacatagcttggccttagttttctttttcttctggataatttaccctaaattcttctagttccaagttgagttgatcccttttaatcactattttatcctcttaaggtcaaaggatctcataaaattacaatgatttcatgtgtatccctttcaacaactctgctaagtttacccagtgtctactagggaattccgacttgcccctttcttccttcttcaacttttgacttagaccccttgctggtatcagcatttattttcaaatgaaccatcatgttaagtagctgctttgaattacctagaatatcttctcacttctcatgccctctatcacacataccccactcttaagttacaatttacatactagaaaactggcttttcttttggccattttttttgaaatggggtctcatttgtcacataagctggagtgcagtgtcatgatcatagctcattacagcctcaaactcctgggttcaagcaatcctcccaccttggcctcccaaagcactgagattatagatgtgagccatcgcacccagccccttatgctatttttaagtctttgagttatttgggcctcatcatcctggaatattcctaagccctgttctatttttaaaactaaagatcttttagagaaagaatctttagtttttcctgtcttcccatgaatatcatatgccaagttgtttgtcctttattacccaaacttggccattacatttcctttaaagcaagagtcttccaaatgatacagtggggtaatatgctgaaagggcaatcagttgtttaaactccagaacgatattccacataaaaatgaatgtggaagcagagaggagccaagatggccgaataggaacagctctggtctacagctcccagtgtgagcgacgcagaagacggtgatttctgcatttccatctgaggtaccaggttcatctcactagggaatgccagacagtgggcgcaggtcagtgggtgcatgcaccgtgtgcaagccaaagcagggcgaggcattgcctcacttgggaagcgcaaggggtcagggagttccctttccgagtcaaagaaaggggtgacggacggcaccttgaaaattgggtcactcccacccgaatactgcgcttttccgacgggcttaaaaaacggcacaccaccagattatatcctgcacctggcttggagggtcctacgcccacggagtctcgctgattgctagcacagcagtctgagatcaaactgcaaggcggcagcgagcctgggggaggggcgcccaccattgcccaggcttgattaggtaaacaaagcagccagaaagctccaactgggcggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctagagatctgagaacgggcagactgcctcctcaagtgggtccctgacccatgacccctgagcagcctaactgggaggcaccccccagcaggggcacactgacacctcacacggcagggtattccaacagacctgcagctgagggtcctgctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaaccagagcgcctctcctcctccaaaggaacgcagttcctcaccagcaatggaacaaagctggatggagaatgactttgatgagctgagagaagaaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagctgatgcaatcaactggaagaaagggtatcagcgatggaagatgaaatgaatgaaatgaagcaagaagggaagtttagagaaaaaagaacaaaaagaaatgagcaaagcctccaagaaatatgggactatgtgaaaagaccaaatctacgtctgattggtgtacctgaaagtgaagtggagaatggaacccagttggaaaacattctgcaggagattatccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaacggaagccagagagaaaggtcgggttaccctcaaagggaagcccatcagactaacagtggatctcttggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaacccgtaccagccactgcaaaatcatgccaaaatgtaaagaccattgagactaggaagaaactccatcaactaacgagcaaaataagcaactaacatcataatgacaggatcaaattcacacataacaatattaactttaaatgtaaatgggctaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaacggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaacacaggagcacccggattaataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacattttttcagcaccacaccacacctattccaaaattgaccacatacttggaagtaaagctctcctcagcatatgtaaaagaagagaaattataacaaactatctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaaaccaggagctggttttttgaaaggattaacaaaattgatagaccgctagcaagactaataaagaaaaaaagagagaagaatctaatagacgcaataaaaaatgataaaggggatatcaccaccgatcccacagaaatacaaactaccatcagagaatactacaaacacctctacgcaaataaactagaaaatctagaagaaatggataaattcctcaacacatacactctcccaagactaaaccaggaagaagttgaatctctgaatagaccaataacaggatctgaaattgtggcaataatcaatagcttaccaaccaaaaagagtccaggaccagatgtattcacagctgaattctaccagaagtatgaggaggaactggtaccattccttctgaaactattccaatcaatagaaaaagaggaaatcctccctaactcattttatgaggccagcatcattctgataccaaagccaggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataagcagagccaaagacaaaaaccacatgattatctcaatagatgcagaaaaagcctttgacaaaattcaacaacccttcatgctaaaaactctcaataaattaggtattgatgggacatatttcaaaataataaaagctatctatgacaaaaccacagccaatatcatactgaatgggcagaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctctttgcagatgacatgattgtatatctagaaaaccccattgtctcagcctaaaatctccttaagctgataagcaacttcagcaaagtcttaggatacaaaatcaatgtacaaaaatcacaagcattcttatacaccagcaacagacaaacagagagccaaatcatgagtgaactcccattcacaattgcttcaaagagaataaaatacctaggaatccaacttacaaggcatgtgaaggacctcttcaaggagaactacaaaccactgatcaaggaaataaaagagaatacaaacaaatggaagaacattccatgctcatgagcaggaagaatcaatatcgtgaaaatggccatacttcccaaggtaatttacagattcaatgccatccccatcaagctaccaatgccttttttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactgataccaaaacagagatatagatcaatggaacagaacagagccctcagaaataacgccgcatatctaaaactatctgatctttgacaaacctgagaaaaacaagcaatggggaaaggattccctatttaataaatggtgctgggaaaactggctagccatatggagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagacaaaattgacaaatgggatctaatgaaactaaagagcttctgcacagcaaaagaaactaccatcagagtgaacaggcaacctacacaatgggagaaaatttttgcaacctactcatctgacaaagggctaatatccagaatctacaatggactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccaggtagaatggcaatcattaaaaagtcaggaaacaacaggtgctggagaggatgtggagaaataggaacacttctacactgttggtgggactgtaaactagttcaaccattgtggaagtcagtgtggccattcctcagggatctagaactggaaataccatttgacccagccatcccattactgggtatatacccaaaggactataaatcatgctgctataaagacacatgcacacgtatgtttattgcggcattattcacaatagcaaagacttggatccaacccaaatgtccaacaatgatagactggattaagaaaatgtggcacatacaccatggaatactatgcagccataaaaaatgatgagttcatgtcctttgtagggacatggatgaaattggaaaacatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcaatgggagatatacctaatgctagatgacgagttagtgggtgcagtgcaccagcatggcacatgtatacatatgtaactaacctgcacaatgtgcacatgtaccctaaaacttaaggtataatttaaaaaaaaaaagaatgtggaagtttcatgaaaatagagacttattttatacactttatcatagctattgctactcatctgctcacttttcttctaagaagctatctggaactattctgtctctacataacaatctaaatattaataggcagtgtctataaactattagtagtgtctacataacagtatctataaagtcccagttaaatgtccatatgaaaatgaacacatagtaagtgctaaattaatattgtttttagaatgaatataataaatggatctcaggcaagactctaaaagcctactttacttagccttcatgtgaatgaaatatcattctaatagtgcagtatcatatgaccttacctccatttattaaagaatttatcatgaaaattccatagaactttaaaatagagatgagaaaaaaaaatcatctttgcctgctaggacttcatcagaaagaggctccatcttctccagcccttcctttaccttttgagtgggaatagccttcttcaattctagtttatttctggggattgcaaataagaagagaccatttgtacatatttggtgccatagagaagagtaaggaatagagatacgggctcttacggaagctgaggaataggacagggtttggtgaaatcccagggaagttagcaaaggctaaggctaagaggcaaataaggacagaagttaggtcacagtgatggcatgaaacatgcaatgattccattaataaatggtcactatacgccaagtactgtggtaaacattagctcatttaatctttacaagaacctagctaggtttatatcattactctccattttatagagagtgagattcaataatttactttttctttggttacactcttaaaaaagtaataactcaaataagtacaaatagaactggtgaaatctgaataagattgtatggatggtgatatcctggttgtgatattttaggattgttttgcaatgttacctttgggagaaactgtgtagagtataccctcaatttttaagaattcttatattgtgaatattcttagaaaactaaacataattttactttatgttctagtaatcattctactagatattaacccaactgatttgaaagcttatatccatataaaaatcttctcattaatatttatgtatgtcttgttcttaattgccaaagattggaagtaaccaagatgttcttgagtaggtgaatggataaataaaccgtgatacatccataaaaagaaatattatttaacaatacaaggaaatgaacaaaaaaaagtggatggaccttaagggcatatgttaactgaaagaagtcagtcagaaatgttcctagactttatgattaaatttatgcggtattctgaacaaaccaaaactatagcgacagtaaaatatcagtggttatcaggagtgaggggtgaggagaggaaggttgagtagggaaattacaggggatgttttagggtggtgaaactattctgtataatactataatggtggatacatgaaattatgcatttataaaaatccacagaatattacagtataaagagtaagccttaatatatgaattttttaataatatcatttaggaggttggaagagcccagtaaataatgcagactgtgacaagagagtctaactgtattatagatgtatgaaacaacttaactaaagagagtgatcagaaaacgttctgacataagcagttttggaaatgagtagtctggaagactaaaggaaaaagaaactgtacataagcactgtactctagttgataagtattgttccatgttagcaatgttagcaattctgatactgctatacaactgtactggaattgaacaattaagtaaatagatggagaatgctaaaagcccaattttttcactgttttagtgggaggttgaagataagaagagaaggctagaatgatccatggggtaatggattagaattggggacattagtgtgagttcatatttagctgaatatagatgcatatagttacatatgtaaatatatatatttacatagaaatatacacatgtataagcacacatgtatatatgtgtatatacatgcatacatacatgtatccataggttagtatacacacacatattttcttgcactgtcagttgacagggcctaaagcaatgacacctcagtagcaatgggcacatctaacacccagcttttggtttctaacaccagtcttcaataagggtcatcttggaaaaataactcattctaggactagagcaggaaatatataagatcagctgggagtatcttataataccagaaaatgaggaaatgcacacacacacacacacacacacacacacacaatgatgggggtatgtcaaaacaaaaacaaactgaaaaacaggagctgactgaaagagtcttattggccaaagtggaaatcatatgttcaagaaaataagtaagtattggattataacccttattattcatatccaacaagtatgtaaattctatttacaaaaatctcttaaatcttgaccctatttgctgttatctctgctgggcttttaattatctccctctaaattattatcatggcctcaggactgggatcttgccttcagccttatctacagttcactgtattttgcaaagtgacccagagtcatctttttaagtgtagttctcaccatgtttctcctttgcttaaaatctttaaatggtcccttactacctaaattctttatcattacccttcaaaatttgatcccagattaccttgttggtgaattccacaatctccctgacagagcccagaaatcctataagccaggacaaaaaagactgacactggagaacttccagaaggtacctcctaagaaaccttaactgacagacactccaagagtaggtagtggaaagaaaagagggttggtggaatgttaagcaaattagtaacaggcaaacaataaatattacctagttcaaggcacagagtaaatgggtaacattccataaatgtttattgaacagaactgaagtggatccaaaatggcagataatggataaaaggtcattacagcttatgatcctgttcctggaaaaaatcataataatgtactttacatatagcatgtgcttaatacatttttccttgaagttcttttagacttttgaaaatacttcacatggtgtatttaaaatatctgcaaagtttccttcatccttattcttcttgccttctctactgctctagaaaggttaaatgtcatcaacattatagtacagattttaatggtccacactcactgttttttgatttgtgaaatgttgaaaaatatgagaaaaaaatttaaaaatgaagaattaacattaaaatctgaattcccttaaaaatggtaagatgtgtaactcaggaatttcatttctgcacaatattcaatgagaacagagtggcacttgcagctgcccagatctactctctcacctctgtaggcttctcagtttgagttaaacagacttttatttgaatcttggctctgccaaggtgggtatattatataaattctctctaccccagtattttcaactataaagtagagataatcataatcactcatcaataagtttagtatgaagaataaatgaaaaaatctgcaaagattttgagcacagaataattactttataaattttatttgttgaaaaattatgcttttgttatcaagtacagagttaaaaaaataaaagtagtggtagattgggagaaacaaatatagacatatcttgttttattgggctttactctattgggctttacggtaattttggtttctgcaaattgatggtttgtgggaactctgagtggagcaaggctatcaacacaatttttccaataacatatgctcacttcatgtctctgtgtcacatttgggtagttctcacaatatttccaactatttcgttgttatcgtatctgttatggtgatctgtgatcagtcatctttgatgttttgggggtgccacaattcacatccatataagatggagaacttaatcaataatgttatatgtgttctgactgctcaattcactggccattcccccatctctctccctttcttccagcctccctattctttcatacacaacaatattgaaattaggccaattagtaaccctacaatggcttctaagtattcaagtgaaaggtagagccaaatgtctctcgctttaaatcaaaagctagaaatgattcagcttagtggaggaagaaggcatgccaaaagtcaaaacaggatgaaagctaagcctcttgccctaaacaattagccaagttgtcaatgcaaaggaaaagttcttgaaggaaactaaaaatgctactccaataaacatataaatgataagaaagagaaacatccttactgcagatattgagtggtcaggatagatcaaaacagccacaaaattccccaaagctctcttcacttgtatgaaggctgagagaggtgaggaagctgcagaagaaaaactggaaaccagcagaagttagttcatgaggtttaaggcaagaagccatctctataacatgaaagtgtaaaatgaagcagcaagtgctgatatagaagctgcagccagtgatccagaagatctagctaagatcattgatgaaggtggctaccctaaacaacagattttttaattagatacaacagctttatattagaataagatgccaaatataacttccatagctagacagaagtcaatgcctggcttcaaaacttcaaatgataggctgactctcctgttagaggctaatgcagctggtaacaagttgaagccaagacttatttaccattgcaaaagtcctaaggacctcaagaatcatgctaaatctactctgcctgtgctctataaatgcaacaacaaagcctgaatgatagcacatctgtttacagcacagtttactgaatattttaagcccactattgtgacttactgctcagaaaaaaggattcctttcaaaatatttctgctcatttacaaggttcctgtaacccaagagctctgatggagatgttaatggaaattaatgttgtttttatgcctgctaacacaacaaccattctgcagcccatggatcaaggagtaattcaactttcagctcttattatttttaaaaagtatattttatgacttatagattacatagataataatttatatgaaggagttaggcaaagtaaattgaaaaccttctgcaaatgaagattttcctttttattctagtgccattaagaacattcaggattcatgagaggaggtcaaagtttcaacattaatagaagtttggaagaagttgattccaaccctcatggatgaatttgaggggttcaaggctttagtcattaatatggcttggctgtgtagccacccaaatctcatcttgaattgtagttctcataatccccatgtgtcatgggaaggatgcggcgggagctaattgaatcacagggatggttacctccatgctgctgttcttgtgataagtcaatgagttctcacaagatttgatggttttaaaaggggcttttcccccttttgcttggcacttctccttgctgccaccatgtgaagagggacatgtttgcttccccatctgccatgattgtaagtttcctgaggcctccccagccaggtggaactgtgagtcaattaaacctctttcctttagaaactacccagtcttgactatgtcattaatacagtaaactggtaccgggagtgctgctatgaagatgctcgaaaatgtggaagcagctttggaactgggtaacaggcagaggttggaacaatttggagggctcagaagaagacaggaaaatgtaagaaagtttggaacttcctagagacttggagggctcagaagacagaaagacgtgggaaagtttggaacttccttgagatttgttgaatggctttgaccaaaatgctgatactgatacagacaataaggtccaggctgaggtggtctcagatggtgatgaggaacttgttgagaactggagcaaaggtaactcttgttatgcttcagcaaagagactggcagcattttgcccctgccctagagatccgtgaaactttgaacttgagagagatgacttagggtatctggcagaagaaatttctaagtggcaaagcattcaagaggaagcagagcataaaagtttggaaaatttgcagcctgatgatgcaatagcaaaggaaaacccattttctgaagagaaattcaagccagctacagaaatttgcataagaaacaaagagccaatgttaatcacccaagaatcctggttccatatttgtctccatccatattctattttatattggcattagataagttagtatcaacttagaatatttaaaaagtaacaataatattacctacattgaacagcacacttaactaatttttttctatgtttggcaaaattgactgcaattttaaaagttttgttacgtgagcaatctaaataaataagccaagatagtatgaacatagttctattccttagataataaaataaaacatagaaataataaaaataacttttaaaataatataatttgtctatgtccaaagagtggttcaataatgtatagctttttaaatatatattctttatctttattccacaaagcaaaattataacatttgcttgaaaacgcaatgttgtatttttctgcctacaagtggaaaaacaatggaaattattgctatgctatttaacaatattttacactgctcttaattatgtgtcatgaactcttattttcacatagaccatgtgactattgctatgctatttaccaatattttacactgctcttacttatgcatcatgaaccttttaatatgcatgtaacctcttttcacctagaccatgggagtataaagagcagttaccagaagaccttggctgggttcctggttctgagagtcatttggggaaaatcacttaatctctttcaatttcattttcttcatcataaaatagagctcaccataaatgttacaacattgttataagaactaaaggacatattatatgagaaagtgattcacaacctgcaatgtattacacacattagcaattattttctttgttattcttaataaattattttcccaattatttccagtaaattttacctccaagctatgctttttaactctaattctgctataagtgtgtttaatatattctcttaaagttttatttatagataatgcatataactaccataggcataatgcacttttgaaaataaagcaaacaaaatagttaagccaactgttcaatataggcaatattactgttactttttaaatattcaaagttgattctaatgatctaatgccaatataaaatacaatatggatggagataaatatggaaccaggattcttttataggatccaagatcaaggttaggccacatttgtttaacattcattagctctcatagaccattgaaaaatgtataaaaacacatcttcacctttccagattttgattcttgaagcagtggcagccaatatcagcatgggcagaaattaatcataggagattagagactctgtcttattctgtgtgtgtgtgtgtttgtgtatgcatgcgtgcacaccattcttcacaactaggaagtgacccacaggtaacttaaggataatgtgtcagaaactattatcttctaaccaatgacccttccacagtgtgatcatcaagagatgttacctgataaagattggagccagctcaaggttacgtagtctgttatcattgtagcatgtcccttgggataatggaaggcatgtggcttagttgactgggttgagtgcatgaaaaggaaggaagaggcaccatacacatcttgaaaaagggagaagcttacacaattttcaacagggtcacaaacgaagatgaagagtgagcactgcatcaacctgatgcctaggccagcagaaatacaacacacttcatgattcaaaaacagcccgtgtgttcctgcttccttttatcctggatttatagggcatctaaagaaacttaatgatatctgaatagctccctcacaatccacatgttctggcagggggaaggtagaaaggaatggactatgctgggcagagagcaaagcatgggaaaggtttaaatgttctctggtgttgggagtgcccctccagctgtttcatctgagacaaaggggcctggagagacacttgtttaatggctggtgcttccatttgtgcacagaaatcaattgcttttctcctagtcttcactcaaaacttctcattcaaaataactaaaagttggttgcccctgtttttttttttctttccatcatctcgctactgtgactgaaatgtatgatttaagtatggtattaactagggaaggaattctaatggtgaggagtcaggagtgaagacatggttagttcatagccacataatcttcccccagataatttatgtatgtatgtttgtagttccacaaatatttactgagcgcctactaaatgccaagctctgtttgaggcccaatggacccatcagagaagacaaagactcttccctcatggagctcatatttcagcgaaggagacagaagattaacatatatatatatacacatatacacgtgtgtgtgtgtgtgtgtgtgtgtgtggtgataggtgctatgaaaaaaaaactgagcatggtacagaaacagaaaaagaaaaaggttgaaggggcaatttagatctggaagggcagggatggcatctctgataaaatgacatttgtgccaggacttaaatgaagtgataaaatcaaccatgttaatatctatgggaggaacgttccaggaaaatgggttagcaagggcaaagttctgcaatggcagtgagtttgccgttctaagaaactataagacagctagtgtgtgtgaagaggaatgagagagaaggagcacagtagagaacaaatttggagaagaaaccagatcaagaaggacagtaaaggttgtaataaagaatgtttatttgatctaattatatattaggaaaagttttaaggactttgagctattgtgcaaagaactgactgtaggaagtcaatatggaatttcacagaaggaccagtttggaagctctgaatcctttagttgagaaaagatggtaacttagactatggtggcaaagcagaaaaaacagaaaaaataattccaattctggatatatcttgggatatgctcaaaagaagtgtatgagaaagacagaaatcaaggagaactcacaaatggacaataggtgaatagtgattcttctcactgagatggggacaacgtgaaggagtgtagttagaggaggaaaatcagtgattctgtgttgaacatattaagttagatgtctactatacaaccaagcagaaatgccaattaggcaagtggatatattgatctgagttcaggggagatcagcactggagatagaaatttgggattcattaatatttagatattactaagaattatgagagtgaatagcaacattaaaagaaaatgattctatgttttcaatgaatattcatttgaaatgaatgtagaaatccagtagaaatggtttttcgattttatagaaactacaactcaggatgtatgagtattgaagatgaatgctggaaataatactggtgtgaatcacaaatactacacagcctctgactaacccgctatcaaaatatgagggccctcagatagaaacaaagggagtgcttatctctgactaaaacactaagtcaggtaagaatagaaaatgaggagctgaacttccacttaacctcagggcaaaagcagctgaaggtggctactgtgattattgtgatggtggttctgtattgtaccctcatattgcaatttgtgaaggcaaactgctttataattgacttcagtaatccatcacaacctactccatttatgtgtcttttggtcttttttattatcctcatcatgggtttcaatgtgtaagccactttgattccccttagaacataaatcataaatataaatgctttataataagaaagttgtgtccattaatagggaaatggtactggtttaactttatcagtgaagagtagaggcctagggaaattcattctcccatattatttaacaacgaaacaatgaaagtgtggaatgttcagattccaacaggtcagtgtcaaggctgggatactgcctccatcaactctatgtttctcatatcccaagtcatagccacccataacatgcagcaaacaatagcttctctgaatcacatgtgcctctggctctgttttgtcatttaggtaatgtgcttgttaattttgcactatttgactgggttacagggtacccagatagagggtaaaaaacattatttctggatatgtctccagaaaagattattatttgaatcaataaactgagtaaagaaggttcaccctcactaatgagggctggcatcatccaagccattgagggcctgaatagaacaaaaggcagagtaagggcaaattctctctctcctctgaggccaagacttcatcttctcctgccaatggacatagaagctcttgtttcttagggctttggactctgggccttataccagtgacacattctcaccatcactatcaccccccaccccagattctcaggactcagactgaatgacatcactggcttccctggttctctgacttgcagacagccaatggtgagaattcttggcctctataattgtatgagccagttctcataataaatatatattggttctctttttggttctgtttctctagaggacccttaaccaatacaagtcgactgccttaacctcactcctctgtcacaaacatattgtgttctcaggaaacatcccctccctagaaagttacactgtggatcccaggtgagtctcttttcactccctgccatcacgcccttacctaggacatcatccaagccttgggcctgtatgagtcctggagttctgcttcctggaagatgttcagattttaaaatcacagggcaattactttttgtaaagatgatggagattttataacataataagatcaaaacattaaaattacaattcactcaaaaatgaattccttcagcattcagaaatgttagcctgaaattcacaaggacaatgatgttattaatctctttcactgctccatgatcagcatctggcagtgtgtccagcacattgtaggccatcaactaaatggacactgtggcatcacagaggcaggggatagtggttgaaagtacagacgctggagtcagatcacctgggacaaactgtatctctgcccctcgcttgctgtgtggttttggaagcttgcctaaccactctataaaccagtgtcctgacctgtaggaacacatagttcctatgtcagaagatttttatgagattcaataagccactacacaaataaaagaatgtggtaaaccctcaatgtgtttttgatgttaatgatgaattacttaagaatttagaatgttatgtgtggaataagttaaaatcctagcctctccatgtagtccatcattaaaattagtactttaataattaataaatcgatcattattaacatttttaaatcaataaattgccatttattctacagtgtgctcttctagctttggtctttgtcaatgaatttagtgaatctcccgaccctgatttcctctggcaaacttgaatatctggaaatgtggaaaccttaacagcaaacagtgaactgtaatgataacatgatatccctctctgagatatgtgcaaagcttcaggcagctgtttctgtgtctttcctgtttctctcctataaattccatgacctttataggtgtgttgaaattagaaaagttagaagtattgttggtaagttcactgctcccaactttcaaagagaaagttatcatctgttatcaaggtttactatttgctattcacatttccatgttccaagatactcaagtttgccagagaaaatcggggtcaagagattcactaaatttattgatatagaccaaagctagaagagtttgctgtagaataaatgacagtttattaatttataaaattgtgaataatgaccaaattattaatttctaataaacaaaataaaaactacccagtagacaaaataattgtgatcagttatgttttcaaaattagaaaaaatctacataaaaagcaagttatagtaagaaaatttttgtttctttttttcttttctgttttctttagggatggcttggaaacagagcatattggttactttgattaatggctgatgatattaaaacagcatagcctgatacatccctcacaactgcaaagataaacctgaataatagttttagttgcaaacacacatatccccctggcttccatacttatatactggagaaacgtggacaatatcttactctttctggccttttgtttttatttatttggagggaaaggaagatggatttagtttataagaccatctgagtgacttatgacagtgattgtatataacttttctagttacttacattctcataatgccttcttcctatttcatccaaatgactttgattgaactttgacttcccaaatctcctctgcttatctgttaaaaaacaataataagtaggtccgaatctatttatttttttttcaattttccttcaaacttggaggcggggtagggcgagatcttacttttatccccgtgtagtgaacaccagatatttccagaaagcttataatctaaaatttagttcccagccacttcgaaagtaagtacatttattacatctattctattttgcgtatttggggtcgtacatgggcctcattcattgtttaaatggtgatgcaagttctttgtactgagttaacaagggtcatgattacggaatacagagattttagcagagatgtatttcaacacatcttttcttcagcattttctatcagtaatgaagagatagatgctgtccatttagaagcatagaactaaaatgttttccaagaaacatctccaaaatggtaaagttcaaataggtgagatgtcatccttggctacgtgctaactccactttccagtaaagggcaaatgtctcacacaattaacaaagattccatcaagcccataaaacgccagccactttcaaattgccaggagatctttggattctcttctgattttttttccatttaattttcttcagacatcctaatactatggtggaaaagacaaattagtctaatgcaggatactataaaatgttcaattacttcaaaaagatatggccatttcccaaaggaaggaatttaatcaaaactagatcaaaatgggaaaatggatgacagaatatataaatattctaacatatttgaagttaaagaagactttacaaaaaggctttaaaaatgaatatatcagagtagatgtacaaacacttagaagcatacagtttgtccatcacctagtgggattttaatgttcagattttaccgtctaatatgacagaatctctcagacttcagttttatgtaaggatgaatttaatatttagaatatttcccattagtggaaattttgtaagtatcacagcttttcaaaaatctccttatagttcaacatatgaatctgtaataattttaaattgtcttttttctaaacaaaaattattatgaaacaaaaacattacagaggtccaagttattttacatggcctttcttttaaatattatttttaaaaccattcgctgagatctctgtttaaccaccaaatctagaataattgtagagacttaaataaggaaaatgttcacatatccaaaaacagtatgaattttactgttatttctcaattgtgtttctgtgtattctttagacatctgttatgtttcaaagatcagacatatccttagtgtgcaaatccatgtaaatatcctcatcctataagattgcctacttaccaaaaataacaacaataaatatgttattaagttgttcattaatcttgagacctcctatggcatacatttttttaaaaagccaagaattattaactgaatgtcaaaggccagaaagagcaatgggggatgtttccagtttcaggtatcaatgagaatcaaaatgaaatgtaaacagtatcagatattgtaactcattacctatgtaacaatttgggaataaaccacacttttcagatatcaactctacagaaaagcagtgtgaggtaggttttgatgtggcacccctgcttttgatgacaggtctgtctcagagccatgttatatggggttgggccagttacttaacccataatacagtgcatggtaagagctgaacttcataatgattattccaaattacaataaaagtaaacatgttttaacattctacctgtgagggcaggagaaaagaaaattagtgcttttaataagtaaggaacattttaaatcactgagaataatattatcaaatattggaaaaacagacaaaagaaaaggaatgaactagtttaaaaagaagtacaaagaactaaaagtcttcacttttaccagtgaccaaacatgtttatatttattgtaccatattgatatagaatattattcagttattaaaataatagcaggagaagtttttaatcacagcataaattttttgacacattgaataaaagaagagaatgtcaaattatctatgaaatgagatctcagttttagaggaaaatttatatctgtactgatatacagtaaaacatcatcaagaatgtttatctctgaattgtggaattatgtatgattttcatttattttatacctttagtatgtcccaagttttctacaatgagcatttagtacttccatgatcacacaaagaaatttttcaatgccaagaaatgtaaaaacttctagactcggttctaccatcaataagctaagtgacctatgggacgtcgcttcatcttacagagtctcagctttcttatccgtaaaatgagaaaattgaactagatcacctcctaaggtcactttcacttctataattttatgaatcaataatgtactattaacactattatatccaaagaaaacaaagactaattgaagcaattgtagcaacaaaagttatgacatatggattaagcctagtaggtatttttttaaaactacaaatgactggccattattctctatgaattaatatcttatcctgtttatgatactaaattctcaaaaccatttcaaagataatattcaatatttctttaataatagccctgtaagttttgcaggacacagtcacccaagctgagtgatgctgaataaggccagagctggggtcacagtcctttcctggtccctaaccacccacaggtcttttctcactctgtgagtctctcctgagctgtccttgtcccttattctaattccatcaggtgtgtgttgcagttttattgagccattttcagagccaattaatcagaaaacactgtttttccatgatttgggggattcctctagtaatgactttgcagccataatcaagaaatatgttaagccttatgtcaattaacttaactgatgtgaaaacttgactggtccagggagcaatggatttccccagctgcaccttatcagagaacagcttagtgtgaaggagagaagttatgctgaagccagagctgtaaacgtgccaggaaaattagcacaagctccaagtacagagggtgaagaagaaaacttgcttagcccatgtatgggtgttgcttaaacagttatgaattattttaaaatctttcattgatgggatgaatagtcgcatacatttttgccacatgtaagtttctccaaagaattgggcccacaagagaaatggaggaggggggcctacatgcaagcagatgaggggcatttgcttccccaaaaatattcttatattttttataatgtgcctcattaaaatatgaaacactcaattcaaagcaaaaattgaaataggatactcctgactcttccctttcttccctctatttcctcatgatatagtcttagcacttcttttaaatgttacaatagtgcttcacaaacaattttttttgccagtccgtcacaatgaatgtttttgaaaaatataataaaaacaaattatcacaaaagtgaaataagaagatgaaaaaactaagcacactttgtggttattatattcaacagtcatgaaaatcacaccacaatttgccatgaaagtttcttaacatttaactctgtacaagtatcgttgcagaacaataaggccacaacacgtacacaagcactttgtcttagcaccatatcaacaattacctgtaaagctttatcttggcattttccactatgcaactgttggtttacacagccccattagactgggagttctgtaatgggtaagccagcagttaacacttggaggcactcagtaagtatttattgaatgaataagtcaatgaataagtgaagcacaaaagagcataagcctttctgctcttaacacctacaggcactcttcttacatcaggaaagctcccatgctctcctgattcctttgccccagattccaagggtacagatgcttttctcacctttggtggtaactgccacctgcttgtcccaaagagcttctttgtttccctgtcttcccacaaaggtgataacaaagattttttttacagtttaagagtatcagtgccaatcacttttcagacaaaacaagataaaatgcaataaataaacacggaggaagttataaaaatttcaacataaagcgcagatctatcgtcttgttttctgctattcagagcactaaagacactgggttttgtgtctttatctgtgggtttctctagtttatccatttgatttactgagtttgtgtgaaaatattgattaaatcttttcttagaaccagttgagaaccatttgctactttccccagctctgatattaacttctaatttaaaaaaaaaaagaagtgtgcaagtatattcgttttctattgcagctgtaacaaggaaccataaacttaatggtttaaaacaacaaaaatttattgtctcacgacttctgtaggtcagaagtctaacacagtctcactgagctgaaattacagtgttagcagggctgcattcttttccagaggttctaggagaaatttcatttcattaatattcaggtcattgaaagaattcagttctttgaggttgtgtcactgagtcctcatttccttgctatcaactgagggctgttccaagcttctagtggccaccaggtctctctgcttgagtcttcctccatcctgaaatccagcaacagctagtggagatcttctcatgatgaatctctctgacccaagctgggaaagcgtctctgcttttaagagctcctgtgactgaacacagtccatctgtataatccagaataatttccccatctcaagatctgtaacctttttcatatctgtgaagttcctttagctatgtcatgtaacaggttcgcaggttatagggactaggggatggacgtatttggggacctcaccctgcctatctcaacaacaaatttataaatttattctagggtaaaaaagaaaattataaatgtatgtttttaactttacatcatccttggataaggtcctaatcttatatgagcactcaggacaaggctctaagagattttatggtggagtcacactgtgtgcatcgtcatactgggaaaggactttgtactttgtttattttgttcatctggtcctttggattgtcccccacatgctctttcaatcccagtgcaccctccagatttctgtcattgtcaacttatgccccaattctctgcataaaattctaaaattgtagatcaaaaatccacactataatattaaatcccatttattttgtttggcaaatctgattcttcataatttgatctcaccctattttataaccccatttcccactatttccccttcatttcctataatacaccaaaatacttgcaaaattctgtgccacttatgcttatctttgcacatgctcttctttctgcttggatggaacttcctttctgcttggatgaaatttctctttggggacatgtgatataattgaaatagcatcagcttggaaaccattttgatttgtatttgacctagtcactctgacacttactaggcctgagactttcagaagctcctttgcctgtggtgcaaaatgggattattaaaacctactttgtaagaatattttgaggctttgaaataatacacatgaaagcgtataacacaacgtctgtcatatgatggacatttactaaatgttagttattcttttgccctagagaacctcatttttcctccaggcttaagttcaccacttctgtcacattgcccagacccatcaggtagagtaagattctcaaccttgagtcttccataactgtgtatatttagcactatcacattttagtgggcaatgtctatacccacctgtgtcctctaataccttataaacttcttgagtgaaagaatgtcttgtttatcattttagccatagcacctggcaaaggtacaaattagtcattcaaaagtctggaggaagagatggatggatggatggatggatggatggatggatggatggatggatggatatgagataaatgtagaatctagcataataactaacaaataatacatatgcttcatttactttaaatataccagttgtgtaagtatatcattctggctgtgttgttttgtctttttatctctttggctgccttgttcactgaataactgtatgtttacatttttattcctatagttatgttaaattcctaaaaggttgtgtctttcatttctttgctaccttcactcaagcaaaacatttgcattctatacattgtgacccttcggtgcagttcaacagagtaatctgtttttaactttgcaccattcttggataaggtcccaatcttatatgagcactcaggacaaggctctaagagattttatggtggaatcacaccataaaatctacctaaaaaactaatatttagggtttctggatagagcaagagctgcttcttagaaagcaaaatgatcacacaggaaagtttcaccagccaacctaaatacagtaagaaatactgtagactttgtagtgtcaaaaccacctgtgtttgctcattggccttatgcaaagttaaagttaaatttttggaatcttcttgaaaagaggtagttttacaacttggagcaaggcacctaatgacgttaggctcctatcctcccatagaaactgggagataggggcactatccttcttgattattacatttcagagaatggtctctgggtccttaagaaagacattccttagttgtaaaactggcaagaggcctttaaaaagatttacttccccaaaggacagagaaatgatttacaaatacaggttttgtaaagtaaatgcttaaagaaaaggggtgttaggagcctagagtcaagaagcctgcctgtcttaaagtttagtcaaccagaggggaatgctaaggtcctcttggtgaggaggaacctaagtgtatatttctggatcagaaaggatgggttcctgagatgtcccttgaaaaatagggtagttacaggagaggaaattatttaaaggaatcagtttatcatagtgcagctcagcaggtctattcattagcaaattgcactgaactagcccgtggctgtagtagagtaggtatacctccaaatccttatgtattaaggaaatttacattaaaagacagagatttaggccaggcaccatggctcacccctataatcctaacactttaggaggctaaggcaggaggattgcttgagcccaggagttggagaccaacctgggtaacatagtgagaccccatctcaataaataaataaataaataaataaataaataaataaatacctgtagtcccaactgtgtgggaagttgagatgatgggaggaactcttggtcctgggaaattgaggctgcagtgagctgtggttgcactgctgcactctagcctgggtgacagagcaagactctgtctcaagcaatcaaccaaccaaacaaaaacccagagatctcaatctggtttcatacaatatatatgtacaagtgtctgtatttcagaaagtattactgctttagaaaatgcctagctttactttttatttcacattttactaacaattaaaaggcagtggaggttacaaccccacatcatggcccgtgctatcccttccttacaattctgtcagaagggggtgacttagaaagaaaagcttacatattgctcttggtggagcactgtgattaatctcagacattctccagaataattttaaaatcataatattttagatatgtttcttcctttacccttcacatttatccaaagctcttggttctgcaattccctaaaacatactttaggcattaagtaaaaagtgagaagtaacgagagtaacattattcgcttctcttcttcctagggtatcttattttcttcaagctttctttcttccttcttactcctatcccatctttgttatttcctctattctgaacatgatcaaactttctggttatcaaaatgtatatgtgggtatgtgtgtgtgtgtgtgtgtgtatacatgcctgcatgtttggggagtgtaagcatttacaataagcagctaatttcacaggatgacagtcccacaattatctggttattatttgtaaccaggtaacttggctagacttgtgggtaggtcagcagagctcataggcacacttctatgctcattatacaaagatggttaaacaaagaatgtatatctaagtatgcatccaatgtaggaagaaatgaattctgcttgtgaaatgaatgaattctatttttgaaatacatcgtatttatgaaattatgcttgtgaaatgaatctgacatatatacagaaaatatttcaaatgcctcatagactacacatcaacaaaaggaacaaaagaaatccaaattttgtattattcttccctctctttcttgtcctcttggctcttcatgcttgtgttcaggcataatttttaaacacttttcttaagccagttttcactgaagaggtcaggtgaggttaggttctttacggtaagtcacactttatcagtgtgaaattctgttgtacttgtcatttctcagttaattaagccagatatctccttagagatctttttcatatgaaattggaaactggcttcatgttagtgattgtaccaaaatgggctttaaaatgtaaaagtctctaatcctcttttagaagggcaagtgtttcatgtcaccttgtctgcagagcaaaatctctttctgaatgaaagatgcagctttgcaaaactgcacactatgattataaatcaaccagtacaataacagtactgcagacaaaacctcctaagataatctctttagcataaaattgtattcagcaagatgaaaatcctaacaagattgtgatttctgtcggtttagctttttacgcatgccatttacactaagattcttttttcatactcatattaccagttcacctggagaaaaatggcttattatataatcagggttcatatgcatggaccacaatgggcatgaagcatatgaggatttatatcaagagtcaaaattcttaacagattggcagttgctcaaagaaaggaaataaaagtgattagatggccacgattgctcctgaattcagaataaaggaactgaggtgcacagctggactacatcacaccaggaaagaatgaggagtctctgaagagtgtgacttcagaggagaagctggaattgtttattgttgccccagggaggtgtaattggggttaatgggataaaattaagcacagaaaaattcatgatgtctatcaggaaatactccctaataaagaggtcttttataaaattgtcccaatggaaggattagaagtccttttgtttgagtgattcaaactttacgtggggaaatatatggaaaaataggctgcaaaagacaatctcatacaagtcctcaagggatgaattacgtagaacaatcagatctttcttggctttaattttcatgagtctattttagtaagctccttaaagactcaattttcaaagcgcttgttgaatcccttctgcattgcacctgcattagtagcaggttccaaagaactgagtttgcaattgtgtactatgacgattgagactcttacctgagaacctggaaacctgaagtcatttgcaatgacttcagctggtatttatggatgtaaacatagtttatgtaaaactcagtatagtaaataaagttctgaagaatgctaacagcaaactgaactaattggtacactgaattccttgtcttatttgagttcatcacatcctttaattaattaaattagactttattgagaatcttctatctgctggtcgttgagtaaatgctggggttaacatgaaatgttaacattttcatgttaaccccataaaaaagcaggcaaacgacatgaacacttttttttccatatgattgttggccacatgaaaagacgtatatgtggccaacaattatgtggaaaacaagttcaacatcacttatcattagaggaatgcaaatcaaagctacaatgagataccatctcacaccagtcagaatggctattactaaaagttcaaaaaataacagatgctggagcggctgtggagaaaaaagaaggcttatacacttggtgggagtgcaaattaattcaatcattgtggaagacagtgtggcgattcctcaaagacctaaagacagaaatactattcaatccagcaagcccattactgagtatacacccaaaggaatataaatcattctatcagaaacacacatatacacatatgttcattgcaacactagtcacaatagcaaagacatggaatcaacctaaatgcccatcaatgatagagtggagaaagaaaatgtggtacattcactgtaatagttaagattctccagagggacagaactaataggatatatgtataaatgaaagggaatttattagggagaattggctcacaggatcacaaggcgaaatcccatgataggctgtctgcaagctggggaagaaagaagccagtagtggctcagtccaggtccaaaaacctcaaaagcagggaagccaacagtgcggccttcggactgtagctgaaggcctgagagccccacgcaaagcacttgagtccaaaggctgaagaacctggagtctgatgtccaaaggcaggaggaacagaaggagacatccaatatgggagaaagatgaaagccaaaggactcagcaagccagcttatcccaccttcttccaccagctttgttctagccatactggcagctgattgaatggtgcccaaccacgttgagggtgggtcttcctctcccagtccatggactcaaatgtcaatcttgtctggcaacaccctcatagacatacccagaaacaacactttaccaactatctaggcatccttcagtccaatcaagttgacatctaatattaaccatcacatgtaccatggaatactatgcagccataaaaaagaatgagattatgtcctctgcagggacatggatggagctggaggccattatccttagtaaactaacacaggaacagcaaatcaaataccgcatttgctcacttataagtgggaactaagtgatgagaacacatggacacacagaggggaacaacacacacttgtgcctaccagagggtggaagtcaggagaagggggagtaacagaaaaaataactaatgggcactaggcctaatgacacctgggtgatgaaataatctgtatgacaaactcccatgacacaagttgacctatgtaacaaacctgcatatgtacccctgaacttaaaataatagtttaaaaaattttttaaacatttttaaatgaaaatgttaaatttgatataattttccattctcttttaaatgcactctggctaaagactgtgtcttttctacattttcatgcctagtacctaacccaatgtctggcacagacaatacttattaaatgaatgaatgaatgaatgcttaagactaccacatttggtatattaccttagtttccatgaactcatttatgcctgtctttcagcatactaattacaaagatatatttttacataaataaataaataagcaaaatgaacaacggtttaggtgccttgtccaagatcttctaacttgttttattccaaagtttctggataaaacgccttcccaaaaaactggctgcctgaggccccttcctcatctctaactgaaagtaaagcagttgtttaaagaaagtttccttctgctttcgacactggcctttttagacacaggtgtgaacccatttcgtttttgtttgtttgtttgttttggaagagggaggaaagattaagatctttctatgactttctttacccttccactatgaccagccctgcaaatgcctagactcaagatcgctaatcttccacactgctggatattgaaagaatatttaaataggcaagctgggcacagtgacttgtttctgtaatccagaactttgggaggcctaggagaaggatcacttgaggccaggagttcaagaccagcctgggtgacatagcaagatcccatctctatataaataaacaaatgcaatttttaaaaaaaatagaaagaaggcaacttacaatgaaaaaaactagaagcaaaatgaagaaattcatagtagagtggaaatatatcagtaattgaaccaggagctctggtgctttttcagactattgaaaacccctccttcctcatctttatctttaggtctctcatgtcattagtcttccttcatgttatatatcatagaagcattttatttctttaatctgcaaaacatatttaagtgttagaagacatttgcttttattttagtatttaatatggctctcatgtagttttcagtctttttttacaggttttccaaaataagttatttgcttcattttagttttttctactttacatctaagttttgtacaaaacctgtaggaagaaagttttagtgacattgctagaattctgtgtattcatttgtaatcttttcttctattccctccactgtcgccctttttattagcaaagagcaactctgctgctattaaactgaaattttatgctaaaggacattttatcccttgccaactttaaaatatgtatttgaaacatcatttatctgtcctctgatgtgatcttccattcattctctacattttttcccacatttccttttgttgaacagatatagatttgtttggtcattgacaggcatcatttgccttgctgttatttctctctgcacgcttcaacattcctgtcactctcatatattgatacatattattacttactggatccctgttctcattttttcccaaatttactagatgtgtgtaccttgtgaaggagtcaaaagtcacttacattttattcaactaaacatgatcagatatcaaaccagatacctgcacttatgaagttgtggttcatctgtgacaagagcacatatgacagtgaaaagatgtttcatctaagtttaggccaattgatgcatgtctgtagaattaaaacaggcttctttaagatatgtgttatgttttccaaagcagccaaacagaacaggctgtagtcattaaaagataattgtcccagtggggtggagcttcctgagacatgtatgtttgtgtaaggttgtccagaaatgaggcaatctaatgagtgacttgttatctttgaaatataaaatatgccaggacactaaattaaatagacccaaatagtcttaaacagaatgggctcaaataggaaagtcaatgttattgagattaagaataaattaactcccacttcaatatgtgtcaacaccatgtttattaagtttttaactaataaggtatgtcactttatgagattctctttattgagggaagatagaaaaacaagagaacaaagttgtgaatacttacagtatctgacttcctttttgtaggcattccagttcagtgaattaaattgacaagagaatgtttgcatattatccccaagtttcatttggggattattttcttaatgttttgagagaagactcagctttagactccagttctaacaacctgaaatgctatcagcagtcccagatccctccctctactgcacacttgcctcccccttgactttcctgttacaaacagctgtagaactcaatgtttgcttgtgtctcctcaaaactcatatgttaaaatcctaacccccagtgtggttaggaggtggggcctgttggaggtgattaaaaccctcataagaatatattttagaaagctctcttgccccttccgccctgtgagggcacagagagaagacagtcctctatgagccaggaagaggaccccaccagacgcagaatctgccggcaccttaatcttggacttcccagcctgcgtaactgtgagaaataagtgtctgttgctaaatctagccagtctatggtatttttgctatagcagcctgaacagactaagacatcaacaaagacactccggaagccactgcttggttaggccgcagttcccacctgaccccagttgcagagcctcactgattaatctctctgtctcctacactatccattctgccagggaattctgcttaagttacagcttcaattgggtgatttttctcttttctaaaacattcaatggttcctcattgtccattgaatgaactacaaatacctcagcccagaattcaaagccttgtacaatatagctccaacctctctctccagctacatcactttctattctctgacataaaccctatcttttagcaaaattgaacatcttatatttcctcacattgtctggtatcttctcctctcaagggcagtgtttccaatttcctttatgaggagcctatccttcagaattattttaaatattgcctactataacaataacttttctgatttttcagtcatatatcctatttcacttccttaacgctattcatttttgccacatgtattgtactttgtatcatgttgattttattgggcatgcccctagcattagcccgagagagtaagcactgcatctaactctacagaacacctcctgcagccaccagaacagggccagacacacggtggcagatcatctatgtaatcttgttttccacaaagactaatcaagtagacagcatatggatgtgcaaagcacaatgttactaactttacaatagggttgcataggtaaagtcaaaacattgttgaatctcattttctaacatgcattgacaaatttttctaagccaccaattcttaccaagagtttagaatattattttaagttagtaaatattaactaaaggatctagtctatattatataaaatattaatttaacatttaatatttcaaatgatctacaacaggaatgctcatccttctctcagaaaccctctgcgttctctcctcactttctttcggtttttgtccacatggtactttctcaaggaagtctgccccctagccaccctgtctgaaattgcaacacacacacacacacacacacacacacacacacacacacacacacacacacacacacacacacacaccccctatctccctttcctgccttattttcctccgtcacacttatcactaatacactgcaatggtctaaatgtttctcccaacattcatgtgttggaaatatatttcccaatgcaacagcgttgggaggtggagcctaatgagaggtgttgaaagcatgatagtaaaagtaaaatagtgcttatcggagaaaacattcacaagcagagaagtggcagagtacacatgatccatgtgccttattagcccacagagtggcacgcttagacaaaggtgaacagaggcacaggaataaaaggagacactctcctcttgccatttttcataatcccaggagaagtgaatggaacagggaacacctagttgactgtgtaacagtgaaagcttccgctcagagaatggccctgttaaaaatgggcagtttcataaaaaagaatgagatcatgttctttgcaggaacatggaggccattatccttagcaaactaacgcaggaacagaaaaccaaacaccgcatgttctcacttctaagtgggagctaaatgatgagaactcatggatacaaagaagggaacaatagacactggcgtctacttgaagcaggaggatgggaggagggagagcagcagaaaaaagtaactgttgaatactaggcttagtacctgggtgatgaaataatctgtacagcaatgcccgccccccgccccacctacacaagcttacctgtatagcaaacctgcacacgtacccctgaacataaaagttaaaaaaaaaaaataggcatctcctcttgagccagattcccgctactctactaaaaaaaaataaaaataaatttaaaaaaagcttccaggcgcttccagaacaatctttcctcagtccactctgggtctgcgggaactcagtgtagataagtctattaatcagctgtggccaataccagattttttttgctgtttaggagtttggtattaataagtgtctcctgcagttaataagtgtccctttcatcattcaggtaaagaatgatgtcttaaatattaggataagttcatattaagagccactgcttgggaaaatcttagaaagctgtttgaggctgtctgtccacatctgcaatagcaatgagttattcaaatcactcacttcaccctgaaatcttgatcctcctatttagattgtctgagtatgtgtccaatccaatgaagagtatcaacgtaccttgagaatgagccacggatttttgtctgcttttttcattattgtatccaactacacagaatggtttctggcacatagtaggcacccagcaaacatttttttgcctgaataaataactgaaatattgacaatcaatgcagtgccctgccctcaattccttctctcatgtctgcatcatcagtaaagatacaagggttgtgttaattcaatgtaagagtttattgccaatttagccacttataaatttccctttactacaatgtgaataagctggtaacggaacaaaattccttatagtaaccaactttcaaaccttgttattaattatagtatgtgctatattatcatgctaacactttattgcttttcctattgcagcttcagaacagatagttaccacacatgatggtgcggggaggctagttagatggccttcaaagtacttggccctccctgaccttgataaccccatttatactcagatgatgctattacttcataccacgtttccttttaacttcttattatctctaaggctctctgccaggatgagaaagatgccactcatttgttctctaaccacctctttctgccccttatcagtgggctttcacccactggctctcatagacacttttctccagattgcataatattacatatttctataccacatagcttgtatcttgacaaatagaatactataatgccaaatagctcctaattctcctttacattaccttctgaaaatatgctttcaaacattttaccccttccttactacgttttctttgacatcctctaacataactttctcttttctttttcatttataaaggcagtatcaaacttgcatgttgcaacatttgtcattgttatgataaccacataaggtctattaacaatctgaatggggaaaaacttatattaataacccattctgttgtatttgtcattataaatccttttgctatcacattatgaattttggaaaaaacagaaataggaaggggaaatatgtctccaaaatgtgcagatgtataccccataatctcaatttcagtgtcctttatctccttatccctctctttctccctagtttctctcactccctggttctctcacacctttctgttgttatatttagaagtaactattagatgtttggtgtataagagttcatagctcatattagtttaccaagggctgctataacaaaataccacaaactaggtggcttaaacaacagatatttattttctcatagttctggagactggaagtccaagatcaaggtgttggcaggtctggtttctcctgaggcctctctctgtggcttgcaggtggccaccttctttctgtgtcctcatgtcatgttttctctgtgtgaacccatccctggtgtctttttgttcatccaaatttcctcttctcataaggacattagtcagattggattaggaccccctccctaagagccttattttgacttaattactcctttaaaggacacacctctaaatatagtcatattctgaggtactgggctgagggcttccacatttgaatttaaaagttgggaggggcacaattcactttataaatatttcttcataagagagaaaaatatagtcataaaagtatagaattcaaagtaagttatgaaaaatgtgataaactctaaagattaggttacaatacacgatgctttttgctttagttggttagatatttgattgttattttgtttttgaaagaaataagatatgagctagaccacaagaggatacaatttgacttcaaaggataggatttctgcagtgaaattggagaaaagtgaagggaataaattgcacacatcccagtggcaggaaaacaaaggactcattaaagaatagagaattgatctggctggaatgttgactatcggagagcgttggtttgcaggagcaggagcaggggtgcccctgggtaagaagaagtctagagggatttcagactagaaaaggtaagtagaacttcactgtaaatctgaggaatttggattttattctgtcagtgacaggaaagaattaaagtcaaagtgctcttgatagttcttttgtttgcatgtactgttcagtgttgaaaatgggtaaacctggagaacattatgctaagtgcaataggccaggcacagaaagtcaaacaccatgtctcacttatacgcagaatctaaaaaagttgaacttatagaagcagagagtaaaatggggttgggggaaagcagggtgattggggagctgtttagccaaaacattcaaacttttagttagacagaaggaataaattcaagagatctattgtacaacatggtgactatatgtataatattagttcttgcactgctataaagaaatatgtgagactgggttatttacaaagaaaagaggtttaattggctcacagttctgcaggctgcacaggaagcatagcagcttctacttctggggaggcctcagataactgccagtcatggcagacgcaaagagggaatgaggcacttcttacacagctggagcaggagcaagagatggagggaggtgccacacacttttaaacaaccacatctcacaagaactcagtcactatcaggagaatagcacgaagggggcaatctgcccccataatccaatcatctcccaccaggccccaccttcaccattgggattacaattcaacatgagatttgggtggggacacaaatccaacccatgttactatagttgataaagggttgtttacttgacaactgctgaaagagcagattttaaatgttctcgacatgaaaaataagtatataaggtaataaatatgttaactagattgatttagccattccacagacatattttaaaacatggtgttttaaacaacattcatagatactgtttttatttgtcagttaaagtgtatataatttaaaaataaaataagctctatattaacagtagtctgtattataaagcatttgcttccctcaaatgtttcaacatttcctatgtcataactggaccccaaacttagctgaaattttcatatacatattcttaaggacctaaaccagtggtttgctttggtcctatgatcacccttcacaaagtctgacacttctgcattatttatatcagtatttctccaactatagtctttggctctttagatatctatgaacttattctgaggagtggaagaaactagtcttttttaatttgtaggttcttaacatggggttcttgagcagaggtgagaaaataattgcatattttattttcactaacttctaactgaaataaaacatttctctttaaagtaaattggcaacacaggcagattttttataggtcattacaattactgtgaaaaccttgaaagttttttaatgcttatcactaatttaaaattatgggggttatcaaacctgatgacagatctcattatttattggtaataaaaattcaccaataatatatttgtcaatgttatgattttttagatattttgattactgtaattctggataattggtttcatcttactggttgaatttagttttatgctttgaaaaactatcctgagaagcagcccgtaagctacaagagacaggcagaagagtctatgggataaaaatggttaagaatccacaacttagaaggagtctatagtattactccagtctaggggtggagggagaactgccttctgttatcactccttgctttaagaaacctgtgttcaggcttttgctttgaatactaaaccatctatttctgtatttatcatatttctttgagtcgatacctttgagccttcctagatggcttcttatcacttgaagttgactataaatggattcttttattttgtttaccctggagtcagaacaggcaggaggaaatcaggttgagaggagtaaagcatcccaaggaaaattttatcaattaaatgttaatgcaaaaaaaaacctattcattctcttgatttgtgttactttaaggtgaaatccagaatatcaaatgaacttatcaaaaggatgcctaaatgctttcaactttttggtgagttctttaactaagttccactaggtttaaaatataaatatattgtttccacttaagcaatctccagataatattttaaaagataatgaaataatatctaagaccctcagatggaagctactgtattaagtgctaactctaatcattattttcttaaatatttggatatttggatctcactgaaacatgtaacattcttttgaaatgacctgtgaatagaaaaatgcaatcaaagcatgttgcagtggaagcacctgcttctctccgttctgtaagaatagagtctcaatgaatagcctgctgaaattccaatggctttatcaaatgagaccctgaccaggttttccaacaatatttaaagcctcccttagtgatttcactgcatttacagagagacctcaacaatcaagaaggaaatgtgtgttttgctctttcttggctctgttcagtccctggttttatcaagctgccgcacagcacttctgtcctgaaagatgcctgtgtgacttggataccatttcatagagtcacactggatcctcttatgtcctgccaattaaattatcttctccagcctttattcctgccaaagaggctcaggctgagataaggtcacactcctcttaagttgtttttgaaatagtgtggaaggcctcatgaagaataagaacatgcacaagcattaatgcctcatcttccccagcccccttggtagatactgaatttctctgcagaagttccttctattgtgtaccaccaccctgaatctctaaaaactgaagagtcctccttaatctcattaaattaaactatagcactacacaaagcatgtgctaaatgtgagattccattatcactgtgccagttgaattacagatcagacatcataggaactgagaggaggttcttaaattggtcctgttcagggaatctagggaacaatacttgactctcttctgtatttatataaaactatctctattctgctacacatctaaaacaaaattaaatttttgtaagctatctagataatggctatttttcatgttttgcattctacacttctccttggcttttgctttccccatcagaatgtttcacaagacacaactaaggtaatggatctttattttataaaacacacaaagtgtaataattgagctttcagttgatttcatattttgcaccaaggtactacctttccatgaggagatgcctgcaaactcaagctctagacttataggagactataaagtgttctctaagaccctcgtttaaagtgcctcttaggacttttgagactgtcgagatgaattctactttctgggtcctgaatccaaaatgagcggaagaggacctacggttgccctgtaagagtgggtacaagggtaagaagtcctcagggtgtggcgctcagactggctcacagacataccaacttcctctgaaacttaaacattcccagccacctgtcccttccacgcaccctctccgttgcctactcacaaaatcattgttgtattttgtgtaaaacctcatcattcctttatgtttccgatgaaagattcttgctgacccttagtactccagttccccaacccttgcaagggatttcatactcagagaacacatggcccagattggagaaactgcaaaagcacagatagtcactgtttgcttgcatatctgctgacacagtttctggcacgatagaatattagcacgaggaaaagctaggctcttgagtatatgcttttcctaaactctctctctttatggagtcttctcaatccaaagaattataacagaatgaagagtttaaaaattttaggtaaaggaattgaaatcagagatgattgagaaggcttttgagctgattgagagatctgtgagtattttcctcctttgagctgtcttgttttttgttttttgtttttttgacggagttttgctcttgtttcccaggccggagtgcagtggcgccatcctggctcactgcaacctctgcctccctggttcaagcaattctcctgcctcagcctcccaagtagctgggattataggcatccgccatcacgcccgggtaattttttgtatttttagttgagacggggtttcaccatgtcggccaggctggtttcaaactcctgacctcgtgatctgcccaccttggcctcccaaagtgctgggattacaggcatgagccaccgcgcccggccctatttttctctttcttagcttttctgtttcatcctatgcttaagtaatttctgatttatactagatactataaataatattttgtgaaatcttgggattttattaattttccctgaaagttgttgagttattttccaccaaagacttttaaatgactgacaggtaaccataaatttgtagaggtttggttttctgctttatgaaagtgggactattgtggtttgcctcctaatcctgaggaaatcacttagtcctaggccattacctttactcttaagatggggaagtctgagtatttaccaagcttttttagcttggcaggtcttaaactccaaattttcttatctcttcagttaaaatatctactcagctctttatagccttcagctctattttttttctccctggacattttgggacctcataagcacgtatgcagttgaggagtcacacaaggatttgagaaaattttataggcagatcttgatatctttcactgttgttctctcctttcaacactctggtggtcctgcatccatgctctgaagccagtaagggtgtggttttctgcttctattttagctgatccacactgcacttgcccatttatttattggtccattcattttttacttttattttcgtctggtgcctcccactaaagtgcaatctctgggagaacagatttctcttctggcaccactatatttcagcacatgatgctatgcacagcacacagtagattcccaacatatttacctgacttttgatagttttacatcatatcatgtgacaatggctttatattaaagttatgttaaattacattaaatttataatttaatcacattaaattaaagtcatgtaaattcttgaaagaccactaaaagtaaaatcaacagagtgtttacatcctcattctagagataggaaagagtccaaaacatttaaaacaaaacactaatcattttgattcaaggagatgtcttaataaactatgtaaatgtatataatttgtagatggtatattactgtaatgtgtgaaagtattgagtataacaaaccaggatggagccatttaactttttattaagcttctatatccaaccttattgcaaaggaaagcatgtacaagctccccacttctgtcaatgtggaaatataatgaatttttcctctgagagtgctgaacagccatctcagctaagttcttacctctacagcaaaacatcaatctaatctgtcatctcagcagcactcactggccattctgtgaaatatccttctgctatttgagagctcaggctcctaaccttcattatcagaaaaataacgaatcacaccatcctaatcctacagtgtttcctaagctaaaaatgcaatatcataaactttatatacaacacttttgaggtagctacaaacagacatcagtcaccaaaaacatactctcaaacatttcctagatataagaattgtctaattattcataggaattgtctaattattcatacattcaaaatttttgtacctgggggaaaaaaaaacaaaacttttgtttgattttctccatcttaccagcaggattttagtaattggcatcatatatgaaagaaaaatttatacttagcctgttcctgtgttgtgtttctttccagggacataaatattgatgcaaacaccatttaaaaacccattttatagtgtcacatttacaaagctgttttgggtcaccacaatcattggaattcattcacccctcagaaaatactttattctggtcataacatcacatttttcctctcatgcagaatgaacaatctatagtcacatgttgtttctttctttaagccacagtttctaaattgagtgtctagcatttataatcaactgcttcatttaattcaggtcgattttaaatgctagccattcatttggtggactgtgagcagcctgtggttttgttagatctacagcataaagaaacagtttttcttatcctgatcctatagttgtctgggaaaggtgacactcggtgagacataatgataagaaaggctacagatgccctaggcagtcagaaccaaagccagatgattaaaccattctgcagcattccccaaagacaaagcaagggaagcaatgttttgaatgtttagtactaaaaaaattctccagaacagaagtcacacatactgtatgtgtttttgttcctgcaatcccccaccctctgtttctgtagttcctcctattaatgaagaattcagagagggaggaatgatagtttttgcatgcctatttactgggatttcttttattcatctgtagagtggaaatatcaactagattaactttgaaagattataaaaaaactcagaattctccatgtctcctcatgaggaagattgttttccctgtttcaagcaatgcacctaaacgatacactccttcattttactgattcctcttacttattgttctagtagaggcacatcagtcggtaaaggaattgaaatgcattcacgacatttgagtttgctagattcatttacaagtgattgatgggttcacctggcaacttcaagacctatttgcttttaaaaatcaaacccttaatcctaaacctaacatgaagattcatgacttgagaagataatttttaggtccctgtagcacactctatattgacattcttgttttaggtagagaaatgtggaagagggaggaatagtgtgtatagtttcatatgtcacaccttcttctggaaattcaagagttaatctcttttcctttattatcttcaacttggtttcaggcaggtagtggccctctctagagacagattctgtcagcactttaatagctccctcaaatgagaacagtcagcttcaataggggttagagaaaatagagtacatatttgctttaacaggagaaaaggaaaacattaacaaactaaacattactttaaaaacatgaaaacatcacattttaaatttaaaactgcctaactaaatcttgcagtatgttattggtatcacctgttcctagatgcaactccagcccttttcctactggacttggcttccctcatgtcaggcagccttccccttgggaattttctgtttcctgtctgttagtctccattcacacccttacactcatttcagcctttctgaaaaaggaggtggtaaaacttcactaatctcttagcgaaattctcactgtgtatctgtgtacaatgtgctgaaaaacaccttcaaatcccatttccatttccccagagaattgggcttcctggagagagatattaagggttttgtctgccttttttaggttgacaatatcttttattttaactgcctctgcatgtcatctatttcaagatttcttatgtaatttacacattttaatttactctattctcttattttagttttttccccttttctttttactacctgaaatctgccttctcttattaacgatgctctgattcattatttcacttcttatgatctgactgttttaagtgcaccagaggccacttaaaagactattaagcctccagaggagtgacaggtacttttgcactagcccaatgattcttacttgttttctatctgctgccctcatgagagctttctttccaagcatacactctatcatccctataactaaaataataccaaaaaaagccacgtacacagttcatcttcctttgccatatcaggagaaccagaaaattgtaaagaaaagagagtaagaggaaatctaggaagagctgacctcatcattaattaacagctactggtaattgcacgtttctatttataaagcttctcagaacctcctatgagacttccctgcagatcctaattccatgagtatcttgactagtccaaaagcccttactcctaatcccaacgagagctaacataaataggtgtattgcctaagacagttgcttcaccataagacattttagagaatctgtacctttgaagtagaacaaaaagtgttgtggatatgtcttatttagtttaggctatgtttaacacagagattcatattgtttatagaagaattaagaaacattttgcataatatatgaaatgttttaaagtgtccatgacccagcaatctcatttggaataatataccctcaaaaaaattgataattgaaccaacaggtgtgttttcctaggatatgtcttttacagaaaaaattgaagctacctgaaaataggagattgagtgaattttgttgtatcaatataaggaaatatatgtaagcattacaaaaaatgattgagagttctattattgtcattgtaagacgatattttgctgagggacaacagtagatttaagcagcatatataatacaatgggatttaacacttttgcaaaattgtgtttttatatgtagattatagtgtattaacagagattaaataaatggcagaattatgagttatttctctttttctctttctactttttctatagtgagcatgaatcaattttgaaattaatgaaatctgaatctaaattttttttaaaaagtgtttatttcttagagtaaaaacacccagcaaaaactgaggaggtgacacttaagctgagttttgaagaagccagaagagttctctaggtgaatgcagtggttctccttcatgcaacagcaggggcaagggctgatatatgttagaggagttgctagagagaatggcatttatgaatactataagtagctcaatgagactagaacatacagtgcaatagaaatataatgggtgtgaaagtcaggaggcaaattttgaaaatgccacatatgccaggtaaaataatttgaattttgtcatgaaagagtgagaaagatattttttaaagagtaatggcataatagaattgcatttttagaaagatcactcagaagcattgtgaaaaatgaattggcaaccttttatcatacactctgccagactgaggcagtggcaatgaggtgggaaaagaaataattgagtttatggtcttagttgtagaaacttagggctttgtagggtggaagtataggtgtaaacattgtcaatgataacctctgagattcaggataatccaatggaatagtcaatggtgccattccctgtgacagagagcaagagacgagggccagagttaagggggaagaggactctgtgctgtacatgatgagtttgagacacacagagtttttccaagtgaagatgccgagtgggcagctgcacattagagcctggagcactgaagggagatatcagcagcatatgtggatttggggaatctacttcccatgtgcaggcatgattttaaaggattattttacacttgcttttcacatgcttttcatttcataacttagagaaatctggcttccccacctcctcgtattaaatactgttctcactaaaatgatctccaatgacttgcaggaggctaagtccatatacagtgaaagttgtggaacgaatagagaaatatgtaaaggaagaagcaaagagggcttaagagacaacttagagatcacaattacttaaagttctgttaacgaaaaaactcagacactgtggaatccaaaagcaggaaggatgggagaggagcaaaggttgaaaaatcatctatcaggtataatgtttactctgggtaatgggtacactaaaagcccaatccctactagtatgcaatatacccatgtaacaaacaagcacacatatcccctgaatctaaaagaaagaaaaagaacccaaaactaagactgaaattcataagtaggtgggagaaaaaaacataagagactattgttactaaggctgagggatgtgagaactgcaagaccccagaggctttttagtggtgttggaacttggccaagccaaataaagtcaagtctgaatactttctgtggacttagtaacctgaatgtcattagacatcctcctagtgagaaccgttttaagatagaagagaaagtggaagcctaatcgctctggattgtggaataaaagacacacaaagagcaagtgtagaataacccttcaacaagcctggcagcaaatgggaaggagaaagaggagggagagagaagaggtgcgagtggtgggggggtcactggaagcctttttaagatttgcatttcttttttcctgcggggaaaggaatggtagaatgggaaaactgaggtaattgaagaaaagaaacagaaggacacagcattcggaccagaatgaaagatcagctatggctcagaggttaaagactttacccttggagatgggtttataggcctgcaggctggatagcaatggaggtaaatttgaatgtgggaaaaatttgggagaatttttctaagtagaataccaggtacaaattacaagttatattcagtttctcaaagagggactagacccagcaatttctatgcagattattggtgctaaaataacccaggttaaccacattaacttcagaaacacaataaaagggactttttcatgtatccgattaaattactatggaaaaataatagagtggggttagtagtgtgagtgccaagaaaggtgcaatttaaaatagtgatcaaagtaaaacttactgaagtgacatttaaacaagatttgaaagagatactgagaaaatattgcatgcctaaaagctgccatgggcttctattttcaagtaataacaaggaagctcatgatagctagagaagagtgagtaggagaacaagaggaggagattgagtcaaagaggtaatggggagacacattatgtcacatttggaagcctctgtaatgacactggcctttactgagagtagattggagagtcatggaagattttgaacaaaagaatgacatgatcagacttacattcttagatgatcaggctggctgctgtgctacaagtagactatgagtaaggctgaattgttgcaagtggggagacgagttaggaggctattgcagtgatctaggtgaaagaaatggcaaattggacctgggagacagcagtgtagatggttaaaaacggtcagattctgagtataccttgaaggcaaatcttacagtattttctgacagattggttctataatgtcagaaaaagaagagtcaaggatgagtccacaagcttgggacttaacatctggaaggatggcattgtcattacctgaaacagaacagctatggatacagttaggtgtagtcaggtattagggagtagagcaggattgtagtttgcacatagtaagtttgaaatgtctactaagacgttctgaggggagatgtctggtgggaagtcagacacacaagtatgtccaaagatactgtcaacaccttggctgggcacggtggctcacgcctgtaattcgatcactttgggagactgaggcaggcagaccacccaaggtttggagtttgagaccagcctggccaacatgatgaaaccctgtctctagtaaaaatacaaaagttatctgggcatggtggtgtgcacctgtaatcccagctacttgggaggctgaggcaggagaattgcttgagcccgggaggtagaagttgcagtgagccaagatcacaccattgtactccagcatgggctagaagagcaaaacttcatctcaaaaaaaaaaaaaaaaaaaagatactgtcaacatcttgtatctttgacagtatctttggacagttgttgtccaaagatacaagcaccaaggatactgttaatgaatgtgatgattttaaaaaaataaacctccaattctagagagaagagaagagaaaggtttaatttcctgacctctaaaccatctgtgctctcaaaacacttgaacatagggtatggaagaggcacagtcaatatttgataatcaaataattcaagcatattttttacttccatgaaaggacaatgcttcatttcttttaacaacaggcttttgaactattgagtattcattggactgggagtgaggaaaaaagcagatattcagacaatatttgagacaggcaaatgtggaactcagaagtgagttttccatctgccacttttttaggaggccgattgggccaagccattctgaaccttcttttgcagctttcttgggatgaagccagcctttaatctcctcaaaggaacttctgttcgtattcattgaattaatggttttacttaagaagttgatacagtacagctttaaaaacaacaacgaaacctacattataaattgaagtcatctccaagtagtatattcaagttctgaattaattatataggagattttgaccatccagagaacattacattatttctgtttatttaatcccatttcattttccttcaaaaactcttcaaataggatatagtcatatacaggtaaaactgaatttttcatgtaaaagtgaattgtaattgcatgtgactataaagagatcgttatctgtgaaatgggaaaatgcctgcaacatcaagcttgcactctacgtgagcagtgaccctactatcttagctatgataacactgcaaggagctaaaccatcagtcagggttactgcactggacagcttcagaaccctcttgacactgatttaattgaaataatgatttttttttccttttactatcctgaacatttctgttcttttagagaggtcaagctactgaaataccaatagtatccaaagggtccaaagggtcaaggccaagggcagcaacaaaagtttgtcattgtacagcataagaggatctggtaatgtggaagtacctcactcctgtgccagcttcagtacacggctccttttccctgaggctggcagctctggcagaaattaaagcaaaccttagcctcctaaatccaattgcagtttggattggaggagtttttgttctgaaagaatatgtagtgatctgtgttcatactgtccatcctgtaagcaatgattaaaactaatttagcttggttattcattaagtctccatggacatttttgcataactatggactttatatttctacccaacagtttagcactgactagcccttgggtttattgtaccctacactggcttcttgctgacagtaccatgcttgagactgacttttgagtttgaaaagagcagaaattctagactagaatttctagaggaagagtaggaagtggatcacttcacctctcatttttatttgcactccagtcactcaatacactgctttagatcaaggacaggaaccatagccacagaaaggtcgtgaggaagtacatcatcattccagtctgtagtctacctaattccaaatagcatgtgatatgtgtatgtgtttgggaggtgaaagggtaggatgcccttgccttacaaatagctaaagctcttaagggtagggttgtgcgttttatttctgctatagtcttgtattcatccacacttccactttaatatagcctgaactctcttattatacaccgtaatttttatcacatctttctattatacagtgttttctaagagataaaagtatggtttccactgtttttttctttagcaattgctggagtattatgcttcaaattataggcactctagattgacaattgttcatatatttttgtgccaagtagtcttttatcagttacttacatttagcagaattagaaggtctcatttttctattgctgagtgtctatattcatcttagtcgtagcatattttcttagttatagatattcaatttagattaaaggcttagatgttgtattatcattaataaagagaaatagttggtttcaacctaaaatttttacctcttcaaaataaaagatattcaaggtaatatatgctcatgtgatcagattttttagtattttctaaagatttaaatataagaattctgtataattcagatttttaataaataatattaaagtgcagatggaaagttatgcttttgtgtatttatttatgtttactttcctaatcagctgcatataaaggaagaaatttcagtctatgaagtgtatattctaaagagctatcaaaaatgcccatggatgccagggagaatgtagccttttacatcctgagcttgactggcagacagtagagtggttaagaacatggattctggagtcagtcaccctgggtttgaatctcagctccactacctattagcaggtgactttgaagaagacttttaacttctctatgccaccaattcctcatctataaagagaatataataactatacctatctcataaagtgattgtgaggagtaagaatttatgcataaacagtgcttggcacagaatgaatactatactaatgctaattgttattattcactaatattctcatattgaatatattcatcagagatgaggaacagcaaagtctgcctgccttttaggaagttgtgaaggttgaaattgatatataacttggaatagtgaagttgcaagtcactgggagtcagagttatctaaagaaagggatttagaaggaatcatactcacaaacaaattctagctgaggaccttttagagtggaggaaagaggtgaggtataaaaaatttctcttacattgtctaattttagaaaattgacctgcagaagcagactgaggctaattacagaattcagccatccttcataaaagaccacaaaaatcagcagaatgtcatttcttactcagtatttcttgctttattagaaatcacattcacacacacacacacacacacacacacaaacacacacacatgtacacagagatgacatccagtaatgaggttttaacaattttgaagtcattaaggtacagtgaggagatagacagattgtcatcaaacttcgcttttctgggagaacaagtgataatgacagcatctttaaaggcaagaaaaaaatgcaaacagcttgctctccccctgagctctgatgctgtggtaataacaagctcatgcctttgtatcttttcaaatgtagtcggaaatataatggaatggaaaacatgttttcctgaagttaagggaaaaaaactacaagtcaaaggagatattaaaatgccgagtttaaggaacgaaaacatggttcttatagcacttgatagcaatttttaaataatacttcaaaaaaaaaaagccctgcataggggacaattctcagcagtctccttttttgatatttgacaaattatcaaattatttttcttctcctactcttgtgtttctttaatagagtcatcaatgttgtattctccttgatattttttggcaagtgtataataaaaaaattttaatgatataataatttaaaagagaaagtaagaactgatgatctggatagaattagtttgatataaatatagagaaaattcgagctcagaaatatgagtgatatttactaataaagataggtaaataactcttaaagaacttttaaaatttgagtagtaagagaagcaattccaatccccatatttaaacttctcttttagaaggcgattccaaaaaatctctaaattagctaaccattctcaacctctgcctgcttaaaggaaaaaaaagaaaaaatcagaaaccacttgagccaattaatacatatactagggagaaaaagagacattaaaaactaccttccttcttgtaggaatggctgaatagagtcaaaaaccgatgaacatttacaaatgaggagaattaatatattttttgcttctcctaggagctcaaagtgcattcatagttatgatttttttatcttcatcttgggcccataaacgagatgaaatatattgtcaggagcgcaagaccagcctggccaacatggcaaaacttcctctctactaaaaaattatacaaaaattagctgggcgtggtggcacaggcttgtaatcccagatacttgggaggttttgagatgtgggagaatcagttgagccctggaggtggaggttgcggtgagcagagatcgtgccactgcattccagcctgggcgacagagccagactccaacaaagaaagagagagagagagagagagagagagagagagagaggaaggcaggaaggagggagggagggagggagggagggaaggaaggaaggaaggaaggaaggaaggaaggaaggaaggaaggaaggaaggaaggaaggaagtcctcctgtcactatttaatcatgaaatcctaaagcaaaattatttaaatgagttggttcaagatataagattggaagtaactgaaaataaaaaccagttaatccttgagagcctaatgtcctttaacagatgagtaagtaaataaattgtggcatcctggaagagttttgctataatggcctccaattgattttgacattgagatgatagcaaacatcatacagagacctgagaagtgcaccttactattattgctctttaagcctgccacaccagtgtgaacaagcccagattattctgatgaatgattagatatgtgagaccacaaatatggggtccatttatttgacttcatcacccccacctaacaataagccaagccccagaaaaaaagtgctacccagatgattcacagtcaaccatagactcatgagtgagcccaaccaaattcagcagaagaactgcccagctgaactcaattcaaaatgttgacctaaaacacaatgagcaaaaatgaatggttgttactttaagccactaaattttggtttggtgtgttatgtctcaaaagttagtgataaaattatattcacatactgatagaacgccagttgaaaataaaacaatgaattactgttagatgcagtagcttggattaatctaaaaaatattatattatgctcagtgaaagaagccagacaccaagcaataagattctattgtatgaagttcaagacccagcaaaagtattctatggttatcaaaatcagaacaggtgtggcctggtgggtggtgtaagggttgggagagtggtgaggatgaaaggccaagaaggaactttcgggggtagtagaaatattcttggttactctagagaatgctgatagtccagtagtccagtttaagaattaatatgcaaaaatgaattaagttgtgcaatataggtatttctcagggtgctatatgagcacagagagtgaggaatgcctatctgtgctttttggtgtttagaaaatatttccctgaggagtagccttgaagtagcccatgtttcatgtaggcattcactatatggtgataaatgttgtttgttggacagagaaatgccttattcaaaaacataaagatatcaaacagcatggcatgtatagtagaggaactgccagagatttaatatggaagagtaaaggggagccacaagtgttggggctgaaagcataggcttgagccaatcatgaatgtccttcgacactttgctatcatgtctttaccttgtgagcaaaaagagttatcgtttagattttcaagctcttagaatcatcccatccatctgactctccacctgatatgagacttgccttgctcaccagcagtaaactgaagacaattagtgactcaccaatatatgtctaacataagaagcccacgctggtgtgtagaagcacgtgtaagcaattcagaggagaactataaaatcatgatgagtcggaaccactgaaatggtaattaaatgagtgggaggagcatgtgcattctcctacatgctccaggtttcccacaagtagtattaaactcctctgtgatttgtctggtagctgagccactttgtttcttgatgatttccaagctctgctaattcaaagctcagtattatcatctgtatccagatttccgacttggaaaactaggtgaacttaattttaacttttttttaagtgaatgtgaattcactctgattattagaatcttatgttccctttgcttgagagtattgtcagttttgccttttggataaactaagaagactgtgtgaaaatgagaagcataggatttagggtccataggcatgaatcaagtcctctcattatgtctgaatcttgggagagcactatataacttctctaagcctcagttttttcatttataaataatagatgatgatagaaattatctccttagttttggaaagaatggatagcagaatggctgtaaagatgttaccacatgcccagaatatagtgaacagtaatggcagctattactttaaatagtaatcactggcatttcctttcctacctcccagctgttaccaggatgtgaggggttggttagatgattggttggttttgaggtttaagcactaaaaataaaaaagtaatgcacagaaatacaattgcactttttcctaggttatatattcccaaacggtaataatggtattgctagtaattaatgaaatcccttcagtctgaggtttatgacattctgtttcacccttgcattggctatgagctacgtagaaagaagacaatctaagatttatattgaaaagaaggtaactcagatggaaaggaagaaagggtcagtgaagaacaccaattatagccaagttctgactccaaagttattcagtccaactagattatactgctacacatggatagacttgacgggccttttaagtgacacttcgattcagtattgtgccttttaaaattgctttgggaaaaaactggtcttcaaatttgtgtcttccccaatccacattttattcccctggagggttctttttcttttcctaccttcactcccattcatcttccttgccacatactgcaacaagtactttgcttcagaggcacgctttattggatgccacataaaataccttttcataagcataaagcttattcccacagatgtcatgggaaagggaccaattgctctaaggttcctacttaactgtattttcaaaaccctaataatgcatctgagtttacgataacattttaaagtcactcttctctctagctggtttgtcctgatgtttccgttgagtttaactgtttcttttttagtgcaatgagagtactactgacatcatttttgtataatattaatcaatgcattatttttgatcactggatatgtgctgaagtctcaggtgcattgtatattccacactttccttatcttccaatctagtacctctaaaaagaaggaaatgttaacgtagttttagcccctttctttttccaaatgcacctatttaatgccagttatttttgcaactaaatattttaatacaaataatcttctctcctagtctctacagagaaatctggccttgtgttcccattgtcatcactggggcagcatactccttccagtgaaattcatggatccttctttagccttgtctactaatgttagagaatattcaatatgggcaaatttatttttacaaatgccttaccttttgtatagttaattttgctattggtaccctattatctctgatcaaaaatgatgttacttgtaccatttgctccccaaagagctatgtagtgattttgttcaaaaattctgtagacagtattaattgtgtacattttacagaacatttaaaaattacactttctgcttcaaatgattcattatgaataaatcagagttccttttgcacattacaaacatacaatcttaaacttagctttaccattaaaatagtatggtattattgatagttgctttttacatttcccaattattttcaatgaatagttttggttaaggactcccctatggctcttatctctaaaccggaaggcgatttcatggtagttctattgcactagattggccatttctttgatcatctcccaaccggcacatgtatggaatggttgaactactgctgtcaatacagttttaaaaacgaatctgatatgtaaaccctgagagaggtattaaccataatgacatttgaatgttattagccatctttcgtcctgcctgagtatcttctgctctgcccagtttactaatacaccagactcctctgaactaggataactttttgataagtttggactgaagaaatctaccagtttccagagactatttcataacaggaatgatttggtaaaccagtgttggcatttagttcagtctatttcccaacttaaatagataataccagtttgcatgtatgtctagttttatttaatcttttaaaaagtgtttaatacagtcatgcttgatgatgcagcagaatacctaaaggctggtattaagatatgtttctgatcctctgaaaagcttttctgacccagtaggctgtgaacattcacaatagccctggaggcaatcctccatgtgttattgcaggttgataactgcacctggattactcgtagcagagaaaatttgcagtgtgttccacaatagtccagccagtggattagtatgagataagaatcatctggtaaacaatacagatgatataccagcccacataataaaatacttcatataaagaccttcattaataacactgatataatcacatttgaatcctttgctgaagcaatctcaaattatgtagatggaataagatgaaaaagagcaagtaaaaatcatctgcaacttaaaattatactttgtgtgtgcataatatccttctgttcaaattcctattacaaaaagcatgggcttagagcctatgaattatgaattcagaacaaaattggattatttaatttaaataaaacatacaaccaatgtatttggaatgtgagataattgtgggtaaaaagtagtgttgctactcctcatttctaatcatgttggcataaaggcacaaaattaaaatgtgtctttgtacttaagaaaacaagcatatctacttggtttagatatatttataactcataaattataatatgaaggtttttaaacataaatagaactgtcctaaaatgtagtatttttcaagtaaacttttatggtgagataattatagatcatatgcaattatatgaaataaaatgagagattctgtttacactttacccagtttctccaaatagtattaccttgcaaaaattagtacagcttcacttttcggatctgggtattgatacagtcaagacatagaacagtttcatcaccacaaggatcccgtatattgcctttttacggccacattcacttccttctaacccaccccccttagtccctggaaaccaccaacctgttctcgatttctacagttttattatgtcaagaatgttctacaactaggatcatataacatacaactttttgggttggctttttttcactaacctcaattctatggaaattcatgcaggctgttgcatgtatcagtcatcccttcctttttcttgctgagtaatatttcatggtatgggtataccagtttgtttaactattaacccacagaatgacgctggggttgcgcccactttggggcgttatgaatagtgatgttatacatattagtgtacaggtttttgtgggaacatgtttttatttctctgagataaaattgcactcctgtgtaggagtgcaattgctggatcatatggtagttgcgtgtttagtttgtaaagaaacctccaaactgttttccagaatggctgtccataaatgtttccctgtttctgctttcaagatatctgtttttgggtttcctaagtttgattgtcatgcatcttggcatgaatttctttagatttatactgtttgtggttcactaagcttttggaattagtaagtttgtgtcctttgccaaatttccgaagttttcagtcattatttctttgaagactttttcagtgctgacctacttctccttttccttcaggactccagtgggggaaaaaaaagttaggtcttttgttatttccatgagtctctgaggctctgtgcatgttttccagtttactttgtctctgtttcttagtttaggtaatttctattgttcaatcttcaagttcactgattctttcctctgtcacctccacatttttcagttctaagttttcagtttggttcttccttatatattctgtttctttgctgagaccttctaatattttaatttatttcaggcatgtttgtaattgcttattggagcatttttgcgatgtctactctaaaatatgtgtcagaaaatcttaacatctctatcacctctgtggttaggttacattggctgtcttttcattcagtttgaggccatcctcactgttggtatgattagtaatttttaattgaaacatggacatttggggtattatgctatgagaccctagatcttaattaaacctttcattttagttgattcctctgatgctgttttgatgggagaaggagggatgctgacttatttctgccaattggggatagaagtccagggttcccacttagcctccattgagacttaaggtgggaagggcttttcattaagtttgggaggctgtggaaggtcctgccccccactagcctctgactgatagctccatatctggcaagagccttattactgctccaaggtggctttcactgatgccatgggggtggcggactggcctcagtactgctgggcattggtaaaagtcctgatcttctactaagcttccactgacatcaccccagtggggagaagagagtgtctgccttgttactggagagtgaggctaaaagtctggattacttactcatgaggcagtggggaagtcttggctccctactctttgttgctgtggttggggagtggggctacaatttttgtgtttttgttttgttttgttctgttttctatggtgttggctaaaacaaagaggtactatcactgtaaaattttctgtcttgctaggctgccttttcccttttctctggtcttttggctagagacagcaagggtttactggggcttttaaaaaatctgtacctgttggcatttcagagttataggcttcttcagctccaagtaagtctggtgtatatgaaataataataataatggaattcaccctcatgtacttttttgagtaccaaaggccatagctggtctgcctcaaagtcttcttgtaattgttatatatataatgttcagagtttttagttatacttaataggaaagatagggaaaggtatccttcccattgctccaacttcccagaaaccgaaatccagaatgtaatagattaaacgctaaggttgctatattttcaattattacaattaaatcttttaaaatacttaccaaaaggctttggtttcattttttctattagcttctaagtgaatttctgggacatacaatcataatttggtctgtggatacaaaaaagaattttaatctgatttagttatacagagaaaatatcatttccttccagtcagtgataatatcaagatgacatgtaattccttaccaggtgaattagaagtgaacaaatcacattagatacatgaaggtgaaaagataaataaaaaaaaaattatacttagctctgctttgaatgacaaagactaaaacaactagaatattttatttctttcactagtggataattgtgtgtttgcctaggataatgccacaggtcccttccattattattctaagcatctttaaatcaggaacaaaataaaattattttctttcaattgaagatactcatatctactctaacaacatgagcctctattatctgctttgtgccgtgttacttccctttatacagcccaagcttctctgaactgggccacttcctcctccctatttcttcccagctctagtctaaactccacttggaagatgtactctccatctctccgtacccctctttattccatttcaagccctcccacctctcaaggtctatctcaaaagtgccaagcaccaacctactccgagaatggattaccagttcttggaggaagcagcacctttattcagccttaaagaatgaattagtgtccattagttgtttttcctgatggatattaactcattctttaaggtcagcttaataccgggagatgaaataatctgtacaacaaacccccatgacacaagtttacctgtataacaaacctacatatgaaccctagaacttaaaataacagtgaattaaaaaattaaaaagaagacccgggaagtaagcaggcagtactgccatgtaaagctttatatccagcttagcaactcaggactctgttttcaaaaacaaatgcaaaaaaagaatgagttagaattactcattactggaggtgcaaggctgactagggaggggaaggaagaggtacagggcattagcattctttgttggcagactgggaaaatgagttaaggaacagagaaggaaagctacctgatagatgtcagcaagctaccaacagctttctactgacatcaattctgacaaggattggtgagagatgaggctagaaaggaagacaagtatcacatcaggaaggatttggacccatgaaaaatgttatacttttgtagggggtgctccttcagctcattgtgtagaaaaatggcatagttccattggcaatttgacacactggaggcccactgattatggccctaatctggtcttcacagctttgcttccattattctagtatgaagtccccaaactcttatcagatgtgactactggctcttacctaaacacaacccctatctttcctgcttgataatctcactctggaaaagcaaattccattttgcctgtcatcagcaaaaatacatataatgctcttccaagggtgtttgagaggattaatgggctaacacatgaaagtgtccaatctactgtttgttgtcacttattaggagtacagttttcttccttctttctgaagatttacctaaatcgacttcaaattacagttatatgtatacctgctacaaaattgcaaactccttaaagctaggactatatttcaaacaatggctctaaccaggggaaattttgccttttagagggcatgtgacaatgtctagagatatttttattgcctcaattgttgacagtcttgattgtaggatgttattgtttaaacattgacaacacataacagcctcaataaaaaagtgcttcccaacccaaaatgtcagtggtgactagaaatctgctttagttcatcattgtagcccaggtagcaattagaagagttgcatgttataggagattggattcgtctcttctcacactgctaataaagacatacccgagactgggtaatttaaaaaggaaagaagttaaattgactcacacttcagcatggctggggaggcctcaggaaatttacaatcaagacagaaggggaagcaaagaccttcttcagatggtggcagcaaggagaagaatgagaacaaaggaggagaaaagtccagtataaaaccatcagatcttttgagaactcacacactatcatgagaacagcatgaaggtaactgctcccatgattcgattacctcccaccgggtccctcccacaacacatgggggttatgggaactacagttcaagatgagatttgagtgaggacacagccaaaccatatcagagacattcagaattgtgggaaataatctgaaacccctttctataggtaaattttataaattgccactggggaggtaaaattaaattagaaatttatattgtgtaggataattggaagatagcagagtttatgaatcttggttaatttgggggacacaaatttccatttgtagttagaagtgaccaatttaaaagctaaagttctcttaatcagcaagcttttgtaacaaaatgcagcaggatttacttttatatcaaaggagctccccagatagttaaagaatgaaaatgaatataattaaaagataactggtaagcagaatgcagtgcagtgcattgccttagctgcattctgggagagtacacttaataatcaagactctagtgacactttaatgagaagtttaaacttattggccatgaatctcagaatgtatcgatgcttgttacctagattttcatttcaaagaaatgaattgatgagtaagaatttttttaaaacagtttgtaattaggacaaattgctttacaaataatttaataagcatttaacactgaaaagaagaggaaaactattgataaacctgtaacatttagccacatatagtaagaactcaatgtggaggaagaggtgaagctataagcaataccaaggggatttaaccaaacccataggccgtttacctagacacagccagatccaagtaccaatgacaagcacccatggcactggctcactccataaaaagagcattttcatgggtcctggtggataaaagatcatgatgtgttagtataatctctatttttccagtacccatgaaaatgctcaaatcactatgtgatttgagtttggacaaatcaaaatctttgctaaagccaaacaggaaaataggagacattggtttttaattagtactcggaactctaaaaataagtcccaaaaaaacaaagaccttgatgactctattatataaagaagtggttcttactatcactatcttattgccaatagttacatataattcagagagaaacatgctgatttgatgagttttctaaaatattttttaaaaagaaaactcattcttctgatatagcatcagtggtatttatttttgactctctaagatgtgtactggtacagatactacagttgggggtagagagggcagggggtacgccttccctctcctccaggatctaaaaacaaaagcgtttgaagactgtgttgcgtaagtcttcttccttcaactctgcctccccagtgtgggcactgctgcttcctgtattgtccaggaatgaccactgttttatcctatgccagttctttttggaagatagctagaatctgccagaacgtgctttctctctcaaatccaaattagggacttaaaagtttcttttcaccagaggccactttgtctcctaacagttctgtgctcattaaatacctattagtgtaccctttgacttaaaatgttccactcacatcctccagaagatcactatctgtcatctaatgaaaaacaacttcattaggcttgtcgtggcggttcctttttttcccgtgcttttgcttcctgattgaagactgcagcttttcctaatgttttcttccccacactgaatattattgtgtggggtcggtcctcagccagatcaatgcctgtctgaaatgtcattgtgaataatcttcatcactattttgaggacatacctttaaggattcctccaaactagatcaatttgcaaaaaaagaaaacaaatagttttccattatccagatattatatttgtttcttttgactagcgctcataagttgactaagtaaatattgtactaataggaaggaatacaaaaacacccaatctgagaaaatagagagatcaagtgactttgctgtgctcctttacaagcacacagacctttttgtagtgtttcagaaaagacgatgcgacgtgtgtaatgccatattcaatgcattttgatgatactccctacttataggtgtccatctcgtcacttctctgtaacatattgtcttaattatactcagtatgccctggctcctgttacagatctgcattttccttacaaagaacccatgcaacaaaccacagaatcaccttaatgtcttccctcaaagcgtttttctgacggtctgtgggtgtccaagttttagaatcgtaggctctgagctaatgaaaagtaaactagaagttgatgggcacaaatgcaaatgttaatccactagtgaatggttataagtctttttctgtattgaaaataatttgttttagattgcctggcaattatcaaatcttacacataaatgcaggtcagagaaaaacagagtaatatatgtatttacaacacagatgagcatcatttgaatgaggaatccacactgaagtcaaggtccagtccgatgagccatgttggttggagccctaagtctggttgtaaactgcctgactttgaaaagccactctccagtgaggtctggtgttggtgcctttttctgatgtctaaagcatctctgttttgtttcagctggcaggtttcatctacgcctgttatgttgtgaaatgtataactgaagaagaggacagctgtaagtattaaagctctattctgtttctttcaagttcaaagcatctcctttactgcctcctacttagccttcctattcctcagacaagatcctacaacacagcattagaatggaaaataagccttttgtgcccatcagactaaagtgtttctcataacagtatccagcaaactgaagaatggagaagcacccattttgaaaacataacttctttcttttcattgaaaaccttttaaaaatcatttcctcttataaacaattctagtagggaacagagatgggagattggagatggaaatgattttaaaatgtggctaacttgaccattctcttttttatgatccctttattaggtattgataactaaccagttttacccaagactacaaatccccaaaatcaacaatttgtaatagttgctaagattcttataaaaactgacttcagattaattcagagaatttgtctttgggaaatcaaatgtccatctgtcctttttgttcctactatttgacacaaatggctagaactctaactatgtcaaagtctcaacattgagacatattgcttgatccagagtttagatcacagtaccctcttacaatcctcccagtggctctgttgttctctgctctccgaaacatggagggtagaaggtttcattccatccctgcccctaaggatctaaaacaggagaactggggaaagtacttctattctctgagggtactatcatgaataattgcctatatagttacatttactctgaggaaaaatcagaattgggaatcatctttcttggtttcaaaaaatatttataatgttgggtttttgaaacagtaaggaaagaggaaggtgagaatatggtgatttgagggaaacatccaaagataaatatctgtttcttcttccctttccaattatactggaaaggaagaggcaatatcaagtgattaatgtagaagaggcacttttcaatcgtactcatacatgatctaaaatcagaagtatacagtatataatttatttcatatataaaaggaaataatggtcctttcactaaataagcatttgtaaaatattcctcagtatttcaagtgctgtgtcagcctttggagattttaggatgagtcatacataatattttacctgtaggaacttgccaactaggaggttaaaacaaacatatgagcaaataagtatgaaactgtgtagtgcacgctgtgggtaaagagaagaaagagatcaggagaaggtttatagagaacagttttgagcttgatctagaaagatgaatagatctttattgtgtagctgatatggaagtgaggggtggtcccaggcaaaaggtgaaaaagcatatcacggccagattaatgtgactgaatttgtttcctgtgctacaggtagacagctggagaaaattggaaaaacaagtatgggtgagatagtagaaaaatgggtatgaagattaaggagtttgggctttatataataaaatcacagatgaaagagcaggtagcttataaaaagagattaacataatcaaaaatgtactttagaaaaaatacattagcatcattataaagaagagactcaagagggggaaagattagggaaaagagaactagttaagacaccatgaaagtgagacatgagataatgtgaatctggacaaggatcagtattggagatagagaggatagatgtgccatgagacatgccgaaatgacatgattagtgggcaatggtgggtactgtgataagggaaaaagaggagactgttagattactgggtatctgatgcaagtgaatgggtagatggaattgccacttgcgaagaaaaatgggaataagatcactagttcagtttgcacaggttgagtttgaggtacctagcgcctatacaagagaagacatccagtaagcacttgtcttatacagaaaagatttattcaaagattaggaaaggcaaaatatatacggattttaaaatgtgtggaccaaacaaactatgtaagttcattgagatattaccattcagtgtctgtgtgccaaatccctgatgaaggggaagtccccagttgattttcatatggaagttgggctttctctgggctatgttgtttgatttcatttcacaatgataccagtgcatttttatcttcagacaatacttactgacataccatgtctcctacatgcataatcagtattttagcagaatagcacctctcaaaggaaatctcagaaatgctagttccacaagacatactgctcaaaaaaaaaaaaaaaaagattccaaagccaagtaagtttgacactgaaaatttagaatgcacatttatatattaacatttctgagagtactgccagaaaaaagtatgtccttttttttgttttctaacccacagttttgttttaatcacattaccttgaggccagatacagatcaaagagaaaaaccagaaagagttctaaggcttgattatatccacagttccccggggagaataccacatgccccacatgggaaggagtggggtcagccatgaggcagagagagagtggaacctttagttcaaatcctacaagaagaaatggatgaggcagggtaggaaggcttattaggataggttagctatgttgcaaagttgcgccccatgaaattcatgttcactgtgactattaatgcataggtttagagctatctaaaatctccacatgctttttggggatgagccagggcttacttggaaacagctagtggtcattttgtagatgttaaagcatcaatttatagaaattaaaagtatggttaatgcaagtctcccaaaatatttgaacacaagactcctgttttccatcaacccctgcccctctccgacctggacacctccagaaaaaagcacttgatattctggagaattcttctaagggaattctgccctaaatcaagttttggccaaagcaatgtaaattcaaggcgattcaaagtcaccaatatctgttgaaagatcaagttatctctcaatcatctaataagcctttttcccctgaaagactccaaaaaataacatatatgtttttatgtgtatcttgaccacacaccacatctgcctttattaatccaaaacacaagcagacttctcaaagacacgttttatcatgttagtcttattgctcagtgcgcaaaatatgaacccttctaaatttttatacacaagtagactgacgcttgcctcagatgttcatgggactagtaaacaggtgggaggagatgttcatttgggctcgctgtctgtccagttgtctttggtgactttcagttaggttcatttacttgtagtcattcacacctagacagttatgagtatcttttggttacaatgctttgggttgatattctctgtatgtaatcactttcctgatgtttatcctcagacgatgcctggacatatgacttccgatccatagagtaaaaaaggtttgacatttctgtatcattttggtaattatattacaaaaaattatcctgatccttaaaaagttgggtgaaaggttaaaataaaaccactctcaagcaaaccctgaaacatgggagggatttaatgtacatgtaaacactgagagggtctctatgtgcctatttttgcccactgtggatttgcaataatgcatcattatttgcagtgaaacatagtggcaggagtaggtgctagctacctgcttgccaaattggttaagtttccattactaagagccttatgaggaacagcggacagttttggctctgtagcttgtgcttagaatggctgtggagataagggcccaatgatggcaactggacaaaatgttctttaagtcaacatgaagctgatcagttatgtgctcagttctgatacctcagcttcacagcaacaggtgtatccaggaaacttcagaggaaagaggcagaaacctccaggaagcaatggagagggtttgagctcaatgagcaaagactcaagcctagacccaatgaaataccaataaatcatcattgaaacagagagttaggctcatgaacatcaaatgcctgagaacttttttcccttatgtatccttttaagcagtatctcattactcttctagggcccagtttgattgatatttatagagatactgttttagttcctttggggtactatagcaacatattataagtaaggtggcttataaatgacagaaatttatttctcacagttttgggggctggaaagtccatcaaggtaccggcagatatggcttctagtgagggctggtttccttgctcataggtgataccttcttgctgtagcctcacatgtggaaaagaggcaaggcagccttccggggcctcttttagaaggtcactaatcccatttctgagggctccactgtcatgacataaccacctcctacaggccctacctccttacaccattacattggtgattatgtttcaaaatatgaattggggagggacactaacatttacatcatagcagacactatattgcaagggtttctgtttttttccattgaaaaaaatctggaccttgaagtttacatctctgaccctttagttatctaagccagagccacagtttggcaggccagctggttgtgcagactcacagggtgccactgccatctgctgtacctaccaggggatgacagcaaccctcagagcagagatcccaaattagatgtgacactccttcccccatgaattagttagctagggatgccataaaaacataccacagacatagtggcttaaacaacagaaatttgctctccaaaatctaggtgttagaaacctcaggtttggtttatcctgaggcctctgtctttgccttgtagacggcactttctgttggattagggccctatccttatgaccccatttaaccttcattacctcttcaaagggccaatttccaaatatagtcaggcatattaggagttaggccttcaacatatgaatttgagggggatcacaattcagtccacatccaaatacacacacacgcacacacactccacgtgtgtcctggacacttgaaaatatctgtggggcacagattgaggatagatgcagctcactggcccatcagatgcctgtgggtaagaggcttcagggctgtattgctgccaggccagctccatactcactgccaccaggcaggaattcccgctcaagatctcctgctgtggtgtgatctgcctctagatgagtagcttctcaccaggataaaagctgaggtccctgctctagaggatgtggcttgaccttagaaccctatttgagtgggccaccttaacaacatactttcatatatttgttcatgaaaaggcagtgatacatcttgggagaaaaggctttctccaggaaagcaggcatctcgctgtgctgtctttgtggcagggctctctgctgtctcatctgtcaccagccatgcagagctttccttatggcctcccgtcttctattcccctctacttgttctcttttacactattctgtaaagaaagaaaatgtttggagattcctggtcgggtgtgccttttattataaatgtggctcttctgtctcacttcatcctcggtttttccccactgcagttggatgtccactcacagtgatagaatcaggaactgtcctcagtgctttattagcactgttcgatgtggcaattaaaaggaagccatgcagccacagaaaatattgctaatccatgttagcaaaaaaaaaaaaaaaaaaaaaaatcatcatgacttctcaatttttattacttctcaatttttattatgtattcttgtaaatcactggcttaatagttaaactaaaactaaatgttggtcctctagcaaatgggttcattttactaagtagtcattttctttgctaaaagagattcaatgtatttgcaaatgttgtttaatgatgaaatcatctggagagagacatggaatatcatttaaaaaataatatcctaagggacttattttgaaatcaatgcagaaaaatgaattcaagatgcttaaacttggagttagacacatgcacatttacaccaaccaagcacaaatgcatcaaaacctgtcctgaattcctcaaaatcaactggccttgggataaaagtcacaatcaatttattgaatctttcatttgaaaagaaaaccacaggaaattattcacttctctggggctaataattttctgttatttttgtttgatttttcttctaaagcctgctggcctacacttctgtgtattgaattccattctgtatgtttttatcatttctccagtttgtcaggatcattggatttgaatgcagttctttgagcacaatcgcgtactctcaaccatgggggagggtagacatgggagcagggaaaactatttccccttgaaaaaaatatttgtttcttcctgtctataaaggaatgcagaaagcatagacaatacagataaataaaaaaaggaaaattaaaataaccccataattctgagttctgatactcagttcaaattttggtatattatgtgcctgcctgcctgcctgccttcttaccttccttccttccttccttcctcccctcttcttttcttcctttcttcttatctatctattatctatctatctatctatctatctatctatctatctatctatcatctaactgcattcctcccatctgattgttagggccatatcatacattctgtttggtagtctgagctttctttcacgtttataaatcactcttcaaacataatctaagaggagacaattagaagttcagaaaaggtgccaagttcttgggtgccaggttgacagggagaattgtgagaagaatatgtttattttacttatctggcatcatactgaagcaatcaagtaaaatgtaacataatcttagtatcttactaatttatcttctctttataacatttgtcttatgaatttgatggtgactgactgaaaaaattttgtccatatctgccagtttcccactaaaccaaaacttggtatttattttgttatctctgaacaggatcacaaagcctgaagacccaggctttgcacgccactaatctctcactatgcctacagaatcctagtggggccaaggtgaaaaaggtgtcatctttcacctttccttcccattcccccctctgcccaaagcacagaagttactgcatttatttaatttaatatcgatttgttctgcttatgatttgttttgaactatgagttgtactgggttaaaaatgatggaaacctgcctactgctctatttcagcactttaattttataggcccagaaagattaaatgacttgcccaaagccactagctcattcatgaccttccgacattcaaatacagtacacactgattcactcaggatggaagaatagtaggagacaccatcaagatccacccctgtcttgttccctgctgtatccttagcatctaccaaatccccaacctagaagaggactcaggaagtatttgcaaaataaatgaatgaatcaattggatctccacaaacattccttgacctttatggaaactgccaaggaaatatgacatctcctcagaattcaatgtattcagagtaaatgaataagtaatttgaataaagcacctgtcattttctaaacaagagtaagaaagacatgctgccatgtataaaactaagtgatcaacacctgagacagatgctacatgcgaattttcctcctgtcaatcaaattcaagttcctattagtgaccacagcattctccaacagtgttacatgtaataattttcacataatctccccagattggtgagcaatggtttgtttttcagccttctattaaattgctccctcttgtgatcatctaacagaaaacacataagctatatttttaaatttggatgttcaggtcaaaactgagtctgattcttcaacattcacttcttattttctttcttttctaataatatcgcctccattattctatattgcttttcactcatacacatacacacacacacatactatgttcatcgttaaataaatctgatatttccaagtcaagaatatgaggggaaagaagctgattcattctctctcctctgttaattaagaacaatcagagctttgtttctacaacacaatatagaggtaacactattcagataagcaaaggagggcctttaactggggtgtaacaaaagaggtattttttatgcaaagaatatttctggcagggtaagttgaagttatccagcagatgaagaatactgatgttgttttaatagccttaataagaaagaaaccatgtgacttgaaggaggagaaagtagtgacatttacagaaatgaataaacaaaaaccttgattttgctgactctgcttcttccagtggtgcagacccccacagcctaccagcagtgggtgtcctggactagctacctcaccatctctctctaccttctcatggataatggcatgagaaagaaagcattcaagtagcagaaaagtggggtgatttttgcagcagaatgttgacatacacactcacaaaataaaatcactgggattctttagtcccatctccaaacaacaaatgagagcaagacaaaacgctggcacaggaaaatgaagtctctttaaaagccctccaaatcagagacatgctgagaagatgacattcaaagttagtctcttgacgaatgatgctggccggtgcccacttccttatgcccggttctgctttagttttagaagtggcatctcatagaaacagaaggctgtgttcagaggtctccttcttaacagcaggagggctaagaaacactagatctctaaggatggccaccaggtttgcggaatgaaaacatctgagcaaagcagcctacacctagctactgaaagagagccttggaaataagtgagctggaggcaaaccctcaatcctgtgtgacatttaaatgaggctgctctggcagaagatactcacggaggcctccgctatgactggttggcgttgtgtggcagggagtgaaagagaaacaaacttaaagctcacaggaggtgcggtttgtttaaataatagaaagtaattaggctgaagacaaaaatcagtgatggcattttataattacgattaatttaaagtttaatttcctttggtgctaaaatcttacttaaaacatttatcgggaaaggaaattaggacgttactatcaagaggcacagagtgcttctgggaatccatgcctattatcacttgaaaattaggttagggccaaagtgggaatttcaattcatttttgagtataataaatggtgaccagacctcagagtcagtggggttggcaggggcaggcagtgtaacatttgcatttgcttgtttgtttgtttgtttataggattaattgcaaatgttttcagcaaagagtgtagtttatacattaacaatcctgctacaaaatgaaaattggatatggattgctgcctttgtaactaatgaagctgatgttgaattcccaaatgtggcactgcaaagggaagcacacagtcacacatccatacaccttcaccactgaattaaacggaacaggggacagtatttctgttggctccaaacccgtcaccccgactgtcctatccaaggccccaactttttcatcattctgttttcccattcatgcctcagtttccaattgccattttcagcagctaatctttctggaaactcacttagtaaaatcaatgcataatagtaacaagcagatggaaataactcctttacactaatttttttcattcattatgcctttgtggatttgctcattttaaatattatattgctaacattcatatgtgaactaatcccagaaatatggaattgtgtataatcataaagttatgaacaatattagtggtcacctactgtaatcccccaattttacagttaaggaaagggacactcaaattgacttgctcaaagttaaacaatcatttagaggcagaactgggagcagaacatcgctgtcaagattcgaagtatactttccatgtcacttcactgtgatacctgagagagattcttgtaacaaataattattgagcaactactgggtggtaggctatttattgtcactagggataaagcagggaaccaaacaggtaccatctttgcctttatggcgcctacaatccagtgcacaatttacgagagaaagagaaattacagtaaatcttgatgaaagttcagacaaggaaaggggatggaggtgccatgggaatgattccaagaagaactcatgcagtttagaagagggaaagaaattcttccccgaagacatgatgattcagctgaaacctaagggataaattagaggactatgtagaacttaacaaagacaggcacgccttttttaaaaggtactacttttcggatccatattgaccaaaggtacaccgtaagtcacacaggaatgatcttaagttcttttaatgaactcgatataggaaatctagtttcagctttcccaaataccaataaaaatgttagagtaaccatgggacattctctttcctgaaattgctactgttgttctaagaagatgattaatttaggctcaggagttttgtgattttcatttctggaggctgtaaaatgatacaaagattatgttagcaaagattacaaggtaaagaatatttctctaataggtaattacagcacgcatgttttatttttttatttccctaaatatgcatatgttaatgtacccaaaaccctaattaaaactcctgcatttaaatgggctgttgattctaaatatattctggatgtcagctgagaagacatacccaatcatgtctaacgagctcacctatagcttgtaataactgctccttccaatttcatctgaaagacatgtcatatataattgaaagcaattctaacaggggagaacaaaacaaagactggaaaatctaatccatccaaatggcatggcacaaagtgagcccaggcacatttaagatgaagttggcttagttatttcaccataatcttcattacatgcttctctacatttactgaaagcatcaaaagatatcggattcataattttctgactctagctttacagtttctccaccctgttagttctcatctccctcatcaccactcccttcatctgccaccttcattcccttcatcgtggatcaccttcattatggtggaaagaggcttctctaagatgcccagttctgaaattttctgcctgaccataaacacctatctattctttttccttgttctactgcctccctcttggaaaaagttttcttcacccttatttggaagcttccctccacctgaacctatgtttttctcatgctttgggtcttcctactcattatctatctccagaattagcaaaagcaatggtgttctcattagcattcttgatttccttccttgcttgcacatcacttgtgcttagactttcaacatctgtgcctgacgatgcccagattcaatttctccacttctaatcctgggtggttgctcattgctggagaaagtaactaaacccgacagcaaatgtgtacttgctacactcagctgggtgttgtctcctgctcaaccatgcttcattcttctgcatttgacaaagtggcactctggccagaggacctgttccacacctttccaggatccttaaaccaagtactgatacctgagaaagtcaaatctatcaaatagaaacttgattttccctcaagaacctcgacaaatctctgtacaggcaattattcttttgtcttcttgcaaccctgcccaaatctgagaggaacaggtaagcttctcctctacaaagtaatccatccaccaagctttggcctatcattctgcctgatccaggacactgagctctcactgtcttcattcttgaccattcactggacagttccttttgcccacaaatgtggcaaagcctcatagaccacagacaaggccagccccaaattctttgtgttctttctgataatatacaaggccatttccaaaaggatttgaaatatggaaattcagttctatgtaattttttaaacatttaacttatttttttctacagtatgtcacacaggctgttcctgttgcttgtccaatcacagttaatcaactaagtgggcatctgaaggctctccatagacctccctctggtctcttcagcttccgtggatgtcttctacacttttgtcactctatataaaattttagtaaattctaatacaaagttctctcttttgagccttgtctccatctactctcctagccttggaaatgctaattatctgagtaaagagcctaaatgtgcattttgaagcataattccaatcattccttttgtataaatcctttttgaaaagagaggagatcccaatcctactcatagtgtatttttaatatatatacctctacgtattacacacatatgacacctgattctctcaataacccttcgaagctgaaattgcttgattatcctcactttacagaggaagaaattaaggctcagagcaattgtgacctgattataggtccaatgatggtaagaagtaaaggcacaacctgagcacaggtcttctgactccaaagccccccatcttgatgctaccaaacagattctacaacaatgtatcaagtagtggcattatgatatatcaagtactggcattatattattaaaagactacctgataacaagatccaggtctcagcagaaaaccatcatttgtttcttaaaatctcacctaaggcactgccctcactgagaattagcagatatgaacaagaacaacaatacaaaatagtttatcaagtgaaccttatatttcattttttattaggcctttagaaccaaaagcttaaagtgatttttcagctaacgatatactttatttattatgatactattatagctattgcttttcactttcattgtttagcacgtgtgaatgtgttaccaagcttaaaatattaaagatctgggggaggagccaagatggccgaacaggaacagctccggtctacagctcccagcgtgagcgacgcagaagacaggtgatttctgcatttccatctgaggtaccaggttcatctcactagggagtgccagacagtgggcgcaggtcagtgggtgcagcgcactgtgcgtgagccgaagcagggcgaggcattgcctcactcgggaagcgcaagggatcagggagttccctttcctagtcaaagaaaggggtgacagacggcacctggaaaatcggatcactcccacccgaatactgcacttttttaacgggcttaaaaaatggcgcaccaggagattatatgctgcacctggctccgagggtcctatgcccacggagtctcactgattgctagcacagcagtctgagatcaaactgcaaggcggcagcgaggctgggggaagggcgcccgccattgcccaggcttgcttaggtaaacaaagcagccgggaagctcgaactgggtggagcccaccacagctcaaggaggcctgcctgcctctgtaggctccacctctgggggcagggcacagacaaaaagacagcagtaacctctgcagacttaaatgtccctgtctgacagctttgaagagagcagtggttctcccagcacgcagctggagatctgagaatgggcagaatgcctcctcaagtgggtccctgacccctgacccctgagcagcctaactgggaggcaccccccagtaggggcagactgacatctcacacggccgggtactcctctgagacaaaacttccagaggaacgatcagacagcggcattcgcggttcacaaaaaaccactgttctgcagacaccgctgctgacacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtacataaaaccacaaagatggggaaaaaacagagcagaaaaactggaaactctaaaaagcagagcatctctcctcctccaaaggatcgcagttcctcaccagcaatggaacaaagctggatggagaatgactttgacgagttgagagaagaaggcttcagatgatcaaactacgagctacaggaggaaattcaaaccaaaggcaaagaagttaaaaacattgaaaaaaatttagacgaatgtataactagaataaccaatacagagaagtgcttaaaggagctgatggagctgaaagccaaggcatgagaactacgtgaagaatgcagaagcctcaggagctgatgcaatcaactggaagaaagggtatcagcgatggaagatgaaatgaatgaaatgaagcaagaagggaagtttagagaaaaaagaataaaaagaaacgaacaaagcctccaagaaatatgggactatgtgaaaagactaaatctacgtctgattggtgtacctgaaagtgacggggagaacggaaccaagttggaaaacattctgcaggatattatccaggagaacttctccaatctagcaaggcaggccaacgttcagattcaggaaatacagagaacaccacaaagatactcctcgagaagagcaactccaagacatataattgtcagattcaccaaagttgaaatgaaggaaaaaatgttaagggcagccagagagaaagatcgggttacacacaaagggaagcccatcagactaacagcggatctcttggcagaaactctacaagccagaagagagtgagggccaatattcaacatacttaaagaaaagatttttcaacccagaatttcatatccagccaaactaagcttcataagtgaaggagaaataaaatactttacagacaagcaaatgctgagagattttgtcaccaccaggcctgcctaaaagagctcctgaaggaaacactaaacatggaaaggcacaaccggtaccagccactgcaaaatcatgccaaaatgtaaagaccatcgagactaggaagaaactgcatcaactaacgagcaagataaccagctaacatcataatgacaggttcaaattcacacataacaatattaactttaaatgtaaatggactaaatgctccaattaaaagacacagactggcaaattggataaagagtcaagacccatcagtgtgctgtattcaggaaacccatttcacatgcagagacacacataggctcaaaataaaaggatggaggaagatctaccaagcaaatggaaaacaaaaaaaggcaggggttgcaatcctagtctctgataaaacagactttaagccaacaaagatcaaaagagacaaagaaggccattacataatggtaaggggatcaattcaacaagaagagctaactatcctaaatatatatgcatccaatacaggaggacccagattcataaagcaagtcctgagtgacctacaaagagacttacactcccacacattaataatgggagactttaacaccccactgtcaacattagacagatcaacgagacagaaagtcaacaaggatacccaggaattgaactcagctctgcaccaagtggacctaatagacatctacagaactctccaccccaaatcaacagaatatacatttttttcagcactacaccacacctattccaaaattgaccacatagttggaagtaaagcactcctcagcacatgtaaaagaacagaaattataacaaactatctctcagaccacagtgcaatcaaactagaactcaggattaagaaactcactcaaaactgctcaactacatggaaactgaacaacctgctcctgaatgactactgggtacataacgaaatgaaggcagaaataaagatgttctttgaaaccaacgagaacaaagacacaacatacaagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaataaagaaaaaaagagagaagaatcaaatagacacaataaaaaatgataaaggggatatcaccactgatcccacagaaatacaaactaccgtcagagaatactacaaacacctgtacacaaataaactagaaaatctagaagaaatggatgaattcctcgacacatacactctcccaagactaaaccaggaagaagttgaatctccgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcactttatgaggccagcatcatcctgataccaaagccaggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacgcaaatcaataaatgtaatccagcatataaacagaccaaagacaaaaaccacatgactatcttaatagatgcagaaaaggcctttgacaaaattcaacaacgcttcatgctaaaaactctcaataagttaggtattgatgggacgtatctcaaaataataggagctatctatgacaaacccacagccaatatcatactgaatgggcaaaaactggaagcattccctttgaaaactggcataagacagggatgccctctctcaccactcctattcaacatagtgttggaagttatggccagggcaattagacaggagaaggaaataaagggtattcaataggaaaagaggaagtcaaattgtccctgtttgcagatgatatgattgtatatctagaaaaccccattgtctctgcccaaactctccttaagctgataagcaacttcagcaaagtctcaggatacaaaatcaatgtacaaaatcacaagcattcttatacaccaataacagacaaacagagagccaaatcatgagtgaactcccattcacaattgcttcaaagagaataaaatacctgggaatctaccttacaagggacgtgaaggacctcttcaaggagaactacaacccactgctcaaggaaattaaagaggatacaaacaaatggaagaacattccatgctcatgggtaagaagaatcaatatggtgaaaatggccatactgcccaaggtaatttacagattcaatgccatccccatcaagctaccaatgcctttcttcacagaattggaaaaaaatactttaaagttcacatggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacatatctacaactatccgatctttgacaaacctgagaaaaacaagcaatggggaaaggattccctatttaataaatggtgctgggaaaactggctagccatatgtagaaagctgaaactggatgccttccttacaccttatacaaaaatcaattcaagatggattaaagacttaaacgttggacctaaaaccataaaaaccctagaagaaaacctaggcattaccattcaggacataggcatgggcaaggacttcatgtctaaaacaccaaaagcaatggcaaccaaagccaaaattgacaaatgggatctaatgaaactaaagagcttctgcacagcaaaagaaactaccatcagagtgaacaggcaacccacaaaatgggagaaaattttcacaacctactcatctgacaaagggctaatatccagaatctacaataaactcaaacaaatttacaagaaaaaaacaaacaaccccatcaaaaagtgggcgaaggacatgaacaaacacttctcaaaagaagacatttatacaaccaaaaaacacatgaaaaaatgctcaccatcactggccatcagagaaatgcaaatcaaaaccacaatgagatatcatctcacaccagttagaatggcaatcattaaaaagtcaggaaacaacaggtgcttgagaggatgtggagaaataggaacactttacactgttggtgggactgtaaactagttcaaccattgtggaagtcagtgtggcgattcctcagggatctagaactagaaataccatttgacccagccatcccattactgggtatgtacccaaaggactataaatcatgctgctataaagacacatgcacacatatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcattcgtaggtgggaattgaacaatgagaacacatggacacaggaaggggaacatcacactctgaggactgttgtggggtggggggagcgggaagggatagcattgggagatatacctaatgctagatgacaagttagtgggtgcagcacaccagcatgtcacatgtatacatgtcactaacctgcacattgtgcacgtgtaccctaaaacttaaagtataataataaaaataaacaaataaataaataaaaataaaatattaaagatttgtttctgatacaagtaagaagcaaactgaaaaataaggccctaaaaccctgagaaaacatatttgatgaacaagtttaggaagcgaagcatctgcggtgatttagctaataagtctcatttcattccatgtatgcttcgcctgctcaaagccttctgttgtataacactttagtgacctttcatgcaacaacaggctaaagtacgtcttcctataaaggattgcattttccttatcaggaaaaaaaaaaaaaaaaagctcagagtccctccagggattttagcccagactgaacacctcaagttcacacagtcagcttgaattcctgccaccaactagagcttagtggaagaaaagtgattcttttcaatttggcttatggttgggtatgttttacgttccttttgtattactggagctaagtacccttggaattcatacctatggaaataatggaaagacgctctattttcataggccctgttaatttcctttaatatttagaaaattcattgaaagacatcaaatactttagtgtctttcagtgagttattctaaatattcaggcttagcttcctatgaactgcctgttaaattttcccttcatggttttttacagctctgtctccaaaagggagtatgttgactagtggctttgtcattaataaccaagggacaattttatattacaatacctcattgccaacatgtatttaataaaacagttttaagtttgctgaactcagtgttcatgattaaaaggtttaaataaaagagaggctcacaacaggaaatatattgtcacaaagaatatttattcaaaaacttttttatcttacttggtaatttctaaattccactatcattaatgttactaaatcatagttattaaattgatatggcacttgactaacttaaaataattgcacctacaattattacagtacatccactgaccctacccataggtcaatagatgtaaacatacccacactgcagataagaaaatgaaggcaaaaagaaaatgcacttgcaaagaaaatgatagcattccaagttgtcttttggaggtgatggatatgttattaccttgattgtggtaaaggtttcacaggtatgcacatgtccaaacttatcaaattgcacacattaaatatgtgcagtgttttgcatatcaattatacctcagtatagctcttaaaaaaaaaatcctgagttgtcttcagagaaccaaaggcaaatccctccgacaaggcagagattaagaaagtacaattttttttcaccttctgtccagttgtgtgcctctgtttagggtcctataaactggccagaaggaaaacaaagttattcctacaattatcaagattggtaacactcgatagcattcatcaatgaatgaccgtctcactggagtccttttgatgcaaatgcatgtcctaacctctttctttccactcctcttggccaaaggggatgcagtggtgttttcttcctactggtatccaaaaagtttcttttgtgtatctcacagcacccagacaacaactctgtagattgtctataaaaagtcttctctttattatcattcaaggccttggcagtcagccaaatttcacttggaagttttactagcatcttctgtgctccaatcaattgccttattttcctttacagcctaaagggtctaagagtttatttggtaaatacctattgagtgtcttccgtgagccagacactgttctgggttctgaggctaatgtagtaaacagtagaaaacagtaaatctcatgtagcttgtattatagtagtggaggaaatcaacaaataaacaagcagatttatacatcaggtagaaataggttgcaatgaagcaaaataaagctgagtgaggagaaagaaattcatctctaacatcccagcaagtccccaatttcccttgcactaattagagttacatttcccttttcccaagcgtctcttcacttagatgtactacttataacttaaatactacatttccaaaagaaagccaaacaccaactcccttttgaccttttttttttctttaaaagcagcaatatgcccctggcaaacaaatttctgagaatcaactttgaaccttttcttttcctccctttcccccatgttcaaaaacttgccatgaactatgttttctacctctttgtccattcatctcaaattcattgacatctttccttcctcattctcctaattctaattcaggcttttagtaattcctgtctgtctttcacattttctgttaagcattgaaattacacagacaatatgccaagtcgcatgaaagaaaacatctctcataactttaaaaaaacatcgttgttatcagtcatacaagatggggatgagaatataaataattttcagaagaaaggactgcttaaatacttatttggtgtcctgcataaattatcagacatgaagcacatgaactaaatcttgaaggatgctaccctcttaaagatacattacaaaaaagccccgaaataccacattggcaactatcactggcaaattcagcaaaggtagtttctgataagttattgtttacatccaaatatttctacagtattagatcaaagaagaatctaatactgtagatccttacagtattagatgggaagaacataaagagcaaattttctagaaagaacagagtaaaagatgctggagaacaaataacagaaggaggaatctacaaccaataaggaactcaaagcaagaacttaagacttttgttaaattaataatttagaaagtacataaaaatgtgatttgatgcttttgatcactgttgataacgttccaaaaatgtactagaatggcatcagtcaaatgcagaaatatctttttcaatatacatacaaaggaaatagaatacctggtttctactctcatcctcagatgttgtgtgactcaagataaaactctataaatctgtactgatttgtaaaattaagataattattcctaccaatctcaaagtaattttgtgaagataaatgatatcacttgaaagggcttcaggaactattaagtattttgtaatttggggaatttagtttatttttaaggatataaggagattcttgatagatagaagttactcttttctaaataatgcagagataaactacgacccaaacatctagctgccatcaaaattacctggacaaagatctgtcaaatgttttatgacccttattgctcagagaagttttagaatatgcagtagtctctttagagcctgaataaatgtcattatataaaagaaactgaaaacagaaaaagatggtattatgggtatcttaaaaatgtaagctaaccccagtaattcaatttttgagaaggaaaaaatacctctacctctctatctacatggcaccccaaaaagttccatatgtggttgaagaacccttccataaaaggtgagaagaatcaagtctctctgtgctgacccccataatcttaactgtaatggttggttggatccagttgatgcctattcttctccctgaggtctttaggaagacatccaaacaatttctgagaagaagtgcacatggaaattgactgtacactgtctccttggctgtgaactcaagcatgtaggtaaaataaactacagaaaatatgccctctacttctgatttaaatttgaatgccccctcatgagtgaaatggtaaaaatccagcctggttacattcagagctgcttcttttctcatcttggttctgggtcaccctctgttggaacttcttccatacccaggccatcagcatggtccgaataatcagaatgatcacagtccttccatcagagctttagtgccgtcctccctaatctgagggttgtaagccatctctctctacctacacagcatacagatcatggttaataagagcaagccccaggccactcaagctccattcgcatcacaggctcaggacaccctcatttccctcctggccttttcttgtgtctttggaaggtctacatggcttctgactcaagctttgctgtccatttttggtcctaattctatccattggacttgaagattcatcttgttttcttcacattatcccttggttcacccgaagatctttggttcataattatcatctattttttttctgccatccctcctaaatccctgtaatcaagttaattaaatatttcaaaacaaactcaataataataacaacagcagcagcagcaataaaaatactaataaacctgagtttgacttggatctcaatttcagtggagaccttactgtttttgtctgccctgatcttgatctattgtaacccactctccaccaccatggtagagaccatcctactaagagggaagctcagagcagtgaagctctaactcggtaaatacctcttagaaaactagtccttaatttagtctcattgtcaacaagagcccatccagataaacaggaatttagacactatctgcaaaaaatccccagtcttaaactatatatatacatatatatatatatatgtatatatgtatatatatatgtgtatatatatgtatatatgtatatatttgagacggagtttccctcctgtcacccagctggagtgcaatggcatgatctctgctcattgaaacttctgcctctggtgttcaagcaatactcctgagcctcccgagtagctgggattacagacacgcaccaccatgcccagttaatttttgtatttttagtagagacggggtttcaccatgttggccaggctggtcttcaactgctgaccttaggtgacccatctgcctcagcctcccacagtgctgggattacaggcgtgagccacggcacccagccaataatttttttaagtgcaaactttaaatagagtcactgtgtaattattacacagttcttctggtactgtttatattagctaaggtacaatgtagaagacaaaagaggcaatgtagaagacaaaagaggatcacactcttttgatccatctcctgtaaaatacttgctatagttctatagttgtcccaaattaagaattttctgtcttctctttctgctatgctgcatggcttagaattataaagaaattttgaattttttgaggggctcttaattttcttcttttacaccatatgtctcatccaggactctacactctccttattttatcctcataccaattatatgcgataaatatgataactcctattttaagagatgttaagttgtttatccaaggtcacatagctggcaaagggaaaagcagaattaaaccctggtccttctaatatcagggtctctgtttttgtcattatgccattccactttggaagagaagagacattctgccttggtaaaagggtttcccatgcaaaaaagaaatgcagtatcaagccatgaaaagtcctggtggaatcttacatgcatattactaggtgaaagaagccagccagaaagggctacatgctatatgagtccagtgacatgacattctgtagaaggcaaaattataaagacagtaaaaagatcagtgattgccgggggttgggggaggaaaggatgattaggaggagcacaggggaattttagggcagcgaaactgttacggtactctaatggtagatacatgtcacgcatttatcaaaacccatagaatgtacaacaccaagaataaacattaatgtaaactatggactttggatgatgatgatgtgtcaatgtaggttcactgattgtaataaatgtaccattctagtgtaggctattcatagtggaggatgttgtgtttgtgtgggggcaggaaatatacaggaattatctgtactttctgctccatttttctgtgaacctaaaactgctctaaaaaaataaagtttttttctaagagaaaacaaaggatttccccactacacagacatcacggactttatgttactttgcaccctgctccagtttctatctgtagcaccccaaatattaataagagaataactagaaaaaagtaagccaatagaaggagatgctaggaaagaagtaatgggtgtcctagggcattttgattgtctctatttgactttctttctccttcctcttatcttgttggccttgtgttcttttgtttcttttatccccactctaaaacctctttattcacaaatgaaaaagaaaaaacaaaaactaaactttttcacagtacttttagaattgactgttccagttaccattgctgccaaaacttagtggtataaagcaaccatttattacgctcataggctctgtgggttaataactcagacaggcacagaggggatggcttgtctctgttctctgatgtcagaaacctgagctgaaaagattccaagactgagctgactcaacagtgagggtctagaatcatttaagggacacttgtttgacccacagcccacaggctacatgcagcccaggacagctttgaatacatcctaaaacaaatttgtaaattttcttaaaacattatgagattttttggcatttttttttttggctcaccagctatcgttagtatcagtgtattttatgtgtgacccaagacaattcttcttcttctaatgtggcccagggaagccaaaagactggacaccccgattgaaaggtattttatttcccacacctggatttggatgctggctatcagctgatacattagttatactgttactgaaacacttatccattggtccttcattgatctctccatgcgggctagcttgggcttccttgtggcatcatggctgtgttccaagagagaacatcccaaaagagcaagataaaagtgcatgacacttttatggtctgaccttagaagccccatagtgtcatttatagcatagtcaaagctgccagaaatgtctgcccatgttcaagaggaagagacatactcaaaccattgtatgggaggaaggtcaaagtcacattgtaaaaacatataaaataggagatactcttaccgccattttggaaaatataatctgccacagtaactcttattatatcttattgtatcttacattgctaagtatgtattgaatttgaatatttggttagactgttccacatgtttacctctgattgtttaagatggtaaaccacatttggcagggacagcaatgttgagttaatttacatgacctccaccatagtaccttgcgcttggtaaccataacatgtaatattattactagtgctgcaattgctcatagatacatgcacttgagtggtcattatttatatttatatgctgtaacattttgtagcatgtcacagaaaatctacactaaccaaaaaggcatatagcatctctattgtgtagatgaattctattactccaattaggtcttggttgtttgaaaatagtacatcattttttctaccaagtgaataaattcttgtaaggcaataattgaatcttacaatgagcagtgggggaggggggcagcggaatcactaccttgaaggaactatcatttcttccatttcttttttcttcacaattagttacttttagaagtttaatagattattactaataaaaggtttattagtaatctgtgtgggtgcttgatcatggatgtatatctcttctgaaaagctaattaatgaattgtcccttttcagttgatttcataggtggctttgactcttatggctatcaagggcctcagaagacatctcatttacaactacagcctatgtacatgtaagtattttacttggaaggtactcttctggggtactaaagataatcaagtaactgtatcacgatacaaaattgatggcatgcagcttttgttcagttatatttttccagtattttttctattaatattgtcttggctgggataattttaataacatttttccatgaatttttcttatttgacttataagaaatgccatttctaaagttatatttagtcttacataagtatcacctacatggctcaaaagcctatgttaattatctaccacttctttgagttgccaaaaagttgtattttttgaaaatgatataatgtaggcagttatatataattatatataaaccatatgttctggtttcagtttacagtggttgtcctggcataattattactctcaaaagagttctcatttagatgataaataataggttcaccctagttatatgtagtgttaagaaaataaaaaactgagtaatacactttctctatcatttttctgatgtaaaagtgaaaatgaactggaacattaacactgaaatttatcgaacccttaactctagcactcaggagagcagacatacaatcagagcctgatttttatatctgtgtttaggcaaattcccttggataacaactgataacaaattctatatatcagcatcaagtgatatgctgaattgcaagcgaagatcaaaatagaaagtaagattccaattcattttaaaatgtgaacttctctttgaagatatgtgtttgttgtcgttgtcctccaccattgaatcattttaccttttaatatctttagtgtgtaggataataaatggagtttgggagtaagtattgctcctccaaagaaattaatctttaaacatcccctttttaagcttctctttaaaaaaagaataatcttgcaccgtgcctgcctttttctttgtgtcacttgtagttctctgaaatcatttgctaatagcacccataaaacagactttagcagttcagaaatcaaccagtatgttgcttcattcaaagcattgcttctgtaaacactgtattacacatttcctcttttacatcctcacaacgactgcactaattcatgcaagtatgacctgttaagtttttcggtctcttccttatttcagaacctccattgtatcctccatatggctgccaaattaatcttcctaaagtactgcgctgatgatttcacttccctacttcaaagctatcaaggagtccctattacctactgttgaaacagtatctcttctcttcaactcttaataatgtttgagtcccaaccatatgcagatgacactggagatattaggaaaatgtagtaatgaataagaactagccctgtcctcctgaagtttataatctattgagagcataaacagtctgatagctccccttagccatttttttcttgccttatccaaatatgatatgtatttttccaattcatgctgttctcttgacaacaaacatcatcttttttccaaattccactctttgaaaccccactatcctttgaattttcttaagatatattcctttatgaaacatttgttaatcttttctcctctaatatttcttttatttctttccccatgtactacagttgtttgctatgcatgccataccttccttccctatccccccagaaagattcttgatagctacaacaacaaaacatgatcaatccttcacactctttaccattcttctcaatattttatgtaacattctataaagtgttctatttaaaaaggcaatcaggactagtggttaagacgacctactgaaggcatactgtctgagattaaattccctccgaccgtgggcatgtaactttgtttgaataactctatttaattttaccaagcctaagtttcctcacctgcaaaatagagatcgcatacagactttatctgattgctctgaaattatatgaaagaatatatataaagcacatgaaacgtaggatatgtcacatagtaagtgcttaataaacataattcattagtggtagaataatgcttgtgttaatcaacatcactcatgaaaaggctgtatcaagtcagaagtaacatacactgcaagtcattcctaaaagatctcctctgtaaatggtatattatatataacagcggtcccctgggccgtgaatagtcctggcccatggtctgttaggagctgagcacagagcaggaggtgagcagcaggtgagggaacattactgcctaagctctgcctcctgtctgataagcagcagtattagattctcatagcagtgtgaaccttattgtgaactgcatgtgtgagggatctaggttttgtgatccttatgagaatctaatgcctgatgatctgaggtggaacagtttcatcctgaaaccattccccccaaccctggtctatgggaaaattgtcttccacaaaaccagtctctggtaccaaaaaggttgaggactgctgacatataacatcagctcaagtaacatgtaatactatatttatgctcaagagtagaatatggctaggcacagtgattcatgcctgtaatcctagcactttgggaggccgagacaggtggatcacctgaggtcaggagttcgagagcagcctggccaacatggcgaaactccatctctactaaaaatacaaaaattagccaggcatggtggtgcacgcctgtaatcccagttactcgggaggctgaggcaggagaatctctggaacctgggaggtggaggttgcagtgagcaaagatcgtgccactgcactccagcctggttaacaaagtgaggctctgtctcaaaaaaaaaaaaaaaggagaataaaatatctacaaggtttgtaattgcttgctactaataatattacataatattttactgtattggccaatatgagtgaccaataaatatgatcaagctgtaataaattagaggtaatctctcatctaaagataaacatgagaatgctaattatatacaatttaatatattaaattcaaatcaagcatttataattctaatgggctttaaagaagagactctacaaagatagatatctttgtccagaattaaattgcataaggacaaaacttatgattttgttaaacagagcactttaaatgccaactaaaagttataaaaaatatattgttttcctctttactgcatgagagtggtaaaattgtatcagagatttcaagtctcactggtcatgaaataagtaaatgtttaatggaattcaaatttaggaagttatgtatacttaaggtacatttaaaaattactagtcaaaatactccaatcattccttccacaaaacatcccataggagacctcggatcctagaacagtaaggttttattttacagacgaggaaactcaacccaataaaaggaaaacaaaagtcacacaacttgttactggtgcagccatgattatcaacgggttttcctgaccccttcagttagtgttctttccaaattcttagacagactgtgagtttgacctggtattacattctgatttttaatttgcttgtttgtattcttaacactaacttagctgccacatttccatacatggctgtgcctctctcccttttctgcattctgtttatttcttttttattttacattacgcactgttaaatgaagggccttttcaacttcatagcccacaagaccaatcatctgagagccactgcttattcaaatctagtgaaaaaccaaaactgacacacctataaacctcatcccctactgagaggcagagaacttagcatctcctatgtctttatcatttagagtgtaccttctgtcaacctgccataaatatgtcttgtaaagtaagagtaatttaacttcaggggccagtccaaacaccctaaaaatattatatagcaaatggaaacacaagctcttccttggaaggaaaacaaatgttgaaaagcaataggcatttttagctgtggggctcccactgttcccagcaaatcttctgtggccaagatcctggacaaagctttgaaaacactgctgtaactgacctacagtcacagctgtgtttcagttcctgcaaacaatgaatagacagtcctcttaagttgggtgactgttcttggtttgtaatttttcagatgatgtataactaacctaaaaaggaaagattttaattatatttttcttaaagtttggtacatgttgttgaaacaaatcaataacaacaaagttgctgcacaaaaaaaatcccatgtctgcgtgctccagccccggcaacagagctagactttgtctaaaaaaaaaaaatcccgtgtctacagcttaagtttttaacaaaatagctgctttgactaccagagacctatgtgactgtcagagcaagtagagatctgattgggcttccagcaatataagaatatcctataatatatcacacaacatttgtaaacattgcattctttttggcagcctaattgtacagaagtacatattcatttcagttgtccctggaaatagattctaaatgaccaaaactggcctctctatccctgcaattgccatgaataaaaagaaaaggaggaaaattatctatttaaaacccaatttgggcttcttttttgtttgtttgtttgtttgctcttgtgcttggaaaggtgagaaaaggtggtgagcagcaggcacctgtcactttcccccttgactaaaaacatcttttctctctctcaggtcaaaataatacagatgacttcagtatgtcagcccatggacctttcaaagaacttttttcgcagtggcctcctgcatttcatgaagagcaagaagcaactgagtttaaatacatacacgtattaacaaaacaaatgcaaagcctctacatacaacactgacacacacacacacacacacgtgagcacgcacacaccaattccacttgacctcctctttctaactgaaacagacaaatatgcaggacacgcccatcttggatttcctgaaagcaggcccctttctcccaggccttcggaaagttcagaaggagatgtgttgatgcccaacggttgccggccattgctaactcctctgcagcccagcgggttggcctctgtgagctgggaagtcatccaaggcacattagtttgagagctctgtcttctgcactccatacatcttgacagcaccacggctacttaggcaatgtaattgcaaaaacaaacgaaacatgccatgatgaccttgtacccgaagtccgaaatggcagattgtttgccctaaaggctgtaccgtacatacttgccttaacccacctacattgtgtgcccaagaatcccagtgcagacagccccaagccacttcctttaggctaacacactgctattaattctaaatgagttcaagcctgtgtgtttcatgtcaaggaacaagactgaatagctcagcagctccagtgtgtctgtataagaaaagtgccagctgtcagcaaagtgctttaccatagagcctccatggtggcccaaaagagacaagtaacaataacaatatctgtcatctttataattctaaaatatggtcttctgatggggttgggggtgggacagagtaaaacattaatctactaaactcactaatctactggaagcagaaagcagaaatggcttaactcgctgattttatttattgcactctaggtgcttttataagtatctacaattgtcttttactaacacagaaacagctgtggatttctatcaacagaggccaactgaatatgtattagctatgtttactcttttatatctaattcaaattgaagactctacgtaggtgaacttttttttctaacttcagtgtacaagattatttttgggtgggtggggggagcaatagttaccttggtgaaatatttgagatctttttgtggtatttgggggatctgttgtgtgttagagtgtatttcaaccctcctgtattattgtggcagaaaaactgtgctgttaacgtagttggcaacaagatgcctttggaaacttaatagtaggtcaatgtgtttatggaatattctgaactcctaggaaattttgttctatattttaaagcattatttggttttcattagtggaaaacataattagctcaggcttatcaggaactcagatgagtcatattttttcttggatacacctgagacattaaactcaattttttaaaactaacacaccattctttagtgcagtgaaattcaaaagttataaattggcatggagcaagttttttctttgatttctatgaagtttcagttattggattaaactactttagaccttagcccattcggatctacatacaccagttccattactgtgtttgcatggatgtctgtaatatacacacacatatacatttgaaaatgatagaggaacaaagagttatcattggaacataaactataaaaaaagattccagcactcatgcttgaatttcctcagtgggttgtatgtttgtccatacatacatgtataaaataaacaattgcaaacatgtcagtgaaacctcatatgacgcttttatagtgacatgcatgtttaatgtatgagaaaaatatttaccaatgtattgtcctttgagtcctaaaatataaatactatacatgccagaaactattctaatgtgacttttaatgtgactattaaaaatgaggtttcactgtacattcatgctgtgatgcgatttcaccttatagtacatgtatatgggtacagaaaataaaccctcatattcctgctttaagttacagccaagttttcaccaaatcacaactatcatcaccaccaaaattttaaaaaacagtagttgactactaaaaagtaatcagtggacaggtcatttatgggatcagtaagcacagtagtgtgattatatctgggaaaacatctacagttgtacagctgtatcctcctcaaaatccggtgaagaatgctatttttctaggctgagcttttgttataaacttaatattcagaaggcaagggttatgatcctgatgtgtcctttttttttgcatttgttaattctgaatgtatttttaacagaatgatttttttgacttactagtgtaatttgcattttaaaaataaatggaaaaatacttaagtttctgagccatccctgaaaacccctgctgcttctcatggtgtatttgcttatgtcattgacagagacaccctattaaatttacatgaaggcaacactgatattttgtgcagtgcagggatgtgtcagcagtgaaaagaaattgccgggtcatggcatcatttctactcagtcataggtaacacgtactttcattatctgctaacactgagggttcttttagaagactgcctgcaatagacttttcatttggggaaccttcctccacccccaccttctatctgggatttagagttagcatcaagctaattaatagttggcagagggttaggtcactacatttaaaaatcttggttaaattataggcagagctttttttttatttttataggccaaattatttaaaataatctaaaatactcatttatttccactttgatgacaggatcttttgttattgttgtttgaatattgatattcacctcaacagatgacagtgttgagataaagcaggcaaataggaaggattagccactggcattagcgattgtacaaacattgtttcaggtgaggttcattgtatatacctaaatgattgagggcagcaggcgcaggctgctccaagcacaggctgtgtcaggttcgggattgtgtcctctctcccactgcacacaaacacacaccagctcccatcagtcaaaatgctggagttgactgaagacatgaaaggcttcgaggccatattttaagaggctgaagatcaacttgtagtccttgacatctcagcggcatggtgaaagccttgtaaatgatcaagccggcttttacttttgtcccctgtgtaaaaagtatactgatgtgttgttcattgaagtcactgtgaataacttcaggatgtttcttcacactgtgatgtgaaatgcacacaacaatgtagttgcataaaaaggacaaaactaatagatcaactatgtgtatatatactgtaaagaaaggattctttcttctggagttctcaattaaataggttgtgagtttggtaaaatcccgtggaaccaggatctgcatctgttaactattaaaaaatacaacttctgatacatttcactctactatacatctgatacatttcactctactataatgagtagaccattttaattcagaaatacaaactcattttaaataggtcacattttagaacaaacttttgagatccaaacctattcataattcaaacccttaaactaaaacctactaaggtggttaaggaactattcaatattaccttgtgtcctgaaaatgcaaataactcgccattgcacagcaaattttaagatgtatactctggtcagaatagaataaaacaaatcccagactctataaactgaccctgagttttaaaaattcaaataaactttgataaggaagaccctaagacagtattaaatcataaaatatttctgaattattgtgtgtcaagttcagtatagtatcaatgttaaatatattttattatatcacagttttttaaaactgataatccaaattaatatgtaaacatgtatatatgatgtgttcttatacattagtaagacacttatgtgttcaatttcagggctatacgtttttctgttattttgtttacagtacacttagaggtaactaatactagagagattaagattacgtaagcagtctcatgttgactattcccaatactcttcaagaaaatatttcttcagatgtttcatctgtctttggtaaaattttagcactcaacacttgtacttaggaagcttttacatgaagatccttacattgtaaaattccagttattctcatcacatgcaaatctttgcttaggatccactgtccaaggctcttttccttttatttatgcctactttccacccactccaagaaaggaaagaacaaagtctgtgattaatatacgatgtccagtttacaatatgcgagcatcttgaaacaattttgatagttatgagagccaaatgtatacaacatacatgtattttatgacttttaattcaacaaaacttgaactagataatacattcgaggatcacatctaccactgaaatctgcaccggtgttaggagacgtgactacccatgacaacaaagacaagctgcgtttcccctaaaaggtataaaggcggatttttataatgaaggtcatttttaaaaaatccttaattattatggagtttagaatcaaaatgcacttaaaattttaaagtaacaaaagttaatttctgtaagacaaattcagagagaaaaaatccttttacaaactacatgttgatgctcttacatgttctaaattgttattaaaattaatgtgagcattttctataatgaaagtaccttaataatgtggcaccttaatagtaaaacaggtatatttttaactgcttattctatgaatttaaactgtacctgcaaaggaataaaacaactcccagaaaacattgcaaatttggtgctgtcaccccaaggttgatggattgattcaattaaacagtaagtcttttctaagagtccttcagggagttatttaccagaggcatatcttgtttattcccttccatgagcctgtcatttttcttcattattcttctggttttacttattatatcatttggggatatgctgatcttcacgtacagaagattttgcacacagctgtccagacatacatctttcagacttcaaactggaggccaccagaacacctgagcctcttgtcactgtttactcaagctgaccaagatactctcaggatgaagtcaaatagctagacttacaaattgtaaatcaatgggaaagtatcaaattgaatgaaagctatgaaaaattattcttaaaggtagtaaccttgtgttccacacgtcatggaactggcttcaccatagacgacctcctaatctccaaaagcaagtaggtaggaggaataatagatggctgagaggccaggacccatgctaataattcatggtaaaacaaaaacatattcagtgattctgttgttttggatactgaaagagaaataaataatcttaaacatgaaacatttctgtttctaatggaccgaatcaccttgtcagtttaagttacaaagagtaaggattccatctcacacctgtagaatggctgttatcaaaaagacgaaatataggtgttggcaaggatgcagaggaaatggaacccttgtgcactgttggtggaaatgtaaattactacactattatgaaaaatgctatagagttcctctgaaaatcaaaaataggactaacgtatgatccagcaatcccattactgagtatatatccagaggaaatgaaatcatcatgtcaaagagatatctacactcccatgctcattgcaacattattcacaatagccaagatacagaatcaaccaaagtatccatcaacggataagtggatcaagaaaatgtggtatgtatgtgtatatatataaaatatatgcctgcaatggaatactattcaagccttacaaaagaaggaaatcctgtcatttgcagcaatgtggatgagcctaaaggacattatgttaaatgaaataaaccagacacaaaaagatatagactgtataatctcacttatatatggaatctaaaagggctgaattcatagaagcagagagtagaatggtggttgccagagtctgagggtggggaggattacagagatactgatcaaaggatacaaaatttcagttagacaggaggaataagttcaagagatccttgtacaacatggtgactgtacttattaataacaatgcattgaatacttaaagattcctaagagaatagattttaagtgttctgaccacaaaaaaagagaaacatgaggtaacagatatgttaattagctagaattagccattcaacaatgtatacttacatcaaaacattatattgtacaccataaatacatactatttttattttttgtctacagaatagtaaggattcaagaagaaattgtctggagaggagcctctttactaaatcttgctgtccagcactagctacgtagtttgctgggcccagtgaacaatgaaaatgggcctctcattcaaagggtaggaaaaaattgctgccaaaggtattaaagtataaaacattttcctttaacaatattttattactgataaagtataatgagggtagtaataatatatgagtaacaatatataattataaaatataaaaaagaatgagtgtcataattgtataatacaataaatatactttattaatgggacatctcaatgattataagatttttctgacacacctttctgcaactttattgattagatcatcaaaatgtaaacttttagccagctcattttcaatcaacacaattgaaaaagatgtcagccattcttggcaaatgcatcgcaatttcttatgttttttaattttaagaagaatctttttgctgacccaactgttgctggagttattatgaatattttacagactgtgaaaatattgggatacatttctgataaattactttgaaaataattaggtaaataattttgaaagataaatttggctgggcactaggtggccagatcacttgaggccaggagtttgagactagcctggccaacatggtgaaaccccgtctctactaaaaatacaaaaattagccaggtgtggtggcacacacctgtagtcccagctacttgggaggctgaggcgggagaatcacttgaacccaggaggcggaggatgcagtgagctgagatagcaccactgcacaccagcctgggcaacagagcaagactctgtctcaaaaataataataagataaattttagtcatctagagctgataattcacaaaacactttttctgaaaagatttaactcttcataaaaattagtttctttagttttatctaaattttaaaactcagatgaaatgtttttaaaaatgtttacctaattttaaatcatttaaatcatttaatttaatttaatcatttaatttaaatgatttaaaattaaaacaaattttgacttaatttttaaataattaattttccttttttaattatctaaatttaattaaaattttaacttgtttggatttgattttaagtaaaaagctgtacagtggcattttagtgttttctctgacatttcttgtaatttgtggaggttgtataagaaactgaaattggcttcatgatttgtatataattcaaacgtgtttatgtattctatcactatatccttcattacaagaaaattaatttttcatattctttattagtaatttgtttatctgaagctttatatgacaatagagttattttctgtctactgcaggtgctacaatatttaagttaattttctttgtaagcctgtggatatatgatttggaatgtttcaacggctttcaaaactgaagaccataaactccttgaatactttctaattaactttcctatatgctttattgcgatgtctatgtgtgtgtatttttaaataatttactgaaaaagtttaccggctgagcaccaagagttactgtcccaatactaaaccagggaatatttgtgcagaagctgcaaagagttgctctcttgggggattaacaggcaatttggtttcccatggttcccaacactgcctgggtcccctgttttcccaatatacaaggtacagataccttgctgctgctgtcactgttctcattgccaatatagttgcaggtcccttatgggacccacactaagcccagtggctccctgggcaccgtcagtcctgtgtgtgcatgccaggtagccaggccaatcactatgcaccctgcatgctgtgccgagggcccagggccagtgccattgggcactgctgctggatcacaaaatttccatggacacaccccaggaaataccctctgctaacaacatgctgaaaaataacaccttaagaatttcatgaagaggacggtagagtgataaaccaaccatcagacccctctgagaatgggaaccatgtgcaacgaactgcacccatcacatgcccattaagccagctgtgcctgctagaggagtcaaaagtaaaaacttctttccacccctgctgccacttcacccttacgtcccatttgttactgaaataaattgaattaagacttattttacttattagtaaaaatagtctcaggatgctttttataagaatgatgaatgattgtgtttccaaagtattacatggataacaaggctggtgagtagttttgaaccatctactacagaattgaattgtctggttacatgataaaaacatgtaatcgagactagcctggctaacatgataaaaacataatatcttcaacacgatagaagtgtaataaaaacatgaagtcatgtttttattgcacttctattaaagagagatgtttcgtttggctaactgaaatccattatagtgcatgggcactaacattcatgattatgattcaactaagggattctgagaatgtaaattcaagaagaaaaattttaaataacagcaagtgctgctttttagctaaaattataaaataggaatggaggttaatgatagtgtaagttcaattatttaatataagatggatttattgttaatatgcatgtagaagctaaaaatatacccaattataatgcatcttgaattgagacattccatgtcaaaagagtaaattgaaatgactatattttatgtaattaaagattgtattttctttatctatattttctatatgggcatatattggaagcactggaatactaaagtttcctttactttttttttctttttttttaacattctgcaatgtaagataatattaagtatacaataagtgacacaatattctacgtggtcacagcacctaagcagtagacccaaatttcaaaccaagttgttctattcataaagcccacaattctaacctctgataaaaaaaaatctccagagagcagtatgcagatgtaagtagctatgttttttctttgatatcagagaaggcttatctctctgattacagtcaatcttattcactcacagaatgaattgttcccaccctattcaaggaacttccttccttcaacccacctcacacactcccactttccacaaatacatttaattcagacatgaaatgggatttcttgacaacaaagcctcattaggaagagagtggatttcaggagaagatgctggaattatccctctcgtggcttatctctggtcctatcatgaccacaggatgttcaccaacatgctttcccagtctgtgcagggagaaataaaagctcagtaaactttgacaaatttggtcaactctcaagggaaacaaggtgtttatgacagattgtgtctataagatcttttctctatgattcccattttggttgtgcttgacatttaaaatgaaaactaacagagcagtgctgagcagaaacagaaaggaacagtgatgggcagtaaaccaggccttgcttagtatttggtgtcagtgccatgcattcttaccagcagcattcagtgtcaccacaaaaagtgacatcttcctgaggaactgtttacattagaagactaaagaaaagctaaaacttccagttctccaacatatgtggcagtgtaatggtattccctcattgtagcctcattaaacaccttttggtaatttctctttcacaaatagtgaatattaaaatgaaaaaccaggcatcagaacaaaaagaaaaaagaaaaaaaagtatttcctaaaacaataattaaagtttcttacatttgatccataaaagtcaacagctttttatgtatattattgattattagtagtgtggtcgcaaattcagtctttctttggttgacaatttctatttgtatttaaagaaagggaaacctacaacagctgatatgacccttaaattgtaattctagattaaaatcactgttagttttctattggtgctatgacaaattatcacaactgagtggtttaaaacaacacaaataaatacaggtgactggcaggcagaataatgacccaaagatgtgtatgtcttaatcctgaaacatacaaatgtgttaccttatatagcaaaagggatttttgtagtcacttttgcagatgtgattaatttaaagattttgaaataggtagattatgctagattagccaatgtaattacaaaggtccttttaagagggaagcagaaggaccagagtcagaaaaggagatgtgacaaaggaagcacaggtcagagtgtcaaaatgacttaaggatgcaatgctgctgggtttgaagagggaggaaagggccacgagataaggaatgcagacatcctctaaaagccagaaaaggcaaagaaaaggaaggaagatgtcaacaggactgtgttccttctggaggacacatgttgacatctgacatcttcattcaagcccagtgaaacccattttggacttttgatctttggaacaataagataaattaatgagaacacatggacacaggaaggggaacatcacactctggggactgttgtggggtagggggaggggggagggatagcattgggagatatacctaatgctaggtgacgagttagtgggtgcagtgcaccagcatggcacatgtatacatatgtaactaacttgcacattgtgcacatgtaccctaaaacttaaagtataataataataaataaaataaaataaaagccttatcttacaaaaaaaacccaaagccttcaattcacctaatatttttcaatagaaaattagataaattatggtatgtaacagaatatattttgcatctattaaaaacaatgaggtaggctgggtgcagtggctcatgcctgtaatcccagcactttgagaggccgaggcaggtggatcacttcagcccaggagttcgagacaagtttggccaacatgatgaaaccctgtctctactaaaactacaaaaattagctgggcgtgatgacatgcgcctgtaatcccagctactcaggcagctgagacacaagaatcacttcaatctgggagacagaggttgcagtgagctgagatcgtgccactgcactccaggctaggcaacagagtgagacccccgtgtcaaaaaataaataaataaaaataaaaataggcctagataaactagcaaatgaacaaaagcaaagtgcaatacgtttagtttcacttctgtatgtttttaagaacacacaaagaactatgtacatacactattctacacatcaatgttcttttctccaaggagaaatgtatggggaggatgacttttatttgccattttataaatttctgtagtatttttaatatgtgcatgtaatatttttatttaatgaacacttaaatgtgaatttatgttgtgcttttttggaaagtgttcaatggcatatcccatattttcctaagcgattgtgaacccaaatgaatgggtaatataatataggaaactccataaaaatgttatgaattgatagatagcagctaattcattctaaagactttcttttcttttttcttttactcacagacactctttagaagtgatgtattagaaatgagctggattttatgaatcattagcaacagtgggatgcagtggaaataatagtggcctgagagtctcatcatgtctcttccacttggataccttcagcctaatactcagcaatctcctgtattaaaaaaaaaaaagcgactagttcatctttaagaatctgtcttttcttagaatttcagaattctaacatattgataggaagcagaggatttgatcctaattttagtagtcctgtgaacccttttgagatttttaggatcttacatattatatattataattgagaatgctgatcctcagaaaaggcatcttataccaaggtgtgggctagttcctgaga

SEQ ID NO: 367 - DNA, 74430 bp, Homo sapiens
aaggcagaagaatggtgtgaacccgggaggcagagcttgtagtgagccgagatcgagccactgcactccagcctgggcgacagagtgagaatccgtctcaaaaaaaaaaaaaaaaaaagagattttaaaagggtaagatacgctggacgcagtggctcatgcctataatcccaaaactttgggaggccgaggcaggtgggtcgcgtgaggtcaggagtttgagatcagcctggccaacgtggcaaaaacccatctctaatgaaactacaaaaattagccaggcatggtggcatgcacctgtaatcccagttactcaggaggttgaggcagaagaattgcttgaacccaggaagcagaggttacagtgagccgagatcgcaccattgcactccaacctgggcgacacagcaagactccacctcaaaaaaaaaaaaaaaaaaaaaggcaacataaggcagtgataaaatattatagagtactatgcagtaatgaaatcatgatactgggccgggcgcagtggctcacacctgtaatcccagcactttgggaggccgaggtgggtagatctaaggtcagaagtttgagaccagcctggccaacatggtgaaaccccatctctactaaaaatacaaaaaaattagccaggcgtggtggtgggcgtctgtaatcccagctacttgggaggctgaggcaggagaattgcttgaacccaggagatggaggttgcagtgagccgagatcgggccattgcactccagcccgggcaacagagtgagactccatctcaaaaaaaaaaaaaaaaagaaataatgatactgaataatatataagcaaatgagaaaatgcttaaaatagtaaatgaacaaatcagtttacaaaacaatatacacagtatgatcccaattgttaaaaaatatatatacacgtacatcaaagtgttaatagtagatggtgagattataggttttattatcttctttacacttttcagtaagttccaaatttacctaataaatatttattattttcataatcaggagaaaagaagctattctcaatcctcttccatccttttaaaaaccttctcatacattattccctcttttaaaaaccatttggaaacaaaaacagttatatcctacaatctagcaagttctattttgagtttctatcccaaggaaaactctaaatattgaaaatactttgtacaccaagatgttcatcacagcattgtttatgatgacaaacagaagcaaaaaacctaaatatctaagaaaaggtgtatgggtaagcaaacaaaggtaccttcacttgatggaccatcgtacaagcatttaaatgtttacaggccaggcttggtggctcttgcctgtaatcccagcactttgggaggccgaggtgggcagatcacttgaggccaggggttcgagaccagcctggccaacacatggtgaaaccccgtctctactaaaaacacaaaaattagccaggcgtggtggcaggcgcctgtcatcccagctatttgggaggcgaggcaggagaatcgcttgaacccaggaggcagaggttgcagtgagcagagattgtaccactgcattccagcctgggtgacagagtaagactgtctcaaaaacaaaaacaaaccacttacaattactagcctgggaaaactaatgaaataacaaaagcaaaaaacaaacaaaaaaactggataaaaaacatatatactggcagggcatggtggctcatgcctaaaatcccaatactttgggtgactgaggtgggagaatcacttgagcctaggagtttgaaaccaatgtgggcaacaaagcaagaccccatctctacaaaaaatgaaaaaattagccaggcatggtggcgcacgcctgtggtctagctactcaggaggctgaggcaggaggatcactcaagcctgggagttcaaagctgcagtgaggtgcagtgagccatgatcatgtcactgcactccaccatgggtgacagagcgagactctgtcttaaataaataaatcaaatatcaaaacattgtataaaactctatgcagagaaaaaaatataaaggttttaaagcacatcagctgcatttggtaaaggaactaagaaaatatttgcatttggtaaagaaactagagaaaatatggatgtttttctttaacctaaatctttagtcttttcttctttctgaattgtcccatactttctttagagaataagtattactttaagaggaaaacaaaacaaaacaaaacaaaaaaacgctgaatctccctctgggcaatgaaaacattcccaaatgacagagtccactccatcagtcccttccccaccacacacaggcttcccccagactaaggcagggtcatatcagaaggtcaagggaataagactcctctctgtggtctagggtcttctctgtggggtctctgaacaagaagaaggttcctctgaccagctgctgtgaaaggccctttccctgccccctcccaagttctattctagcctgaactaattcaccacaatcctgagggctgggaaaaaaatttccaccatggtgatttggaacctgatatttagtccaagtttttcccagcccatttctgtgtcaaaggaggcccctcaaagcctcttagacaactagcacccaggccagcttagctcccacatcaatgctacacttacagaaaaacccccaagttgtcagtcatcaccagggaaatgtgagaggagaaactgcagcagggatagctcctgtcacacaaccctacccttatgccctgaaagcctcctcctaagggatatacagggctttttctggcatcagaacttttagactccatgtcaagtctgtagtaaatcaacaaagagaaaaatcagagtacaatcacaacaaagacagacagctatcctttcaaagaccttagagccctctgcctcccctctctatggaaagtccagtactggccagaatactagcttctgagcaactgagtttgggtagtaatctagtttggaccaaaacacactgggactgtatcagaccagagattggctctcattctggtattcataaagaggagctccattaattgccccaaccccaaacttctcaatacccaacagaatgggaagtgctactcagatagggggtaaggaaggatgccaagaagcagtgtaacacagcagcttcacaacctttttcccatcgaggcacacctagaaaatattactgtttctacagtacatggggtagaagctgatcccatccagaggggactgactgggaactttagctgcccctaggaataaggggatcagtattccagcacatctgtgatccatctgcagcacactagtagggaagccctgaattaaggcactgggctgggttaggattcttggaatcaatgttctcatcaaatcttctcatagccctcatctcaagctcttcaactttggctgacagatcatgtgtctagaacagaaggctgggagcctgtggtcttgactcagcactgatacaacttccccagcgaggatactcttcagggggttttccacagacacacttggggctaaggaagccctccagcttacagcagcagccatattccgagactggatatacacaacagggtaattggttttatcagatttctaaactttaaaacccctttttcggaacacaagtgatctcagatctgagtcactgctgagaggtacaaacttaaaagctaccatttactaagcatatagtagatgccagactctgctaagtatttgacttccaatttcattaaatccacacaacaacctcatgtggcaaatgctattattatccccatgtataagagaagactgggaatcagattaagtaacttgcttgaggtcaaacactcttctaaccaaagactatggatgaaacagttgaatccactctgacttcaaagtccataagcttaaccaggacaccactatgtcacctcaacaaacctcccaaatagctttttcaaaaaacctaaccaattataatgaagctgacaatctaggaaagaaaaaggtgagaaaggaacagtttatctgactgtttcacaccatcaacaaaaataagctaatctggccaggcacagtggctcatgcctgtaatcccagcactttgggaggccaaggcgggtggatcacctgaggtcaggagttcgagaccagcctggccaacatggcgaaaccccatctctactaaaaacacaaaaattagccaggcttagtggcacgcgcctgtaatcccagctactggggaggctgaagcaggagaactgcttgaacccgggaggctgagtttgcagtgagctgagatcgtgctgccgcactccagcctggatgacagagccaaactccatctcaaaaaaaaaaaaaaaaaaaaaaaaaagaagctaatctataatctatattgagtacttactgggtgccaagcaccttatatacaggggctcacctaattctcacaatctcaccagaacaggattacctccattttacagatgaggaagaagtctaggctcagagaagttaagatacttgctaagccagagtccttgatttttctactacactatgcttctcctgactgttcaggaaatacccctaagcctgtacctgggtcaaacacctgactcagtcagtactgttcccaaagcatggtagaaagggtacctttcagaacagtggacacagggacacttaagagcccccagagaagaactcaaatccccaagaagggatgatttccctgtattggaaaactgaggtgaaatcccgtctcctgagacaactaactagctctggcctgccctgttccaacccttcatcagcagcagctcaggcacacagaaacaagaccaaaacaaaaggcatgaggaaacaaatcaaaattttatacagaaaggaaggcatgcaagtgggtggtccagtcccccatttgacctgggttctcctggtgctctggtgtcctggttaactaggacatcacgtgcattttgtgaatattaagccattagtttgctaactaaacgaaatggtcaaccaagggccaatgagaacatgatggattctggttctgagctctcacaaaaaatggcctggcagctcccacctaaggcagcctcccacccaatccacctcaccccatccctttctccccagtttctatagctaacttgtgtcagcttgctggggattttcacacccccaccagagtgcagatcccctcccactcttttccccaacagttgggctcttgttctcaaggccactaagtcccagtctctcctcctcagcctgtgagatggtcacagcacattggtaatcactgactcacccgatcccccgaggaggctgggggaaatgcagagggccacaggatgtatggcccacatccctttggcccttcgcagagctggcgggcagagaggtgccagcgacaccacttccccttggaacactgtggaccctctttgagccagctctggtgccagtgggctgatgtcagattctctaccatcggagaggccaagatctctagacagctccactgttgccaacagatctaatctccttattccaaggcagatgaaatccaataaggctgctaagtccacaacttatccctcctgatgggcagaggcaaaggcagagtcggccataccaacaataacgccagaattattactgcttcttagaaaactctttggggaagtgagaactatttccccaaatttctcaaagattaaccccggtttaccaatgttttcgctctgcaaaacttcattttcagcgcaaacatattttctggctccttcccggtgataccagctcagaacctctcgcttcatagagccactgacatcaatgtccaattcccacaccaaagaagaatcccaaagtcagctctaaaaacccatttatacagaccgtttgaaacccacagaaagactaaaaagcacaggctaaacaacacaaaccagtcactatggcttaacgtgaaaagggggggaggaggcgggatggtttgtgtattgtttcacttggagaaataccccagtgaaatggtttatccacatgttcagcctttcaggcaaatccactctaacttagcaggatgcctgcaggccgttctgaaaataagcagaatggcatactctttattccacccccttcaggagctgccagccgcctccccatccccctctccccccaaacatctggtctgggctgggagtgggacccactccctgggaagcctccatgttcgcaggagaggcggtgtccccactcagggaagcctgctgaggagcgagccggccgcgcttctgaattccccccacccgcgagaggctccgggctgagaatgctagggacggggagcctggcgaagaagcggggaaacgggaaaagggcagcagaagggggaggaagaaggagggagaagcctggttcctaggacggtcccgaactggggacttctcctaagggtccagcggtggaggcgtcggtcccgagatccccgacggggctgtccgggccggccagcggctgctcagaggttcctgggaagacactggaggccgggatccgttcgggaccccgactgaaagggtgggcgggacgggggcccagcacaaagtcccagcccgggcgtcgggacctgaggggcggtacgcgggggaaggggctgggctcagctctcaccagcaccagggcgaacctttcctccagctcacagggctcaggcatcggcatcttgccgggcggcagcaacaacgggacagaggggggctctcccgggaccccctcggcgctctccaggttgcccatcgcggcggggccccctcaggggcctcggccccccacctccacgctccggagctttcggctccgcggctccgaccaggctcctccctcagcgccggctccccgagtcccgactcctcggccccgtcgagggcgccgggggttccctggagtcccgctggcgggggcgcgcggcgagggcggaggcagcgtagcggacagccgcaccgaagcaaggcggacggaggcggccggctcttgctcacacccgccgcctcgccgcgctcggcgcgccgcccgggcgctgcccctccccgccccccgcgctctttcccttcccccgccaacctcgcttcctcccacccacacccggccgagactcgggcttcccccgcgagcgccgactgcagcccgcgcgacgcgcgccccattcatgcaggccccgcctcccgcccagaggcctcacaggcggcccggcccgccccacctgcgcccgattgacggccgcgtctgccaatcacagcgcctcccgcccttgacggcctcgtgccgggcgccgagcgctccctggcggcctcagccggcatcgaatcaccgcggttcccagagggcgtgaggggctggcgtggacacaccgggaatggaccgtaccctttttcaaaaggaactcatgatgtatacaagtaagtaaaatattatacaaggcatggcgtacaaaactaactacaagagaagtagaaacaagcaggatactcagaagagggagagagatagtacctgttaagagtcggggtgagggagatcatagttggaccaggcattgagggatgaggaagcccttacccgacagaggcaggggaaaaaacgtttgggaggagagaagcttaaccatctggctgcgtgtgaaaatggagaggcgggagaagaacgctgttctgggctcagtcggcggctgggtcgttgacatttgcggtggaaatttgttgtctagccgccatcttcttccagtgagagcacccccttttcttttaggaaaccacctctcccctcttctcagtctaaatggagctgaattttatccccagttccaaaggaccgcatgacccaggcccagtcagtcacaacattttcctcctctacccatggacactgttttagggattgtcacttgacccaagcccagacaatatgatatatccaaggctttctctgaaacaatcaggaaagaggcactcactctctctccatttaggctgcaaaattattagaatgtaaacctgcagccgctggtggccgtcttatcatcacctgtaacacatcaagcctgcttgagaatgaagccagcgcagaggagagaaaagctatgagacaggacaaaattctaatgacatgccaagaacctggatctaaccatgcctgaagttatcacctagatttttaattcatttattcaacaaatatttattttagaaagtttattctatgccagatactattctgggcattgaaggtacatctgcgaacaaacaggatatacattgtgtcctcttggaattcacaatctgtgtagaaggaaaggtagacaataaactagacgagtaaaatgtatagatgttagtgatcagtgttaataaaaataaaactgaaaggtgatagagatggaagaggcattaagattttaaatagagttgcttacttgggaggctgaggcaggaggatcaattgaaactaggaggttgaggctgtagtgagccatgttcatggcactccactctagcctgggtgacagggtgaggctctgtctcaataaataaataaacacagctgttgcttgtcacaggcatgatggcttcaaggttaattttcagagctggagcgctagccgcataggcctgagggcttacagtcccaatggggtggttgcagtgtgcttcatggcatctggaggtggcgttcctactgatgacaagcagatgactgggctggagagggagttcatgacagccatgtatgagattggacccatacaatatattacccccaaaggcagcttcaggcaccagggaagaccctaacagctccctccatcaccaagataatagtgagctgcatcggtgaagaggacaacagtgctgtcaactggttctggctgcacaaaggcgagacccagtgatgctctaactatgaacccattacaagctgatgtcccacaagttggcccagtgagccctggcactaattgctcaaaatgtgctgtaaagtatcttctctccaataaagactagtcattgcattggctccttcttcccctccctcataataaatattttaaataggatgatcaaggaaggactcactaataagatagcatttggataaagatctgaaggatgcaaggaaataagctatgtggctatctagggaagaattatccagacaaagggaatggcaagtgcatactatctctgatgtattagaagaacagcaaagatgccagtgtagctggagtgcaatgagcaaggaaaagggtagtgaaagatgaagtcagaaaggtaaccagaagccatatattgtgtaggatattgtaggctattgtgtgaggacttcggttttctctaagtaggataggtagccattggaggattttgagtagaggagtggtatgatctaacatgttttgtaacagggatcactctggctcttgcattgaaaacaaaccaatagaagtatggacagggagactagttagcaggctagtgcaatcatttgggtgagagatggtttgaaccagggtggtaactgtaccggtggaaagaaatggtcagattccttattaaagacttgaaagtaaagctgatggaatttcctgatagtttgaatgtggagggtgaatgaaagataactgcaaagtatttgacttgagcaacaaagatggtggagttttcactaattgaaatgggggaagtgataggaggagtaggtttggtgagggggaactggaaagggaaggtcaggaacaagtttgggccatgttgagtttgatttgccctttggacatccaagtaaagatatccactaagcaattggatataaatgagtttgctcttcagactcatatatgtcttattgcgattgcaccccgctgggactgcaagccctcaaagccttcatggccagcgttccagctgtgcaaagtaaccttgaagccatcatgcctgcgacaagcagcagctctacttattaatttatgcaatttggcaatgtaaatttggaaatcatcgtcatatagatgctattaaagctagtaaattctttttcttttttattttatttttttattttatttatttattttttttgagacgaagtctcactctgtcgcccaggctggagtacagtggtgtgatctcagctcactgcaagctccgcctcccaggttcacgccattctcctgcctcagcttcctgagtagctgggactacaggcgcctgctaccacgcctggctaatttttttgtattttgagtagagatggggtttcactgtgttagccaggatggtctcgatctcctgacctcgtgatctgcccgcctcagcctcccaaagtgctgggattacagtcgtgagccaccgcgcctagccaaaagctagtaaattctttttctaactcactatgcattgggttcctgttgtttacaaccaagaggtagagtccctgtctttccaaaccattgaaaccctttcctgtgaagctcagcctcttctaatcagtgaacaaattaatcagttcacatcttatcccctttcttcatctccacttcttaccctaaatacgtgccttcccaactgctgtggcagactcttctaagcagaggggttataacaagactgtagacttccactagacaaaagttgagaattcaagaagggaaataattcaccatttatcatggatgcacaaggaacatctagcaaaaagaagaaactcgataggacagtgaacagcagtgtattcaccttttgtgtggtttcttagtccctaaccttttaattctgtttttgcttgcctcaagcataaccaccagatttatatactctagggtctttggggatctgctagattacttctttcattgttaactgcctgctcacccacctttaaatgcttactttctgtaggataaaactaaaactccttattctgatattcgagggtctatctctaaacgctaatgtcttctaatcaaatcaaccctttgcttcagctggaaaggtccatctccaaacattagttgctcattcttatgtctggctttgctctttgtggtagacagaataatggctcccaaagtatccatgtcctaatccccagaacccgtgtatatgttatcttacatggcaaaagggactttgcagatgtgattaagttacagatctagagatgagaagactctccaggtgatctcaatgtgatgacaacggtccttataagaggaaaggccaaaatgagggagggagatgtgatgacagaagcaggagtcagggtgaggtggagccatgagccaaggaatgcagtagcttctagaaactgaaaaaagtcaaggaaacagattctcccctcaatcctctataaggaacatggccctgtcaacactttaatttgagctctgttagacctaatttcagacttctgatctctagaactataaaatcataaatctgtgttgttcttagccaccgtttgtgataatttgttagagaaccaacaggaaactaacacattcctgctgcgtccctgatctggatttcttcttccttctactccatctatccaaatcccacccaggcttaatacaatctttaggtttattgggtgcttatgtgcaaaacatctgactagatgccggtagataaagaaagaatgcaagatgaaaaggtgaacaagagacctgctgccaacttcaaaagagctccaagtctggtgcaggagaggcaaggtagagcggaggagtgtggacccagtttgaaggaaccgtgtaagatcattggtattatattggtgggtaccaagtttcatatcccatcctggagttttctcaaattcaaatgatcatgactcttgttttctctacttttcatttggaacttgtagatatgtaactcttggttcctttactgccttgtgctgtttaatttttttttttttttgacagagtctcactctgttgcccaggctggagtacagtggtgcaatcttggctcactgcaacctccacctctgggttcaagtgattctccatcctcagcctcccgagtagctgggattacaggtgtgcaccaccacatccagctaatttttgtatttttagtagagactggatttcaccatgttggccaggctgatctccaactcctgaccttcggtgatccacctgcataggcctcccaaagctgtttaattttttgtctatgtcttgtctggtctgtggagcttatttgtttatttaaaagtatatatatccagtcctcttttatttcaggtactaaggaagatccagatatgaataggtgtctttcttccctgtgctcacaatagggctagtaggaatctaaaagcctctcaaactaatgtttacaaaacagtatggtaagtgttgtcatagagggtcatgccaagtgctattgagagaactggggagtggatgacactggagccagcgcttaagggcgaatagatgtgccaaatggaaaagagagaacagtgtgattagaaggtgatggaaggatgatcaggaaggagaaaaggcattccagaagggggaacaatacaggtgaaaatggattgtttgagcaatagtaagaaattcagtgaggctgaagagtagggtgtatagcaggaagagaggagataaatctagaaagacaggtcaaatcaagttcaaaaagagccttgtgctaagctaagaagtttgtcccttttttttttttttttttttttttgagacagggtcttactctgtcacccaggctggagtgcagtggtgcgatctctgctcactgcaacctcaacctcctagctcaagtgatcctctcatctcagctttcctagtacctgtggctacaggtgtgtgccatcatgcccagctaatttttgtatttttttgtagagatggggttttgccatgttgcccaagctggtctcaagctcctgggctcagatgatcttcctgcctcagcctcccaaagtgttgggattataggcacaagccaccatgcccggttgagtttgtcctttattatgtagatagtagcatgtcctagacaatttttaagtaagctctatggaaaaattcctttaggagcatttgaaaatatagagggtctacagaaacgacatagggaagatagaagcctgaaccaaatcagagcagggggatgaacagaagtaaatttggcgaaggagatatacctgagatacaatcaaccagacttcattgcttattacataataatactgactggtggggctgggtacggtggctcacgcctgtaatcccagcactttgagaggccgaggcaggcagattgcttgaggccaggagttcaagaccagactggccaacatgctgaaactccgtctttactaaaaataaaaaaattagccaggtatggtggcgcacacctgtaatcccagctacttgggaggctgtggcaaaagactcgcttgaacccaagaggggaaggttgcagtgagctgggattgcaccattgcactccagcctgcgcaacaggctgtggcaggagactcgcttgaacccaagaggggaaggttgcagtgagctgcgattgcgccattgcattccagcctgtgcaacagagtgtctactataaagacacatgcacatgtatgtttattgtgtgcacactgatcatttgcaatagcaaagacttggaaccaacccaaatgcccatcaatgataaactgtataaggaaaatgtggcacatatacaccatggaatactatacagccataaaaaagatgagttcatgtcctttgcagggacatggatgaagctggaaaccatcattctcagcaaactagtacaagaacagaaaaccaaacaccacatgttctcactcataagtgggagttgaacaatgagaacacctggacacagggaggggaacatcacacaccggggcctgttggtgggtggggggctaggggagggatagccttaggagaaatacctaatgtagatgacaagttgatggatgcagccaaccaccatggcacgtgcacttgtgtgacaaacctgcacattctgcacacgtaccccagaacttaaagtataattttaaaaaaatagtgactggtattattatagtgttttacaattttcaatattttttcacatccattacctacttagatctttacaacactatacgagggagatattatcattatccttgtcttatagatgagaaggcagattttaaaaagtgaagtcgtatgaacaagaccacctaatgagtaagtggtatccctggctctgaacccaggccttgtttcagaattccatgccatctgattctctaatgagaagtgaggaagtaaagaagactgaagagtttaggccagcttaaggatgccctacctttatcctctagggaagctcttaggtcaactgcttccccctccttactgacagcactttcaaactccagcttccacccctgtcctacccatcgaagaagcttctacattctccctacctcctagtctagcgcctagtctttagaaacacacatctcctcaccccatctctttcctaggaaggtgtgggagaagtgtcaacacagatatttaagagttttacttaataatttgccctggcaaattattacaggcggtggctcacacctgtaatctcagcactttgggaggctgaggaggaaggatgacttgagcataggagtttgagaccaccgtgggcaacatggtgaaatcccgtctctacaaaaaaataacaaaaatgagctgggcgtggtggcatgcgcctgtggtcccagctacttgagaggctgaggtgggaggatcacttgagcctgggaggtctaggctgcagtgagccatgactgcactactgcactccagcgtgggggacagcgtgagatcctgtctcgaaaaatagtaatgaaatagttttccctgttgcagatagaatgctcttccccttctttgctggccaattcctactcatctgttaaaaccaagcttagagattacctctttgatgacatctctaccaagtctgattgagaacatctctgtgagcacatagtattctaacatctctatcatcataccatgaaatcatcaggtaatgtaaactccttcagggaaggtaggtattcctgatgtctagctatagacccactccatgtctgttacatgcttgttgaacaaatgaatgcctttccacagtcccatttttcccacatgatagaagatgttttttgttttgttttgtttttgtttgtttgcttttttgagacagagtcactctgtggtgcaggctgtagtgcagtggcatgatctcggctcactgcaacctccacttccggggttcaagcgattctcatgcctcagcctcctgagtagctggaattacaggcacgcgccaccatgcctggctaatttttgtatttgtttttagtagagatggggtttcgcgatgttggccaggctggtctgaaactcctggcctcaagtgaaccgcccgccttggcctcccaaagtgctgggattataggaatgagctactgtgcccagctgaacatgttggattctttatcattcctcccagatacatcctgactgcctgtatcactcaggatagttggaggggattcggtgcagaaaacagaaacccctgcaactatcttagggatacaaagagttaagtgcttacgaaatccttcagaaagtctagaggaatggccgggtgtggtggctcacgcctgtaatcccagcacttttgggatgccgaagcaagtggatcacgaggtcaagagatggagaccgtcctgaccaacatgatgaaaccctgtctctactaaaaatacaaaaattagctgggtgtggtgatgcacacctgtagtcctagctacttgggaggctgaggcaggagaaccgcttgaagccgagaggcggaggtttcagtgagccgagatcgcgccactgcactccagcctggtgacagagcaagacacagtctcaaaaaaaataaaataaaataaaataaagtctagaggaactagctctgggttgaaactccaagaataaccaccagaacaaggtaagagtgctccaacagggaagctgttacctctaccacagtcagggagggtgaagcacctgaaagtctccactaactgggtttaagagtaagtggctgcagctatgatccagcgagctggcagctgtatcaggacattgccactgctacactctgatgcagccacctctcaatatttgcaaagctagagacctcacagtatcactgctatagaaacatgacacatctctacaaccttgcttggccaggagaaatagtcaaagtagcagggtgattggcctttttctcacttctgcattctactatatatattttttgagacagagtctcactcactctgtcatccaggctggagtgcagtggcacaatcacagcttactacagcttcgaactcctgggctcaagggatcctcccatctcagcctcctaagaagctgggactacagacatgtaccaccactctggctaattaaaaaaaaaaaaaaaaaaggtttgtagatacagggtcccactgtattgctcaggctggtttcaaactcctgggctcaagcaaccatcctgcctcagcctcccaatgtactagaattacaggtatgagcccagcctcacttctgcattcgaaatctcacccaagtacatgtgattggatgtaaggaattctgagacatataatccttagctttttagcctcttcaggaaagtatgctaaaaggagatgaaaatggatgctgaatgctaatcaatcatccatcacattgcttgtctgaaaatccacccaattgtcttatcatccacaactgagtctcttcctttacacctacaccccttgcccagtacctgcccctgtggctggcttagtctctgattcttgcccttagtcagctccttcaggctacgatttgatcttttctgcaacttggtttaggcaaaatgtcttagctatgattccagaagcacaatccataaaagagcaattgatatattatactctatcagaattaaaaattaatgctctttgaaaactactgttaggagaactaaaaacaaatcacaagctaggactgggaggaaatattgcaaatcacctatctgacaaaggatttgtatccagagtatataatgaactctcaacacctggctgggcgcaatggcttacgcctgtaatcccaccactttgggaggctaaggcaggtgaatcacttgaggtcaggagttcgagactagcctggccaacatgatgaaaccccgtctctactaaaaaattcaaaaattagctgggagtggtggtgcgtgcctgtaatcccaactactcaggagactgaggcaggagaatcacttgaacctgggaagtggaggttgcagtgagccgagattgcaccaatgcactccaacctaggtgacagagtgagactccatctcaaaaaaaaaagaaaaagaaaacaaacacccaactcaatagcaacaggtgttaagcagcctctgcaaaaaaaagaaaagaaaaagaaaaggaaaaacaaacagctcaattaaaaataagttaaaaaaaaaaaaaacaacggccaggcatagtggctcatgcctataatcttgacactttgggaggccaaggctggagaattgcttgagttgcttgagttgcttaagtccaggagttgaggaccagcctgggcaacagtgggatcccatctctacaaaaaaattaaaaataaagttagccgggtccatggcacacacctgtagtcccagctacttgggaggctgaagtgggagaatcacttgagaccagaagttcaagactgcagggagccatgattgcaccacttcactctagcctgggcaacaaagtgagacccagtctcaaaaaatgatagcgatttttcaaaaattaagaataaaataaaggccgggtgtggtggctcacgcctgtaatcccagcactttgggagaccgaggtgggcggatcacgaggtcaggagatcgagaccatcctggctaacacggtgaaaccctgtctctaataaaaatacaaaaaattagccaagcgtggtagtgggctcctgtagtcccagctacttgggaggctgaggcaagacaatggtgtgaacctgggaggcggagcttgcagtgagccgagactgagccactgcactccagcctgggcgacagagcgagactctgtctcaaaaaaaaaaaagaagaagaagaagaagaaaataaaataaattttaaaaatatagggccaggcacagtggctcacgtctgtaatcccagcactctgggaggatgggaggctgaggcgggcagattgcttgagcccaagagtttgagaccatcctgggcaacatggcaatacttggtctctacaaaaagtataacaaattaaccagtagaacatatctatagtcccagctacttgggagggtgaggtaggaggatcacttgagcttgggaggtcaagcctgcagtgagctgtcatcacactacggcactctagcctgggcaacagagtgagattctgtctcaaaaaagatgtgcgtgtgtgtgtgtgtgtgtgtgagagagagagatggtttggatttcagtgtgtttcatttctgttagctgctttttctcataaccattggccagaacaagatcagtgcatttgaaatgaaaaggagggatcagaaggagggttataaaagtagacaaggaaaggtgggagatattggcagggggcaatggttcacacatgtaatcccaacactttgcggggccaaggctggaggatcacttgagtccagaagttcaagaacagcctgggcaacatagcaagaccctttctctacaaaagaaattagccaggtacagtggcatgcacctgtagtcccaggtactcaggaggctgacatgggaggatcgcttgagcccaggaggtcaggtctgcagtgagccatgattgtgccactgcactccagcctggtggcagagcgagagagagagagagagagagaaagaagggagggagggaaggaaggagagagaaagagagaaagagaaagaagagagagagaaagaagggagggaaggaaggagtgagaaagagagagagaaagaaagagaaagaaaggagagagagaaagaagggagggaaagaaggagtgagagaaagagagagaaagaaagagaaagaaagaaaaagaaaggggagggagggaaggaaggaaagagagagagagaaagaaaaagaagggaaagaaagaaaggaagaggccaagcacagtgggtcatgcctataatcccagcactttgggaggctgaggtgggcagatcacctgaagtcaggagttcaagagcagcctagccaacatggtgaaaccctgtctctactaaaaaaaaaaaaaaattagccaggcatggtggtgcacgcctgtagtcccagctacttgggaggctgaggcaggagaattgctttaacccgggagacggaggttgctctgagccgagatcatgccactgcactccagcctgggcgacagagcgagactccgtctcaaaaaacaaaaacaaaaaaaaaaaaaatttagacgaggacctcgaggtcattcccaaattgcttccactggttctcctctccatccttgccctgggctgagggatttaatctgctttttatctctcactctgccacaccacctcctaactttgggaaagcagatctgtggctattttcctaccttcctcccctctaccttcttactccccccacagcctttaaagtcaagtccaactgccattttcctttaaaggttttatttatttgttaaaaaccacaaaactttgcaaagttatgcttaccaatacatgccaattgtgccacaagaggcagcatagcataatgattaagagcatgggctccagaacagtcaccagagctcaaattcaagctctgtgaccttggacaaactgaatgagccttttcgtcatctgtaatgtagtcattgttcctacttcccagggtgattgcaaagattaaatgagttaatacatttaaaacatcttgaacaccatctagcatctcataaccagaaaacactgtgaagaaaacccttagaaatagagctgaggaagaccttaaagagagggttctcacgcatgtataactgataacaaaaaagattctacaaaagccacagttttgcacaaaggccaccacaacctttcacaaaaaaaatactgctgcaaagacatctgcccagcaattgcttgtccaacctcagactggtgtcggccttgttattgatctttgtagccaaggataattatttcaaaataattatgtaatcctcattttttcctttgaaaacctttgtcttcctttaccttcctgaatatgcatataggttactatggcacatgtattctcattgcaatgctctattcccaaataaatatcattttcttttgggaagcctctcctgtttgttatttaggttgacatatgcatttaaatgactcctgtgccttttcatggcttgatggctcatttctttatggcactgaatagtatttcattgtctgagtgtaccacaatttatccattcatctactgaaggacatcttggttgcttccaagttttggtaattatgaataaagctcctggaaacatccatgtgcagatgtttatatggacataagttttcaactcctttggataaataccaaggagcatgattgctggattgtacagtaagaggacgtttaattttcttttttacaataattttaacttttattttagattcagagggtacatgtgcaggtttgttacatgagtatattgcatgatgctaaggtttgggttacaattgatcccatcacccaggtagtgagcatagtacctgtattagtctgttttcacactgctgataaagacatatccaagactgggcaattcatgaaagaggtttaatggacttacagttccacgtggctggggaagcctcacaatcatggcggaaggtaaggaggaacaagtcacatcttacatggatggcagcaggcaaagagacagcttgtgcacggaaactcccccttataataccatcagatccaatgatacttattcactatcaggagaacagcacaggaaagacctgcccccatgactcaactacctcccaccaggttccttccacatgggaattgtgggaattacaattcaagatgagatttgggtgggaccatatcagtaccccaatagtttttcaacccttgccccttccctcccaccaaccatatcagtacccaatagttttcaacccttgccccttccctcccaccccctctagtagtccccagtgtctattgttgccatctttatgtccacgagtacccaatatttagttcacacttatgagaatatgcagtatttggttttctgttcctgtgttagttcacttaggataatggcctccacttgcatctatgttgctgcaaaggacatgattttgttcttttttatggctgtggtatacttagttttctaagaaattgcggaactctcttccaaagtatctgtactattttgcattcccaccagcaatggatgagagtttccattgctccacatgtttaccagcatttggtgttgtgaatgttctgaatttgggccattctaagaggtgcacagtagtatttaattgtacttttaattagtatatccctgatgagatataatgtggaataccttttttataaattaatttttttttgagacggagtctcgctgtgtcgccaggctggagtgcagtggtgcattctcggctcactgcaacctccgcctcctgggttcaagcgattctcctgcctcagcctcccaagtagctgggactataggcacccgccaccacgcccagctaattttttgtatttttagtagagacatggtttcaccatgataaagccgggcacggtggctcatgcctgtaatcccagcactttgggaggctgaggtggacggatcacaaggtcaggagtttgagaccagcctggccaacatggtgaaaccccatctctactaaaaatacgaaaaattagctgggcatggtggcgggtgcctgtagtcccagctacttgggaggctgaggcaggagaattgcttgaacctgggaggcggaagttgcagtaagctgagatcgcaccattgcattccagcccgggagacagtacaagacaccgtctcaataaataaataaataaataaataataattattattattattttggcagagacaagagttgcctaggctggcagggcacggtggctcatgcctgtaatcccagcactttgggaggccgaggcgagtggatcacgaggtcaggagatcaagaccatcctggctaacatggtgaaaccccgtctctactaaaaacaaaaaatcagctgggcgttgccatgggcgtggtcgtgggcaaataagtatacgaaaaatgctctagtgctacacagtggctcacatctttaaactcagagctttaggaggcccaggcagggagatcacttgaggccaggagttcaagaccagcctaggcaactctttttttttttttttttgagacggagtctcgctctgtcgcccaggctggagtgcagtggcatgatcttggctcactgcaagctctgcctcccgggttcacgccattcttctgcctcagcctcccgagtagctgagattacaggcacatgccaccccgtctggctaatttttgtatttttagtaaagactggatttcaccatgttggtcaggctggtctcaatctcctgacctcgtgatctgccctcctcgcctcccaaagtgctgggattacagacgtgagccatcgcccttgtccaccatctgtacatcttctttggtaaggtgtctgttaaggtatttggcccattttaaattttttattttattttgtctttttctttcagatcaagtgaacaaaatggcccatttttaaaaaatagggttgtttgttttcgtattgtcgagttttaagagttttttgtttattttggttaatagcccttatgtcttctgcaaatattttctcccagtccgtagctcaatttttcattctcttgacagtgtcttttgcaaagcagaaaatttttgttttaatgaagtcaacctttatcaattatttctttcataggattatacctttggtgttatatctaaaaaggcatgaccaaatccaacgccatctacattttctcctatgttatcttctaggaattttatacttttgagcatttataccctttgcccacttttatgttgttttttttcttgttaatttgtagaaaaaacactgtttcaggctgggcacggtggctcacacctgtaatcccagcactttggaaggctgaggtgggcggatcacttgaggtcaagagttcgagactagcctggccaacatagtgaaaccctgtctctactaaaaatacaaacaaaacaaaacaaaacaaacaaacaaaaaaacaaccagccgggtgcaatagctcacgcctataatcccagcattttgggaggccgaggcgggtggatcacctgaagtcaggagttcaagaccagcctggccaacatggtgaaaccctgtctctactaaaaattaaaaaaaagaaaaatagccaggcgtggtggcaggcgcctgtaatcccagctacttgggaggctgacgcagggagaattacttgaacctgggagaaggaggttgcagtgagcagagattgtgccactgtactccagcctgggcaacagagcaagactccatctcaaaacaaaaataaattagctgggcatggtggcatgtgcctgtaatctcagctactcaggaggctgagggaggagaatcgcttgaaccctataggggaggttgcagtgaagtgagctgagattgcgccactgcactccagcctgggcgacagagtgagactctgtctcaaaaaacaaacaaacaaacaaaaaacactaagaacatgaatagacaattctcaaaagaagatatacagatgaccaaaaaacatacaaaaaatgttcaacatcattaattatcaaggaaatgcaaatcaaaaccactaattatcagggaaatgcaataccaccttactcctgcaagaatggccataatcaaaaaatcaaaaataacggatgctggcatggatgtagtaaaatgggaacacttttatactgttggtcgaatactaccactatggaaaacagtgtggagagtccttaaagcgctaaaagtagatctatcatttgatccagcaaacccactcctaggtgtctacccagacgaagtcattatatgaaaaagatactgacacatacatgtttgtggcagcacaatttgcaattgcaaaaatatggaaccagaccaaatacccatcgatcaacgagtagaaaaagaaaatatggtatatacaccatggaatactactcagccataaaaaggaactaaataattgcatttgcagcaacctggatggaattggagaccattgttctaagtgaagtaactcaggaatggaaaatcaaacatcattatgttctccctcataagtgggagctacgctttgaggatgcaaaggcagaagaatgacacagttggactttgtggactcgggaaagggtgggacaggggtgagagataaaagactatacagtgggtacagtgtacactgctctggtgatgggtgcaccaaaatctcagaaatcaccactaaaaaacttattcatgtaaccaaataccacctattcccccaaaacctattgaaataaaaaataaataaaatttttaaaaaagagggtacactgtttcaatatctatgccaccccaaacttggtggcataaaacaacaacaattttatttggctcatagattctatgcaacaggaatttggactgggcacagcagggtatcagctggaaggactcaaatgaccggaatcatctggagtctccttcattcacatgtgtagcatctgggctaggatgactcaaaagctgggcttagttgggattgttgacccgagcacctaaagatggcctcttcaagtggcttgggctcacaagctggtggctgggttctaacaggaagtatcccaagagcaagcatgttccaagagacttaggcagaaactgaatagcttttcatgacacaaccatagaagtcacacagcatcacttattctgtagtctgttcattgaaacagccacaaattgcccacattcatggggagaggatatggactcaacttcccgatgaaatctgtgtcaaagcattgaagatcatgtttaaaaaaccatctcaaatgtggcttctaattatactgctgagagagtaaccaggactgggaacaattgaggtacagcattttgtatgcatagtcaaaagatgtttattatctataggacattgtttagaaatttgctctactatttaatttgtgataagtgattagtaaacatgtttatcagtgtaaaactcatagaatggcaaaaaaaaactacctcagttttaattttcagaagtatgctttcccccatttgggggaagcattagccttccaagtcttttattttttccatttgaaaaattggtataaaaattgcagttgatggcaactccatccttctaggtgctcaagtagtggctgtaaatatgttcttaaattctttgatatcccaccttcaaaaggtgtagtctaattcccttccctttgaaagtggacaaaactcagtaatggaaacagggccactcttacagtgtgtgggaccccaggcaaatttgcttttaatgagatcccatctatataatgatttgatttaaaatgtattacattcttagatatgacacataaagctcaagcaacacagattttatcaagcaaccaaagaaaatggataaattggatttcttcaatattaaaaatgttctggccgggctcagtggctcatgcctgtaatcccagcactttgggaggccaagatgggcagatcacatggtcaggagtttgagaccagcctggccaatatggtgaaaccccgaatgtattaaaaatacaaaaaaaaaaaaaaaaaaaattagccaggtgtggtggggggtgcctgtagtcccagctacttgggaggctgaggcaggagaatcgcttgaacccaggaggcagaggttgcagtgagccaagattgcgccactgcactccagtctgggtgatagagcgagactccgtctcaaaaaaaaaaaaaaagaaaaaaaaaaggggagggcgcagtggctcacacctgtaatcccagcactttgggaggctgaggtgggcagatcacaaggtcaggagatcaagaccatcctggctaacacggtgaaaccttgcctctactaaaaatgcaaaaaattagccaggcatggtggcatgcatctatagtcccagctactcgggaggctgaggcaggagaatagcttgaacctgggaggtggaggttgcagtgagccaagattgtgccactgcactccagtctggacaatagagagagactccgtctcaaaaaaaaaagttattgcttcaaaaaatcattaagaaggattaaaaaaacagcccatggaatgggagaaaaatatctgcaagctatatatctgataagtatccagaatatataaagagctcttaatatctcaacaataaaagacaacccaagttaaaaaaaaatgggcaaaagtcttgaatagacatttctccaaagaagatatacaatggccaataagatactcaacatgattagtcattagggaaatgcaaagcaaaaacacagtgaaatatcacttcgcatctaataagatagctataaagaaaaccatgggtaataaggaatgttggcaaggatgtagataaattagtgaccacagaaactgctgatgagaacataaaatggtacagccactttggaaaacaggttggcaattcctcaaaaagttaaatctaaagttatcatatggccaggcacggtggctcatacctgtaaccccagcactttgggaggcgaagcgggcagatcacctgagtttgggagtttgagaccagcctggccaacatggcaaaaccccgtctctactacaaaaaattagccaggcctggtggcaggcatctgtaatcctggctacttgggaggctgaggcaggagaattgcttgaacccaagaggcagaggttgcagtgagccgagattgcaccattgcacttcagccttggcaacagtgagactctctcaaaaataaaataaagttaccatatgatccagtaactctactcctaggtatatatccaaaataaatgaaagcatatgtccacacaaaaatttgtacatgaatgctcatagcagcattattcataatagccaaaaagtggaaacaacccaatgtccatcattggacatttaaagtgaatggacaaactaaatgtagtataatcatacaatggaatatgattcagccataaaaaggaatgaagtactgatacatgctacaacatggatgaactttaaaatattatgctaagttaaagaagtgagataccaaaagccacatattgtatgattctatgaaatttccaggataggcaaatctagagacagaaagtaaattagtaattgttgcggttgtggagaaagagagaaggaaattaaccctgctaatgaatggagggatttttttggagggtaataaaaatgttttgagggctgggcatggtggctcatgcctgtaatccgagaattttggggcatcaaggcgagaggattgattgagcccaagagttcaagaccagcctaggcaacatagtgagaccctgtctctacaaaattaaaaaaaattttttttaattagccaggtatggtggtgcacacctgtagtcccagctacttgggaggctgaggtgggaggattgcttgagcccaggatgtcaaggctgcagtaagccattattgtaccactgtactctaacctgggcaacagatcgactccctgtctcaaatattttaatgtaaaactattttttaaatgaaaataaggttctggaattagtggtgattgcacaatcttgggaatattctaaaaatgactaaaatgtacactttaaaagggtgaatttcacattgggaggctgaaacaggaggatcacttgagtccaggagttggagaccagcctggccaacatggcaagatcccgcctctacagaaaaaaaaattgttgtttgtttgtttgtttgttttgtttttgagatggagtctcgctctgtcaccaggctggagtgcagtggcaccatctcgactcattgcaacctccgactccctggttcaagtgattctcctgcctcagcctcccgagtagctgggattacaggcatgctccaccatgcccagctaatttttgtatttttagtagtgatggggttttgccatgttggccaggatggtctagatctcctgacctcatgatccgcccgcctcggcctcccaaagtgctgggattacaagtgtgagccactgtgcctggccaaaaaaaaatgttttaaaatgcaaggcatggttgtacacacctgtggttccagctactcgggaggctgtggcaggaggattgctagagcccaggagttcaaggctgcagtgacccatgtttgcaccactgcactccagcctgggtgacagagcgagaccctttctcaattaaaaaaaaaattggggccgggcgcggtggctcacgcctgtaatcccagcactttgggaggccgaggcgggcggatcacgaggtcaggagatcgagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggctacagagcgagactccgtctcaaaaaaaaaaaaaaaaaaaaaattgggccggtaatttataataattaaaaaataaatggtaattttttttttctgagacagactctcactctgtcacccaggctgggttacagtggcacaatcttggttcattgcaatctccacctactgggttcaagagattcttgtgcctcagccatctgagtaactgtgattacaggtgtgtgccaccacgcccagctaatttttgtatttttagtagaaatggggtttcactacattgcacaggctggtctcaaactgctggcctcaagtgatccactcgccttggcctcccgaagtgctgggattacaggtgtgagccaatacgcctggcctaaaatggtaaattttatgatatgtaaattatgtctcaatttttaaatatatcacaaagtttatgagactgtgtgaagtatgacgacatatagcaaaatgatatatcaatgaagacttagaataatgggtagaaaagagatatcagcttattgtccatatcagagcatgtgatgattcttcacagtgtgcaggtaccaccttttcttgttcaggtccaaaaatcatgttcttcatgttctttattgtcaaatatgccattcctggctaatttcatatctcccaccaagagaaaaaggtagtaactcctgttactataattccacaggtctttgcaacctgtttgtagtgaaacaatgtagatatttttgtttctggagttccttaatactcttggttacaacattactcatgatacattattcatgatgtcgtccatgactctctcaaaaattattactgtattttctttttaaaatttttttattttattttgttttattttattactgtattttcttgattatgatcacaaatgcaagtcttacccagagaatgcccaaaaatgtaaacaataatttgttttatggtcatgttaaattttcactcagaattttatctaataaacatagagcatcacttcttctaaccctatcttcttttgcacactttaaaccataattacgacattcctaggctatcagttctttgaatgatgaccacatgcctatcttttggacaccatcaccaacagggaagatgtgtgaagggcccatgggtgcagcaagaggagtgatcccattcctgcatgcctcatttggcatgacttaagacaaacattgagggagcattgcatcactacatcagtcagaagcaaaaggacatcagttggaaagggccctttggcactgtgtagcaacaatcccaaaatcattggactacccagggaggactgcctgacacctatcatggaatcttctgccggggtggggtaactaccctgggtgcgagtgatggggcagaaaggagatggcatgcagtcatacacagaataaaagatgtctgctaccactctgtagtcttcaggtgctgtggaccaccagcagttccacagtcagaacactgacaaaggaaggccagcacaaggtccccaacacatggctcatgaccaagggttggtagaggactgtcgatagcccagagacctgaactcatcttgtgtttgaccccaaataagcatgtcaacactattctggagacccaatttcacactattttatgaaagaactgtgctagccagcaagagtgactgactgacttacctgcaaggtgctctcaaattcttgttttcttttttgtagagctggcatctcgctttgttacccttacccaggctggtcttgaactcctgactttgaaggatcctcccacctcagcctcccaaagtgctaggattacaggcataagccaccatgcctggcctcaaagataacataataaatgattattgttttaagccactgagttttgtagtgctctgttacaaaacagtagataaataatacatacgactaaaaacctaggtgtcatccttgactcctcattctcttacatcccacatccaatctgccagcaaattatattggttttaccttcaaaatatatccagaatctacttcccaccacctctaccactaccactttggtgtgaaccttctaactgtactgcttttacccttgaatctccacaatttattttcaaacagcagccagtgttactgtaagaaggtaagtcatattatgttagtcctctgctaaaaaccctgcaatggttacctattttcctcggaacaaaaaagccaaagtcccaagtctttcaagcccctacatgatcttcccctgctacactacctctctgactgcatctcctgtacttctgccctaatttataccactgcagtggccttcttactgttcttcacctgtgccaggcatgtttctacttaaggctttagcccttactgttcctctgcctgaaatactctttccttggatcccgtgttgtgcaatccctccctcgtctcctccaagttattgctcaagtctcacttcccaatgaagcctatcacctctgtaatttctacatgtccatctctgaacttcttcttttttttgagacagagtctcactctgtcacccaggctggcgagatctcggctcactgcaacctccgcctcctggaatcaagtgatgcttgtgcctcagcctcgggagtagctgagattacaggtgcatgccaccacacctggctaatttttgtatttttcgtagagacagggtttcactgtgttgcccagggtgggcttgaactcctgacctcaggtgatccacccacctcagcctccatctctctgaacttccgataccaattatcctactctattttacagcacttatactctaacaatactatacaatttacttattatgcttattatttagtttttctcttctagaatttaagctctatgagggcatgatttttgtattttgttcactgatatacccacacatgcctaaagcaggcacgtcgtaggtactcaataaatgaataacctgtgtcactcaaaactgtgcaggcagaactcttagcaagctcttgtcctaggcacataatttaagcctgacaaaaggtcaattgaaccttaagtatgccatgaaaacagagctgcagcacctgaaagggccacactggtacaaaggtaaaaatcttggggacaggcatggtggctcacacctgtaatcccagcactttgggaggccatggcaggtggatcacctgaggtcaggagttcgagactagcctggccaacatggtgaaacctcgtctctactgaagatacagaaaattagccaggtgtggtagcgtgcacctgtaatcccagctacttgggaggctgaggcaggagaatcacttgaacccgggaggcggaggttgcagtgatcatgccattgcactccagcctgggcgacggactctgtctcaaaaaaaaaaaaaaaaaaaaaaaaagtggatatatgatcaggtcaggcagttggctcatgcctgtaatcccggcactttggcaggccgaggtgggtggatcacttgagcccaggagttcaagaccagcctgggctacttggtgaaaccctgtctctaccaaaaaaaaaaaaaaaaaaattagccaggcgtggtggtgtgcgtctgtagtcccagctactaaggaggctatggtgggagaatcacttgaaccaggaggtggaggttgcagcgagccaagatcgtgccactgcactccaacctgggtgacagaacgagaccctgtctcagaaaaaaaaaaaaagagtggatatatgctccgtggagcctgaaacatatacaattgtggggctctaaaattatgtaataaattcaatatttatttagagtaaataaacttatgtaataaagaattaaatgatgtcataaagtcagtatttaaaatgagaagaatcattgtagattttgaaatactgacaaaaaccacagacatcacaaagtccagaaaaataatattaataactgcccagcaaccgctataagtcttcacccatcttgcattttttagttgcatactctttgcaactaaatgaccattttatagagatgttagaaagataaattagtcaaaaatagattttaaataattgatagtctctaaactttgtattatcagctttccaactccttgctataatgtcttgcacgggtgatgcttctcgctgaggaaaagccctggggagaattccagccctttgatctcccttggcttggtctccaaaggggcttctaagacagctccatctggtggtcactgccctcgtccctagcccaccgaccctagtccaccctcaactgacacttggcctgagagaatgacctccatgctggggtccaagtgtccgatgaagggctggtaatactttttttttccattctgatggaatgaggttcagagtaaatattaggttgtacaaataagggaggagaccacccctcatattgtcttacgcccaatttttgcctccaaagaaagaagaagtaaaaactaaaaggcaggaatgaagtccacaagcagacagcctggcaccacactctgggcctggtagttaaagatcaacccctgacctaatcggttatgttttctatagattacagacattgtatagaaaagcactgtgaaaatccctgtcctgttctgttctgatctaattaccaatgcatgcagaccccagtcacgtacccactgcttgctcaatcgatcacaaccctctcaagtggacccccttagagttgtgagcccttaaaagggaaaggaattgctcactaggggagctcggctcttgagacaggagtcttgccaatgctcctggctgaataaactgcttccttctttaactcggtgtctgaggggttttgtctgcagcttgtcctgctacatttcttggttacctgatcgggaagcaaggtgattggcagatggtcgagacagctccttaggcggcttaagcctgccctgtggaacatccctgtgggggacttcgaccagcccaagtgacgcagattctgagagcgctcctgggtaggcatttgcccaggcgggatgcctcgccagagcagtgtgtggcaggcccctgtggaggatcaatgcagtggctgaacaccaggaaagaactggtacttagagtgtggacatctgaaacttggtaagactagtctttggaacttgcctactccatttgagtggaagcgtggcctgatcaccgacggcatgcttttaatggcactttggtttggttttggttttggttttgacttggtttgaattgcttgacaagaccggtcttaggaactttcccactccatttgagtggaagcgtggcctgatcacccacgacgtgcctttatcggcactttggttttggttttgacttggtttgaattgcttgacaggactggtcttgggaacttgcctactccatttgggtggaagcgtggcctgatcacccacggtgtgcctgtaccggcactttggtttttgtttttgacttgatttggattgcttgatactttggttttggttttgacctggcttggatttcttgatactctgattttggttttgattttggtttggtgtaaactgcaaaagtgtgtgtgtgccctttttacctgttctttgttttgtggtgtgcgtgtggtgtgagcatggtgttttgtctcaaagaagcatgggtcaggcacaaagtaagcccaccccactaggaactatgttgaaaaatttcaagaaatttaagggagactatggagtactatgacaccaggaaaacttaaaactttgtggaagatagactggccagcattagaggtgggttggccatcagaaggaagcctggacaggtcccttgtttcaaaggtatggcacaaggtaacctataagccaaagcacccagaccagttcccatacatagacacttggttacagctggttttagatccccgacagtgattgatagaacggcagcataagtggctggcagaggcaaggaaagaccaggagagagagagagagagagagagagagagagagagagaggcagagagagagaaagagacagaggcaaaagaaaagtcaaagagaaaaagagacagaaaatcaaagaaagagagatatacaagtagttaaaagaaaagtgtaccctattcctttaaaagccaaggtaaatttaaaacctgtaattgataattgaaggtattctccgtaaccctataacactccaataccactttgttgacagtgtaaacaagggcgtatcttgaaagcactgaggccttcctatcaaaaatccttaacccagtaacccgtggatggcccaaatgcattcaatctgtagcggcaactgctttgctaacagaaaaaagtaaaaaaaaacttacaggaaacctcattctgagcacacctcaccagttcagaagcatcctaaggaataaaaggggggggggggggggcggaatttatgtaaaaagagtattatatggtaaatttttgtcctgaattaaattaactggttgtttaaagaaagaaatatttgtaataagtcagaaagttgaagcatgtcaaagaattgtctgcaaaagttgtgaaagagaaaaatgttattaaaaaaagaatttatgcaagaaattttgtataatttaaaagtaactaggcctcctgaatgtaaacaacaaacaaacaacagtttatgtgcaaggtgtataaggaaagtaaaatatacctgtggtaaaagaattataaggaggcatgagaatataaatttttacctacattaaaaggctaaaaatatgtatattttgttttaaaggtttaatcaagttttaaagtgttaattggaaagaaaattctgtgtgtaaacattggctaaagttaaagcagtatcatccagtttttctgtaaactggacattaaaataaaaccatagcaggtttttcttaaagcaccaacctgctctttagcaaaaattataaaaagttaaaaagagtctataaaatcttaccttgtggtctaacattaaaaattgcataaatatgtctacaaggttttgttaaaattaggtttaatattaataacacactaatataaaagtaaaatttagcttatctggtgtaaaaatcatagaaaaagcattgttaaatgtaaaatggtatttggctttctttggtttaaaaactaataaaaataggtgctaaagaaaatttctcagtaaaaaggcactaaggactaagtccactgccaaggtccccacatttaaaacaaaaggtcaatttcttaaaaattatatacttggtttatcttccactttcctttccctcaaaaactaaaagtcttttagcacatgtaccacccctagaatttccggtaaaccagcaccagcctgaagatcacgttctcatcaaagggtggaaagaagaaaaactcgagccagcctgggaaggaccctaccttgtgctgctaaccaccgagactgttgtttgtacagtggaaaggggatggactcaccacacccaagtcaagaaccccctccagagtcgtgggccatagtcccaggggaaaaccttaccaaactaaagctaagaaaaatttaactttttcatctattctattactcttccttctttcctcgctctattgctaaccgtctagttattaacattaccaagtcaattttgcctcaaactattgcatttaatgcttgccttgttataccctgtggggacttgccaagtcaaagacagctctttacttcagaaaagtacttctgtcccttctgactctcctcagattgggcattagtaaattaggaccatttaatctggggaaatttcgataaagattccagtgtcaaccaggagtcttgccccacaatgtagagcttttatgctgtagttggtccaacattctatggaccactaaagagcaaggatggactgccctaactggtttttgtaatttcctaaaatcatacattcattttactagaggatcatagaagttaaagacttaaaacaaactttagcagttaagacaggataccaagatgcaaatgcctggttaaaatgaatcaaatattccatctgcacattaaacaaaagcaattgttatgcttgtgcacatggcaggccagaggcccagattgtcccccttccactaaggtggtcctccagttgaccaggcataggtctgcatggtagctcttttccaggattctacagcctggagtaataagtcatgccaagctctctctgctatatcccgaagtccggcaccctgcgggtcagcccccaagggctatccagcttccgtctctcaacactaagttcacttcatgtctccctggcattccttggagacctgaaaggatgcaatgagcttaagaattttcaagagcttatccatcagtcagcccttgttcatccccgagtggatgtgtggtggtattgtggtggacctttactgagcactctgccgaataactggagtggcacttgtgctttggtccatttggctatccctttcaccctggcatttcatcaaccagagggagaaaaaaataagacatcgtaaagtgagagaagccccttattggtcttccgactctcacgtccatttagacacaattggagtcccacagggaataccagatcaatttaaagcttggaatcaaatagcggcaggatttgagtcaatattttggtaggtgacagttaataaaaatgtagattggataaactatattataaccaacagcaacaagcttttcatgagttaaaactcatgtcggccccagccctggggctacctgacctgacaaaaccctttacactctatgtatcagaaaaagaaaaaatggcagttggagttttaacccagactgtggggccatggccaaggccagtggcctatctctcaaaacaactggacggggtttccaaaggctggcccccatgtctaagggccctggcagcaatggccctgttagcacaagaagcagataaactaacccttaggcaaaacctgaatataaaggccccccatgctgtggtaactttgatgaataccagaggacatcattggctaacaaatgctagattaaccaagtaccaaagcttgctatgtgaaaatccccgcataaccattgaagtttacaacaccctaaaccttgccaccttgctcccagtatcagagagcccagttgaacataactgtgtagaggtattggactcagtttattctagtgggccgaacctccaagaccatccttgaacatcagtagactgtgagctgtacattgacaggagcagctttgccaacccctgcaaagtgactctgaaaaagacgacaagccctgctccagtcatatccggaagctgactaatccacacacggctgaagcatgagaaaactcatcacgggactcattttccttaaaatttggacttgtacagtaaggacttcaactgaccttcctcagactgaggactgttcccagtgtatacatcaagtcactgaggtaggacaaaaagttgctacagtcttattattttatggttattataggtgtaccgggactctaaaaagaacttgtttgtataatgctattctatacaaggtatgtagcccaggaaatgaccaacctgatgtgtgttatgacccatctgagcctcccatgaccacagtttttaaaataagattaaggactgaggactggtggggaggactcataaatgatacgagtaaagtgttagccaaaacaaaagaaaaaggggtgcccaaacaagtcaccttgaagtttgatgcctgtgctgtcattaatagcaataagttaggaaggggatgtggctcttttagttgggaaaaaggctatatgaccgaaaataagtacatttgtcatgaatgaggactgtgtgaaaatgaatgtggatactggtcttgtgtcatttaggccacttggataaaaaatgaaaaggatccagtccaccttcagaaaggaaaaaatggctcttcctgtactaagggacaatgtaaccccttagagctagtaataaccaatccccttgatcctcgctggaaaaaaaggggagcgtgtgaccttaggaatcgacagggctggactggatcgtcgagtaaatatcttagttcgaggagaagtctgtggaaaatttaaccttaccaattgctgcctgcacatagatgatcagaggcaagtagtcgaagatatagttaaagacatgacgaaactggcacatgtgcctgtacaagtgtgacacggatttgaccctgaagctatgtttaaaaatggttcccagtgctaggaggatttaaaactcttataataaaaattatagtagtaatagcctgcttactgatcccttatttactatctgtactcattcaaatggtaaaaggtttcatcactactctagttcaccagaatgcttcagcacaagtgtactacataaatcactatcgatctgtcatgcaggaagacataggtagtgaagatgaaggtgagaactcccactaataaaatgagtgagagtctcaaagtgggggaataagggaggagaccacccctcatattgtcttatgcccaatttctgcctccaaagaaagaagtagtaaaaactaaaaggcagaaatgaaatccacaagcagacagccaggcaccacaccctgggcctcgtagttaaagatcgacccctgacctaatcggttatgttatctatagattacagacattgtatagaaaagcactgtgaaaatccctgtcctgttctgatctaattaccggtgcatgcttgctcaatcgatcactaccctctcaagcggatccctttagagttgtgaggccttaaaagggacaggaattgctcactcagggagctcagctcttgagacaggagtcttggccgatgctcctggcggaataaaccgcttcctgctttaactcggtgtctgaggggttttgtctgcggcttgtcctgctacactacagcaaaaattaggttgtattatagaaaattaacttttttggtttttttgagacggggtctcgctctgtctcccaggctggagtgcagtggcaccatctcggctcactgcaaccttcacctccagggtcaagcaattctcctgcctcagcctcccgagtagttgggattacaggcacacgccaccacgcccagctaattttttaaatttttaatagagatggggttttaccatgttagccaggctggtctcaaactcctggcctcaagtgatctgcccacctcagcctcccaaagtgctgggattacagacgtaagccaccacgcccagccgaaaattaacttctattaattgcatacctgggtttgcctactgagaatcataccctggatatttgtattctttactgaaaagaactgttctatctttccagaaagtggtttcctaaattctggttttcctcctggaatcctgctatttccttctcgcatactctagagaaatcgaagtgttttcaaaggtgctctgaagcttacgctccactagtttcacagtaaatcgccccttgcgagggcgctttttttttttttttaatgtgttctctgaatcgctttccccctttaacactgcatgacaagactaaagccagaatcccaagactgcagcgctaccccttcacaagccgtcgggctgtcccgggcggggccggcccattttcactttctccactagaggcagcagcgcaccgtgaccctggcttactacggtaagaaagcggagaccttttgcttcgaggcggttggtggccagtagtcttgatcgacaagctcaggcctctgaactaagcagccgctgtttatgcacgtacagccaatggaaaggcaggagtgcggccaacggccaatgaggactggtcttaagcggaccacagggcggggtttccctcgagaggcgaacgccgggtaaaagatcgggagcggaagtgggcgagtcagagcacatccggtgttagaagcgctggtaggccttggagaggcgggttaggaaggtacgtctgaacctagtactgggcgaactgggagtgagaaatggaaagggagttagcagttactgtctgagcaagagtggcagtagcttccttctgcggacagatggcaccctgaaggaacgaggccctgctcggagaccagactcgggaaaacagggtgtggagggaagctagggaactagtgctgcgcgtgcgcaacagtgctgaagcgggggtggggcggaggcgagtctgcgggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgatgtcacactcctctgtgacacgcgaggctcctcagttacttagccaacggcagaggcgggaagtgagaggagtctggggctggggctgccttccaggcccacggggcggccccgctcttttcggattggttacctttgggcaggtgaggtggctttgctttgcttggtcttgaggttttgtgggcgtctttctaagtctgctcagcaagggcgtcgttgggcagtttttatcttgggcctacttgctggacctgtggtaacaagtaggctttggtatctttgtatatttactgagtgtagaattactacccggtgccagcccgggctgcttggggtcatcagcctttcattgaccacccccacaacaaaaatcactatgaacttgagactgtgttctagcaacttgtgaatgtgtaacccagtagaagggctgactgtgcttgaaacagacaaggattttaaggtcaaaggtaaataaatggcaaatggacttttctagttacttattgatatttatttacagtttatcttttgtatgtgtggtttaagaattgaattctggaaagataccggaattgcataaacacatttcttatgacctgcgtatacacacttttttctgtaattattgtatttacactctttggtgttttcttattctttgtgtctaatatttttgttctggcctaaagaatatgttgacatttagattctctgccgccactttcctccagtagggacagaatagttgaacccttgagaaatacaatctgtacttttgatccatagtttgcttcttccgttatttatctggttgtggaaacatggtttagtaccttcctcctctttttttttttttttttttttgaggcagagtctcactgtcgcccaggctagagtgcagtggcgcagtcatggctcacttgaaccttgacctctcctggcttaggtgatccaccccagcctcctgagtagctaggaccacaggtggacgtcaccagctccagctaatttttgtattttttgtggagatggggtatcaccatgttgcccaggcttaccaactccagaactcaagcgatttatttatttattattattattatgttttttttttgagacagtctcactcccttacccaagctggagtgcagtggtgcaatctcggctcactgcaacctccgcctccctggtgcattcaattctcatgcctcagcctcctaagcagctgagatgacaggcgcgcaccaccatgcccagctaatttttgtatttttagtagagacgggcttttgccaagttgtccagcctggtctcgaactccacacctcaagcgattcgcccgccttgacctcccaaattgctaggattacaggtgtaatcctttcctaaagaaaaagagtcatctctcctgaagaataagaaaaggtaaaattaatctagatacttagcattttcaagttattttccctgattatagatatagttcgcgctctttatacaaatgctgaaaatgcagaaaaatgtcataggaatcaatgtatgttttgggagggtttttttgttttaaagatttgttttcacctatggctgaaacttttgaaagcttatataaatgaaagcttatttttctactgtaggatggaatagtaaaaagagcactagactatagtggtcagaagaccccaaatctggttctggctctgctatttaactttctaatgttggtcaaatcaatactaatgtttgttttagtactttacgttgatttcacacagattttcttattggcattcagtagagcaggtattgatcatcatcgttatcttacagatgaggaagctgaaataaccttaggtaaaatgatttttcctaggttatatagtagaaagtggcagcacttgtgacaccaaatcctgtcctcttgccactattacattgcctttttgaacttaaaaaagatgtataaaatgggcctaatctttccctttccttgtgggttgatgtgtgaggattgaaggtgatacatatataaaagcaccttaaaagttataaattttatataaatatagtcaggagtattagtatagaaggtactactgctggcctgacgagtttcattttatttcgtaaactgcccaagggtattaattttctctagagaaaccattgaatattctgatgctctaacttctgattttttttcctttactactttgacctggttgtagaatctggtagaaatgtcttctaccactctgttttgttcccccagagtttctaaccaaactgcatgcagcccttcgtagtttttatacacattttgttttccaaagatggtgttcgagaccaaggagagaaaggctgtctccttgacttaaaggttacctaagtgaccccttgaggtaggttccactctgagccagctggggaatgttgatttgaggttacagcactcttgatctgataatagggtctaaatttgctctagagactttgtagtgcttaaatcttggggatagctgagctgaaccagatgcaagctctgccctcagggtgagaagtttctgcacaattaactggaatccaaaacacgtgaaaaaggagcttcaccagtgagggtgaagtgggtatgctgtttgtcttaatttatgtgtgctccccatttgggctaaatatggtgttattagggagggattactggtttatactggaagaagattatgtatttaggattttggggccttcttaggattcagtatctgtcaaacgttatagagagggagatgaagtagtgtcaacgtttggtacaaaaaataatttactgaaggcagtaggcatttcatctccagttactggtttggttttgaggcagccccctggaggagatggattcagtattagctaatccagggatttgggtccaagttaagggagaggcggggacatctagggtgtccacctgggaagatcaaagcttggtcctagttgaatgaaacaattccttggatggttccgaaactgaactgacctacctcctgggagtggcagggaaagcatcaagcttttgcgcatttacttcatcaaatcctttaccatatcagattatcacttagtggctattaggctgtctcaaaatgtccatggccctgtgggacaagagagatagtataaatgtgctagaagaaaggtatgccatttaaacaaaagtacagacgggccccaatttatgatgattggacttaatgattttttactttataatgatgcaaaagtgctacctgtttgctagaaactgtacttcaggccaggcatggtggctcatgcctgtaatcccagcactttgggaggccgaggtgggcagatcacttgaggtcaggagtttgagaccagcctggccaacatggcaaaaccctgtatctacttaaaatacaaaaattagctgggcatggtggcacacacctgtaatcccagctacttgggaggctgaggcatgataatcacttgaacccaggaggcagaggttgcagtgagctgagatcgtgccactgcactccagcctgggcaacagagcgagactctgtctcaaaaaaaaaaacccagcacatttagaatttccatcttttcccagactagggatatctggtatgatattttcacatgagatatttaacactttattataaagtaggctttgcgttagatagttttgcccaacttcagactaatgtaagcgttctgggcacatttaaggtaaggtaggctaggcttaagctataatgtttggtaggttatatgtagtaagtgcataaattacgatactttcagtttacaatgggattattgggatgtaacttcattgtaaatcgagcatctatacttttaccagtaatgagatttttcaagtgcctttatgtttcagtttataattttcttttctctctttttttttttttcttttttgagacagagtctcactctgtcgcccaggctggagtgcagtggtgcaatctcggctcactgcaacctccgcctcctgggttcaagccattctcctgcctcagcctcccaagtagctgggattataggcgcccaccaccacgcctggctaattttttgtatttttagtagagatggggtttcattgtgttggctgggctggtctcgaactcctgacctcaagtgatccgcctgcctcagcctcccaaagtgctgggattacaggctaaaactagacttttaaaagagaataatctactgaagatattgtagtaatgagtacaccagtaataacaatgttagtacaccagtaataacaatggttaccatgtattgaactcattctatgtacaaagagctattttaagaactttatttgtattatctcacctaatctgcaaccttaggaaataaggattgttatgtactagtattttacacatggtaggtgaaactgaagtacagtgaggttaagtgccagcagcttgctgcatgtcccactgctaaggaaataactaggattcagaagtagcaggcagtcttaaccactatgcaggggacatggttatacagtgtatgaacattactcagtagtaaaaactaatgaatggaaagctttcttggccaaaaacacagaagaagaagaagaagaagaaaaaaaactactgacaaattactaacagttcttccccctcctttttttgtttttgtttttttgagacagagtctggctctgtcacccaggctggagtgcagtagcgcaatctcggctcactgcaaactctgcctcctgggttcaaacgattttccttccctagcctcctgagtagctgggattacaggcgcccaccaccacatctggctgatttttgtatttttttactagagactgggtgtcaccatgttggccaggttggtctcgatctcgtgacctcaggtgatccacccacttaggcatcccaaagtgctgggattacaggcatgagccaccgtgcccagccctttcccctcttttaaactatatgggatttttcttctaagtatcaatttggtcccttctagatatgtgggaacaaggttcaggatggttgaatttatacaacaggaagaaagaaccatgtaattgacaaactaatttttttgttttaattttataaaacggttttgctgtgttgcccaggctggggtgcagtgacacatttttgctctgttaccaggctggagtgaagcaacatgatgatggctcactgcagcctgaaattcctgggctcaagcaattctccttcctcagcctcccaagtagttgggacaacaggcgcacaccaccacacccagctaattttttaattgtttgcagagatgaggttttgctgtgttgcccaggttggtctggaactcctgggctcaagcgaccctcccaccttggcttcccaaagtgctgggctcacaggtgtgagacattgtgcatggcctttttccttttttgttttttggaagtgaacataaccttgagactttattgtcttcataataaaacataaactgatatttaattaaatgtgcgaacagtgtttctttgacttgctgttttaatgttgctgtacacactgaggcaaagtctgtcttggctccagcattgcatagaacgcatactaaatccacgatagttttgttttgcatagcttttggctacttcagcatgtttcatgttcactgtagctcctaggtgtgtgggaataggactgaagagaatggttgtgttttttttaatttttaaattttttttacacgtagtctcgcactgtcacccatggtggagggcaatggcgtgatctcagttcactgcaacctccgcttccctggctcaagcgattctcctgcctcagcctcctgagtagctgggactataggtgcccgccatcacgcccagctaatttttgtatttttagtagagacagggtttcaccatgttggccaggctggtctccaactcctgacctcatgatctgcttgcctttgcctcccaaagtgctgggattacaggcgtgagccaccgcacccagcctgttttttttttgttttgttttgttttgtttttaatttaaggctggacccttgataatagtctttcattttaggacaagggtaagggagatacctagaacaaaacaaggcatttaacatgacctagatgtccactgctaagaatgcctgtctcctcctaccagcccctgctgtccctgtcttcccaagcaaaagcagaccacaggaatatctaactcaaacaattgtgtttacttgagttttttcttgggagagctatgtattaagctcttagctttttgtttttgcatggctctggcagaggaggctggtcagggataccacagaatgatgacacttcagcaaaactttagcagtatgtgcatgacatgttgacagcttctgacaggttttcctctcctgggatgaaggcataacaggaggctctgaatgaaattagaggaatttggttatgattaacacctgaacatttacttttcagttacaaacgcagtataggcagattttccacaactccaggaggcactatccacattgtattctatgtaaataacccctcctctttattttagaattgaattagtaagtaataggcttagaggtgtgaaaggactgctgtattgaattttttagcagcttgtaatgtactttttttctttattgtggtaaactataacattttaatgtgtttttttaaaacaaagattttcatttaactgtgggctcctctggaatgttagcgagttacttggttaatggtactgaatataatacttcaagctcttaagagctgattgctcctagaatggaaaatacttgatatgagagctgctatttttgagttaagtgcaacttaatcttgtttggctgagtttgcatatcggccattgaaatgtaggtatcttttctgagcttcgctagttgaagctaagattgaaacttggtaagtttattttatctggcaaaacttgtcagaacagtttgatctcattacttatctgtatattcttgtctatttggaacagctctagagcaaactatcatatttctttgattctaagacctatgtattccctctcacattttaacatttctgaaattgtcatctgtacattgtgtcatatacattaaatgtatacagatgctcctcaagacggggctgcatctggaaaaccccatcataagttgaaaataccgtaagttgaaaatgtaagtccttttctttttgtaagtcatttttgtttttttttgaaacggagtctcgctgtgttgcccaagctggagtacagtggtgtgatctcggcttactgcaacctccacctcctggattcaagtgattctcctgcctcagcctcccaagtagctgggactacaggggcgtgcctctatgcccagataatttttgtattttttgtagagacagggtttcgccgtgttggccagactggtctcgaactcctgacgtcaaagtgatccacctgcctcggcctcccaaagtactgggattacaggcgtgagccactgtgcccaacctgtaagtcatttttgagtcaacgatatttttaatttacaatgggtgtatccagatgtaagccatcgcaaatcaaggagtgtaccgaatgagtatcaatttctcccagtgataggtcaaccctggtaagtcagggaccatctgctttaccaggtttcttttttttctccataaagctaataaaattgctgtgcccttttgcgtctataatatttggtagttacatgttttgttttaaattttgaaatactgatattgaaaaacagaagttttagttattttttaatgatttcaaaccacaagcttctattaaatcaaagtgaaattgccgtttgacatctcatccccctgccccaacccacacagcctttgatggttttggtttttccatcaacagttgttaagagagaaccagaaagaggcagtcagtaccccctgggaaacgtcagagaagtatctgagaaaggggagtttctgccattctcccctcgaacagattccgccaagcagggtctggttacatgagcattgcctctttcttagaatcccctgggcgtttgaggatccaccccgctccatcccttacctttctttaattcttgtaattggaagcaagaggttctttagcattgctgttgtgaatactgagaaacttggctctgaaagttgcttcagtattattgtaagtgctgtctagggatgtcattaggggtgttaatgggaaaccttaaacaaagacactttccaggtgctgaattctgccatgctgtaagtgtgctctctagaggacatagtcatattcatcttggttatggaaggctgtggttggccttgtaacaacctgcaataattgcaccatctagatcaagagggcccagatccgtgtgactcagaggagagagcaacaaccttagtaggttctgcagcttctcactgtatctgtccttaagaacagaattaacaaaagttctgaggtgagtagtgatgttaatgagagaaggaaagaagaaaccagagaaagcaagccagccattgtgattgtttcatttgtgggagagagcctcaggaagcagatgatgtttatatctttccactggcccaggattccttaggaaatttgtttggggactgtaacttttattattacctagatgaattgttctgagtgttgggctgggtgctgattagagtgcttcattcagtaggtggcgtttcacacaactttatgtttgaatcccttcctccctgcccctccttttctggtagatttaaaatggatgggcattatggccctgataggagtttggaggatttatatttagaagagatgaaagttcttgactggatctttagtactgtagattgaacacgtttacttaggattgcatgtgaaataggggagggagcaaaacttaagaacttgactttatggtgttgatatgatctaacctggatatagttcagtttaaaaatgccctttttgacattgggacagttggcaaaaatctgaataaggtctgcagattagaaatagtattgcattagtattaatatcctgattttgatcattgctttcaggatatacacactgaagtgtttaggagcactgtgtctgtatggttagggaaaaaatatttttacatctgtctatatattgctatatagaaagaagatgaagcaaatgtgaaatattagcatttaggaaatctgggtgaaggttgtacaggaattctttgtactgttctaacctttctgtaggaaaggttctgaaactgtcaaaaaaataccccccaaaaaatcctcctttctgcataaattccttttttatggaggtaggaacctctctttttttaaaattgtgagtccttttcagttcagttcttaaatgtgttaggttaagaaaatttgatacgcatatatttaaaatgcaagtcttaatgccagacccagctttatagtttttgtttgttttgttaagactagtcaaagttttgttttttatctttgaggtgctgctagtgagataatttttttttttttttttttttttgagatggactcttgccctgttgcccaggctggagtgcagtggcgtgtcttggctcactgcagcctctgcctcccaggttcaagcaattcttctgtcttaggctcctgagtagctgggattacaggtgtgtgccaacacacccagctaatttttgtatttttagtagagacagggtttcaccatgttggccaggctggtctcgaactcctgacctcaggtgatccgcccacctcagcctctcagaagtgctgggattataggcctcagtgagccactatgcccagccaagggaattctttagcatcttgaaacaatgacataaaattgctttatgtgccaatgtctaggttcctttaactagattgttaattgagaatttcttttataaacttactgccttttaaagtggcaaatcacctgaaagaatagaaatcagatgatagtaacaaaatagtttgagggagaagaagatgcattcaattcctctgtcgtctttaagatggttgactatgattgcaaatatattgtaggacacataaaaataaaaatggttgtgttagggctgtagaattttaggcaagttttcatctttctgaacttacatgttgcttttttttttttttataagctgttcgtgtgattctgtatgacttaatgactctaacctttctttattctgcagagtggagactgctgcacggactctggaaccatgaacatatttgatcgaaagatcaactttgatgcgcttttaaaattttctcatatgtaagtgttttgaccttgactggttttgtactgcatttcttttcatatctctttgtcccttttctgcatttataacttttgtgtgtataagctaacaaattaacttggccagaatccagaggacctgatgaaaatgtccaaattctacacgttgctgtgtggttattggaaaggcatttattctagtttgggtactgattattcataattttgggcatttggtcttcctcagcatttaaggttctgttaacctattttcaaaatattattttttattgtaatatgctttcctaaaagtatttcaaactatttgtaacagaacttttacatattcccaggaagggaaagagagaaatgattcttcttagcttaaatatgagattgatctgggactgattgctcttattcacattcttttcttagaaccccgtcaacgcagcagcacctgaagaaggtctatgcaagttttgccctttgtatgtttgtggcggctgcaggggcctatgtccatatggtcactcatttcattcaggtaagaacgattttctctcctggttgctgtggtacaaattacattaggaaaaaaccagctcagcaaggtggtccaagggaccctgttcctctctttaatctttatcagtagtttaggatttaaactcagacattaaatcaggacatgtaaagccattttaattttctggcaactgtgccccctctagataccgaaaaacagaatgccttaaccttggcactgaatggtgtgctgctgacgtacaagacccccacccactgagtaggcgcatggcatgcatgctgggattctttggcacagaagcttttttatcttttcctccattcttcctttacaaaactctgattgtgtgattaactatcaggagaggcaggattgagatctttttaaggaattgacctgttttattttccgataactgttgtctgcatggttgggtaaaaaccttcaacaatttgttttcctgtattgagagagaatctgggtttggtcagcaggagtagaaggtacagtttgaggaataaccagaaagtttgaagactccctaacatagtcttgtgcctttgtagagtattccttttagcataaatgtagaggtgggcctctgttggcatttgccactgttgagaactatccttatgttcaggcatctcctggcagggattgtgtgaaaaattactttagacactcaaaggatagggctttgatcgcttgagttttaggcaaggttagcccttaaataatttagtaaaatacagtcaatccttgttattcacagactctatatttgtgaattcacctactcattaaaatttgtaaccccaaaatcaatactcatggcacttttttttttttttttgagacagagtctcgctctgttactcatggcactttttgcagacagtcacagagtggtgaaaaagttgagtcaccctgctgttgcagtgttttcagctgaggttgaacaagacagtgctctgccttcttgtttcagttctcgtattgtaaacaaatgttcttttcatggtcatttagtgccacttcctttgtatttttgtgcttttaattggtgattttgctgggttttttgagtggaggtcttgtggtgtcgtcctgactggtctcaaactcctgggctcaattgatcctcgcacctcagcctcccaagtagctgggaatacaagcacatgccaccatgcttggcttaattttgctgttcagaatgcaaacagcatagtgctgaagtgctgtctagtattcctgagtgcagaaagaccgtaatgtgccttatgaagaaaatgtgtatattagataagcttcattccggcatgagttgtactgctgttgtaactgtgagttcaatgttaaggaatcaaaaataatgtcaaatgaggtgtccttaaacagaaacacatataaaagcaaggtatctattgatcatttgatgaaaatgttgtgaccttaggcttgcaggaacctacctaccttttatttccctcaggaacaagggtttactaattcattgtccactgtgattttataacataaacactgaataatgagaatcaacttcttcctttaaaggaaggaaggaacttcagtgtctacgtccatccttaatgatttctcttttttctaatgcctatagtttttcccacttggcgtttttaaaaaaagaaacacttttttcttactacaaagctaatatgtgttcattttagaaaattcagaaaacagactagcaatgagaaggaagtattttagaaacttccataatcccatcatccagaaataactactgttaacattttagtactttgcagtcttctgtatatgtatgtgtcttggtgttttggtgtttgggggttttgtttgttggtttttgtttttttgagacggagtttcactcttgttgcccaggctgaagtgcaatggcgtgatcttggcttactgcaacctctgcctccctgggttcaagcaattctcttgcctcagcctcctgagtagctgggattacaggcgtgtgccaccatgcctggctaattttgtatttttagtagagacggggtttctccatgttggtcaggctggtctcgaactcctgatctcaggtgatttgcccacctcggcctcccaaagtgctgggattacaggcgtgagccaccatgttttttttaaagtgaccaaagggggatcatttctatttgttctacagatggaatgtactttaagcacttgtcacgtttcattcatcctttctattttttgggcaagactcactcatagtttgacttgggtagttgtactgtagttgaaggactacgcaagccagaagagcctccagcatccaccatggtcctaactctgtgcttcaaggcttctgggttatctcctcagccccatccctgagaaaacactactttttctcctgcctccaggttataagcaaatgttaggaagttcagacgagtgtttgaacccaataaaggtctcttgcaaaataaatttgaaactttcaagtgtttaatgattgattgattctgactctaacaggctggcctgctgtctgccttgggctccctgatattgatgatttggctgatggcaacacctcatagccatgaaactgaacagaaaagactgggacttcttgctggatttgcattccttacaggtacgttaagggatttgtctaattttgaggggtgagctatattttcagtatctcttaattagttcccccccctttttttttcttttttttttttttgagacagagtctcgctctgttgcccaggccagagtgcagtggcttgatcttggctcactgcaagctccgcctcccaggttcacaccattcttctgctttagcctcccgtgtaggtgggaccacaggcacctgccaccacacccggctaatattttgcatttttagtagagacggggtttcatcgtgttagccaggatggtcttgatctcctgacctcatgatccgcccgtctcggcctcctaaaatgctaggattacaggcatgagccaccgtgcctggccctttttttcctttttttttgagacagtgtctccgtctgtcacccaggctagagagtgcagtggcgtgatcttggctcactgcaaactctgccttccgggttcaagcgattctcctgcctcagcctcccaaatagctgggattacaggcatgtgccaccatgcccggctaatttttgtatttttagtagagatggggttttaccatgttggccaggatggtgttgatctcttgacctagtgatccacccaccttagcctcccaaagtgttaggatgacaggcgtgagccatagtaccctgcctcctggcttttttttttttttttttttttaagatggagtctcaccctgtggccaggctggagtgcagtggcgagatctcagctcattgcaatctctgcctcccaggttcaagcgattccccttcctcagcctcccaagtagctgggactacagcggctaattttttgtattttagtagagacggggtttcaccatgttggccaggatggtcttgatctcctgacctcgtgatctgctcgcctcagcctcccaaaatgctgggattacaggcatgagccaccacacccagcgcttttttttgtttttttgtttttttttttgagactgagtttcactcttgttgcccaggctggagtgcagtggcacgatcttggctcactgcagcctccacctcccaggttcaagcgattctcctgcctcagcctcccgaatagctgggattataggcatcaaccaccacgccagctaatcttttgtatttttagtagagatgggccactatgttggccaggctggtctcgaactcctgacctcgtgatccgcccacctcggcctcccaaagtgctgggattacaggcatgagccactgcccctggccctaattttgtattttagtagagacggggtttcaccatgttggtcagactggtctcgaactcctgacctcaggtaatctacctgcctcagcctcccaaagtgctgggattacagacgtgagccactgtgcctggccttcctggcctgctttctaatctcatataggttcattttgtttccccatccattaggggaaactctgtgagtagccactgtgactctacttttgtgtccaaaaatagccattgtgtacttgaatgaatgaggttcaagagcttaggtagcataacctattaatagtaggcatagaacttttaataaactagacttgagaatccgacatagttgcacccatactggcaattatcataggagcttctgttctgagtcttacagacagtgcattaaagctatacattgagatctattgtgcaggacactttgctgattctcaaaaaaagaaaggcacagctcttctagaattgtcataaaggaaacaagactcaagctatgtaataaaaatgtttgcaaaacatttgaattagaacagcttgttctgagtgacagtctaatatacgtaggagaaattttagaaaggaagagatttagggattaaaatttttgcatcagggcaagctagtttttgaaggcattaaggggtggaattatcagaaggaaagaggaaagtaattagaacgaaagaaatgttagagctggaacaggttgccctcctgttggcaggtgtccacctgcagaaccagtctcacctttctttgctacaaaggggagtcagtcctacatgactataaggttgctggccacgaggcactgttttgctctttatcctttttttctaattcctgatctggcctatattaccatcttacatcactctagctctgaaatgtttggcatgcctactttattttcttgtaatctctgtaccctccctgaggtcatccatgattttcagctaagaggacaattttgcagctatttctataaaaaaaaaaaaaacaacgcagtcaggtatacattttattgaaaacaattacagcggaggggagagagatttaattctttagtccacgtttgttaagagcatgagtatgcctatatttcgggatcagcttttggatgaggatcctattcaagaattgatcgtaatactgtgttctgggttttctgttttctaggagttggcctgggccctgccctggagttttgtattgctgtcaaccccaggtaactcttttggtagtgtcttatgtgcttttatctttatgaatataccttctaaatgtagaccgtatacctgtagcccttaatctaatggtctttttttctaacagcatccttcccactgctttcatgggcacggcaatgatctttacctgcttcaccctcagtgcactctatgccaggcgccgtagctacctctttctgggaggtaagtgtgaactgggaaacagggaatgggggctcctttttagccagaattctcactagtactccttccttacccctaactcctttgcgactattgagttgagattaaccttcattctgggggaagttaaggaatggctttaatgggattgctttactttgccttggcttctctcaagacagctttttgctgtgtcttataggtatcttgatgtcagccctgagcttgttgcttttgtcttccctggggaatgttttctttggatccatttggcttttccaggtaagacttagcctggaactttccagcagccatttgcctcacacttctttctttccttttttttttttttttgcacttctttctgtactactttgggcagtgctctctaagccttcccattatccttcataggatggagccttctgccacaagtgaaaacaggctgcacaaggttgggcattgctaagagaaaatggtttgctcagacaccatttgtgtaaggccagtctggcagtggctgattgttaaaatgattgaaactcttccagtgaccagtgcagtattgtgcctagggaagtaaagtggtcttcaccctaggctgcagttctcgtgaatggtaatgttcatagggttcacatttgatgtactttcaagtgactatgagccagaaagtatggctggtttttttttctctgcaacttctgctgtatagtaacttcatctcttacatttgttaggcaaacctgtatgtgggactggtggtcatgtgtggcttcgtcctttttgatactcaactcattattgaaaaggccgaacatggagatcaagattatatctggtgagtgtgggaactagtctttaacaagcatgaaggttgaggcataccgttcagcagctgaacttaggttggcattggctgaacataggtggccaagctttgggagtgtatgtggtaggaaacccacggttttggaactgtgtaccataatcttcctcaattcctgaaagatttcagattttttaaaaatctgggctaataggccaggtgtggtggctcacacctataatcctagcactttgggaggctgaggccactggatcgcttgagctcagaagtttgagaccagcctgggcaacatggcgaaatcccatctctactaaaaatataaaaaaattagctgggcatggtggcacatgtatataatcccagctactcaggaggctaaggtataagaatcatttgaacctaggaggtggaggttgaagtgagccaagattgcaccactgcactccagcctggcaacagagcgagaccctgtctcaaaaaaaaaaaaaaaaaagtgtgggggccgggcacggtggctcacgcctgtaatcccagcactttgggaggtcggggcaggcggatcacgaggtcaggagatcgaaaccatcctggctaacacggtgaaaccctgtctctactaaaaatacaaaaaattagtcgggcgtggtggcgggcacctgtagtcccagctactcaggaggcggaggcaggagaatggtgtgaaccggggaggcggagcttgcagtgagcggagattgcaccactgcactccagcctggacgacagagcgagactccttctcaaaaaaaaaaaaaaaaaaagtgttggggggtggctatatatttacatatccatagtggctacctccaagcagaagtgagggaaagagatctttctccttttcctatttatacttctgtattttttaaacaatgagtagaagatacactctttttttagagacagggtctcgctctgttgcctaggcagtagtgtggtgccatgaacacagctcgctgcagcctgaatttactgtgctcaagcagtactcctgcctcagcctcttgagtagctgggacaacaggcacgtgcgaccatgccaggctaatttattttttgtagagatggggtcttaccatatgcccagattggtctcaagcagtcctcttgccttggtttcccaaagtgttgggattacaggcttaagccaccatgcccagccactttttttttttttttttttttttgagacagttttgctttgtcacccaggctggagtgcggtggcaacatctcagctcactgcaacctccgcctcctgggttcaagcgattcttgtgcctcagcctccctagtagctgggattacaggcactctccaccacgtccagctaatttctgtaattttagtagaacgaggttttgccacgttgccccgtgaggacatggtgtcgaactcttggcctcaagcaatctgccttcctcagcctcccaaagtggtgggattacagacatgggccaccatgcccagctcacttttttttttttgagacggagtttcgctcttgttgcccaggctggagtgcaacggtgtgatcttggctcaccgcagcctccgtctcccggcttcaggtgtttctcctgccttaacatcctgagtagctgggattacaggcatgcaccaccatgcccggctaattttgtatttttagtagagatggggtttctccatgttggtcaggctggtctcaaactcctgactcaggtgatgcccgcctcagccttccaaagtgctgggattacaggtgtgagccactgtgctcggcactttttttttaatgtagtgattctctcagtctcatgactaattagtggtagttaagggttcagacttggacctctgcagagttcagagcgcttgagacagggcttgctctgtcacccaagctgcagtaggagagtggcactgtcatggcttactgtagactcaagctccctgggctcaggtgttcctcccatctcagcctcctcagtagctgggattacaggcacatgccacaatgccctgctaatttttgtagagacgggattttgctatgttacccaggttggtctcgaactcctgggctcaagcagtccacctgcctcagcctcccaaaatgttgggattacaggcatgagccactgtgcctggcccagtctcttttctctatgctgcatgacttcgatgagtctaaaggatctcagacaccagagttttacttccttagttgggggtaaagtgtgggagaagctggctcgtgggggtaggggtggggtttatattctgcatctttgtgggcttgtggataaaaaagtctgaagtacagatcctaatctggttcttgcctttcaggcactgcattgatctcttcttagatttcattactgtcttcagaaaactcatgatgatcctggccatgaatgaaaaggttagttagcctacaacccaaagatgagacaataatggctcctgagcttggcatgtgtgtatacttcagatttgaaaacttgctcacacactgtgttaggtccagggtaactgtaaggcaggccactgagtaagaggtaagccagaagtcttcagttgttagaaaaaaagcagcaagtgaaaaaaaaatttttttaactaattcctgcgtttagtatgaaagggaaaaaagcttcagtggcagtaaacacaacctgctacatgaataatttaaaggctatatagttgtgactcagagaaaggtattgtggaggacgttgtaaatttcagaagtagactaattttatccatttgttaatttttttttccaaggaagcattctatatagggctaatgagtatctaacgtagttgagtcaagcagtgggggaaacaaatgaaatgagcttttctttatagaccttatggagcttagagatagcatagtggtagcgggagtagttgaccagataggattgctggctctgtctgggctatgccatggttggactgagcactaggcagatgtacaagtttcagaacaagcaactgaattttcattccttaatacattgggcttccatccaagattgaatgaagaattctgctggaccaaattatttctgaatgtcagtttatgccagagtcatgctcactttgcagggtggagcacttctcgcgcctaatggttggttggtggtcttggcctctagtttcactctttgaggatagagtgccatctgcagccttcactgttgggatctgagctgtagtggctgtgaatagcctagagtggtcaggcagcccacctcggcactcctggggtgggggtggggacagctgcttaacctttattcttggtcggtctgtcggcaactttgggaaccaccagtaggatgtggttaagattcagttcttgctgagctaaggaagcatttctcatttctttttaattgtctggctcacttctagtccctaactaaatgctcactcaagagttttagcttgaatgtcaaatgtcaaaaaattaattgggtgatttttctccatttctaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttcctggtgtttgtgttaaattcaagggtacagctggtcatggagcttgtgatactgccagggtttgctactgggggctgggagtgggacacgattgagttcgtgtcataagtatgaacagagacaaagacctcccactctgtagccccagcatgccacaaatgttgagaattttctctgtcaaatatgtaagccagttttttttccagtcctctccaccccctgccacctttgctatatgttgtttgtggtgatatgtgcagttggttcagatgtgcagccaagctttggagtttgaggatgcataatggaaaaaaggcaaatgatacccactcattctgcaagtatttttgttcacccactgctgcccggctgtattctaagtgcattagttaataaagatgtaaaagttggccaggcatggtggcttatgcctgtaatcccagcactttgggaggccaaggtgggcagatctcgaggtcaggagttcaagaccagtctggccaacatggtgaaaccccatctctactaaatacaccaaaaaaaaaaaaaaaaaaaaaaaattaggcaaagtggcaggcacttgtaatcccagctacttgggaggctgaggcaggagaattacttgaacctgagaggtgaaggttgcagtgagctgagatgcaccactgcattccagcccgggtgacagagaaaaaaagtcggccaggcgtggtggctcacgcatgtaatcccagcactttgggaggtcgaggcaggcggatcacctgaggtcaggagttttgagaccagcctggctaataaggtgaaaccccgtctcaactaaaaataacaaaaaatagcccggcatggtggtgggcgcctgcagtgccaactactcgggaggctgaggcaggagaatcgcttgtacccgggaggcagaggttgcagtgagccgagagcgcaccactgcactacagcctaggcgacagagactcccatctcaaaaaaataataaaagtccttgtcatagttcagatatgagattatcaatcggaacttgcattacaatcaggttgctcaattctgtgtttgtgtttttgttttgatttttggagacagggtcatggtcttgccctgtcacccaggctgtagtgcagtgatgcgatcatggctcacagcaacctcagtcacctgagctcaagtgatccacctcagcctcccgagtagctgggaccacaggaacatgccactgcaccccgctgatttaatttttgtagaggtgggatctcaccatgttgctcaggttatgttgaactcgtgttcctcaaacgatccaccttagcctcccaaagtgctgggattataggcttaagccaccatgccgagcctagtagctcaattttaccatgcttgttctccgcttgtcatattcattgtagacccaggccttcctgttagaatttgaccattattctgactggttcatctaggttactcccagttgacctgttcggactccacatgtgcccgtgccaactaaggatagccattttccttaagcttgggaaatattccttaagcatcttttctctcttgctgactttgagaaaagactggtcctaaagactctttaaagcccccattttatctgctaggggagaagtacaaggtgcaacaccttttgagtgtttacaaggtcaggcactgtacaaagtgccttacatggattgcttaacatccccagtagtttaagaagatggtgtatttactacgtacggtcagttacttccagggctggcagatgtgtgcccagaaagaatctaggcacactatctccagagcccctatcctttactgttaacctatgtaagcagtgttaaggttagtcctcctgggctggagtcatcctttccatcctgacctacatcctggctatggctctggccaagggtggaaagggaaattgtgaaggggtttgagcaaaatctccccaccccaaatctttgtaaccaaagaaacgtagaagagtgagcggcctttttagtctttcttcccccagccagcccaccaattaccaattaaatggaagaggataacaaacagcagctctttccatgtgtaggagacctgcaggccaaaactagaccaaggaagaccctagtgggcggcagaagtggaaggtcctctgggttgaaagaagaaacagtattttttttttttttttggagatggagtctcactctggcccaggctggagtgcaatggcgtgatcttggctaacagcaacctccacctcctgggttcaagcaattctcctgcctcagcctctccagtagctgagattacaggtgcatgccaccatgcccagctaatttttcatatttttagtagaaagggggtttccccatgttgctcaggctggtctcgaactcctgacctcaagtgatctgcccttaagtgatctgcccacttcggcctctcaaagtgctggattacttacaggcatgagccaccacgcccagccaagaaacaatatgttctttctaagcatggtgagcagatgaggggatctgtcttgtttaagctggggataaagatgtagaagacagttcctgccttggagtccttcaccactgagtagtgctggagagccacatgtgaacattacatgtgaataggagttaagcatagtgggccatgagacaacagcaggagacacagcctggtctggtcggtcagagaaagtgctttgtagatgacacctcagctaagtctaaatctcaaagtttgagtcaaagtgaggcaagtgaagagattaagaaaggcagtgggagtggatgtttctgatcaagggatcagcacgaggaaagacaggagtacgctccagcatggggagtgcaaggaaggagctgcaaaaacaggttttgctaactaggaaagttggaggaaactagtaggaaatggagggggtaagtcaacagttactgaagacctggtatgaggcactgttgcatcaaacctctgatgaagctgggcgcagtggctcacacctgtaatcccagcactatgggagaccccaggcgggtgaatcacctgaggttgggagtttgagaccagcctgaccaacatggagaaacctaaaaatacaaaattagctgggcgaggtggtgcatgcctgtaatcccagctactcaggaggctgaagcaggagaatcgcttgaacccaggaggcaaagattgtggtgagccaagatcgcaccattgcactccagcccgggcaacaagagcgaaactccgtctcaaaaaaaaaaaaaaacaaaaacacttttgataatgaaagtagataatgataatataagaatggccactaatgccgggcgcagtggctcaagcctgtaatcccagcattttgggaggcagaggtgggcggatcacgaggtcaggagttcaaaaccagccttaccaacctggtgaaaccccctctctactaaaattacaaaaattagctgggcttggtggtgcacacctgtaatcccagctactcaggaggctgaggcaagataactgcttgaacctgggacgtggaggttgcagtgagctgagatcatgccactccactccagtctaggcgacagagtgagactttgtctcaaaaaaaaaaaaaagaatggccactaacatcatattaagacagacaacctgacatcacataccttctgatagaagtaaatactaccaatgaagtgtgtattttttttgtttttgtttttgtttttttgagatgtctcattctgttgcccaggctggagtgcagtggcatgatcttggctcactgcaacctctgccttccaggttcaagtgattctcctgcctcagcctaccaagtagctgggattacaggcacctgccaccacgcccagctaatttttttatttttaatagagatggggtttcaccacattggccaggctggtctcgaactcctgacctcgagtgatcagcccacctcagcctcccaacgtgctgggattacaggagtgagccactgcgcccagcctaccaatgaagttttcttaacaacaacaaaaaaattgaatctgggctgggcacggtagcttacacctgtaattccagcacttcgggaggctgaagtgggtgaattgcttgagtccaggagttcgagaccagcctgggcagcatggcaagaccccatctctacaaaaaaatataaaaatacacctgtggtctcagctacttgggaggctgaggtgggaggatcagttgagcctgggaggttgaggctgcagggagccataaacgcatcgctgcactccagcctggggagaaaaaattgaatctgaatcatattaagttctgtgtgaggtaataatacatacgtcagttcactagatttaatcatgccacaatgtgtatacacttcaaaagatgttggacacatatatggttttatctgtcaattaataataaaaagaaaactttaagttcaaactattggtttcttttttcaaaaaatatggcaaagaacaaatccaaaaagagagggaaggaaacctagacattaagagacttataagccatatcaacaaaatgcaatcaatgatgtgatcttgtttgaatcctgattcaaataaatcaagtatagccgggcgcagtggctcacgcctgtaatccaggcactttgggtgaccgaggctggtggatcacttgaggtcaggagttcaagatcagcctgaccaacatggtgaaactctgtctctactaaaaatacaaaaattagctgggtatggtggtgggcacctgtaatcccagctactcaggaggcggaggcaggagaatcgcttgaacctgggaggcggaggttgtagtgagctgagattgcaccactgcactccagcctgggcgacaaagtgagacttcgtctcaaacaaaaacaaaaataaacaaaaaaaccaagtgtaaaaggaaaagaaaaagggagagaattggagcaatttgaaccccgattcacattctccaagatggcccccaaggatcctcaccttggtgtgccctggtagagttctccacattgaggcaggctggcacgcatgaccaaaatatcactgcagaagcgtgtgtggcttctgaggccaggtcttcagaggaattgcagcttcctccttgtctccttggatcacttgctctgagtgaaactaagtacaggttctgaggccattcaagccgccctgtgtggaaagccttgaagtgaagactggagccccctgcccacagccagcaccgacttgccagccagtgggaaggagccaccatgaaagcagatcctccagtttcaaactttcaggtgactacagtctcatgagacactgagccagaactgcctcaccaatctaccaatctgtttctgaatgcctggcccacagaaactgtgagcaataatacatttattgctgttttaaaccactgtgttacacagcaatagataacagctcaaacactgactacatgataaagaaatattattaatgcataacgctaataatgttatgattgcattcttcaaaagttatcttttaaagatgcatactggccaggcgcggtggctcacgcctgtaatcccagcactttgggaggccgaggtgggcggatcacctgaggtcaggagttcaagaccagcctggacaacatggtgaaacccggtctatactaaaaatacaaaaatgagccaggtgtggtggtgggcgcctatagtcccagctactcgggaggctgaggcaagagaatcgcttgaacctgggagtggaggttgcagtgagccgagatctcaccactgcactccagactgggtgacagagcgagactccatctcaaaaataaataaataaataaaaattaaagatgcatactgaaataagtatggattaattactatgatgtctgagatttgcatcaaaatactcagttgggcttgtggagtgcctggagtgagggttctggatcccacccgtgagatttaggattgttaaaatgagtcttcagaagcaaatccctagtgacttcttatagcaaatcatcggatgaccaattgtggtaaaattaaattatagagtggattattgaggggtcctggcttgcctggatggctacatgaatatagccttggggtagacagaagaatatatacaaccaaagaataagtatgggaagctgggtacagtggctcatgcctgtaatcccagcactttgggaggctgagttgggcaggaatttgagaccagcctggccaacatggtgaaaccccttctgtactgaaaaaaaaaaaaaaaaaaaaaaaaggccaggagcggtggctcacgcctgtaatcccagcactttgggaggcagaggcgggcagatcatgaggtcaggagatcaagaccatcctggctaacatggtgaaaccccgtctctactaaaaaatacaaaaaaaattagccaggcgtgatggcaggcgcctgtagtcccagctactagggaggctgaggcaggagaatggcgtgaacccaggaggtggagcttgcagtgagccaagatcgtgccactgcacccccagtctgggcggcagagtgagactccatctcaaaaaaaaaagtacaaaaattggccaggcgcagtggtgcacacctgtagtcccagctactcaggagactgaggcaggagaattgtttgaacccgggaggtggaggctgcagtgagctgagatcacacactgcactccatcctgggtgatagagtaagactgtctcaaaaaaaaaaaaaaaaaaaaaagaatgagtatgggctacatttatccaagaaaagtacatcagtacacagaacagaagggtgtgaaggcaccaagagggccatacttttcatagttggatatctttttattatttttttctaattcttgcttctttgtgatatactttgtcctgttttttataatagtttatttttcactgacatttaagataaatgtatacaattaattatgaagtgttcttttacatttaagtttcagtcattttcttttaccactttgtcagtgtacaaaatgctaaaagaatttttgaaaaagaaaaaaaatagttgaatggtggcagggagtgaagaaagtagagggtatagataatatgaatggttatgagtttatatcggttgtggctaggcaatggacattgattgtacgattctctctccttttgtgtttgaaatgttctatcatggaaaactaaagaaacaaaaaaggcataatggtccaggcaagagaaaagatgatgtgaagtagagcagtagtcataaggacaggagacaatggactaaaatattctggaggtaaaatctccaggccttagtgattaatgagacatggggaggtgagaaagacaggagatcaaggatgattctcagggggtcaggatggtcctaccagctacctgccaactgtgcaagcttgggagagttactcagcctttctgtgtctcattttcccatgtgtaaaatggaagtaataatagtacttcctgtatagaactattgtgagaattaaattaataaaatacagtcatgtgccatatgatgttttggccaatgacacgctgcttatatgatggtggtcctatactcacacctgtaatcccagcactttgggaggccgaggcaggcagatcacgagctcaggagttcaagaccagcctgaccaacatagtgaaaccccgtctctactaataatacaaaaattagctgggcatggtggtgcatgcctgtaatcccagctacctgggaggctgagacaggagaattgctagaacccgcgaggcggaggttgcagtgaggtgagccaagatcacgccacagcactccagcctgggcaacagggcaagactccatctaaaaaaaaaaaaaaaaagattatcatactatatttttactgtaccttttctatgtttaaattcacaaatgctcatcatggtgttactataattgcctatagtattcagtacagtaagatgctgtacaggtttgtagcctaggaacaacaggcgataccatagagcttaggtgaatagtaggctacgccatctaggtctgtgtaagtatattttaccatattcacacaatgacaagatccctgtcttactgtatgtaaacaacttagaagtgtgttcagcccataataaaacttctaaatgttagttcttccactagggaggcccaggtctgtgggtgggatggtagttttggctctgacatgctgagattgcagtggtgtgggacacccttgcagatgccaggggacattgggatatgaatctaaagctaagggaagaagttaggaatagacgtatggatgacttggcacttttttcttttcttttcttttctttttttttttgagacagagtctcactgcaaccgccgcctcctgggttcaagcaattctcctgcctcagcctcctgagtagttgagattacaggtacccgccaccacgcccggctaatttttttttttttttttttttttttttagtagagacggggtttcaccatgttggccaggctggtctcaaactcctgacctcagatgatccacccaccttgacctcccaaagtgctgaaattataggcatgacccaccgagcccagcctgacttggcacattttttttttcttttttttttttttgagacagagtctcgctctgtcgcccaggctggagttaagtggcacgatctcggctcactgcaagctctgcctcccgggttcacaccattctcctgcctcagccttctgagtagctgggactacaggcgcccaccactgcacctggctaattttttgcatttttagtacagatggggtttcgtcgtgttagccaggatggtcttgatctcctgacctcgtgatccacccgcctcggcctcccaaagtgctgggattacaggcgtgagccaccacgcccagccaacttggcacatttttaaaccataaaaatgtcagctccttgaacttcactacttcaccaaagaagatacacaaatggcaaattgcacatgaaaatatgttcaaaatttaaaaattagttgggtttggtggcatgcacctgtagtcccagctactcaggaggctgagttgggaagttgggaggatcacttgagcccaggaggctgagctgcagggagctgtgattgcactactgcacccccacctggaccacggagcaagaccctgtctcaaaaaaaaaaaaagaaaaaaaagttgttcaacattattagacattaagggaatgcaaattaaagcaacaattaaatactactacacacctactagaatggctaaaatttttttgaagtgataatactgagtgctcgtgtgaatgtggagcaactggatctattgaacgtcgctggtggtgaggtaacatggtacactggatctattgaacgtcgttggtggtgaggtaacatggtacagactctctggaaaacaatttcgcagtttcttataaaattaaacatacattaaccatacaacccagcaattgtactgctgggtatttaccctagagaaataaaaatttgtgttcacacagaaacctctacatgaggccaggcacagcatgcctgtaatcccagcactttgggaggccgaggtgggtgaatcacttgaggtcaggagtttaagaccagcctggccaacaaggtgaaacgccatctctactaaaaatacaaaaattagccgggtgtggtggcctgcacctgtaatc

SEQ ID NO: 368 - DNA, 174781 bp, Homo sapiens
gagtagctgggactacaggcgtccaccaccatgcccggctaattgtttgtatttttaggaaagatggggtttcaccatgttagccaggatggtctccatctcctgatctcatgatctgcctgcctcggcctcccaaagtgctgggattacaggtgtaagccaccgcacctggccattattatagtttttataggttagaggagatctctgaatctaatttttacaacatgattcacatgtttactgttttcagagcaagttgttagagaaggattgctggccagcaatgtaaatgttataaaaatgtttccaaatttaatttgcaataaatatctgacaattcattcacattttcaatgtcttatgaaaatatatttatatatgaaaattgcgatcataataaataattttccgaatgattaatcacatgttaaaaatttcaaagaatataagttcctctaaggatttaaaaataaactgtttcctttcaagaaagcataaggaccaaatttcttaaccttataaaggaaaaagttctttattgcttttaagtccttgatgaaagtcattcctggagattataagattattttcagaatgactttccttttaaaaactgtaatttctctttaatttctcactggaaaaattataaaaggtgcctcagtctggattacaaattgggaatggcgagttatttttgcatttctctctttcatatagatgttgcaaaaattagtcagattcagaaatctaccctaagctataaaaacactacacagtagcagctgtacgggggaaaagtatgccaatcatgctaatcatagattttctatgaggtgagagtagatgagggaaggagaattgctagactgaatggtgactgagtggcctctgctactgagcatttcaaaggggcagatataaccaagggatggggatggttgttattccactttcagtgtgtgcccgtctgactcattaactccctccatcccccaaaacttcagtaaaggcattcacacatggcttgggtcacggtacttcagaagagtacgggatgtcccaaagggtagtctggtgtggaaaatggacagatgagcagggggcatagaagggagatcaagctttcatcagaaacaagaaatgacagagaaacagaggtactcccacagcaatccctggagctactgagaaggatgttgaacttcttattgtacttgggttgatggtgagtcattcttgtctaaagctataaaaacaaggaatccagcagaggctggagatgagggcatccatttcctgacatatgggttatactgataacacctttctatacatacacacttagattgtagagttggtgtgtacctgtattgatacatacacaccaactctgagccaggccagtcactgttctccgagttacagttttcaaatttttaagatggtcacaccaccacctgctctccccatccaacaaggttttggaaggaaggaaaaggcatgtggaagcactttgtaaagcacaaagcataataatcattgtaaggcattaaaaggcagctctaggctgggcgccctggctctcacctgtaatcccagcactttgggaggctgagggaggtggatcacttgaggtcaggagttctagaccagcctggtcaacatagcaaaaccccgtctctatcaaagatataaaagttagccaggcctggtggtcacgcctgtaatcccagctactcaggtggctgagacacgaaaattgcttgaacctgggaggcagaggttgcagctgagatcccaccattgcatgccagcctgggtgacaaagggagactttgtctaaaaaaaaaaaaaaaaaaaaaaagtcagctctagtagaatagaaaaaaagtggaatttgaaaagtcaagtttgattcccaacttgtttgctttactacttgtataatcttcaagaggccattggtttctgtgaacctagtttcctagtctgtaaaatggggattataatacccattctgcttctctgctggtacctttacatagtaccagaggtaataatatgtaacaacactatgtaaacactcggggttcatataaaaataaggtatcaaatggtctttcttgcagacatatttaataaaaacctataataaaagcattcaaattttgttctatataaaagcaaggagcagaagcagagggtgtccccatgaatgaaaatttctcagaatatcattgtctttttgaaaagtagtagtgcactggactagatattacactgtgaatgatggctcactcacactattttacaaggattgctattaaaggaagtcatgtgatttaccagaattgttccgggctacataatattgaggacaagtcctgaattgaattatagcagtaggagcccacatagtagcattaagaatatagttccttacagtttagatcattttatgagacaactaatcaattttcaacaaatgcgtctgcagccactttcccccaaataatcttcattgcaagagataattttttcagaagtattaaaaaggggtaaggaaaatataatcaacctcagcagatgatcctaattcaaaatccattccatatgaccaactctgagatgataaaatacaacattttttagagcagcaaatgtttgcatttaggggaaaggggtttagagatcatacttacctcccttaaggataaaacacaacatagatgagaccagaaaggttaaaggggttacccaaagttagccagatcatggtagaccgtgaattgacccccagttctaatgaaaataatactagactttccagccaagcgtggtggctcatgtctgtaataccagagctttgggaggctgaggtggttagatggcttgagctcaggagttagagaccagcatgggcaacatggtgaaatctcatctctaccaaaaatacaaaaaattagccaggtgtggtggcctgcacctgcagtcccagctatctgggaggctgagatgggaaaatcgcttgagccagggaggtggaggttgcggtgagctgagatcacgccactggactccagcctgagcaaacagagtgagaccccatctcaaaaaataaataaataaaaataatactagactcttatgaattattttcttgtacaaagcagtaagatgtttacttacactttcctacacctaccccattcccgcaccactcatttcagaaaggaaatgcgcagattttctcctgtaatgtctgccctataggctgttgtgatagttagcaagagtgggagcctgtggaaaggcacggcaagagcagctgcataggtgtgaaccctgctgttagttgaaagtaaaaggactagggcttcagcactgtgcatctctttggaacttccttactgagccttcagacactctgaggtcggaggctgaagggagtgagccatgcttcctgcagccatggtaattctcagtttcagcctttgcacagtggcagctgcaacacagtcatctccctgattcaccctctgcccccatttttgcaataaaacatctgcttgaaaaggagtaaaccaggcaggtgagttggatagtgctcaaattacatactttaattgaatactcatttgtggaattcaggtttatgcaaggtattaaatcaggaggtaggagacaagagttctgatctctgcttcagtacttacaagccatataaccttgggcaagtgacttatttctgagcctcagttgattaatctttaaagtggggataataatatcttgtttgcttaaaggcaggggaatgaaacagaagcagctgttaaagatcccttctagattctagaaaattaaagacaatgtgagcgttcctcaagtaagggagtcatttttagtagtgtatttcttagatatgatctctgttatagagtataaataagttcacagctctttttaactattcaagacaactgttcagactagcaagaagtcagggtctccctcagctccattgttgacataaggtgtgcctataaaagtgctatgcagccttatcttcctcacacactcagctatttatcccgaagcaccccattaatgccaggatgtctaatccaaaaggagatttgtatcttcaataaagagttatttccgaatgagaaagatccatacttcctgcctctgtattgcagctagtgaatttgggtcactggtccattctcctgttgacttcagctgcgttctagatagcccctcccacatacaccactgtgtctgcaccataatctccgggagggaagagaaagcttcagtgctccttcttgcctgcagacttaattagggataatctcaaagcattcaaataatgtagcgtttcaataaggacagttattttgtcccagaagcctccttagtacctatgcaaatttgtccactgcactcccaagccaagttccctccccacaaaaaggcaacgggtacctacattccttttatccatcaagataagaagggacatcccaacacaaagatagcttggcagtcttcaccactaaacattgaggcagctggcaacaaacctctacctaaccagacaagttaagaaatttgtcactctctttagcattgatgtcctgaatctttttcaataatgagttttctgtccagttctctctatcttaacatagatgggaggatggtttctgagcaagtcaattgcagatctagaaatggatgtgcatgtccttgattctctatgatcattgctgttctagctatatattcaatgcagagcttgacattcaaacttgcataggcatcctctttccaaattaaaatggacccatcactcattagtgggggtgaggtagtggcagtaccaaaggatgtgtgtgggaagggcagcatatgtgcttctgtactctttatcagctgcccccaattaaaaacaattgataattctttaatatgacaaagggtactttcttaatcttaggtcaagtatgaacgtgggcaccttataccaagttgatatttgtaatgatcttgtcactccctgcttacgagcctttctccctccacaatggctattataatcagagtagaaaatgaaagcttttattaggcataagaagttcaatgtgaccagaacccagtgatgtagccatgacctaatcttatattactctgtgtctagcatgtaccagtctttaaaaaatgctcacattcaccaacacttcctcaaatgaggcttttgaatccacctgaaatttgcttctcagtgatttttgctttggctgactctttctaggcattcaggcttctgcttaaatgtcacctcctccaagaaggcttctatgaactcccatctgaactagttctactactcctgtcactccttcatattatgcaactgtttgtctatctccccccatcagaatgtaagctccagcaagaaagacactttgcttatgttgtttactgtatcaatcgggatccgatcaagagagaaaaacagtaatttcaacaaggaaagttcaatataaaaaattattacctataacagggaattggatcaaagggagattggtaagaggtaaagagagctctaaataatacagaaatagagatataaggaacagctacttactaaccctagggctgagatacagcatctcaaaaagagctcctccaagacacagacacactcttagggctggctgagatccagactttgctggagagggcacagttgtaactttctgaatagcaggagagccctgctagaattctgccttctggaacttgctagaaatccacattccagaactcgttggaaatccattctctggggttccaaggaaagctgctgagggaggtgactcattagaggcacttgctccaaagccacctaaggggcttctggaggaagctgctggctgctgggtgctgctgcttgctacctgtgctgtaggaacctgcccagtatgcaaccagagccaggaaccaggaaaccaaaccctttcctcctgcaatgtctctccagcgccttctattgacctagcttttttaacagctggaaaatatttaaagggctcagattcagtttcactaggcaggcaatgaggatgaatttggagctaagaggcaacatattaataatagccacttttattgtgaaatccccatattctggcacatagtaggtttaataaatatttggtgaagtaataaataaatgatttacatctaaccaaagtgaaaagcatgcttggcatatgtcacttcaagattggagctttcaggcctagcttttaacatgaaagttgctgccaagtgcctcccacatgaaaactctggaacaccccacctaccccccactctgtggtagggataagacaggcctccagataacatcatagcttggctcaacagttagcgagaagtgcaatgagagaagcacagcagagaaaaggagaaaaagtggccatgagccccacttacagtctgtgttacggctagggctgggccgccagttgctgcatttgcatctttctgagacattgaggtgagttacatagctctgccacgtggccaaaatgtgaaacacatccaagggctatattttaatacagaacttaaaaaataaagaaacatcttgacttctctagccactttcctgttgacacaaaccatcgagagagattaggggaaagatccttgctataagtgatctgatatttcctaacagagcaaagtttcctctttgtccactgaccctttcaatagttcttcgggttctattcttagaattctcgtttcctgtcctgagagaaaactgcacagaatttcaataaatatgacccaaatgatgtggaaacttcctataaggatgcaatgaggtattcattcattaatgccatcaacaaatatttactgagcaccaactaccagacagtgatggcagacataatttggggagtttggagtgcaactgtgaacacaaccaggtccctgttctcatggaacttgctaacattctggctaaaatagagaacatggaacttcctacagaggcactgtgggtgatttcacaaaccattgaaaagctctagtgggagcaagcaactaaccaaccttagaataaaacatggttgttgctggtgttcttagaaacttcgctgtcctcgtgtgcaaattgtatcactaaagtcttctcacttttgattcttgggaaggtttcagggcagggctgtctaatggaaatatgtaagcctcataatttaaaatcttctaggaacaaagttaaaaaagtaaaaagaggctgggcacggtggctcacgcctgtaatccaagcactttgggaggccgaggcggacggatcacctgaggtcaggagttcaagaccagcctgaccaacatggagaaaccccgtctctactaaaaatacaaaaaattagctgggtgtggtggcgcatgcctgtaatcctagctactcgggaggctgaggaaggagaatcgcttgaacccaggaggcggaggttgcggtgagccgagatcgtgccattgcactccagcctgggcaacaagagcgaaactctgtctcaaaaaaaaaaaaaaaaaaaaaaaaaagtgtgtgcctgcagtcccaacaacactggaggctcaggcaggaggatagcttgagcttcagagtttgaggccagcctaggcaacacaggaagacccccatcaatacaataaataaatagaaacagacaaaattaattttactaatatttttaattgagttattcaaaatatcacaattttgacataattataaattattgagctgcagttttttcacattaattttttcaaaatgccacatatatgtgtacttacagcacatctcattttgaattggacacatttcaagtgcttaacagtcacatgtggctaggtatggaacagcagaggttcagaaaactgtcaaaaggacttctctgtcctcttattttggggatggaggcgaaaatatttgccgaattgaaacattctgtgaactttggctctgggtttttagtatgaaattagaggcaggtgaagaccaccatagccttcctttgcaccagctcactacagtggccagaacggaaggaggttcacagaacgtgctaggttggacattaagtcaccgagtcatccactgaggaaagggatatcattaagaagaatagttttccactaacgccgaaccggcggcaccatctcaaccaacaggtcaagttacagtaggcaagcacgcatagaaataaacgtctaaaacccagcctgttacattagccaacactcttcttgactttttccgaattttttccctgtccccaagattagccgctcgctagaaaagactgcgagcctcagcagcctccccttgaactggggcgctgcctccagctggacacggactaaggatggaaaggcgcactgacggaggccgcccccatttcccaggcccctccctaggggtgcccctcctcagccatggctgcccctttctctcctcctccagcatctgcccctggggccacccccacctttccgccatctctcgggcccgcgtggcaccctgctctgtttttaacggggataaacttgacttgcttctccaaagagcgggaaaaagaggcgcagtcttggtactgatctgggggagggaacgtcccagggcgcgcaggggcgttttctacccgtgccccgtcggcctgctctgttcagtaccgaccgtgttcggggttcacgtggcccagtcggcaaagtttctttggaggtccagcgtctctgattcccggatcttcagccccacccggagcccccacggttactgccccccgcgacccccgatggagcgtcgggatgcgctttctctccgagtgcctccgggggtggagggagggaggcctgtttcggaactaaatggcaatcacagcccccgcggggcttggagggacgagctccccgcccaccccgcggccccggccccagccagcatctcgcgactccatttctggctctaaacaagaacggggaccgagtcgcgttcacacggaaaattatgccggctccagcggcgcgtaaaattgatgtgaaccgaacgaagtaagatcagcgtgatcctccccctcttgtctcaacaggggtttcggcgcgttacacaaggccgagcttgtctctttaaggagacattggaccctaattagtccgcattcctggcgcggctgcggagcgaggggccgaaggtgtctgggttgggagacgggtgggcgggaggacgagactcggaagaagatcttttgaccagcccccaggctcaccgctccctccaccctctttattttgccgccaccaccaccaccaccaccaacacctaattctgaagatgcagccagggcagcagcaacagcagcagccgccgattctcccagccccacgttactttgattgacagctgaacaaatgttttcccggttcgaacgctcgcgctaaggaacgtcagccaaggcgaagctccgccttgggcgggccatctccgccccgcctccgccaacctcattcctcttcgttaattggtcggagctacaggcgacgcccggcccccacgtgggtttcagctgggttggctcctccccgctggcttgccatttgtcagcagtgaaatgatgggcactaacacagaacggcgattaatgttcagccacctctgattggttggtggagacgcctaccgcaacgggggtgggcggggcgcttggagagctcgccagagcgctcgcatggcgggccggtgattgtagtcaatctggccgtattctcaggcagggtcgcccggggcggactacatctcccgggatgctgcgcggccgccccgcggaagattgtgaatatgtatcagaatgttaatgattagctgctgctaaatttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagtgagtgcgggcggcggggcgcgggctcgccgggtgctgggggattccccgcgtcgccccctgcgcaccgagttgtgtcttttggccggaggggcgtggagagccgcccgaaatcggcgccccgcgccgggagcagcccgcccgccatcacccccaccccccggcgcggtggccctcggagggggtgcggagaggcaattgagttgtagccattttcttattgttgtctttgaagcccctggaagccgcgccgagccgtttgcggtccccgcgccgcgactcctcgagggggggtggcgagcgatgaaggaggcgcgactccgcgcccgggcggggagggcgccctcggcagcggcgctgctgggctggctgcggtttggaagtgcggggcgccggcccctcgcgccgcgggccgccggggcgagcgggcgaacgaacgagccgagagggtggcggccgcctccctcctcccccggcctgaccgcagcccgacgccatggcgcgggtccccccgacgggccagtttcgattccgggtgaggagggagtgggcgcggcgcgcgggtccctgggtgcctgtctttggccggggaggggagacgggactcgaaccctcggggtccggggcgcgggggcctgcgggcgggagtatgcggggccccaggaccacctcgaaaccagcctctgcctgggctgttgggcgcgaggagggttgcgggaggagagttttaatctctctttgcttgcgtgcgcgatgaccctcaccccccgctaacgccgcatagtaggttttctccgtctccctgcttcgcctgtgatgtgggctaattaaatattttattgttgttcttcaggcaccgcatcagcctgctcaaccctttaaatttacaatttccgaatcctgtgatcggattaaggaagagtttcagtttttacaggctcaataccacaggtaacgatattgactttagctgatccttctgtttgcttagctcttgtctccccgacaaatacacacaaacacttaccctcctccttttttgtgggggcgtcacaaaggtattatttttttttctcggtgggcagaaagggcaaatcaaggcctccttccttaggcaggtgtaaataaattaaacatttcttctaccgtaaataaaaagaaggcagaacaatcgaaactggggagacttggaaaacgctgaggccaaactttcgatattgatttattggggccgggagaatgaaaggttgggaagattctggggccttttgacatccttggttctttattactccggacttgattccttctcacttttttctgccattccactgaagagctgagagcccagggaagtcggagtgagcgatttcattacttttatgctaaaaaaaaaaaaaatgttttcatcttatagacgatttttagacttagggtgcctttgagacatttttctttagctggctttttaatgatgcctaattcttatttcataaatgcaagaaccaaaacaaaccactgaacccgattgacactttgcccctgggtggtggtattcaacttgtctgtgtgttttggagggaaaaaaacaagatatcattcataagacatgcttgattcatattttcattaatctctttgtagaacattaaagaaattcccttgtgacgttttggaggacttatttgtgcttgtatgtgcagtcattattgaagtttattttcgtgtttgttttattaagtgaatattcaattctggaggaagttcctgaattaaactgattagaggatttgtttccttaaaacttaattaaaaaaaaaatcctaaaaacaaaaaaccacatatatgatccttattgaaggggcaagtccagactggttccaatcacccctttccccttccctttccataatgatgggggtatttatttaagattgttgatttagttgtttgtaggtgagatttagaatatgcgtttaagagttgaaggatgtaagttaagatcattgtacttagagtatcttatgtcttgaacagtctgaagctggaatgtgagaaactcgccagtgagaagacagagatgcagcggcattatgtcatggtaagaaaaccatgtcacagattcaaagtgcctattagtttggaataccaaaaacaagaatatgtttaaattgctgggggctgcaagatagatcacagtcaccctgccagtgcagttgaagttgtgggaatatgtctattagcaacctgtaattctaggctgttataacttgcctttgacaactggctttgattggaattttcagaaagttcagccacatggggtataattttctgtgctttgtttttacagatcgaaaaaaaataaaaacaaaaccttgtttgttttgtcacaagcaaaaatgtttttgtgttagtggctttctttgttgttttattgctcttgctccaaacaatttttgccagtttttctgtatgctgttaacattgtaaatgtcttattattaaagacattattaaaaaataatgttttatttctttgaaaaggagtgatggataaggaaagacagcagaccatttttcaaatttttttctctttatgttactattacattaatatttgtatgttttcaatttctgtagtgttatattggtttgaggaatgttgtagtctcctgtataactgatgtgttctgccagaatttctatgccagttatactacacgttcaaaaaaccagatctgcttttacagaagtattatgaagcatatttttatgattgtccaagaaagctccagaataacccactcatttatttttctatctagcttttttgctttgaatgtgtgaatatgagcagtacactaacaaatcagaaatcaaactctaagtagcatcaccttttccaaccttcctttcaaaacatcagcgtttgtataaggcattctttgctgttaacttgcctgctgtgcttaggaattaagagtccgtaggataccaaattttcatcagacttttttgatgcatctgcttgggatgtataaagaaactggagatgttaagaatgctgtgtttgaatttaatttttcttagttttgtgtgttttctcttagaatttgtgtcttaaggtggttaaagatagtgatgggctcttgatttattggcataggttatatgaagatactggtttaggtgaggcttttatgtttgtttcagatttacttggggcattttgaacaaactagggagattgtttgatgaaagtcatgcatttaattgcttttccttctttgacagtattatgaaatgtcctatgggttgaatatagaaatgcacaagcaggtaagttatttctttataaccattttaaatgacagtaatactgggacactatgaaaagaaaattgtatgttttgcagttttattctgcaagccgttgtggctacctgtatttaaaagtctgggtagtgaagaaaatgctgttttttcatgtgtggctccccatctttctttcatattatcctaatttttataatttaaaaatgttattttaaaaagtctgaatacatattaaactctgtacactttcaaaagcaggatgctaaattttaaaatcctcttgttattcttctgaaagagttgctttatgtattttgggcattgcaaacttgtcttgtgaaagagcttttcttggaaaatattaaacagtaaaattaaattgtgtggcgccttcgttggcttgatgtgaaagaatggatagagggtgagctgggaggatgaaaatgaaatctgtggagctacaaaagaaattgatgtaaaatccttgtactggtcccctgaggctacttagttgggtcttaccaagaactataaccgttacttccaaaatttgtacagagtaaatgagcctgataggaggatgtgataaggttcaacattgggtcttgaaatctagcaattagttcagtagcaaaaaaaaaaaaaaatgattagtcagaaagcactgagagatacgactcaaacagtcttctttttgtgcaggagactgaataaaatggtttggcttaaatttcctagacagaagaataatagcgggtatatctatctatatatatatatacacacacacaaatatatatacatacatatatatatataaatattgtttggcgatagtaattcctctaggaagcatttatttttagtgatctcctagtggaagcacttcaggtctcatcagccatttcagaataggtgtgtatgtgtttgtctgctgggaaaaagacaagggaaaacttactgcttttcatttcctatttatggtcaaggtggatgtcattactttctaagttgagaaaatatgaaatgagcacatactattaggccttcactatttatggattcctttttgggtatagttattttctacatgctcagaacatcccagatagtagatctttaagagatggctgttagacaataaggcaatctgatgaatagtattggaaaacaaaaagttggaaaaaaatgagacgttgcttacattgaggacttttaatttcagatactgttttactttgtatgctatttggttatgtcaatattagcattatagtatagtttgaatggcctgttgaaattaaattcttattttggcatctttgtcatttctgtttagattagtaatgtaaatatcttctgcttaaacaaaatctgttcaatcttgtggatggacttctcttagttctaccttacaggaataaattacatgagagatattgtttgttaattatcccattacatttcctttgaggtctggatcttgtgtatgtctctttttttgtctgcaccccactccccaaaattaattagtgtctttttaaagattggaccagatgattaatttagtccctttatttctccttctgtatcttgtttaccctaaccacttagtttccaggtctccttgtaccatctacatttctaagaggcacatagcttgtatttggctgtatgtatttctttttcgagggggtatgtgaaatcccttaattttacacattttatactgctataattctgtcatcttcttgtccagctagcctcaaatgccatccatttaaaattgagaacagtacattttccctttttttcgtttccttttaaattcaatcatatcaagaatcctgagggcagtttatcacattatgaaatacagacagccctgcaaaccacctacttattatattttctttctttctcccccttaagcatagaggcatatctgtctttatttgttttcctaggcagacagccttagttcctcttagcctctcttccagatgtactcgctggatacccttgtaatggaaagcagcaataatgcagggaagttgccctgcggcataattgggcctagttctcaagatcgggttaggtttattcacttattagatttgtgtctcgaagggttcaacagtaggagtcccgggagcccttggaagtaccctagtaattggtggccctgatatttgaaacctttgtgtattttttggttaacgttcctgttcttcttggctgctgctagccacagaatatttatttttagagaaatttttcattggaacagaaaatggtggttgtgatgcagtcatggctctgtgacttagcaaactgataaaaagataaaagtatgaagcaaagacaaacagggtggaggtcggtgttctccctcctaccctttctatgtggtgctcatcatcagtccccctgtgttgattctgatagagaactataaaatgaaacctatggggaatttgtcattctgaaatgaaagctaatgtaattagtaccaattaaagtacatttagtaaattggatttaatcttaattaagcctgcataatgttgccaatttttaacaattatgtttgagaacataattaatttaaattttggtaactgagtaaatagcattagtctggtagaattagtggattttttttttttttaaaggggaacttggtgatatgacgtggaattggaacataaaatatgaatctaaatttctggtaatctttaggattgatagagctaagcagatgaagcaaaaaaaaaaaaaaggatgaagtattctaggctataatgggaattaatgctgtgccattgtctcaagttctagcataaaagtgaagatgacaaataggacatggttagaaatggcacatgttttagtgtgacgtcttcaaaatggaatttttaaaaatgaaagaacataggcccttattccctaaggatttccctaagtgtatggtttttgttttttgttttgtatgagacagctgacccagggtttagttgttaagtttttttgctgattgttcttctttgtaaatacagtgtggcttctaaatgggttggtggcttctaaatggcacagtggggtgatgcatggagttgatagcattactaaatgctgcttcttcccatctttcacctgtaatgctgtcattaaagaagtcctcactgatggactctgacagcagtggttaccattctaaaaagtgagtattggatatagattaggaacagtaggtatgtgaattcaacctataggaactatatggagatgaacataccatcttttgaaaaggggagcatgagaacatctatgacttccttatagttagtattctacaatgtgaaagcttcttcatttgaattttagtaatcatcaggaaattttagaaatctaaaacgcatagaatctgaaagtaagtactgcacatttatgtatgttttatgtgtgtatttttatatgtgtgtgtatttgtgtgtgtgtgtgtgtatatatatatgtatatttaatcaaagcaagaaaactcctgtttcacttaaagccatgtaaattttattacgagacttgggccacaaccatttgagtgctgctaaaatattaattgaatagaaatgaaagggccttgccaactgataggatatcataatcatagcctctttggtcgatggtaaatgatgataaatgacattaggaaccttttagcaaactgtaataactacaaggagggaagcagtatggatttgcattgtatctgataccctctagtaccaagtggattgccaatactgcttgtttagcattttctaagggcaataagatattgatttctgacttacaaggaacagctctattttcaccattgaaaagtattgcaggttgttaagaagaaattgacttgaagaggccgactgctgcccatcatggagcaaataaagcaaaactgccgaagcatggtggagcagcgagacgggccctcagcaatttgttgctattaatttaccatgctcgacagcaaatcaatcggcatctacttcatctgctggagaaaatgctgtccagggcagataaaaggctcggcatggtacagagaatagactggattggccaaaagcaggctgcagttaatgtgtaaataagtgaaatcaaggccactgttgcagaggaagctgttgttaattaggttggtgttttttagtgaactattttagaaagcagctaggatttggagagtaagaagagatttattgagattgaagtaatacatgactggcatgacattctagccttgagtgtacttgaatctagggtgcagtaaatttatttggggacactgcttgctatgaagtttgttgaaagttcattttagaccacatttcccttatgataactttttttttcaaccttgccagttttttgcacatcttctgtcttattgtgtactcttagatttagaagagtagatggaggagtaggtgttttagtatggaggcacaaatgtgtctgttatattcttacccagtgcctttttttttttcagagataggtataattgaactcttgtataataatgagagtgaactatcatggaagatggggtgttctagctgaaagtaactaataaatgaagattttgctgacagaactttatcttgcttcagaaatattaggaaataacaatctagagggcctgaatagtgggtagatactactagattataaaatcttaaagatgacaagtgaaattttgatgtctgcataaacttcagatacaattataagactatgtgtgtgggggtgggaagggttcttgtgtttttggttttcattaaggtttaaagccaccttttctaatttaagattatttacacgctgataatattccacaattaatgttaacggagtgaagggtattggtggtgttttttcccctttacctctcatttgggcattttaaaataggaggccaacttcatttactcctgtttagtaaatctaaatgagtgtaggttttaaattagattttttcccaaaacccttcagaaggtctagtattagggcagttgataagtaagtggaagcaccttgggcaggacccagtgacctgtccttttacttattacagcacctgcacgggaagcagatctggaggatgaaatttaacctgttacagtgtgtgtatgttttagggtgtgtgttttccgaatactgtggggagttccctttttccttctcccatgatggattcttttgtctttctagagataccataggaggatatctggatttttcacctaaggcagtgattcttgagtgaaattggaatttcctttcaatagaagtaaacatttattatatatctggcttgcgcttaccactggtctgggcacactgccaaaattcttatcgttagttctcataatgatcctaagacagggattatatccaatcaaaagttgattaaacagggtcagctctgcacaaggtgatacagctaatagttggtggattcaggacttcaaataaatttatgtgggaggatatctcctgggagatgggtttgctatgggttagagattcaggccccagttcattcctgaaatagagagtccctgaactttaggctcatacgcagaacctcttgagttgggggattctctgcaactgcctagagtccatggatggctcagcctgccctctgcttgcagactgctttcagtgggtgagagggtgaggttgctttcactcggaatctcccacatgtgggctagggaagctgcttgcttatcaagatggaatttgcttcctccctaggcaacctatttctcatttgtttacaaacttgttcttctctttaacttttatcttttcctgtggcttatgagagtgcctacagacaaggggctgtttgttaatcaccatcttgtgggcttttgaagggggaagctgggaggggaaaatgtgatgttttgtagcctctttgtagtttagaaagaggttcgtcgatgcaggaaatcacacaactcagttttaaatgaaggcagatgttttgcttttactgttaaaagaatttctttgcagcattcaaacaaaaggatagttccttttcactgccccttaatccctgctggatattatttatttgtatttattattttgatgggcaaagttctttgtatctaggtatatatcactttgatctgtgtaggaatgatggaccggactaatgagctacatctctaggtgctgttgcagcactggtgaaggagacaatacaagcaccagcccattgttcttcacattcttcatttaatctttgctttcctagaatacatcttttttatttcttcttttttttcttgtgttataagataggtagaggaaaccagttgggaattaaatgtttaaaaaatgcatttataagttatttgtgtttgtttttaatgtggctttttttttttttttttgcctttgatgtgattcgatggtttggtttaccacttctggacagcaataatgtatttggtggctagagaaaagagggacagggatgtgagttctagaaggcactttcttgatccctctacacaccctcttaaaatgactccagcgttccagcaatggtggtaggttcagtggtcctatactagctaagttattaccagttttgtaagctgggctgttggagagaagcaggggggcagcacatttacgcatgggcaatggagtatttacactgataatgacagtttgcaaggcttaggacttgttcaaagtaagtatactgcgaacagtttatgaaattattactctaaagaggaagggcctcagaagttttagtcagaagcaagagttagagctgttttgtctttgccttagtaatagctctcagtggtagttgttttctatctatggagagggatttagctggcattcatcaccacaaatctatataccctctctcttttcattggaacttacccagcatttatgccaggctgttgctatttctatatcattgacccaaaacttatccctggagagctgcacgtgtaacccttattccatccaggggtgacacatgggcagggtgtggattttcttagctggttcatcaaataagcagaagagaagtactctgggataccccttaggtactctgtcctctggtgagtggatcgcactgtcatctcttttgaggatttgcccacacacatttcaagaattgtatggtggaggcagcttctgcgtttcacggaatgaaaggataacttctctcccggtgcgagacaatactctatccccaacctgggctggctgtggtgtgcttgggacctctgcagggccctgttgcttgcagcaacctaggcaaagtgagaggttggggaaggaggaggggggatattggctttttcatttcttagcaggcttatttaactcattattattattattattattgtaatttgggttctgtccttattttcgaactatgtattctgtttctgaaggtctgtggatgattttggttattgaatttgaaactgcaagaaaatataactggaaagaatagtcatagtagaaattataagcactagtactctgtaacaccctttctttacagagagcttaaggcattttatatgttctctttaatgttccttatgttctgtgaagcaggtagcaagcttggatccatgtatttatttaaatagcttctgtcagtggagtacccaacagtttgccaagcagtgtcattctactggcctcctttaatagataacactgaggcttaagggcttaagagactagcccagtgtcacagtcagggaggatcagcacgggggtggagataccagagttcacgcaggtcagcgaatgcgcctgaggttgcatagtgagagtcactggcagaagaggaaatagtaggtttcttgacttcccttccagggctcccttcgctgaccatgctgtttccaaacagcaaataacatgcttgtttctatgatgtgtttggctttctgcaacatgaggagcatggtgatgctactggcagtccaagagtgttacaccgtcatctctagtgagagatctgatctgtgtttgtgtttgaggacagctcctccctcccctcccttctaccctctcattgcctctgccctgcccaaagggagtctaggatcagcaatattgaaatataaagccaaggtccacttttagaaaagtgcttgataaaactggctatctggcattcctgaactgtaccatgcaaacacactgtgttagatacttacctgtttatttcctgtctctctctcgtgctagattgtaagctccatgaaaacaggagcttttattgtttactgctgtgtacccggtgttgagccctgtgcctatcgcatagtagatgctggtgcgcaataaaatatttggtgaatgagagaatagcagttagagctagccaagaatatgtgtgatttaatatttttaagggtatattaggttgcaagatagataacaaatactgaatctcaggcatacttaggtctgtgttgtctactagtttgtggaaaagtgacacttggaaagaggaagcaaaagcaaccgaacttgctgtgcctttgaggaacaagttagtatagctaaagtagaatgtatgtattttagtatgttgagtctgcctttttaaagatgaaaacatgaatcattccaaacagaatttaaaattcagtttgaacgtcactgtatcactagtcagtgtttatctgaataattcttttactattaataggtctgtgtacctgtggtttgaatgaatgtggagcaatatcgatcttgactatattgtgtgtttagctaacttccctgcaaatcagtaaaaaatgcaaggttttagttcttttcaagggacaaggaattttgaaaatgtcttaattttttttattagtagagatagtataacgttgttgaaagaatagtaatcataacagtaagcaattttagattgcttatagtgtcgataatatttcacttattcttacaacaatcttatgagattatagtagtagtattatttccattttacgtatgttggggctgagacacagagagcttaaatagcttgcttgaaatcagctagccggtaaaatagatcttgggtttgactcaaggtcagaacgctggtatgacagatatttctgccttattccagttgatatgtttggaatactccaccatcagcatacttactaccttcccccaaatgcttgactgattccggagcctcagattctagttctggccttgctagtcaccagctttgtgatattgctgagtaccgtacctttaagggccatgcttttctcatctttaacttagggcgtaagtgaacgcccagatctcttttagctcttttggttaaaatgaccatttcagtttggtttgttgctgtgatccagtgaacagaaattgaatttttttttttcagtcttagaaagtctcttttagcacttattttcagaatttttaaaatccaaagttacccaatgtgcctaggagtagaaatgtatatttatatactattaatactttattttttataaggtactttctcatccttttttttcatgtaaaccccaataataaagcattccccccgtcctgtggatgaacacagtgagacgcagatgttagatgacaaagttcttcacttaattagtaggtggtttacaattcactgattctcttatggccagcgttcaggctaaagtaatgttgacacagaagtagagcaattttcataaaacatgtaatataaaagtatatataacataaaatatatcagtatgtctttaaagtgattagtttttgtacttttcctttggcatatattagaaaacttaggctgggcacgtggcttacgcctgtaatcccagcactttgggaggctgaggtgggtggatcatgaggtcaggagatcgagactgtcctggccaatgtggtgaaacgctgtctctactaaaaattaactgggcgtggtggcgcatgactgtaatcccagctactcggggggctgaggcaggagaatcacttgaaccagggagtcagaagttgcggtgagccaagatcgcgccactgcactccagcctgacgtcagagcaagactctgtcacaaaaaaaaaaaaagaaaagaaaattgtgtgacttctgaaattgtatgaattataaagtgatccaataattttcttccaaagatgtgcaaagggactatgtagcagtttattacctgttgtgtaattagctccgggggttactcttctagaatctaaggtaggtgtcagtttctctagcttgaggtaaagcgtgtctgtaaactgtggcttacagtgagcttgacatctcaagtcctcaggactttcttgctttgtcccatcaaggaccctttccttagggaagataaattcattgtaaataaatgacttaatcataagtagaagaagggagaaatgtttaatcttggccttttggagtttataaatcaaagacacagtagagatcaagttccttcattaaagtgtagttccaaaaaggaagaatgtggttttggttttaaaaaatttttttatttttaatttttaagagtacatagtaggtgtatgtatttatggggtaaatgaactattttgataccggcatatagcatataataatcacattcgggtaaatggactacccatcaactcaagcatttccctttttttgtgtgggttagaaactttctagttatactcttttagttacttttaaatgtacaataaattattgttgactgtagtcactctgttatgctatcaaacactataccttattcattctgactatatttttgtttacagaagaatatgttttgttcactgctggtaccactagcacctaaaacaatgcctggaatatagtagaagaaatgaatgaatgaatgatggaacagctaaaggagtggtttaattttttcattttattgcatttcatgtagcatcacatattctgagtatcagccacctttatataagctgtcttcgtttctgagtgcttagggagggcctggctttatgctgagcaaaaaaggcctagataggcaatcagagagtgggagttcttatctcagtctgctacaggtccttgagctgctgattggcatttttaaaatttagaattggattcatactttgccagatgatttatttctaagatatctttcaactcttaacatcatatgatgtttaaatgaccagcttaaaaataaaattcatccctacttccattgctcggtactataggcatgccattttagtaagttaagttttaagataatttttataagaggaaatacagccaggtttttttttgtttttgtgtttgtatttttgtagaatctcactttgagcaatgttaggctattgtgtggacagctaaaacaatcctaatattgccagtgtttcacaacctagaaccatctgctgtgttgctttttttgcagttgtagctgcatcttcctggtccttctataggctaagagcacatcagtaagtacatatagttaacagatttttcatatgtatatcttgggcaagtgttagtgataataagagcagttaaaatttatcgagtgcccactggataccaggtaaagcactaaatgcttcagatgtattaatttgtttaatttgtaatcttttgaggaagggatctgattatccttattgtgtatgaggaaactaaggtaaagagaagctgagaaatttgcccagggttatatatagctggtaggttacagagtaggggtgtcaaggccaggcattctggcttgagaacctacattctggttttgaaccactggcaataaatgtctcataagtgactatggtaaacttctttgtttatccttgcgtgtgtgtgtgtgtgtgtgtgtgtgtgttttgagatagagtctcgccctgttgccaggctggagtgcggtggcgtgatctcggctcattgtgatctccgcctcctgggttcaagtgattctcctgcctgagcctcctgagtagctgggattacaggcccacaccaccactcgcagctaacttttttgtatttttagtagagacggggtttcaccatgttggccaggatgggcttgatctcttggcctcgtgatcccacccacctcggcctcccaaaatgctgggattacaggtgtgagccaccgcgcccggcctatccttgttttctaaatgaaaaaacaaatcgtctgcttctgtgttctgtacacagtgagcttaaatgttaaaaataatagctggtatcatttgggtattttgttttgcaaattaacacactagattagtggactcattcattggttcatcttttatcacagattctactgtttgtccgtggctggataaccacaggcctctagatatttttgtacctctgactgtgagatttctaaaacaggcatggcaccttcttttataaccacgtgtcacatgggaatgttcagggaactgtaaacttttgagtgcctgcctggggtggaggagagatggaggttcttggctgggtttgaaaggttctatatagttctggaatttatatgcataattgtgtaccttttttgtgggggcagaatccatagcccttactggttcaatgaggaaactggaacccaaacaaaagaattagggaggtactgtgctagagcagtggttgcaaactggagcagttcctttcctcagaggatgtctggcaatgtgatgatatttggggttgtcacaacttggagttgctactggcatgtagtgggtagagtctgggatgctgctgaacatctgcatgtacaggacagccctctacaacaaagacttagctggcctagaatttcagtagtgccaacactcagaaactctgctccagagagaagaaaatactattaaattctgttgcctttttatggcccggagagttataggtttggggcataatgacctctttgagtagagaaaggccaagtatgagcattgtctggcttctctagttaagtcaatttgagagaatcctttaaacgtacttaaccttttcaggttttttcctccctttcccatgatgataagcagagtggggttggtggtagttaagttctgaatagagatattacatgatcctttgtaatcttccttttcctaaagaagggaccgtgataaaccttctcggtgggagggacttttcacacttaagttcagcttctcactggaaatcagcttgatttccactgaaaacatccagatctttgtggtgctactactgcgcaaggcagaagacattttcagtggaggtattggattggcagaaatttctttatgtgagacccattagtcctgtcccccatcgaagtcactagaattagtcttactccttgtctaggtttttcagaagtgttgccctttattagccttcctttgtccatgctgggcattctcagtcattttaaccattctcctgagacaccagtctggttggtaccaagatgtatatgatagaccgggctgcctgagaattcaacgtgacgtttctggcctgattctacccaactgaggcattagggcagatcttattgcaaagtagcccttctgctctttctctttagggcaaagtacattatatttgtctttgtcatgtcctgatcacactgtaatacacaaaatggaaccttgagttttgtaagtaacctgagtccacaatatgggttcgtttttatttttgaatgtgtgggcgctgatcagtgaacctgttttacttggacttcttttcccccaacaaatttcactatgctgcgctatgaatgtgggtggctgttttaaaggcttttgattttgcgggggacagagaactgtttggaaatgtggttttacctctggctagcttggttaacccccccaaaatatagtcaacctaaagtggctagtgaaaaaacaatagcagttctgtagctgcttgtttgcttgaacattttttgggtgagctaggggaagacaaaacacttgtttgggcttcttaatgaagaaattgtgtccccaaaattccaatgtgtgcttcttaagcttccactcttctctaggttctgggcatggggaggtaaactttggcacccctacttgcttgtaagttttctctttacatttcagaggtgtcagatttaggagaggctgcttgtaagttttctccttatatttcagaggtgtcagatttaggagaggctgcggcaggcaaagtacattatgtacaaaaaccttccttttgtaatatgggagctcatttccaaaggctccatatggctagcctaggaggctcatagtaaagacctgctttagttgtaagcagagctgataggagggtttttttataatctaagcaataatttttaggttattttgcatcagtttaggatgcacacttgtgaggtggtatttatgccttcttcccagattagatttacaaatcccactttcttaagatacttgattttacattttgaatcatgcttttttgccactttctttctgtttgaggctcaccgtgcaaattaactttctaaactgaaatatttagcttctcaaatggaaatacctggaactggatttattataaaggttaagaagattataacctaaatacttaaacatgaaaaaagtaacttaatcttcatgagattgttttattctttcattgggagggttacttggttaagagccagtagtcctggtcacctcagagggaatgcaaaggctcttattctttcatccagctaatgttaattaacctcatactatgtgcaggttgctttgagggctagcagttaggaaaggtaggaggcttgcctccatggagaatctagtctttttacttcatttggaccactgtaaaaaatataaagcagtgcagtggatacacagttgtgacataggtggaagagaagggggtctttctggctccttgagtgattaaggatgctgttacggaggaggtgggcacagtttagtgagacctcagaggatggggagcacttaggcaggttgaaaggaaagggtaggattccaagtggaagccacagagactggaaactgctgtgcatattcaggctgtgtttagtgtttccagctttattgagtggtagaggagagaataattgggaatataggtttgggatgcattatagaaggccttgaatgctggtggtagtgcttgggctataaaaagaaagcaaaggggagattaatcagtagttggtcaagggaccatatctgttttgctaatttgttcagcagctagcatgaggcctgagaacaaatgtcagtgaatgttgttgaaacgatttgagtggagaggggcgtgactggagagggacagggtggaggaagtgaagtctgaactagggaagtagaactggaaaggaggaatccctatgacttgacatttcattgggtgaggagtatggaaatgcataggaggaaaggccctaagacattgatgtctgcagagggacagagtcatggtaccattcattgatagaaaaagatactttagaaggggagaacttggtgttgataatgctgccaggtgtggtacctaggaaggagggagtgaaagaaggaagaggaggagggaatgaatgagtttgttgcttcttttgctttcgttcatcaccttactttcatctctcctgccaaatttataatccttccaagaacctcaaggattctttccacatcttctgtataccacagtggactttgccaggcagccttttgtgggcatgtgttttaggaactatttgacgtttgtaggagtgtggaagagagtttcttcttcttcttcttctttcttctttcttctttcttcttctttcttctttcttctttcttcttcttcttcttcttcctcttcctcttcctcttcttcttcttcttcttcttcttcttcttcctcttcttcttcttcttcttccttctgcttcttcttctttcttctttcttcttcttcttctttttttttttttttttggaggcagggtctcactctgatgcccaggctggagtgcagtggcgtgatcatggctcactgcagcctcagcctcctgggctcgagtgatcctcccacctcagcctcctgaatagctgggactaaaggtgcttatcaccacacccggcaatttttgtattttttggtacagactgtgtttcgccttgttgcccaggctaatctcaaacttctgagctcaagccacacgcccacctcatccttccaaagtgcaaagtgctgggatcacaggggtgagccactgtgcccagccagagatagtttctgtcattttgctcggttactgccattacctttatatagacatagtggaatttgtaaattcaattgatttttaactttttcgtctgtaaaggatttttaacattagaagtaggtacagaatactcaaaattattcttctatcattgaaactctttgttgcagtcattcttttcttccattttttatttcttgtatgacttggccaacaactctggatatcagtgattgtgtatcctttttaagttgagaaatttcatgtagacataaggctgagtcaataattgtcttgggcaactactgtgtttcaaaagaaataattattcccattgttcattatgtccctgatgagctaaacactgaaattacaatagatgctttagtcaatgtgaattatttgtgtgtggttaattttcttctttttttctccctaatgtgaggcatattctgtattttcaacctttaccccttttagacacttgtcttaagctgccttggttgaatgagaacagcagtgatagtaaggaaagttaagatgaaattaaaaaggccatagagtacatttttggtaaaccaaaatattgcttggtggcataaagccacagatccattccaaaaaaaaacgaaaaccgaaatgtggttttgctgtctgtcatgcagtctgtttcaactgtcagaaacatacgttgctttatgggatgtttttttcaagtctgaccgcagcttttaatttccttcattccacccacacctcctaccacacacccatgtatctagtactaatttataggcaatttgaatctaatgacataatcatcagcaagcaaaagggtcagcacttgtggcaaaagtttctttcttggtgtgctaattatcagttctacactcttggaaactctaaacagtcagaacacagtgattgtccttgttcatggacttttcagtctaagttagattgaggcctttaaaagatgggtttgaagtgctttgtatttttgctaaaaacataatattaaagaaaattaaacaatattcagtgaattttagaaagcaaaagaaagaaactcactcatgttcctacagttgtgccttaactgctgaccaggcagaggcatccctgtgtctccatcatatatgctgtgtctgatggagatcatgtcacccaaatgaaaaaatacttttctagtctaggttcaaagggtgatacataaaatacataccacaaaaaattaatgatacaatgaaacctcagatctttaaaattattattgacttattggtaactttacagtttcttcaactccttataggcaatacgatcctaaatatttttaaaaatctagtcctaattcagccagtaacttcctgtgacattggtaaattatttaacttttctgagtctcagttcctcatccataaaacaagggtctaggactggatttttactttttataacatgttggttcccaggcccctgatctgggccttaggcatcagtatttttctaaaagctacagaggtgattttgatgtacagcaaggttgaggaccagcgaactagagcagtgctgctcaaaattcaatgtgcatacaaatcactgaaatcagattctgtttctgtaggtctgggttggtgcatgatactctccatttctaacaaaaagatcaggtgatactgatactgctggtccactgaccacattttgagtagcaaggagccaaaacatctccaaaatgtcttccatttctacattgtatctccatggtatagtttatatagttcatgaagtctgtgtgctgcttgaatgagatctcacatttagtatgttaagattgatagtgtattatcttattatctgcacaacctctctttgcttaagctccatccagactcatgcatctttatttttgtttttgttttgtatttttttttttgggagattcatgcatctttgaaacaattcctcatattgaagtcattttaatagtaccttgctttagacagcctgacagctctagctggtggctggtgggttgttatatttgctgtagagaagagggttttcatttctttcttcttcgttcactccactccgacagatacttaggcttttgtattgtcacctttcctctcttcaacaggtaccctccccatattgacctcttgtattttggggtaaatgggcaaaaagaatcatgaagtgcattttgttttaattttgttctcatgcatgtacattctctgcagaaaatttattaagcgtaagtttaagggagcaaaactccaacttaaagctcaaacatacttaagctgtaacattttttaactctgtactttaaccatatcacttggcaattgtttttagaaataagaaaatactatttatagtttgtggttctttatttttgtttgctgcagctcaatctcacattggcaggcatcatgacccagtagaaagacccctgaatggtagtgtctggagagctgatattctaagccttcacccacccttaagtagtttttgcaactgtagacacttgggttctgtaagtaaaccagggaagagattaaggaatgctccatttcttagggctgtgttggagaatttggttaccttggaagaacatacctatcacctaaagtctaaggcaataagaaattatagtttgcgattggggaatgttgcttcggagcagtgacactcagagagtggtccatggactggtgcaggtctgtgaactatttcttaaagatgggtgaatgagataaggtacttgttacttgtgcaaaaattaactcactgttttcttcatagagaatgtctttatttttaaaaaacaaaacaaaaaactccattgaactaaacgtagttaaccgttatctttttgctgatcggtaacaatgtgggaactagctactttctgctttagaatacttaatcggtcaaaagttgtatcaggttattttataatttaagaatagaccaaagtagaagttcataaaatgtagcctaaaaaataaaaaagtaaatttaaaggcaagttaggttaaagataagaatcaaattcaaggtggtctggacgtatgtagcatagttaagtccaaggcagttaacacaggttcacaagtagtagcttcttacagaagctgtaagaagcactgcagtttgtgctttggttaatgcaaaacttgtttaaattcttctgagtgcttctaaattatctgagagaatttttgtttttcattttttgccatctactttttttttttttttttgagacggagtcttgctgtcacccaggctggagtgcagtggcacgatctcagctcactgcaggctctgcctcccgggttcacaccattctcctgcttcagcctcccaagtagctgggactacaggcgcccaccaccacgccatgctatttttttgtatttttagtagagacagggtttcaccgtgttagccaggatggtctcgatctcctgacctcgtgatccgcccgccctggcctcccaaagtgctgggattacaggcgtgaggaaccgcgcccggccgtttagtatctacttaatcgaagagaacatacctctgtaagtcacaaagaatttttattctgtagtcttaaatttcaggaccatgttattgtctgagaagctttaaaattaagcctgcctcgcctcctcctgcctgatgatattctttatactttactactatatataaaattcactgcatctagggcaagtatctgttcaccaagaaaagaggaagggagatccttcaccagtagcaaaacataaatactgagaatgtcttttctgggtaaaagtgcaagaaaagtagaaaaacagcaaattttctggggctaggcctgtgagctcactccttccaatcagtgaggaggcacttgtcttctgccactgtaccagtgagtctggcatccccatcccactttagatctgttccctagccacctcatggtccttgcagcccttcccctgtgtagtataaattagtaagggatgctttcttaattgagagacagaaagagccctaagcttgaatcgatacctaacaatacagccactcaatttgtagcactatctaatctcagttctgtcttaaaacagaactacttaccttaagggattttattcgtaagcctaccctcataaatatttctgtcagccagatatggggcagccattcttcccatttcatgattatagaaatggagtccagaatcattttggagtttgcttattaaagtcatggtttagctagtctagaaattagagtcacactaggatttgggactgcacagctgtatagttcgtaatatttggtgttcttttcagaatgttttgtcacttgattctgaattcttcccatgcctttccataattgtcccctaaccaaatcttgacacgagcctgtgatttccctattttaatgaatggtaggaagcaccatatcatccaggttttacacactggaatcattgattccgtactcccctggttgtctaatctagtgaagccacatagtctgctagttctccatgtgcagcctgcctcctttccttgctctcaccacggtcaccatcactgaccatcagaccttgttgtcatactagaggctatggtggtctccaggctttttgtctgcagcctttgccttctctgttctcttatctgggcttgctggacctcccggtctacttttatatctaccttttggtgttgggtcattttttagggtcccttctctgaccttggaaaatcctaccagtatttccaatatggctctgtcctcttctctgcttactttgcccttttatttaggtaattttattcactctgagtagatgaatctcagggttttttttctactagcccagacccttcctctgagaccattgtatgtcctcatttgccttgaatgtctcatagatacttaaactcaacaggtcccaaaatgacatagtccccccacaagcctgcttagtgattcctatctgaggaaatgccaccaccatccacccaatttctcaagccagaaacccatagaggcagctgattattgtccttccctcttattcattagccacacccagtcaaacatgaggtcttctggtatcaactcccagttactcttgcatttgtttacttttctccagctatatgatcatggtaaattaaccactgtatgattctttggctttatctgtaaaatggggacgagagtaatcctcttaaaattgttctgaacattaagtgaaatatctggcacagagcaagcgttccatgaatgttaggatggtgaacacccttggccaccatatttaaaaggactcactggcctggcgtggtggctcacgcctgtaatcccagcattttgggaggctgaggcaggcggatcacgaggtcaggagatcgagactatcctggctaacacggtgaaaccctgtctctactgaaaaagaaaaaaaaaaaaaaaaaaaaaaacttacccaggcgtggtggcatgtgcctgtaatctcagctgctcgggaggctgaggcaagagaattgcttgaacccagggggcggaggttgctgtgagctgagatcgtgccactgcactccagcctgggtgacagagcaagactccgtctcaaaaaaaaaaaaaagaaaaaaaaaaaagactcactacgagtaatgcaatagcctcctaactggtatgtcctggatagtgataattctggtccactaggttcttttggatctacttctccaccttcaccttgtgctgatactaccctttcacttttttatttgaacgtcagtgtcccatgctggtatggcaggctttgctgggaatggtcttacccttttctctgcccctttctcctttgtgtgtcagactcattttaccctcagttactcagggaaatagtcctctaaaaagcatttaaaaataccctgcattctgtatttgtttcaatgtctgtctcatttgctagattatggactctgtaagtcctatcttgttcctgtactgtttttttcagactataatgcagtatatggcagagtagcagacaataatcgaaagttatgaaattaatatggctcacattactctctccccaaagccagaagggttttcttcccctcctcactcttagatttccagggctcctctgtgtagtagctagggcacttaacacatggcgtttgttattgtgtttatttatatttgatcttccccccccagattataaacacctcgagttcagatcagttttgcattcagaactgctgtttctaccagagcttctagtttagagtaggagccagtaactgaaaacatcttgttgaatttcctaagtctgaggtgctttggaaattcattttgttcctattctgaaattatctttcatcctccatctttcctcttgtggtatgttttgtggttataaatctcttctttccgtccacaacattaaatataatcagtgccaagaggaggatggaggacagaaatgcactgtggtgtcttgacctgtctggtacttatcataactttcctaggaattgaccttgatgggcccttactgccttctaaataaagttcaaaccccttagtgtggcattcaagaccttccatagtctgaccccagtgaacctcttctgtccttattttccactctattttttattgcatgcatcctgtgctctagcttaatggttttcaatcctgcctgcacattagattcacctggggagctttaaaaactgaagccagggtcctgtctttggagattgtgagttaattcgtctggagtgaggcctgggtgtgggtgtttgtgaaaggtccactagtaatgctgatgtaaggccagggctagaaactactgacaagctcagtgtttcccacggaatatcatctcctctccgaattttgacgagaaagggtcccaaagtcaaagaagcttgagtagtaattgcttttaatgtgctcctttccaaagatgtacaacgaacactatcaaatgaaaggctctaagatacccaacagtaaagaaaactgtttaactttcttcatagtgtgtgaggtcgtctgataagagacacttttatgtatataatacttgttaataacatctgcaacatgtggtatagaaaatgtttttagccacttctcaacttttgagtcacttctttttttgtccttccctgatcatgtcatccaaatcagacccacctcctgccccagggctctctcttacacccccaattttgtcttcatagcacttctcagtatctgaaattcctctttatatacttgtatgtttgcttctgtctccctccacctatgatgtgagctccatgaccgcagggatttacttgtcttgttcacccctctgtcttcattcagcatctacaatagtcctgacaaatagtaagtagatatttaataagtatttgttgaatgggcaaaaatacacgggcagtaatgcattcgtggtttaggctttttctaaggtgcatttgtttaaatattttaaattgcctacagaatttaatttaaaagcaacctgaagtacattttaaaagtaactaggaatataggaacacaatagtttgctttacctttaattttctcaacctgcctagtcaagtattaaaaaagaagaaaacaaacaaaagtggatgtgagcctgattatagggaaaatgctgttatttttctgattatagagagttttcagtttgtggttggggacttgttttttctgatttctcagcctgtctcgggtggcttcccccagccattgaaggaacttgagtgaggaatcagtgaatggtagtggactttgtgtgcagtacaccaccccaacaacaaaaacacacaaaaacagacaaggaattaatttcagtaaaaacttcctaataattaaaaccctcctacagtgtgagagtattcagacaggtttgtcagggacagtggggaggcagtttgtgtatcagaatccgtatgtggaatcccaagttcggttgcctgctgctcaacacgtgatgctgcagcaactcttggaccttgttcagaagggatttgaatagcctgttctctctaggggtcctcatgctgcagctgtgcccatggctccccaagcctggctctaactgtgttgttttgagcagggttaataagcacgaactcgtctacacattgtagtgtgtataattcctgagctccaccaccacaccttgaattatcaggaactgaccttttacttcctgtggacctagtgatgccgtcgcatgagtaggccctttccttgggctattaaaatcatcaagttggttcactcgagataacattatagagatttctcatgaacgctgtatacaaggtgctctcctagggtgcttctaacaaatccatcagtccagtgggtcaggtgatcagcaatctggtataaataatctcaagaaggaggttgagctgcatttcctttattatattttaaaataatctttaaaacacatattttgccaaggtttcagataggaagctttaatcatttattcacccatcaggaattgtccagaatgaatttgcatttccttttgttgcacactatgataatttattattcttttgaatagcatggtatcctaaatgccagaaaagatgtgtgatgggaaactaaataaaccatatcagaatttaagcaagttttctggatagatattcctttatggttgatatattaatgtgctttagctacaggcataccttgttttactgggtcttgctttattgtgcttcacagagactgtttttcacaaattgaaggctgtagcaaccctgaatggagctgttcttccaatagcctgtgctcacttcgtgtctctgtgtcacattttggtaactctcacaatgtttcaaactttcttattattactttatctgttacatgatttgtggttagtgatctttgatgttactattgtaatagttttagagtgccgtgaactgtgcccccatcagacagcaaacttaattaatgtgtgtgttctgactgcttcatgctattcccccttctttccctctcctcaggcttccccattctctgagacaacagtattgaaattaggccaattaataaccctacacgggagggcctctaagtgtacaaatgagaggaagagtctcacatctctcactttaaatcaaaatctagaaatgattaaccttagagtggaaggcatgtcgaaagccaatgagccaaaagctaggtgcgttgtgcccaacagccaagttataaatgcaagtaaaaagaagttaaaggaaattaaaagtgctactccagtggtaagaaaatgaaacagccttattgctgaaatagggatagttttagtggtctggatagaagctcaaaccagccataatattcccttaagccaaagcctaatccagagcaaaacccctcactctcttcaattctatgaaggctgagagagatgagaaagctgcagaagaaaggtttgaagctagcagaggttggttcattaagtttaatgaaagaaaccatctccataatgtgaaagtacaaagtgaagcggcaagtactgatgtggaatctgcagcaagttatctagaagatctagctaagatcattgatgaaggtggctacaccaaacaacagatttgcagtgtggataagacagccttctattggaagaagatgccatctaggactttcatagctagagaagagatgtcagtgactggcctcaaatcttcaaaggacagacagactcccttgttatgtgactaatgcagctggtgactttaacttgaagccaatgctcatttatcattccaaaaatcctagcgcctctaagaattatgctaaatctaccctgcctgtgttctataaatggaactacaaagcctgggtgacagcacagctgtttatagcatggtttactgaatattttaatcccattgttgagacctactgctcagaaaaaaagatttctttcaaaatattactgcctattaatggtgtacctagtcacccaagagctctgatggagatgtacaaggagataatgttttcatgcctgctaataattctgtagcccgtggatcaaggagtaatttcaacttttaagatttactatttaagaaatacattttgtaaggctgtagctgccatagataatgattcttctggtgaatctgagcaaggtaaattgaaaaccttctggaaaggattagccattctagatgccgttaagaacatttgtggttcatgggaggaggtcaaaataccaacattaataagaatttggaagaagttgattccaaccctcatggatgcctttggaggggttcaagaccctgaggatgttctttgggggtggaccttgaagatgtgactgaattgctgcaatctcatgataaaacttgaatggatgaggagttgctgcttatggatgagcaaagaaagtagtttcttgagatggaatatacttctggtgaagatgctgtgaacactgttgaaatgaccacaaagaatttgaatattacatcaacttagttgataaagcagtggcagagtttgagaggattgactcctctgaaatttcaaagaaattctgtgagtaaaatgctgtcaaacagcatcacatactacagagaagttctttgggaaggaaaagacccccagtgctaacaagcttaattattgtctgtttttgagaaaatgtcatagccctccaactttcagcaaccaccaccctgattagccatcagtattgagccaaaaccctctgtcagcaaaaagatcatggctcactgaaagctcagataatggttaacattttctagcaataaagtatttttaaattatggtgtattgtgtgtgtgttttttttaagacataatgctacttcacacttaaactatagtacaaacataacttttatgtttgtactatactgtagtacacacatgtactgggaaaccaaaaaatttgtgtgactcgctttattgtagcattcactttattgttgtggtctggaactgaacccacagtatctcttgtgtatgcctgtattcccaaacaattgtagcgtgcctgcaaaagaattcatgagattctaaccacctaaactgtagtttcttctatttattcaacaaaagcgtattgagtgtctttgacataccagccactggggctataagacaaagctatctgccatggagcctacattctctagaaccttactactaggggtctggtctgtggaccagcattttcagcatcaccttaaaatttgttggaagtatagactctgaggcccttttccaatttggattttaacatttccaggtgattagtatgtgcattacagtttgagaagcactagtctagtccatgtaaacaaaaatatatatgagataatttcagatgattacagatgctgtcacgagaagacaaaactataatggccagagagtgggaggaggacgagtaattgaggatggtaagtgaaagcatcagagggagtgtcctgtgggctgagacttaaatgatgggtggagatgagccatgggaagatctggggaaggtggttccaggtagagggaacagcaagtgcaaatgctaggaagagggactgtctccttgttccttgctatgccctctgctctagccaggccagggcccatttattcacttgctgactgtgcctgcacctgaaagtgtggtggaagtgtaatggcagagtggtatctcagtaaacaggaaaaggccaaaacttgggttttgataagagcagctactcatagtgagaaaacaatcaaagggattgtaaggatgttttggtaatgacagcttcaaagaattggaattttatataattgggaggagggagaagaaaccactagaggccatatgctggaattggaagaagaggaaagaaaatactgagaaatgcaggatagatggagatttcctgaaaaacagagaaaagaagtaaacagacaaggaagctttagcctcgcctgagaggaaagaccaaaaaatagagcatggctctctgtataaaaggtggcttgtttccctgaaggtaggcatccttgatgagaactgagtaaggacgattagtctgttttgttttgttttattcctgtatccaaaattcctttgtctttaggtatttctcacatcattttgatcatacatatatgttgggaaaaatcaagatgaataatctccgtttactctgggaacaaggagtatcttcttccctctactgtggctaagtatggaaaagcttaattgtaaatcagcattcaaagacaaccaaacatttatttatgtcagtaggaaagaggaaggtgtgtgagagagagaaggaggaggaggaagaagaggaggggagggagagagaagagaaataaaatgtaaagcaggcagctggcaaggcttgctctgacacactggctgaggaaagagctattggtagaacttggatgtcttagtaatcagagtaatcaggttctctgaccggttccaccttgttctgtgcaggctgaaagtaagctctctagagaaagtaattttctttctctgctccttctgacatcccacttttccctcccatccttcctttctattttccctgcctctcccctctggtagaactgagtataaccgtggtaacattggttacagtgttttctagacttgagaactgaaatgatttgaccttgtacaagtaactggatgtctggcacaatgatcgtcattctcaaccttgataatttatctctctcgatcactgttaacattggagcagtatttaaacacaataactagagcccagaatatgcatgtaggcgaataggcacctatctaggatttctcttaaagatatacctctagagagctcacatggtaggaggaaaaagagggtgctcttttttttctttaaccattgtaaaaatgcttcagtaaaatatagcttgagctctggggatagactggaatagtaccatgaaatgtgggtataccgtgattctcttcaagaaggactttgttctgcttattcccacatgagcaccacaaacagtagccccatgtatcttgttaggacaaataaatgggacacttgagaatatccagttaactgagccgcacattgggtactttaaagcacacttaacatgcagtaaaatagcataaatatgagttcaaaacacaaaccaagttgacattgcttgtggtatcatcattagtagaatcattgctttggttaaactccctgggggaagcagtggaagggaggtatgggggttgtgaaaagagattcaatattgacactttcacattgtttaagatgatacaaattaactactctgttatagacagtatccttttctcactggagtaagtaggatgggcagagcttttaaaaacagcaagtcttagttttaatcagtcctttaggaacctgatagatggcctactaattcgattcttataatgttatcaactttgttttattgctttattaagcagtagtagttgttttttttttttttttttttttttttttttttttttttaacaagcacttgaactgaaataaagcttaggcatgtggtttaccaacttgctagctatactgacgatacctttggtctaaatctttaagctttattccagtcaggcttttttttttttttaagaatacctaagattagtgtgtgtgtgttttttttttttttttaaatactttttaagttctagggtgcatgtgcacaacgtgcaggtttgttacataggtatatatgtgccatgtggtttgctgcagccatcaactcgtcatttacattaggtatttctcctaatgctatccctcccccagtcccccactccccaacaggccctgatgtgtaatgttccctgccctgtgtccatgtgttctcattgttcagttcccacctatgagtgagaacatgtggtgtctggttttctgtccttgtgatagtttgcttagaatgatgatttccagcttcaaccatgtctctgcaaaggacatgaactcgtctttttttatggctgcatagtattccatggtgtatatgtaccacattttcttaatccagtctatcattgatggacatttggattggtcccaagtctttgctactgtgaatagtgctgcagtaaacatatgtgtgcatgtgtctttatagtagcatgatttataatcctttgggtatatacccagtaatgggatcactgggtcaagtggtatttccagctctagatccttgaggactcgccacactgtcctccacaatggttgaactaatttacactcccacacagtgtaaaagccttcctatttctccacatcatctccagcacctgttgtttcctgactttttaatgatccccactctaactggtgtgagatggtatctcattgtggttttgatttgcatttctctgatgaccagtgatgagcattttttcatatgtctgttgactgcataaatgtcttcttttgcgaagtgtctgttcatatcctttgcccactttttgatggggttgtttgtttttttcttgtaaatttgtttaagttctttgtagattctggatattagccttttgtcaggtgggtagattgcaaaaattttctcccattctgtaggttgcctgttcactctgatggtagtttcttttgccgtgtagaagctctttagtttaattagatcccatttgtcaattttggcttctgttgccattgcttttggtgttttagtcatgaagtctttgcccatgccagtgttctgaatggtattgcctaggttttcttctgaggtttttatggtgttaggtcttacacttaagtctttcatccatcttgagttaatttttatgtaaggtgtaaggaagggatccagtttcagctttctacatatggctatccagttttcccagcaccatttattaaatggggaatcctttccccattgcttgtttttgtcaggtttgtcaaaggtcagatggttggttataggtgtgtggtgttatttctgaggcctctgtgctgttccattggtctatatctctgttttggtaccagtaccatgctgttttggtaccagtaccatgctgttttggttactgtagccttgtagtatagtttgaaatcaggtagcatggtgcctccagctttgttctttttgcttaggattgtcttggcaatgcgggctttttttttggttccatatgaactttaaagtagttttttccaattctgagactttgctgaagttgcttatcagcttatggagattttgggctgagacgatggggttttctaaatatacaatcatgtcatctgcaaacagagacaatttgactttacctaattgaacaccctttatttctttctcttgcctgtttgccctggccagaacttccaacactatgttgaataggagttaatagctaagattagttttatgtgttacatgttattaacacttttgtaaaattgatttttgataaggtaaaaatggagttgtcagtttagagaaatagtactacttgaaaatttttccttatatttagtctggattttaagttagaatttctcattagtcctctgactttttaatctagggtcaggcaagatcagtttcagaagttgtacagtttctttagaaaatttggaacaaatcaagatattttctgattgaaattttaaagaattgcagtctttgttctctagtggtgaagtgaagtgataaggttgcaagatttatttgtgtttattccaaaaagtatttcaggcagggtaagtaggacttctttgtcacctttttaaaaaatgttgatattaaagtggatgaatgtatgttcttgataaacattcaataaaataaatagattcatctttaaaaaaattttggcaagaaactgctgtacagaaaacgaatggtaaaaagttattcttcaggaatgtttcctaaaactgtaattgctttaagttagctgctgaaatggtttcctaataacgctttgttattctgttttatttcaacaatacatatgtagtaatgttgttcctattttgatgagagacaaacccatcaaacagtttttaaaatcaacaattgcttttgatatatccgtttgattactaaaataaagctattggtactttcacccaagtttattatgtttttaaaataaaatttatgtctttttaaggaaatcatataggctgaaatgatctaaataaaaatcagatttttattgtatcaggtctatttcagggaatgtagttaaattcaggtatagggttaactaagtttttgtcttttaaatgattagtaaaatttgttatgtgataaaggaaatatgtatttggtattgtgtgcgttagtatttgttactttttaacctagtgattgagttacagctttcttttcaacacatgacatcactttcccatgatgtaagatagatgataaattttccaatgattcttgagttttggagtatgaagaaataaaggataaaagattcttttctgtgttttcctgtttcgttactacctggtcatgctcctaggccactgtccatcagtactgtagagttagcctgttgacagtcacatgtcatgtgttgagtgcgtagccaagggattttcgtagaatgccttttttgtctttacatttttctgagatattttatccaaaccaaggttttctttagcagggatggtgatcatttttattttatttatttttttgttggagaatggtgtaaaggtgggtaattttgagagagaggaaatagaatggtagtgagttgagggtaggaaaatacatctgcaacttttattgttttttaaatgagcatcttgatagggaagatagaatggaattgtcaaaaattgttaatgtgtttgacaaagtgtggctgtcagtatgatctttttgttacattttgacatgaacaattgtccttttattggggctgttaatgctattttagaatatcatgagcatctgaaggcaatagtttagcagtgtccataaagcatcaaataccattataatatctagtaaccctaacagcaatatttcagaatccctgcctgtttaaatgggctatctgtgaatgtacttgctcagggatgcatgacccacatcacctataaatttgattggaagctaacagtactggcgtagcctgatggatagcagattagagccctgattaaccatgtgattcaaagactgggaatatattgtctaagcaagattcatcagatgcaatcagaatttcaagtggtcagatgaaattcaaatgtgtgttgtggcttttcctcccctattgcttttcctcctaggttgcctttttttccttctttccccaaagctgaaaaatacttctttgatgaatctgctccttaccctaaagctgtctgtctgttattcatcagaaagcaggtcgcagttcagtgagcagaagaaaagattttaatagaagctgtgccaagggctgtaatgcatcattttagggccctaattacattacaatgacaaatatcaatggtgacaacagcaataacctacatcctttaatggctgtgctggaaaaggagtttgggccccacgccattatattagactcagtttcaaaacataggccattagaagtgtgtgtccacagtgttattggctgatcgctaaagcccagtggaaaggcctgtaaataaatgatgcctccctaaagctgggtcctgtgggacaaaagaggcgaaattagatgaccatgggagcagcagtgtttccgaggcaactttagatttcaaagtgaagaatgacctgcttaattttatgaaatcacacacacaccccacccccccactgccaattagcctgaccatgaaaatccattggcatgacaacttaaagaaattaagaagtcttttaaacaaaaggagatctttaacggaagtttggaaggtttctgccctcccgtttctgttgtgtgtgtgttaacctatgtgattgaataaaaaggctcttctcctttttacatttatttttaagaaaatgtagaatttttttaaaaaatagttgctcagacttaatacagcctaggtccaaaattttatttcaccagatgaataagtttccttagagtcgtttttattgcctagattatgtaggcgaactaaagaactcagttttcttatgtgcccacacatttttcagccctcctagcaagggactattttatttatgtaaacaacataatgacgaaaatatgcttggcagatggttctaagcattagaatcatcagtttggtctgccccaaagtgtctcattatcttttattctctccccctccacctctccctgcaaaaagcttaacaaccaaatgcatttgagatgctgtactttcagcctggtgaatgctactctatttttattgctcaccctggaatttcaccccataaccactgtggtatgttcgtccaggtggagagtggtttggtgattcccattgcagctcttcatggtggcttaagcattcttaaaggatggctaaatgctccatggggccagtgcagtaaattaaatcaggtcagcacagttgggtccttattcactgcagcttattggtgctgggtttttgtccatactgttaggaatgcaggctggaatggaaagcttggatttgaaacttcatggtgaatttgtgttttcttttggctggtaaagtttttaaggtgctggcatttaaaagattgcatagctacacagttagaagggttgctgatgaaagaaggaagcctagattgcacaagtagagtgtcactgtcattctggtaatgacttggcaagaaaaggcattttgggcctcacataaaatgaggaactgaccctggatggaatttaagaatgtcttagggatagtaattgctttacattttctgcctttcaattcttcttagctctctttcctccattccatcattaaaatataaactattttgtatgtacgtgtattaaaaaaaactgtgtatttatacatcacaaaatatacaaggcaccatctgaaaaatacaaattaagataaacattggtaaaactgtgagtaactttttaaagaaaacatgtagtggtggtttttcttttaacttactgtagcatcttattggtttaaaatgtctgtacttataaaaattattagagaatagactgttctttgacattgttgggacttttgcatatccacagtaaaaaaaaaaaaaaaaaaaaaaagttcccaaggatagtttccagatacatacagattgcttcctgctaagtgtaataagattttagcatatctcaacctctgcacactgaaaaccttggtaggacacatttggaaatttttatggttgaagaaaacattttgttctccaagaatttgtaagaatccgaattagccaacttttttgggttgtttgggtgctgctgtttcagaagtttagggtcttgagtttaaaatcacagcaccaatgtttttaaagcaaaggccacaaatatagaaatccaatgatttgctaattgatggagttgagatgtaggaaagaatgtatctttacttatctaaattcttaagacttagaagactgcaggttttatggaaaacattagtatgagcaagggtcctggtgaaggctgttgaaaactgatttccagtcatggaaattaaattccattttatattgccctgatgcttgaaggttaactttttaagatgaatgctggttaataaattgtgctgttaatgtggcactgttgtcactgcttccttttaatgggcttactgatgagatagttttcctcttccttaggaaatatgccagccaaattataaagtatgttttaatatcatcctgttaatatttggggaatctgtaaccagctgactgttctctttattgctttcctttcccttattttttgcaggcagagattgtcaagaggctgaatgctatctgtgcacaagtcattcctttcctgtcccaagaggtaaggtagttgattttaggcactggactagaagttgccattttagtggttttgcagaaaagggattgtagaactgactctctggccttgccagtctcttggtgtttgtattttattttcatttctaagaaacagtgttctcactccaacttgtataccttagtaactttctgtgggatataatttatatgtgtttacataatggaatattttctagttgggctaagcaaaattcagtcgttaaaatattttgctatctttgtcgtgttgctcagaattatgcttgtttgtcataatggtacctaatagggtagactgaaaaattgccaggaaaacaggagcttactctgtactattgtcattgggcattaagaattggcagaagacatatcaaatggaaagactttttgtagtaaacaaactaatgaagcttttggctagctacttttaaacatttacttcttgtttcctgattaagtctttatattattgtgcttttgggaaaagacctgcaagatgaactcattgaactcgtttctctgagtgccacttttctcaaaattaggctttggtgatggtaggcttagcacattgctaaggcctggcatgcggctcactagttctcttgctcacctacaggggaagtgcatgccatcagcaaacaggcacaggttggaataaagcgatgcatttctagtgcttgttggcttccttgtggtttttttttctctccctgcttacttttggtagttacaaagttgaagtgagaatactggaaaaagataattttttgcttctggattactgaatgccttcatttgctcaggtaagatccactctaagaaggaaggagctaatgaaatatctgcatgtcttgtagccgcaatactttgtgctgtgggctgagaaggcacagaggcacttttcttcctaccctttcagttgttctataagtgtgttgtgtcactgcttttcaggagagaggttcattcacctgcttgccagcgggcatgtgccaatgttatgtggccaatatttgagcctgcatgtgtattatagatatgcagattgctgtatatgatttttttctttggtctggactgggttagacttgagtaactatgggtacccttcataggtatatactggggagggggcactcatattcacaaatcttgttgacactctgaattcacatgctcttttgggtcttgataaacaaagggtatgttgtcttttctcctcctttagctgtgaccacaaaacctaccaccagtcatgtccccatttgcctgtttttacttaggatttgcttatggctagattagatggcttggtgaatgagagtcaaggggtgtatctgcatttcttttggaaacctgactgccccctgcctgatccagactagtgtgtattttttactttaagcagctctgctttatggagatggagaatgggaagaatgtgtgacctacagagctgtaaccaggctggggtgtcatgttctaaggtgacagggaaaagttcgaattatccctggggtggtattagactttgggcctctgtaggcacagacccctgtatatgatcgctggtatggctttggtctcatcacatttctgcaggatctgtgggttgtgttcagaagtagaaggttgtcttggggatgttgatgaagctgatttgccaatgagttgttttcccacatgaattatgttgtttgtgtgagcaggcccagtgggaacagaatgtataatggtagtggtgctgagcaagactggactgaaattaattgtctaaggaagttgtacctgtaggtgaaagccatggggagatactgacaactcatttgctctagtctgggaagaaaggtgtcatacttaactgttgtcataccacttaactatttatttcccaaatactttgacatttcttggttgaaatccttgactcacgtataatgatttatgccaagcttgtgcaaccccagggcctgtgggccacatgtggcccaggatagctttgaaagtggcccaacacaaattttaaactttcttaaaacagtatgagatttttctttgcaattttttttaagctcatcagttatcgttagtgtattttatgtgtagcccacataaaatgggatgtgtgtgtgatttcttcttccagtgtggcccagggaagccaaaagattggacacccgtgatctatgccatggttttctaaatgctagttctgtgtatatattttcttttgcttactttagatttaatttactcatctttttctagtttcctaaggtatgtgtgtatcttttattgtgtgagacacaaacatgtttgtttccttcaaatcagggcatctctgatgttttttatctgaacatcgtccaccttgtttcttcttctgtgcattctgtgagcattggactccttgcttctgccctgaagccagatggaccataatctggagggaggggaggagcaggttagtagaggaagatgaattctgtttcctgtctcttcagaggcatggaaaatcactcttgcatggctgtgagcatcactgtgccaggactgaaggctcttaatctgatcttttaacaccggctctctgtgtgacagtctcgctaccaaaacggcagctgctgcattagaatttattttaaaatgtttttatttaaaaattaaatgatcgtatttaggaaaaagcaaaacaattcctgaagagtagtgcataagctaacagaacattggctggagcgattgtgagcatctgaagtcaggctttttggagtttgacaggaacaaggggtatatttacatactgttagatgaagtctctttttaatttagcccccatgtgttgattaatatacctgcttaatattgcttgcgtctggtttaccgcatttttttaaacttaaaaaaactatatagtactgaatgataactattaaatttagctttaacttcaagactttttctttttagaaatgagttgtataattgtgttcagaagtacttgaagtgtgtctgtatatgaaaatcacagaaaaatattttcctattagagtttactaaaacatttaaaaatattaaagccaatatatactttaataatgtgctgttgcactcacgtacaactgcttccagcgttacaggcatttgacaaagatattgccaactcttgtcattaaaagtgagtactcatcacttggagttcatagaatttcacaggattctcaatatcagaatttagaaaaaccttgtgaaccctcatctgtcccaagctgttcttttctctcacttcactttttagcttttaggaatggataagactcaaatttattcttcaaaaagccatctcaaggtggtaaacgggaagctcttttctttccctatttcggtctcatttgcaggggaagaactataaatatcaactctgagttggcagttccataaacaagagatgccaggatgatgacagttggatctgggtcctggcctccctattacaaatcgtgtggtttactctaactgggctaagctgggtgacctttagcaagtgatgtgcctctctaagcctcagtttcctcatctgtatgatgaagttaatcatagcgtgaaacacatccaatgtctgtgaagattacttgggattatacccaggtagcttagcacacaataagcacctactgccgttgactagtgggattaactacagtagcagcagtggagctctgtctcctcttgggaggagctagaaccagccctccctcccttttctaatcattgcatttgggaagaatgtgaattgattatcttcctctctaatgtccttatagaagaaaaaatgaaaattaaaagtgaacccagggccttgaactagctaaaaatctatgtttttgtttccattggcaattttgggatatggcttatagacccttagacctcagtgggtccttagtaaaactgaggattgccaataaatattgtattgcttccagtatcccagtaacaactcctcctccatcccccaattccaggaacatatctatgtagagagtctaaggtggacctaaaactctacatcactgttacaccctggcagtaagggacagcatttctgctaatttagaattgggctagctctccctcttcactagctttgcattgcaaagttgatctctctaagccttagtattcctgtagaataaggagagtaagcccacctttacaatgtgtattatatgtatcaaaatgtaacagacttggcatagggagtgccgtttccccacctgctcttttcctattttacttccagggaaatagattctatttcaggttatttggggtcctaagacatttggaaaggaatgacttagtaaaaactgggaagagttcaaggtaatatttcaaacgagctggctggcagtcttcctgcagagttagctaggccttgcagctccagtagctgcttccaacgatggacatttagctccacacaggttatctttcaggaggaagggaatttttttttttttaagtaaaccagtaggtatttttcttaacctgttagattaagcaggaaatattgtgcacttagttgaggacctgttggaggatagttgtgttttttgtactcttgtttccctataaggatcacttttaagatagggtatgtttcacagtgatccacaaggtgttcctaagatctttgagaacctcaaactcttgaaaagcagtaggtcagtaggtgaaaagtttattacgttatagttgaaaattattctccagggtacagttgtatttttcagaaacttgtcgcttcagtaacaaggagcacattcattggaagaggcacattaggcaagaggcaatgtaataaaagctggaggtcagccagacccaggactaaatcttggctcagccacttgctttctttaaaatgtggagcaaaatacttaacttttctgggctgcagtttgcttatcggtataatgggatacctgtactgtaggatttttatatgaggattcgtgacagtgtaaaaggacctcactgaatgtttggctgctttaacagagatcaaaggaacagtggttttttcaaggaaaaaaaaaaaaaagcttgtttctctctcatgtaatagtaacagttgacagcgaagccatctatagctaatttggtgactccatgatgttgtgaattcggttccttttatatcgacgttcatcatccttgcaccattgtgtcttgccccagcgtcagctggcaggaaagagaaaggaatgggcaagttatttccttttaaggttgccctctttgcagtggccagcacttagttacctgcccacagatagttgtaagggagatacagaaatgtagtcttagctgagtgaccattatgcccccctaaaacttacaccagtgtaagagaagggatactgggggacaactgccacttgcttccagacataatgctatgcacaaaataaaaattatggctattgttactgctaatggtttatctttacataacaaactctagctttgactatgtaattagcacatctcatgtttttcagttacataagatataaaataatgcatagttcttgttatagaagtctcttccttaccattcgaatgttggagaagagtcacccatcaggtattatttatcattcatacattcataggggatggaaaagaacctacatgaacagtatggcctctgtgggctgtctatatttgtgtttcttatgaccagtggcttcctaattctcatttattaaactcatggtcattgttacctttagagaaatggcattcatttttaaccttgttattagcagacttgtttctagtcactgggtgccaaggaggatggacattttcctccttctacactcctgtaattccatgactgttttttttggtggtggtggttgttttttgagtcgaaacagaagccgagctgctcagaggctgatggaggagccctgcaggctagtcctcacagcaatgatgaggagcacacctgggggcctgcacttgcacatgaacggagctgtttttcccttgcatcagttattttaagaaaatattggtttaacaaatgaaataaagaagacgttattctttttacaatatttaacaatagttctctgatcattagaatattgagaatataaaagggaaattaggacctaaaaatggaaaccttccatttttatacttattttacctggggaaaagggaacttccataccaacctgaatgctttctggtgcaaatttaattttaacttaaaacttggtttgtattgccctgttagcttttctaacacgtagtaccaagtagtgtttgggcactctccattgcatttatttggtagaaaataatagtcaattacataatagtgataatatgagtttatttgaattataaatccaacaggctagaaaagctagtcacatcaaacgatacataaactcctgttttggacatgccataaatttggtccatgtaatttgatggaaaacaaaccccttctactacattgtgatatatgagtatatctcagatgctgtttacttgggcatctcggttaatatggtactgaattacttggagccacattttgcatgtatagaataattgtgaaatgaaagttgaaaaatgtgatcagtcactttcatattgtgccttcgggaggaaatgaagaaaatacagtggttatatgcactggtggaagtgttatcgccttacagtcgtgccaggttaacttgtcttattgcttgttaactttgcgaggaatcaatggcttgtgataacaggtttgatataggagagcatggttaaaattgcagagatcccctggcaagtatgcagtgacatccctaagaccatcttcagaaagtgcttgtgttaagtgccagcagcctgcacagggcacgtctgcttcccagttggagccattttgtcagtcttggtaatatgttatgacagtgccatatatcggaagaatgtcctaaaatgaataatagacatggattggggcttctggggatttggcccagttttctgattttcacattaggttgtgggcatgggtaacttttcatttaaaaaatatatattttctcataatactgaatgagccatcagagagcgtaattctgtcccatattccgtggttgactgattggcttgctgtacctgaccatgtattttggtgacagttggctgcttggtgagattcatctggtggcatcatggcctgtttgacctcaagaagtgaaagatgattctcaggaggtagaacttttttcctgtggtttaaatgtgggtctctatccaaaggcagcaatgccaacctttatctgtatgtctcaacaaattaatgagtgtttgagaactgactcatttatttgacttttagttaggtagtgattagattattattagtggagctaagtttgaaggtaccttgagtagagctgcattgtccaatacagtagtagctatgtaaagttgaataaaattaaaagttcagtttcttagttactctagctacatttcaagtgctcagtatccactcatatgtggctagtggctgtcatattattagcacagatacagaacatttccaacattgcccaaagttctgttggacagcagtgaatttgtagagcttacctatccgtgaagaatgccctgtccccatgtaagtgagagtggagaaggcaaggccaggtaggcagtcagtaatgtgctcctaagagctttaatcccatgttccacagctaaaattgtttgggaagccaggtatacttatttactctctctaagctttgtggtgctgagataacctgcagtttaccgggtatttgccaaattaaacctgtgtttgtgtacgtgtatgtatgtgtctaagtaatatctaaagtaatatctaatttcttgggtgactgtgttgggctgttcttgcattgctataaagaaatacctgagactgggtaatttataaagaaaaggctttattggctcatggttctgtaggctgcacaagcatggcaccaacattacttggcttctggggaggactcagggagctttttttactcatgatggaaggcgaagtggtgaaagcagaaaaggagagagagattgagggggaggtgtcatacactttttaagggccagatattgtgagaactcactctctgttgcgaagacaacatcaggccatgaaggattcacccccatgacccagacacctcccaccaggccccacctccagcattgggaattacaattcaatgtgagattggagttgggacaaatatgcaaactgtatcagattaatgtttctttgaatactgtataggaaaggctgatttggggagattgggttaaatttaagttgatttgtactagcaaatttaatagagttgctgaaaaaggcttttagtgggattttttatcctgacttagcagacatggagcgacactttcacttgaatttgatctgcttggccatacctggagtaatgtgcactacaaggagactagccagaaggatggatgagtgggctagagcccatgacacagagaaattgttgagtgaccttaggatggttaacctagaagagataaaattgagaacatgcattatgcattgtcatatacttggagtgtcagtcaatggaggagaatttaaagacaaaactgggtccagtggggaagaattaatggcagggtagatttcaacttagtattagggctcattatcccaaaatggaaaaagcttgtccatgaggtagtgaattgcctttcacaggaggtgatcaaggagagactggttagggtgtgacagaggagattgattcattggatagagtagtggcctttgggctgtggttggtactgtagttccgccatcccaatctgctcagccccggcagtgtttagaaatttgcgtgcttttggtgatagggagagtcttttgttgattggttggttggttgattgttaatagtgcctggggtactctggcatctgggtctcatggtctctaaaggccttttccagttctgaatttctatgagtggcttcttaagtacatgtggctaatggcttctattagccaaaagggcatttggtccaagttcgggcctaagtatctttcaccctagaatattgcagccctctaactgtttacccttcaatctggtttacctctctgccatccaccttctttacttttcccagatccatcttactcaaatgcagaactgatagcacatagctgcttaaaattttttaataacatctcatttcctaccaggataaagtccaacttttttgcatgtcatgcaaagccctttgctgtttggcctcctcctgtcttgccagaattcatttcccactaatacttggttctttaaagcatttccatgctacactcatgtcttcatccattttcctttatttttctttgtgtgcacaccctttccactttaaagtgttcttgcttatgtgtcttatcatacccaagaaggccctatgaaattctactctgcttgtctgcagctgtgtcccctacctgctctccctcttccagccacacagacattcttgctcttcctataaggcccctacccagttctcttccctttgcctggaattcttttatcctcattcttcatctacagaattcctggaaatccttcaggtctcagttgtcaggtcagcttcctaagggaatcttcccctagccccaatattagattaagatatttccctgataaatgattgggtagcatcctgtaatttttcttatggaaattatcctccagttgtaattatagagccttttgagcattaattcactgactgttttccttgatagagtttaaattctatgagatcaaagactatggttcttgttccttactctaaccttagtatctccctaccacagtgcctggtgccatagtaggtgcttaataaatatttgaatgaatggatgaaaaaaacaaagccttcccagatgccgcgggaagtgcgctggccatttcctcctaaaacttctttctgttttatatcctgtattcctctaagatgtgctctgtgtatgagttcatcacgtgagaagcagggccattggtcttactttcacctctccacatgttggagactttaattaatattgttcattatgagaatcctagtttattttgtttcattttatatctatctctacccttatactcttttactaccccagtcaatatggggagtactttttaaatgtttttttaaaattttaatttataaaattttgaagcatactttagagagagaatatactgaacctacaggtacccatactaaacatcggcagtaatcagcattttgtctttttgtctcatttattccttaggggagttcttttgtttttgttttattattatttttttttaattctgaggtgtactatagctttttattacggttttttattagaagtactgcatctgttgctgtgccctaaaacattggcatgacaggtattctcatcataataccttctgagaaatatatattaaacacctactatacacatattactggtttgttaaggtctgctttttagcaggcttttttggacttatgagctggtattattttagtttcttatagaaaaaatatattagtactttgtctgaacaaatgccagaaataattttatgatgatggaagtaaggcaagtgatttaatgtacagaatttcattttactggccctttcccctgcaaccatgtttgtattgcttaaatcacttttttaaaaaaattatttttactgaggtataatttacacaccataaaattccctagttttaagtgtatggttcaatacttttcagtaactttacagagtcgtataaccatcaccacaatctaagggttttttttttttttttttagaatttttttaaaattgtaaagtacagcattttaaagaataaataattgggcatttgttttgtctcttcaaaatcccagttagaggtcccctctcttacccttggcttactaatatattcttagtggcatttcatttggtggtactggtggcgcattcaaacaggacacttgtatctgagtgagcagctggagcagtaagaatgacaacacttggtctctgcagattggctggacccaccactctggtgctagtgctggcttggtggctgagggaacaagcaggaagtagaagaggaaatgagatgtgggtggagtgggaagagaggacagattggggaggggagggaaagtggaagacaaggcagacataatgggaaagccctcatagttctaagaagatgtgaaaaacttgctgtttttttctgagtgagagcttacttgttaaaacccgaaaatggaaaaaaaaaaaaaaaaagcctcctgggtcagtttatgggagtactttgggcttccttgcatgttcatttttctcttttgtgtgtaatcttttgacccttcttcctgtttgggttttaattttctcaccttccctggtgggtgcttcctcaggctgtggcgtaatgttacatggtgtggctgagtgagctaatatattagggtgtttctggtgctttcagagcacacaggggaggaggcattgtttgccttagggagcttctattcaaaaggtccttaaacagtgaatgattcatgggttgtaagcagaaatagggaagtagaattctgaactgcaggtaaagttcagatatcagcccacagccattgccatcaaaaagaagaagctgaatcatgacttccattgtcattttagctttatagcaggagtttctttaggctgtcagagttatggctcactggtgtgcgtttccggttttctgaaaaaatgcacttgattttaatgccagtgcggaaagatatcccctgctgcctaaggcatctttgcccattttagcaattggaatctagttcatgaagtaagtgttgaacagtcttcatgctagaatggcactaagtagatgtattttccatatctccgtctcatggaaactattctttgaatacttgcagataatatttcaacaatagggagaattggtagagtaagagctttaaaacttttgttgaatgaatgaatgcgtgagtagaatgaatgatacctgtgttggatgtgacttaagtgtggtcctttgtttcagttccgaagttttaagtttcttttaaatctatttcttttctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcgccgttttagccgggatggtctcgatctcctgacctcgtgatccgcccgcctcggcctcccaaagtgctgggattacaggcgtgagccaccgcgcccggccttaaatctatttcttttaagatttaaaagaaatacctgaagttcttaaacttgagttctatgtttttgatcgcttttaaatatgcagcccttcatgataggagttaaaacacgaacaatttgcacatttccagaagaaacatgtttgttgtattctgtatgtccttccggtgtctacactaactgatatcattgttgagtataggaaagtaaaaggtggaaaatcccataaacatttctatcctacttttttttttgttttccaagtactgccatttctcaccatctagagaatcaaattgtcttcaatgtgaacatgagctctgtgtttggcacatagtaagtgctcaacatacatacatggtcaggttggctttaggggaacctgaaatgacaattgctggccattttattgactgtgcccttctattccttctaatattttcaaaatcccttaagacttttacttgcttcagagaaagaaatttttttcttccatgttagcaaatattataaggaataaaagaatggaatggacatatctataaatagacttttatatttatataaaataaataaatatatatttatatatattttgggattgcttcttaagctcctgctttgaaaatggaatgcatacaatttaaaaacattaaaaagtatatagtttaataatcagagtctattaaaagcttaagattctatggtctattatttgacatttttcttcccattagtcatagacacaaaatacacatttctattaggaaaccaagagtgaaaacatcacattgtaaataattaaagtcgtttccttttccacctggcctccccactccccttacacagctcagaggtggaaataatggtcaccctagttaatctcagtaactatatttgaggattttggaatgggggccaggtggttcacggagaattccacattgaactgatagctctttgtattattaagcagtgtggtagttgagcttcatactcatctcaaataagtgaagaaagttagctaaatttctcaactgagattaaccaaaataagactcttcagatgtacagaggagtacttgtttcacggcgcagttcctttggttcttcattcactaaaccaagttgaaagaaacccagtaagactgattttaaaccaaaattgactgtagatactagagtggtcaaatgttttaatgggaaataatatttagataatatttggagggggtaattcttgtaagcacttctgtgtctagatatatatgagtgcccctatacagagacttccatgctactttttctgtacaaaaattactaacatcagttcttacttattctcactggaactgagttgtggatggagggattttcctgtactgtccgtcctagtttttctaagaaaaaaaattatcgtacacttttgtgggctttagtttttctgttggatttaaaagaaatacctgaagttcttaaacttgagttctatgtttttgatctctttttaatccctatctcatgataggggttaaaacaccaacaatttgcacatttccagaagaaatatgtatgttgcattatgtatgtccttccggtgtcttcgctaaccgttatcgggagaaaatttaaaaataattacttccaggaaacaatttttaaaaattttaatgtagatagcaaagagaaaaggtagtgagtacaaagaaagcaagtgggatgggttctgttttgtttgttagtactaatagcagatgggtggtccaagtgtaccataacttttaagtgaaatttaagctgttgtaaaggagcattcttcatggggtcacagagatggtacctgcagttggatgcccagtgactcctcaactttgtggacccagatgtaccctagacatctagtcatccatcacctcaggcttgtattggaaacctggagatcccccaaatgctgttttgcatgtaactgaagttagaggacatgttaggaaaagctgttcttgactgagtagaaaacaaataattgtattctgtttctgatcttcatttatagcaccagcaacaagtggtgcaggctgtggaacgggccaagcaggtgaccatggcagaactgaacgccatcattggggtacgtggcctttccattttagctctgatcttagtgtttgtcatcagctctctcgctctctctttttacattttgttccgccaaaggggcaaaaagcaatagatgactacaaaatgaaattaagcactttgccttcaatctcctgtgaaatttgatggctgccttagaaactttggatcacattctcaccaatttaagtggatgtgttcatgaaaactctcctctaaggagactggatagctctttttcatatttctttgctttgcaatcagcttgtgttgctaacctaggccaaaaaaaaaaagagatatagattgccctgacgttaaaatgacctggtttcttttttctttccttgaataatcatgtagagtatcttactatcatttttaatgaggtgtacattttcacatctcccgttctacttattcttccttcccctgtcatgagtggctcttatgggttagtgtccatttgaaatagaaataatagatgaactacactttatttttaaaaaaatcagtggcccatttagaaaatccttcctggcaatagtggcattaatgttgcatagaaattgtgctggaattcatggatttgggcagtcacttcaactctgcttatatatgtatgttttttttttctcagattaatgtaacaggcaataaaataatgtgctgaaacttagaaataacaataaaggcaagaaatcacagctgtaaagagcataatattcacctctctatttatgcagattgtacaagcagttccttgggttattctaatgaagacactacaactgcactttcctctttctgtcccctcccaaatactttcttttgtgtatagattatacacaaaagtcttttttttttctgtcagtgtatcaaacacactttgaaatgctaattatttcgtttactttcattaaaattcaaattgctgagtgaagatgtggataagggtcgcctgataatcaatctgaagtgaagatattgcttcaattattcctctgtcttttaacaaggaaatcagaactctgggatcactgctgatgttgagggcgccatagtctgattgtagcttgttttttaatggggtatttggagctctattttatgtccctctgaccaaaaaaaaaaccaaaaaaacaaaaaaaacctggtaggaaattagcagatgtaatgaatggaaaagagtgacctttatttcctccagagtgccccttggaaacaagaggctgaatcagaagaagccatgtagaatcatgaataatgtttgtcatacattttgtgtgatgggcaggggaagggacggatagtagagacgaatacatttcgcaattggttttcgtttccaaaaactccaggaaacagcagtatattaaatttttaaaagttgagaaaggtttaattttaaagttaagtgtgtgtgtgtgtgtgtgtgtgtgtgtgtgtgtgtatatgtataaaccagctgtgctccattgacgtgtgtgcacaagtgcaggtgttgtattcactgtggatatttttgttaccaaatcttccaggggtcagaagggatagaacctacatttctctactgtctctactgtttaccatggagagaatgtgcagagtgatccctgataggagaggttgctgggtcatttttagcttagcgtttactgtttgtatgaatggctgaaatacagatagccctcctgccttatgtgtgattggcagccttttctaggaaaacagaatggattattattatttttttttcctttttttgagtcttttaatgactgtacagtggagagattaagctaaataaaaaacactttgtttatgtgttggatgttgcttaatatgagggaagatataaaatcagaacaagttcccttcacttcacatcaagaatatttttaatattgttttatatttattcatttttatatactttatttggaatggaatggccgattgccttttcttggggaaatgaggatttattagactgcagccaagttactgacatattgtgtttatatgtatttaattattaaaataaagctaacttaattttgtgacctaaaaacttaaagaactaactcagcagtacattctgtcaaagcagcgttacgtgctatcaacgcggcatatacttggatatagttggatatagttggatctgatgagtcttccaaactcttggtatctgagcagaaaatggagtcggaaatcacattatctgactattctggaaaatagattgcagaaataggaaaacaaacccaacagttttagagaaccacaaaccaagtgagaaggaaagagctcagttacaaactcacttgacaaatttttgctgctgaggttctctttgtctttttagccatggtagtgcttgcatccagtagtttttgcagttgtaacattgtagtattttaaaggcacttgctgttctctgtcccttgagcgtagatggctggctgagttggtggtattttgacacgctaccaaaaacaactaggggtcagtttttagatttttgttacttggtttttagaatgtagtcagcagtgattttctgcactgaaggaatgacagttttcctttgagaggcaaagacccatctaagcccctgcagaccctcatttatttatcactacatatgtgtctattttatatgtatgcacaccatccagacaagagcaaatgttcccagatttaatgaaatctgatgaagcacctttttaactctgcaatattattctaccttcattggtaaatgagccaaacgagtgatccatgcagtttaaatgcaaaatgctgaagtgatcccgtaatctggagaggcggctgttctcttgacaataagctggttgtgtttaatggaatgaaacacagttataatgatttctttcacaggtcatgttcagtttaaaactgttgatagattgaaataagttaaatatcatttatcttttatttataaggaagaaaaccaggaaaattcctgtgttggtttcccatcgttgatattttgtgttttgttttgaattggtgatattacacatttccttcaggccttccccaagttccctcagttgggctaggggaacgttatggatctagtttgattttgtcatgtgtcctgctagccactgtgtttttaaattagaatctctgcgagatcacactgttggaacaacacacaaattgtagttttaaatcagtaatatgatctaattagaaatgatgttttcatttcctgtattattaaattgagtcacctgactatcttaaaatgctttttaaatctattacactatataatcagtacatgctgtgtgaatgtggttatgcttaataaaggaggctgacttggaacctcataagaatttcaccaaagaaactaccattaagaaaaaaagtttagtcagtgtgaatagtggaaaagaaaatgtttggcttataaaaatagacgatgtgggttcctttggaaaccccctaacccactttttaaacctaattctgaggaaaaaaaaatgatagaaatgtatgcgtttggaaaaaagctcacccccatccccaataaacccttaggaaacaggtatgccatggtgttgtaggaattgcagtttagcacaagaaatgctgaacctcaatttttagcagtgacattttaatgataggaagtctgcaaaattatttgccatcaattgtgaaggcaataacaagccttggtggtttttcacactctctgtgttaagtgctttcagaatgacagcgtaaactgtgttagagaactccaaggaagtaaaactgattaaaatgttcatgcttgaatggtgctgatggaatagttcatttggactttctctacctcctgcagctcaagctgaaatattaaaattcagtggatttaaatctctttcctctcagctcaggaaaaaaacattacattttaataggttttaaacccataattcattggattggagcagcactattaaatctatttaaatattacttgtattactaaggaaatgatttaaatgactttgcctttaccatcctatgtgtttgagttagtttaaaaaaagaaagacaatacctttgcggtcccccccttagtattttgttttcttgtccttgtcatatgattgaaccttaaatgtgtgtgtgtgtgtgtgtgtgtgtgtgtgtgtgtgtgtgtgtgtgttttctacattgacaacgtggtaagagggtcttgcagtatgactgtttaaaaatgtatgtctcttcttttccgttatagatttcaaaactgccattttaactttcaaaggcatttggatgagccaccgtggtcattttccttgtattctttttaaacagtttagccattaggcagaaagggaaagatataaatatgtgggtatatataaaaatgtgtgtgtgtgtgtttccctcccttacattgcaagtgtaggaaatatacccctgtggatacatggcctccagtaacacacaacttgaaattaaatttaaaaatttacgtttttttacaaaagtattcttcctgggcccaccgtgtacccctcagttcctttctctctagcccttgccactacaacatgtgtcccacagcctgacagcacctccagtcagccatagcgcgaagtgcttgctttcccccagtgctttgtgggaaacctttgtggggaatccacccttcacttacacaagcacagcctggaaagtgcaggaattacagctgcattgggtaaccctgaatcccacagggaaacagagttagtggaatgctccccgcattctctgggggagacacctgtaagatgccttctatgctactccacaaaaggttccagtaggatggagcttcagttgcccacagtagtgataggctagataatacatgtttattttgagttttcccccttccgtggttcactattcataggcccgtactcctgttctgtgatcatttcaaaattacctgcagccaagccctctccctccactttcccggcagacacttaggatttgatttcataggcctcaagctacttaagggggctttacagtgtaggtaggtaattgtagtcatgtactagagtcagggcttgttttctgatgtgagttctgtgcgtaaaacatatttaacagctcaactgtacaactcagcttttgtgttattttttaaataaatatttttcagtaaacttacaggtgagcttctctatcttgttctgcttcttgcagctgattactattggtattttctagatgtatgtaatacagaatgaaattaaaaatgagctataaaatagatttatcagagattgttatttcagctttgttactgtctttactgaatagtgtgcctggagcttaaaggctttataaaacatgctggccactgtctgtgtcgtgtacacacacagcttgcacaatgggggaaggggctggcttgaagatgcactcacttggagggctttactcacctgcattcatcaaacacatggcaggaacaccaaagcagttttacatcacattctttcttctttatcttctgtgggtgtgcctgcccctcactctttttcttttcttaactggttcatttgccatggagcaggggactacattattgaatgatgtattcataatctaatctttctgctacggtttgatgaggctctaagaggcagtaatttcccttctctcataacaaagactctcatatatttaagtaatttaaaaactctgcctgcacttcagagacgcccaaaaaccactaggtaaggaataggatttctgatttgtgcttgtgatgtgctctccgttattttctatgacaaagcttctctggaagaaatttctagaagccagtctatcaatcctctcacctccaaaactgggactagccagcaatgctacaatttttctttctgtttggagctgagccatcctttcctttcccccagtgaatgcacttccatcgctgtagagttgagttcaaagtgttataagagttgcagaatgtgtctgggtagatgtatctgaggaagggatatgggcattggcttccactgagaagaaagtagttctcccagatccacagagctcggcaggctgagcttatgcagaggtctgaggaatggttatatagaaaaacaggctaaaacagagaataaggcaacctgcaagcttgcagttccagagtgttaccccattttataggttgttttgttttggttttgtgtcacttttgtaattctctgatgatttcctgccagcagtgtttccacaagcagcatcaccaacttccgtatagtcagagacctttttccttgtggtgtcagactgctttgtacccctcgaagctgagagggagggaagaagcatgggctataagagacagtctcacaccaaacaggcaactaaagggttattgacagtggttaactgtcaagcacttaggtgaggtttttaaggacttttgttgcctgttctcaaagctccctaagaaaccagtttgggaatccttctaccccaaaatgcatgtgtggtcttaagtgttgtccttaagacctttgtgaaaaggttagaactctttagtgaatagcaagagttatttaatgattatgtccattcattcattcagtaaatatttgagtactttcaccaatatcctattaaaggggcatattttattttcattttgagtgatattttaaattgtcttctgaaatatattctgaaatgatcctcaagttacatttaaatcattctattaaaattttggtagctgtcagcttgctggtattacattgtacttacaaataatcaacttttaattaacgcattttaatttcaataaagctagtttccatggataacagagtaaagagaaatagttaataaaaaacataagaatgaagcagcatacatttacggatttgtatttttttatatttgcagatacattttcagatatttggattaggaatttagaaattcattattgatattctctattacatcagatttaatgagacgtaatctgcaaaaagtaaaatttaccctttccagtgtgtaggtctttgagttttgacaaccgaatacagttgtgtaactgccaccacaatcaagatacaggatagttccctccaccccaatcccttgttactctttgtagtcagtcatttttttctatcccagcccccgccaaccattgaaaatgtgtcttcttccaaagtgagcctttttgacaatgtcatgtaaatggaattatatatcatgtagccttccgaggtttcttcttttacttagcataaggcatttgtgatttgtccatgtggttgctcatatcagtagttagtgcctgtgtattgcagactgatattctattgtatggatataccagtttatctgttcactccttaaaggacagttggttgaataaagccacgagaaacattcttatttggatattttaagtaagtgaatgtaagttatatcttttgggtgattacctagaagtgggattgctgagttacatggtaaatgcacgttaaactttccaagtaattgacatactgtttctcagagtgattctactattttgcagtttcactaatatattacatgtaagaaaacctttcctctacatctttgtctgcacttggaattacaggttttggggaggttattttagccatcctaataggtgcataatagtacttactgtgttttttatgcattttcataacaattaatgatgttaagtgtcttttttgctgtctctgtatcttttctgatatctgttcaaatctttgcctctttttttttcatcagtcagttttattattgagttttaagagttctttaattttctggatttttttgtgtattttgtaattctcccaatctatagtttaacattgtcaaagttaaacttaggctttttttttcctttatggacttttggtgttgtctgtaagtaatctttgcctaaccgaagaccgcaaacatgttattctggggtttcttgtagaagttttacatttaggtctataattcagttcaatttttgtttatggtaagatatatgcattaagttgaggtttttttttttttttcccacaaggacatggattcagtttttctagcactatttgttgaaaaggctatcctttctccattgatttgtctttgcaccattgttgaaaatcaattaaccttatatgtatgagtgtatttctgactgctccaatcaactgttgccgtctcttttgctagtgctatactgtgttgatgactatagctttcattattgatgttctccattccgttttgcacttgttcttcctgttcttccttgccctttgcagtactcctcagcacttcaggtctttatcatcagtatactaaagactgactgatggatgaagggaaagggtctaagctcagtataaacactttctctcatcagaaatggtgtctgctccacctcctaacatttctctcaaggttgagcgcatttttccatctcctcctggtccaagtaatgcctttagctagactcttccagcctcttcctgataggctaccatgtttccgcatttgtctttctttcattctacacacagcagccagagtgaccttcttataaaatagaaataggatctattggtcctctgcttaaagccacagtgagtgtggtggtgtcgtctatatatatgagactatatatagtagctgagacgctactcgggaggctactggatcacttgagcgcaagagttcaagaccagcctgggcaacagcaggatttcatttctaaaaaatttaaaaaacaagcaaatgaaaaacccaggaaaacctgatggctgccccttttatttagaaaaaggtctgaatttctaaccttggcctacaagattcttcatgagctgacccctctttcactggcctttctgctgtcacataccacttatgttcttcattcagctgtccttaagccactttggcccctttcttctgtccctgggtcactccaagtgtgttctcgactgagggtttgtgcaccagcttctctgtcctctggatagcccatcctctggatcctagagtggtcttccttatgcctcttttcagagtgtcagctcagatgttatttcctgaggaaggactttcttggctggcactctttttactctttgcttctaattcattctctgtcccattaacctgttttattgtcgtcattgcacttaccattgatttgttatgcatcactttcccttgactagctagtgaaatctcattcacttttgtagccatgaagcctagagcgataggtatctcataattttcaatacgtatttgtatgataaatattcagtaactatttgttcaataaatttgcagtaatttgttcataataattttccatagatgtttgttaaatactatgctctgggatattttctcatttggatattctccgtacaattttgagccaagatagaaaaggaagcgcatggactggtagaaaatatacagttctgggtttcacttatagtatgatattaggaatttcatttaggttttttcatctgtagaatgcaaggctggagctggcctatttattttgacgttaatggaatttttattttaaaacttggggtccttttgtgtcatagttatttttctaggtttatcacctccctaggcttgtattcttttcctgaaaaaggtaactaaatatagtagatgttattgaatattcgctctgtgttaagcatttacatgcattactttgtttaatcttcacatcaacctcatgtggaaggaaatactgttccagctttacaaataatgaaaccaagggctttgaagaggtaagtcattttctgaaggccacacaaaagaggagtggcaggactgggatccaaactccagctgacttcagaactcacacatttaaccattatgctacacttgtctcttatttgttctcttgactctgttctttctttcacactgtcatcaataatctctttatcttgagatccactgataggattgtccagccagagctcagtgttggaaggaaaatggaaactgggtatgctgggtccacatactaagtggttagtctaaattgtctgaattatattagttccacaggtcagttggatactcttgactcatacgttgttgcttcctgtctgttgtatcttactcttatgaacaagaactgaaagttgttataaacacagctgttaaggcaggtgttttaacccagtgtccttggatcttctggaatttcatgcttgggcattgggctgtcaattaaatgcctgaattgcttgcagaattgcctgtgtgtgtgtgtgtgtgtttggggttggtaggagaggagtatgtatagtttttggaggagagtgttcacaaagggtcctgtgacacaaacaagtttgaatccatgccttagtagaataggattgtgcaaaatcctgatatgaaatagcaaaatatcatgtggggtgcatgtagacaaaaaatatttgcccgtagcagcgtggggacacattctaggatggttgttcagaaacttggaaatcaggagtttacttttgtaggagggtttcttgattaagaactattgttggtactctagttgcaggcagcagtaggtgaggcaggggacatgactggtggtgaagaccataaaggggcccccaccaggccagtggctagtcaggagatataaacaagttagaacttacagggattgccattatgttgtggggagttctatctttgaaattacttcattgctttgtgataagctctatacttctctgcttctatttctctatcttgagaaaaccttgtatgcctgacttgtgaataacaattatttcatgagatagagtaatattgcaaacttaaaaaaatggttttgactaaatagttagagctaactgtgcctttgaccccaacctcttaagaaaaactcagaatggtacattcttgaatcctttttaaggcagctctatagctagtctgacccttgtgattctcatgcttttttttttttcttggtagattcataaaaatggtgagagtttatctttgctcagattgttttctgtgaccatcaagggcagtgccactatggtcccgaagcaaagtggcagtaatgttgctttttttctttatttccctagagtgtttctgggttgactcaaagcaatttgtagacacagctctgcacaaattaatatctgggagaagaaacagttgagaggaaaaaacagtttaagttgagatctacttggattgaaagctcagaggttgttcttgggtttctttcagctaatagcttcagaatggcctctgagcaaagatagatgtcgaggcaggctttgttgtttgttggttctcccttgcaggcagaggctaccctctgctatcaaggctaaagcattccaggagctctttgcaggcttccttacagaagaactgtgggcaagtgaccctatccaggtcagcgagatataaaaagatgtggttttcttcttaacagaaacccatggagagagaattatcctcccttctgcattttaatatggttatgtgaaggcatgaggtaatgtgtggagctgtggcagccatcttgtgatgggaggggatgggatttgagggatgccacatgaatcagggacccagagccctgataatgttaggtcatctatccatccctggacttgtagtgtgagaaataaaaattcctttaaaaaaaattcaggccatttttgggtattctataccttgcagaggaactatcttaactcaaatatatagttacatgccatataataatgtttcagtcaaggacagaccacatatatgacaatggtcccataagattataatggagctgaaaatattttattgcctagtgacattgtagctgtcgtaacaccacagcaaattactttttaaataatttttttgtagcagtgtagagtaattataaagtctgtagtggtgttcattaatgtcctaggccttcacatttactcaccactgactcattcagagcaaattccagtcttgccagtttcatttatgataagtgctttatataggtgtaccattttttatcttttatactgtatttttactatacctcttctgtgtttagatacacaaataccattttgacacaattgcctacaatattcagtgcagtaacatgctgttcaggtttgtagcctaggattaataggccatattgcatagcttatgtgtgtagtaggttataccatctagataaatatactctataattgcacagtaataaaattgcctaaagactcatttctcagaatatccctatagttaagtggtgtatgactatagatagatacatatatatttctatgttaatgtcatgacttatgtatatcaaaatactgggaacaacctgaacacccaacactggggaactacttaagtgaactcaggtatggcagtacaggttgcaaagaacagaaggagttgagtgttactttgaagacagaactagaaagacctggttatggaagacggcagagtgagactaagtggaggaattcaggacaccctggaaatttggaacataagtaactaggtagatagttgtaccatttactcagatggggcagaagagagaaggaatggccatatgaatacaatggcataccatgtagctgttagaaatgatgtagtcaaggtgtattaaggatgtggaaaaatgttcttaatacatggtaaacaggaaacgaagaaacaggttaaaccacaagatagtttgagttacttttgttaaaaatgctaacatgaattcaaaaaatactggataggcccaccatgatattactagttttctttggctggtaggattatgtgtggcttttaattttttttttcactccgcctatcttcatttaacatataagtttctaatctgaaaaaagctataagacaaaattctattcatatggccattccttctctcttctgccccatctgagtaaatggtacaactatctacctagttacttatgttccaaatttccagggtgtcctgaattcctccacttagtctcactctgccgtcttccataaccaggtctttctagttctgtcttcaaagtaacactcagctccttctgttctttgcaacctgtactgccacaaccctaactgaagttatcattcattattttcttgtttgaaccccctgcattacctactagccggtctcctgcccttcattcttgccactctcagattcagaaaattattattttttaatattctagcttaaaatacttactagtctttataaaggccagtttaagctggtttacacactcaagcttaaaatacttggtggtcttctttatataggccagtgaaatagaataaaatactaagaaatagattcacttgtatatgtcagaatggacaagcagatcagtggggagaaagatggaagctagtaaatattactgtggggctacctggttattcttgtggaaaagaattggatacatacatgtcaccatatgcagaagtcaatcctagaatcataaaaagaactttaaaacttaaaaaaaaaaaacaggaagaatcttttttttttttcttggagtaggatttcttaaaagggtcacagaaagcccaacccatgagaaaagattgatagtatttaatactcacttggaatgaaaaacatctgttcatcaaaagatgctttaaagaaaatgagaagacaagccagaaaccaggagaagttatttgcaacacatgtaaccaaaaagtgattatgatccagatttataccagttaaagagcaactaaaagttcagcttaaaaaacaaaaccaaaccccaaaacccaccgtagcctagagctctaattattcttaaataaaagtcaaaaacccttagtgtgcacagcctgattcccagaatatacttgtattctacccgacttccccattgctcactggattctcactaggcttccttttacttcactggtcacagcaagcgtctctcttgttctgggtcctctcaactgcttttctcttgcttctgattctcccagctgtctgcagtgtgctgtcatttgcatcctgcaggtctcagttcaaaggttatttccccagaggagctgcctccatttatttttatgaatgaatgattgcttaccccttccaccctagttgagaaagggtcctaattgggcagcaggtacatcactggactaaatggtaggggcttgtgctccatttcttgatgctaataccatctcccactgactctctcacctaggagatcacacatgtgagtgttggcctggtttagcgttcttcaaattgcagctcaagagactcatgagtgtacagtgaagtctatttagtgggcatagtggactttttttttttttaattaaaaaagggtatagaagactatagaaaatattagcgtatgttgcacatagtagtgtttggtaaactttgttaatttacacgtatattctatgtagacacacacacatatgcacatagacacacacacagaaattgtggtcaaaattttggaaagcaagtctcctagatgacatctgaggttcattccacctctgacgttctaagatcaaatgcaggattactgaacaacctaaagcagataggctttttaaatgctgctttacttaaaaaaaaaagaaaaaaaagaagaagaaattagagatggtgtctgactgtgttgcccagattggaatatagtggctattcataggtataatcatagggcaccacagcctcaaatgcctgggctcaagtgatcctcctgcctcagcctcccgagtagctgggactacaggcacatatatgccactctgcttggctcagctttacttttttttaaagtactctgaagtaactaaagaaagcttttctgagtacattcccttagcttggtgactttaaagactaaaacttacaaaatagaaccattggtatcagtaagatgttaaagactaaaaatttttcttaagtagcttaaacaagcttctgggaaattgtatttccattattaatttgcttagaagtacaattactaataaacttttggccaattcataaaatacgctaacgggatcactaatgggaaagttaataaatcagggtttttgtagttttctccttcttttcttgccattattacttcatgagttaaactacaagttaggacaatggagccgctggcaaagatctcatgatttgcttgctttggttgttacttgccatccccttaagaccagtccagagatttggaggactacagagatctgtggtttgtttagcttgagaagcttatcctttcagtgataatcttacttggattgctctaaatgcatgtcttctccctatagtaaatctcatgttgtaagtcatcaggaatgagttacagataagcttagtttgaaaagtttcttcctttgttctctttattcttgcttctttccatatattcacttaacctttagctttttctagagatatttgttaaagtaaggtaagaagggcacatcttattttcccagcctctacaactacagagaaattgaatgaatagtagagcaaacactgtatactcgtcacctagatttaccggttaacgtatcgtcacttttgttttctgtctctgtttatatactcatacaaatacatgtgcactttttggaatgtgctgaactaattgaaagtaaaaggcaatcatgctgtttcaccccctaatatttcagtgtgcttcttctatgaacaaggacatcttcctgtataagcataataccattaacacattcctataccagtgtgacagctcataatcatatttctccaattgtccacaaaatgtccttaatagcacttttttattcaatccaggattcaattcaaaaattgtctttgctgtcatgtctttttactcttctttaaatcacagtgtccgaaagcattttgctttttaagatattggcattttgaagattccaggccagttttctggaatcttccacagtctacatttgtctgtttgtttctgattgttttctcaagtttagatttcggttaagtgtttttagtaggaatactaactaggtgatgtgtatttccagttgtatcatattactggtgaagctaggtgatccatggggtgatacctgggcactatgaataacctgtttccctgcaactttttacccagtggttgtaatatcgatggttgagtctgtcttgcattagttaatacatttgacatggtaaaacagtaaattttaagttatttctttcctttcaaattaatattctgtaaagaagagcttttcctgttttctcctctcctcgctccctcactctctgtgcatatgaaaatgtgggcttctggtacctttccttaatactagcagtcaccatttattgagtgtttattatttgccaaacactgtgtgatatggtttggctgtgtccccacccaaatctcatcttgaattatagttcctacaatccccatatgtggtgggagggatctcgtgggaggtaatttaatcaggggcaattttccccatgctattcttgtgatactaagttctcacaagatctgatggttttatgaggggcttcccccttcactcggctctcatgcttctgcttcctgctgccacgtgaagaagggcatgtttgcttccccttccaccatgattttaagcttcctgaggcctccccagccgtgcttaactgtgagtcaatcaaacctctttcctttataaattacccagtcttgggtatgtctatattagcagcatgagaacggactaatacgctgtgctaagggttttatatggatcatgtcatacaattcttccagcaaccttgggaggtagattttgtaactaactgttctcgctttttacatgaagaaacagagcatcagaaatgttaaatgacttgttcaaacaggtaataaggattccagtgactctgaggccacttcattgtgatgcttcccaaatgtcagccagactgtgctttctcacacctagcccgacttacagacaggagcgaggccagcagaacaactgtccatagtaaatagtgtcttcacaagccaaggagtatggctaccagcccagtcctgggcccttccctgtgcttgctgctctatttcagagtctgttgcctcttcctttttggctcctttcaaggtctgctgagtcttcccttacttctctcctagaatggaacagtgtctcctggttggattgaggcacacgtgctcagagcgagcagctcacagcttggctagctcctggtggatgagtagtatggttgtgggcttgggagacagccagccttgaacttaggagctggcactggcctgagagtcattatctgtctctagtccttggccccagagtgccctacatcttcacctattttcttggggtaccaaaaactccattcctgaaaatgttttttgaaaatgtgttataacctataaagtcattattcttaatgatgctgagattgtctcaagttttgccagtggggatcccttcaatttggctcattgtccttttgacacaatatccgttagtctagatagctttcttgatttctggcacaagatatagcaggttcaccttgcacttgcactttttttagaaaccaaaatatgagcacaaagtgtgctcattgctactgagatgttgttgtttctaaggaaggtgcgtgttttttgagaattattctgctgttgatagcgtagtagagttggagtgggggtgaacaaggaaactgctgcctggccttcaattggaaatgcccaaaattcctagggatgtcagtgactgcagctctgtccttgctggctcctgcttggtcaatgacttgtcagtcccttgtcatcaagcagttggggacctttgattacaaagaactcctctttttgctgacagaaagacaacatttcaaaagacatttcttgtgaattctattctccagtggtccttttctgccctttgtgccaaacttgaaactgcagggaaatctttgttacagagaatccagaaaagacctattaacagcattgaggctgtgtctgccacttcatggctgtgtattttcagacatcattgctatttttcagaattaaattaattatcttaatggagtacttacttgcttaagtttaaagttcactccattttaatgtttattttcttgagtggcccatcaaggaaataggaagaagtagtttattttgtattgtggtttgagataagagaggtttttatttattattaattttaagtaaggcacccaaagataataaaggcctaggaaggatagtgagaagaattttgccatgatacatattttcctcaataggtcttcctcagtggtggttatgtatgtacgtttattttaatactctagtctatgccctctttaattctttggcttgatctttgttttgtttttcttctaaagcctatatatatatatattttttttaacctgctagtttataatgtatcttaaattacatccgtaacaaatctgtgttatactgtgtactcttaatgtacatttcccttccttttggtctttaaaaagcaaggggttttatgtttcttagtgggactgtaagataaagtagaatatctttgcaggttaattgctctgtaattaacccagatggggcagagggcagaggacagttttgacttaaccctgttgggaaacatcagcaagctttcactttactgtagagcaatccattagattatggtactctcagctacttgactaatatccagagaaaccttactccttttccagggaatcctgagttcctctgttgataagatgacttaatagaaatatatttttaatgaattcttgacatttgataaattaaggccatttattttagcagagaaaaaggtgaagttctacttagccattggtgacttactacttttatttaaagaagatgttttctaatatgttttattgactaacccttatcagttataaaatacctgctactctagttctaggctagttcctaaggtgaaaatttgcaaagaagcttaaaaatgaccactaagtacagaaaggggtctcatttattaatgtatacattttaaagcctactgtaatattttaatatctctgtcatatgccttttggtgacttaatttcattttatcttatagtttaatatttttaaaacacttgataaaaattgctcccttctacaggatgcctgagtataatttttctgttttgatattttgtatatgtataaaacggtgactgataaacatgaatttatggtagctgcctctcatttattcttctttaagatcaaggcatatactattaagcagtatgcctgtaggttggttgttaccattcataaaatctttgaaaggactttataattttggtataataacaaatgaaaaagcttctctaaatgcaacgttgtatgctggtttggattctgggacagaaaaatgacattagtggaacaactacagaaatctgcataaagtctctagtttggtgaatagcaatgaactgatgttaatttcttagttttgataaattttatggttatataaaatgttaacattagtgaaaggtaggtaaagaatatatgggaactctatatgtagtagaagcttaactcattaaaagctttgaatatatagagacatatgaccatagtttgagttcattaattagttcagggaaagtttagtggtagttatatttaagcccatttataattcataattaggaatttaaaaattaaaagaccgacaataaaaataaatgcacttttcatatgagggcaccaagttctgtatgttcgatcactaaaaatatcagttttactcattttagattattgctgcttaagatgtccagaataggcttatagtacaagcagcttttttatttcttctagtttaattttaaattcaaaagcttgaaacatctggaagaaaatagagtcagaattcatcagtgtataaaatcatgctgatattagttggtaatctgtttgcatacctactaagtgtgagaaatatctaggcactatgggaaatattttttaaatagctctaattaagaggtatggcatacacagacttgtgcacacacacacgtagcacatatatatgtatttaaaaagtctttttttgtcttggattgttaagtatcttaatggtattgagcttaagtggtgtcagaattgagagacagtggtggagattactttgagccggggtgatgagggatgtctccaccgagaaagtaggcaggagtttagcttggaaggatgggtagaatttatacatatagagacagatgagagagtactctgtgggtgtgtgttgattagtagtaaagctgagccctaggagtttagatgtctccctaaacagactagtgttgcgggcagagagttccctggatggtgttgcacagtagggtggagttaggctgatgctagtttatggaaagtcttgaatgctaagaaattggaacttttgtttttaaataaaagggatctgttgcttttggaaccagagagtaactatcaaaggagtattttattttcagtagtatcagagttttgtattgagttctcgctatgtttagggaactgagctaggtgccaggggtactaagaggcctgagactggtctcttctctccaaagtctcacagtctctggcaagtcagggtcttcttatctgtaaaaagatgaataacaatgcctttatgaggcagtatatgccagtgaataatacagggagccctataagatgatggacacttagattgcttggagaaggctgtagggaacaggtgaaacataagctgagctgagataggtgagtacaacttagataagtaatgtggaggttgttctaaaaggtgcagaaggatatgaatttagggaaaaaaaccacaggtggagaaagcagtaagggttcattgtaactaaaataagctgatggagacttaaaataatcagcatgtgaggtgatgagtctggtgagtatcgtgacaagtagaaacaagggattatttgagaatcttcaggacttggcaattatcaatataggatagcacagaaggataacaaattgttgatgaccagtaacttgagccagtagaggttgggttttgtgtcacacattttcatttccaggtaatgctggacttccaagtacaattgtctgacaaaaagttagaatgggggtgtcaaagtttggaagacaattgtgggtcaaaggtggataaagatgggtgaggccagagaggagcaaaggagctaaaggagaaaaaatcaagaaggatatacaactgctgcattcagagagccaaagaaaggctggccatcgtgatgatttcagtgttcttgaagcaggtggaggatatactgtctatgactgcagatacatcagaaaaagaaaactgagaaatgctcagtcacgtgtgagtggtcctcggttttataagaatggtgggcctgcagtccagatgatcaggtctaaggagtaagtgtgtgtgtgtagaggaggggcttgttgaagtggaggcagcagatttacctcagtgtttgaagaagtttgggtgtgcgaagacagggacggacatacatacatacacacacacacacacacacacacacacacaacaaggcagtagttgaagagggcaaaagaagggtattgtagttaaatttaacaaacatcaagtgccagttttgtgcaagacactgtgtagggggcagtggaggacacaaaaagtgattaaaatatagtgggatttctgttcccctgaaaagtactgcctcaagttcttttgactttagatgggcagttcatcttaaacaaaatgttggacaaaatcagtgatgaaacaactgaggatgaaggagagttggagagttgaaggagcagtgaaaaagaatggaagaaaacatgatgtgcaggtggagaggctggcctttgaaaggaaaaggacccttctctaagattagcatacaagaggaagagaagaagctcattttagaactgttctgagatagaataaaaccaaacaaggacctcaggaagccttactgtgaatgtcatgtataactatgatttctgcctttgaaaagttctggtccaatggaacgatgagtcggtgcttattttttatcctgtaggagaaaaagaataaaagtgacacacctggatcattaaaggtattgggctttggctgagggctttttgttgttgttgttgttgtttttttgttttttgttttttgttttttttttgagacagggtttcactctgtcacacaggctgggatgcagtagcacaatcatggctcactgcagccatgacctccctggctcaggtgattctcccacctcagcctcctgagtagctgggactacagatgtgcgccaccatgcctagctaatttttgtgtttttagtagacacaggattttgccatgttgcccaggctggtctcaaactcctgggctcaagtgatctgaccgcctcaacttcccaaagtgttgggattacaggcgtgagccactgcgccaggcttgggtttttttttggtctaatgtaatagatacatttttaaaactatcaagataatgtgtgaatatttcagggtctgcagttagctaggatttgtgagatgtagactcatagagcttagattctaagaagggaggtaagaaagatgagcatgcaggatcttaataaatgcctgctcattgacctctgatctgaggtagaaagtggctgtgtgtccaaaacatacacaaggagtattaggggaatttagaggagaaagaattggagctatttctgtttttgaaacaaatttgccatatatttacttcaagtccctattttgttttcttcatagacgttattttctgcactgttaggaaatataattttgtgtgcatactttttgatccccactgaataacagtatgtaaagaattatgaacatgattttggccacttaaatgaagagaatcaccttatctcaaaactacccagttaagaaaaccttcagcaggacttggagcgtgggtggggcttggttggtggagtatctggatgtggctcccattttccattttctgcttgtaaacttgcttttcaaagtgttcatactttattctattgactatattttaagtgcatgtagccagaacataggtacaagtcagtaagagaaaagaactaattaatactgtacttggacttttgtagtcaaacataggaagacatgtgggagtggaagaaaataaacctaatttggagaggagaaaaaaaggtccactttttttctctgaggtattaataaaagcattttgagatttttcttggtggaatgatcgatctctctctctctctctctctctctctctctctctctgtccctgtccctatctctagatattttgtgaaattttgcttggaaagaaaattatagaagggactatttggctatcacaggttaggcctggaatgtgatttctttaaaggcaaaaactaaaattcagtcactacaaaatttaacctgagaattactcaatacttgttgtcatacaatattgctaagcagggtttgagttgaagggattcctattgagtaatacatttaatgtccttccttcaccaccaactcctcctctcccccacttcccactcagaagaggcagcaaggcttgcccaccgcggttcctgtagcagagtttgacgcagcctcagctgaggtcaagcacacccattccagcctcttgagggctttctctatgtgttgccagtgtgctggtaaaaatgactttaaactcttgtcagcgcagttactggtgcatgcatcacagtcccactcaaataaacctgtcacaacacagagtcggccgctagagaagagtacaagggcaggcctctagcttttcattcgagcatcactaaacgtgcacagagtgcccaattatttcagcattattgagcaagcctacaggaggacccaagccttgctacattagattttctttagtaatttgctcaagtaccgctgaggacacttaaagggcttaaaacggtggctgcaaccagtttccttttctgggttgttaattcaggttttctctttcaaattaactctccctgcatgctgtgcagtggttctgggagaattgtttaacactaattttctcaattttcagctttttttgttcaacataactgctttaacagttactcacgtatatgttttgattagaaatgtatgatagcgaggccttattttattttttgagataaaaaaagccttttatgaggtttgttaaagaaatatgtttgcatatcaactattgaaagttacttatatactttcaccacttaaaaattaaattatttatattgcatgtgcaaaacctccaagtataagaaaggtagcatttattgactacacagctcatttgctccttcccccttttaaaaatatatatatgttaatagtaaatcttacgtaggtgttggcttttttctttttcttttttttttgagatggagtcttgctctgtcgcccaggctggagtgcagtggcacgaactcggctcactgcaagctccacctcccgggttcacgccattctcctgcctcagcctccccagtagctgggactacaggcaccagccaccacacccggctaatgtttttgtatttttagtagagacgggatttcaccgtgttagccagggtggtctcaatctcctgacctcgtgatccgcctgcctcggcctcccaaagtgctgggattacaggcgtgagccaccgtgcccagccggtgttggcttttttactgccgatttatgcctcctttctgtttctcttggggcaggggttggatatgggggcaaattcaatatctgtgtttaatttttcacagcagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagaggtgagtaactctcttggaatgccaatctgagatgacctacttgctgctgagggtaggttctggatgctattgtttattctctctgaatttagttttaccagtgactaaacaaaggatttccactggaaggtaaattaattactgcaagtagtcaattgccaaatgatattctagtggttggcaagagctaacatactccctagaggcagaggggcctatttctggttattgcctttgatttcttgctaccttctatgttccccaggtctaaatcagtaatgaaatcccatgatgctctgtttgaagtagcatgttgcattaatagttaactttgactgaatttattttggggaatgtcttgctgataaatgctcacttgatatttgaccaaatcaattattatttataaacaaatgagcctatatagagcagtaaaaatctcacaggtaagaaaacaatttcagtagtcttagtaattaagaaggtacagaccaaattaatgaaatctgttggtttaactctctctctcacccagtctgtttagaagcatgaaattaactaatttcttcctagaagaccaacataattgtttatgcaattaattgatttaaaggccagttgtgctccttctaggttgatttccttcctccactaaggtagatgatggtgcagaaacattttgatgtgactgttgtttttctttggtgcttactgataatttttattagttgatgacagaaatgcagatgaaaaagtctctcccagcattcctttttgggaatttacttagcacaagggtggttcattggcttgaagggtgtgtttcataattaaaagctcatacccctgtttcagcatccttactgtgaattataatattaagtcagtgatttttatcacatatgcataaatatccatctctgatattaaaaacactgtaatttgtcatccagttatcttaatgctatggtacagagttgatgcatgattgtaaatactttgaaaaagtctataaggagcacagataataagaatgtccagctttggttcttctgaaattgtgtcaaaggtagattggtactttatgaatttggttgtgcagtattaataattaattttacagcacagttgacatctgtgtaatttattatttagcagagatcaagtttgataaatcagtatgattttatgtaaactaactagtacttttcttttcttcttcccaccactttatctgcttgtgttgctgctgttttgcatatagacagagactccatcaaggtaggactcaaaatttacagactaaggaatggcttaaaagggctgtaaatgatttgaatgaatctagtaaagaattctttgagatttagagaatgatttcattggttagtagtggttaactgcatttttaaaattactttcaggtgtgtggttgattttttttttttttttttaaaggtcccatttctctatcagaatcagatttgttgacccaggttgaattgcaagatctggcttgcattgctcattttattatttgccatgtgaaaaaaaaataactgcttttcttcacttaggctttggctgtaagataacaatgaaatgaattaaataaattggtttgtaaagagatacatattagtttcatatttgaggaaacagctccaacctacaaaaatatttgtttaagtgaatggtgcatttttttttttttttaccactagaaataattttctcttttaaatttaagtgaatttttttcaccaacttttctttcaaattaacattttggtatctggtataacaagttaattctctttaggttttgcatctgtcttatctgccttttgtatctctttatagacaagttgtagggaaagaggaaaagtatttaaggtctaatgatttgggtatgcttctatacctccagaatgggatgtgctaaggatacctgaagttatttagtaagcaaacaagaaaaataggctgccatggcaggaaatgagtaaggcatgaaaattaatgtgatcacttatgaaccagacacaatataaatacaccattgtaggccgggcttggtggttcatgcctgtaatcccagcatattgggaggccgaggtgggcggatcgtgaggtcaagagatcgagaccatcctggccaacatggcgaaaccccgtctctattaaaaatacaaacattagctgggcatagtggcttgcgcctgtagccccagctactcaggagtctgaggcaggagaatcgcttgaatctgggaggcagaggttgcagtgagccgagatcatgccactgcactccaccctggcgacagagtgagactctgtctcaaaaatacatacatacatacatacatacatacatatgtacaccattgtattatgcgtaattgtattacatatgccattgtgttacttattggttagaaggaaaggacagttctcaaccattggccgaggtacaaatgctgtctatttctttatatcttacaacagttgaatgttttggagtataggtagttatatcttgcagtttttaatggagctatgtatatgaatgctaaaattttctcccagaaccactgtgctagcactttgaatgcctttttactccttgtcgttttacaattaaaggaatttttttttcagagcccttaagtaatggaaaataaaacttgagcctatctgttttacccttcaagaatctttgtaatttgaaagggcatctgcactcccatgtaaatgtcaacatttacaattagaactgaacacattgaattatttaattatgcatttgcagttgtgtattttgttgtatcatatgcatatcagtacttagactaaaaaagcattcttaaagtatattaagtgtttttcacacatgtgtacttaggaagtagtaagtaaatgcagtggctaggattaactgataccagcctttgaaagcctgtccagttattctgaggtcataatataaacattccctgccttcttattataaatatatacctttaggcagtccagtgaactaaacaaaagcctccactcccagaagactgtgaaaatatttatacttcagtgtacacttttgtgtcaattacattttcttattccctcatgcaagagtaagggtgtgttttgaaatcatcaataatcattcagggtgagcctggaaatgagtatctgtatagctagaagccagggaaaaacaagaaaggctgatgattttgccttgatttattatgggatggcatctataaatagatgttttggttgggtaccattctcaaatttgaagttgtattacgtcaggtctgggactgtcctatagttctacaaggtgagatagtttgcttatttttctgaatgtgttctgtgatgctcagagaagcagttgtagttgcttgttccatcgatcgtcctcccataagtggttcctggttaagaggggctttttatgattgtctgctgtgtgactctagatggtttttatcagccagagcgtgccagttgcctgcagctggagtcgagcttgtatgaaataatttatttatgcaagataatgctccttaacatttaacaggtaatgaacgtgacataaatttccttcttgcttttaatttttccctttcctcttctaatgtgcaaacaggcagctctggtactctaaataataagtaatttttggccatctgtcaaaaggaaatttcaatacaaatttaaattaatggtgcctgaaattttttatagctcctctaaaagcctctaatgtgcagaaaattcggaatctgctggtagtaattagtgttgcatgtaatgaggatgtgggcaatcttatacagccccagtggaacattttgatatggtagcaaaattttgatttatacaaggttgtagatgggtttgattgtgagagatactttaaaatgttttcttgacgttacagattgttaaacagggcagatttcagaatagcttataaactataaatttaaacttactgtaaagatttaagtaatttaggtactttacctttagatgccaagtaaaattcacttgttaacatgttgggccttttttttcctttgtctttctcttctgggaagttctgtggccaccaaattgcacgctgttggctttattgatctctttttctatagctcctgtagccaagttcattcctaagcctgttatttgcagacctgtatctgaagtttttcaacaaaggtggagaatgtaaatatggatctaaaggagaaaacactgtaggagcccaagaatcagtttccttgatgatgagaaactagaccagtgtgtgttgtagggctgttgaagtcaggagccatggcacctgcagccttccttgcttgtcacttggctgtccagtgactccatgtgcccaacagtaagtcccacatttgaggcctgaaaatgacaagaaacacagactgtgatccactctcacccttaatggtagggcagaaagcccaaatttatctctccaaaaagaatccaacgtaggctaagggggagtgttctcaccatcttatgtagtatcaagaaccatttctctcatccctagaaaagtcgtaagtgacaccaaggaaatgttttctgaggtgatggaatcttccattgcccaccccctctcattgagggctgaggggtaaaagtgatgggctctaaaatggtgtcagaggggacattcccttgtgctgccaggagcttcccacttgatggaggttccagttcattaagaggagtcagctgcccagactgaaccagtgctattaggttcctcatagcactctccagttcttttctgagtgactgaaatgagggtaatgattcagagctgtgaaggccaaaattgcctgaaacttggtaagaatctgaggttcagaaatcgtcttatttcccactccgtcccaaatgtgtgcataattccaatatcaggtagcaaaaaataggcaccaaaatcaagaccagcttaaatataagtcgcaaaattcactatcaccaaatgctcattagctccgtggcctcaaccaagttgctattattgtgcattctttattactttgtaagtccttttcatgtatctgcctggttctcctgtgttttatcctgagtgcaatagccttctcaagtcacatctatgagggatttgccttttttatctgtaaaatatagcacgagtactttttctcctctgtgcctatgcttacccagtacaaacattttttccatctgagtggtggtgtttttatttttgttatttcattggaatgtcttcaagcccagagtgctggatgcatcatcaaagagtatgatcatttttagtgacttgtgcagtgccaaattgatctcctaaaaccctgtactaatttaaaatgccaaatgcaatgtttgaatatgtttccacacaatccgccaatatggaactttatagtttttgtaatttttgttggcataatgagtatggatggtgcactttatttttttaatttacgtataattattttttagctaaatgcttttctctgggtatatacactgtttttttcctgtgcaaattccttgattttgtttaaaggtttttataatgattcattcattatttgtgtttaaggcaatgcatttttattctgccgcatctgtattttggggcatagatgactaaaacatcatacattgcttttttctatcccccatttattatgttgacaataaaggtttatcagcggaaaattagaataaggttgtttttatgttcaaattgaagggcatgattcaggccaagaaagcacttttgcctcattaattgggtgttaaccggtgaatgtgggtttttagtctgaattaacagaatgattacttcatacacccctttaagtaggagttttaccgtttgggagataacttgctgggataaatttgtattactccagactttagaagtacatattgtaaaaaggcaaaggcataaaataatagaaaggtagattaaaaaggggaaatcattgaaatccacagaacactaaagagtgtttaagcaaacaaaacagtcatggacttttggtatcttctgttttcccctcagtaatcagcaatctgagaagagaagttgtctaattaagggctgtaacacttcagcatatccactgtaacctagggaaaaataaggtgggtccacagtgtccactcagtcctactgatctcctctgagcagcccccactgcatgtatagctcataggttagattttgctggtgaaggtaggtgttatgcttacccttatttcatacatgaggaaaggtttagaagtgtgaagacctgtcaaaggtcacacagccagcgccgccctcaaaggaaagctctttgggtaacccagtttcattctcagttattaaaaatctgaaacatactacaaagtacaaagaacgcctcatacacccagcaactaggtacaagagctatcaatatgtagccatatttctatctatactttttctttgccgaagtatttgtatgctcattttgctcctgtgtacttcaatatgcaaaatgaacacattatctaaatagtgggcccttttttttttagataaccataatgcctttaatcacttagtaaaataattctttgatatcttctaatacccagcttataatcaaacttctttgattatttcaaataattggtttacttgaaatgagattcgaataggattcattttattttgttgtgatctctgttaggtctctataaatctttcttattaaaaaaatttttgttttttgccactccctaactcataatttccttctcaaactaatcttcgatttgtcctcttatacaattccacaaagcagattaagactcttcccctcaagaagctaaaaatttaggggaagagaactttacttagttagggcatggggaatcagggataccacctaataaggaaatagaagtacttaatatatttttaaaatcatattttaaaatatgtttttaaaagcctatcttgagcaatacttatttggacagtggatttgtatttcaaatacatcatagcctgtgtttcaaggttaaagaatagaaatagaactctacctttttacggtcagcatacatttctagatatcttactcccttgattattggtaaaatccatttcattgttcatcaccaatgtatacagacaaacctagatttcattctgtcccattctcccatcataaggaaaaggcttttcctggtgtaattcaccatgaagtattcttgacaccacaaggaagcacactgaaacatttagaatatgagccattctgtaggaaggctatgccaggttctgcaacaatcctctctaccactgggtaagctgaatatcaatagacaagtcacttaacctccatggatctcaaggctgtaactcaaggcattcttccaagtatttggaatgtagctattttcttatgtgttatttagtcctgtcctagaaacaaattttgaaataaaaatcttataccataggttatgtttcagcaataaagttggccataccattagccaagtaaacacagtggttagaagtgaggaaatcatttgaggggttcggtggtagggtgataaagtatgcctttcaagcatttaacgttataactctttcaatttcccaaaataacaaaataagatggtaatttgaaattaagtgttttagcattgctattgctttttaattatttgtttacaagacttttaggtatttatttctaccatgtattttactatttacagttatcaaggaacagttaagaagttttgttctatgaatctatgatgcagtaatttgttcagtattaattgatacctgcctctaggcatgtaaactgtgtgaaacgtaacaggtgtcctaattctagaaaaatgtgtggtaattgtttgtttgtcaaacagatgaataaatatctttagggcatagctggtcctcaggtggtgagcataaatggattaatgatgtgagtgactcggggagacacgcttgttttgcagcaccctcctccgccgatcgctgaagcagaacaaatactaattaacaggggcggcctggttggcaggttggctttctccagctgatttggcaaaatggtttattcctttccctccataaaccatccctcttagttattagacattttcatactgatgtttagttaatttctaattttcttaattaggatgcatttcatctcttgcaaaaatattataacgtttatagttaacatttttaaaaatttagaggggcctaagatttaagttttaatagttgacgcttgaatttcaaaaacatttgtttctcaaaatgtagataattcttccaatggaattattccaaagaatcgttcaccatcttttttttgtattcttacagtaacactaaccccactctggaaaaattataaaatcactcatggggtagtttaatactcttgttcttctttcttgaattatttctgcaacactttcctctgtccaacttatgtattttgttctgtggtgatttgaagtagctcagctatcttctgggttaaaagactttctacgcgtaggacccaccactttaataagggctgtaattttggacttagagagtcatatctgattactgccatggcaactgccttgtgaaagggttgaagagaattcaggcttcatgagagagtaatagaaaggaagtttgctgaggagctgagtagtactttctgaaagagtttttgatgcttttaaataaggttgctgttaaatgaagataatacagttatttcaaaactcagtaatgctgcttagacttggcaaatcaaaacttgaaatgttagcattgaatacttagttgtttttctttgaatctaaatattgaataaaataagtcacattgctttaactttatcagattattcattatttagaaccaatccaattatttttgtatgtaataaattttactgcttaaaaacagtgtaagctgagagttctagtattgtaatgtaacataagaaattcccgctcatttgtgatagttggaattggtggttaagtaccctcctcctcccaacccctgggttcagttttgcctctagttttccttcactagaaactggagaacaacacacacatacatgtaatccgctcacgtgcggtccacctttcttccttcacactgtttaatattccatcccctctgcatccactaaatgttcgtgaaaagcttacactttccctccccttttacagaaatgcaggcagtgaggtggaagttaaaatgtcttaagtattcttgttgtaagtgaactttctaagatatggtgataagggtgagcatgaggaattctttttcatggaaatggactcattatttaattgtatcatatcctgaaggattcttgaatcttcttttttaaattgctacttttcaagttgctgacttcaaatttgagaatagaagagggctgggagaggggaggtaaataagttagtgatgccacccagtgagagaagccagtaggcttatataataagatctccttgttatttattgctccttatggtcattttaattattctagagaattttgagaattctattcacttatctttttttaaacttctgtttttgtgagcgacatttggccttttgaacaacaaaataaaattggaaatgctaatgttttgagccaactaaaggaggaaaataaaaatgtcaccatggtaacaaagctgctttctagatggtttcctaagatatgcctgaactagaagcagatgtctgatttgagaatcttgcctccttcgatgtaaacaaataacttctgggcaggtgttggaaataatatggaaatcctattaaggggccccgggttcctgtcagtcaggaaacccgtgccacaaaagggctggttgtcgcataaaggagcagagtaaattctcattaggcttgagcttttcccaggaaatgattgtctccgtgtgttctttctcctgtgaatctgaatgtaagctgttgcttctattgatctattcactggctttatttttctcctcttcattccagatcctccctcgcccccacaagcctgtgttctccccctcacccaccccttccctttagattaacacttgatctgtgctactgctctgagagtcgtgacatttgtgattttaacctcccaacctgggtgggggtgggggtgggggtgggggtggagaaggaggggaaagttagtcttgttccctcagcctttttcacaaagactctggctgattgggactcgcacagctagcggcaacggcaatcatgaagaccattctgtgtacatttacttgaagttatatttttatgaattaagcagaaactaaaagcttgaagagacagctttttaggaacttttaaaaacatagatagttgtctggtaagcctctgaggctgccctgtccaatatggtgtagccactagtcacatgaagctatttaaagttaaaatgaaatagaattttcaaacccattttcccagttatattagccacatatcgagtccttagtagccacacgtggctgtagaaactgccaaaacggcagagatacagaaccttcccactgctgcagagagttctattggatgatgctgcgtctctgacagactctgatgaggcttgctggttctgacattccttctggctaaaactgactcctgatactcaaaagcaaggttcccctggtttcatagaaaacaaggcatgtgtgtattcgggtttgggtggttgatgtggttagctgcactaatatagtagtgatctttaaatggttgtagattttttttttttggtcacggaactggttgagcaatataaacatgggtcttcccaaaatggacccctaagagatgcaatttaatgtttctagatagaaagttgtggcagttttggggggaagggaggagtgcttgaaagctatgcataagggtgctctttataatactcagaaggttaaatgtggataaacacaaaacaaggcttcagaaaagccacactattattatgcagcgtttctcggactatagtccccgagacgcacttcataaagccaataaagcgcgcactggtggtctcccgttgccctagcaacgggccacggggcacagtgtatgtgaaatgcatgaacatctgtgaattaatcttttttagtttgttcttttcttggcactgattggaccactcgggcttgtgcctgtgacactgcgtgcagaggggtaatctggagcagtccccagggccttgccctaaagtggatagtggaatggaaagtgaagggagatttatcccggcagtgcattcagcagtgcagggatttagcctgacagcactctcagcgggatgttattagcttactttctggtgcatggggaaatgaataaaaatttttctagtaaatctgggcattattgggtttattgggttgccctgaaaaaataatctgcagagaaaattgaaataatcacttgtgtttgtaccacagttatcaggacttgaaagctgagttattccacatccttggcccagcccccgcctcagggattataaccaaaccatattggactgtcactgctctgaatgagactcctgaattggatgcgtaggctggaatctgatttgatgataaaatctgttagtaacctagtctgaccttatttagggaaattttaaactaagctggtgacatttttgcctttgggagaatagagcaaataatgactaaatacgtaagcgtccaggaacagtacttttgttagttagtcccccacccctgacctcttctgttctttccctcctcctgcctcccgctgccacttcttccctccctcttttcaaattgccatcctccttctagacttcagcatgactgtacagactgtgttcagttcctcctgtcaataccagatgttcacttgtaaactgttttgctcacccttgtcattttcaattcccttctcttttcttccttttttctctttgtgcctccctttttttttctctctccattcttccttatgggtcaaccctctttcctggggagaaatgaaagaagaatattacatatgaaatgtttcacgatggatgtagtctatttggttaattgttagggtgaaaatttcctttataacaaatgtattaaaacagaagttcgattgcattagtactgaaaggtatttaggtgggaagaactccttgtcaattctgtatatgttttcctttgattattaaaaaggcacagctatacctctgtatgtagctgagagatttttctgatttgttttttgttagacaactgactaaaaattatattaatggttcctgactttgaaacctgttggtattgacagatgaacttgcagtccaaataaaatatttaaatcagtaggtattgattcagcagctggagggcaaacaggcctgtactgcattgggggtgcacagtaaagattagatacaatcccttccttcaaatcatgttcctgttaaaatatggaattgcgatatgctgccttctgagtagaataaaatatattaatggatcgttcctcttcatttctcagagcttctggtgagtcctgaattctttaaaatgtgcatataaaaccagtttatgatgatgggaggactagctctgaaggcagtcttcccaggaagctgcccgggctgatgtgcaaatgcatgcaaacatgaacctttagcaaacactgacagtaatgccagtggcaacgttctgtcgactcccaatcgggatatgggccttttactcgaattcagaaagtgttttgtaggaatcggcaaaacaattgaactacagagctaaaatatttatcatctgattttttggcacttgaataccctcacttgcttttcaggtggtttctctgttttcaaaattagtaaataattttatttgtttttttgctgctcccatttagctctgatgatattttcttctttcaagagtatttttaaaaattgccagctttctagttgttacttgaagccagcttcagaagtagaacagttaacacggattattagagacctttagaaggaagtaaaattctcaaattttatttctatgtcttggactgttatttggtttttgaaagcacaattttttatgccaagaactaaaaatctgtagacactggtggtaaaaagtagaaattccacaattacaagtggcagtgagtaaactggctagagtgagaagcaggaatgaggtggaatgagtatgaatctctgctgtttccttcatctgtgtgtgtgtgtgtgtgtgtgtgtgtgtgtgtgggtggggttttttttttttgttttttttttttttttttttttgagaaggagtctccctatgtcacccaagctgctgctggagtgcagtgtcatgatctcggctcactgcaatctctgtctcctgggttcaaacgattctcctgcctcagcctcccaagtaactgggattataggcacgtgccaccacacacctggataattttttgtttttggtattttttagtaaagatgtggtttcaccatgttggccaggctggtttcgaacttctgacctcaggcgatccacccacctcagcctcccaaagtgttgggattacaggcgtgagccatcacgccccaccccttcatctatttttaacagtttcttaaaatctctgtcatgttcctatgtactaggctggtaaatagccataattcttgaattttatttttaacttttctactcttactgtgttttaaaagcagtaatagaaataaaatcagcactttaattagtgttgtagatatgtgtatctataaaagtgaaaatgtttaggggaaaaaaatgctgcttgttttcttagacacacaacattacatggaaacatttggtgattgcagtggcttcagcattttaagactgggctaccaaaaactgtacctgatacttaacctgttgggcctacccagggacagtgaaagagtccaaatggaggccctcataccatacactgaagtatttaaaagttataaatccaataaataaatacaccttagtgataacctgaaagaccaggttggaatttaaaattctcaggcactttggagttcattgctttaaccacgtgggtcctcacgtattttcttgtacacaccctagttcttacttcaaagcttcatcgaacccctacagctgcgcccagatctagacacactcaaaccagcagcttgatctaaccctgggaggcttcaggaagaggactgagactgagtaaaccctggaagtgggcctggggtgttagggcagggaatttcagggtcctgggtacccagctcatggtgtagaggccacggacaaaggctgtgtgtgggcatgcccccttggtcttacagggtgttgctcagccaactgagggccagggcccacgtcaggggcccttctccttctcgccaggctgcttggtttgtacatgatttcataagctatacacttaagaggaaagaaagggaacttagaactgttttatcttaaaataattctttgttaaataaatgtcaatagttttaatcaaaattcatccagggaattctaaaatataacatacatatacacatatatatatgtatataaaacattaaagataatctctaggaacagctgctttgacactgtgttttatagtctgtttacggatgtgtatgtttttaaaatactccattaaaaatccgaaatgcgtatcctgcctattggaagtgcttgtgaaaggaaggtggggagttggggtaccatttaaagctgagcaaggtaaagatagtgtggagcttcgaagtcaggattttctacacgaccccaccctcaatctggtccacatagtaaagattggatgctagtgaaaatgccaggcaagggttaggcctaaaaggattagtcatgaagattcgagattcttaaactaaagattatcactgggaactaactcgggtcatgatttctcttttcatctgcctttgttccttttatgcacttccacagttggacagctggaagtgccacagaaatatttgaagagccctatttagtagtttacgtgaaaagtcgttgaataattcacataacaaatgattagacaagcacttgtccatctgactgaattattctacatgtttgcccaagcaacaaaggagaacagcgtttcctcctacagagggtatacagtggtggtattgacccatctagttactgggtgggtttcagtcttttgttgacattgttgttaatgaaagcagcccagacgagctgtgagcagctgggctggataattgtgaaggattcatgcttgttgctgttacccccagtgtttgcagtgggttgtttgctttgacttttgttgaactgttgacaaaagcattagatacaaatgggaacaaataaagtggtgagatgccaggagggcttggcaggagtagtggttttctttctgactgaagtggaggatgtcggaacgtatctagatgggaagtggaaggtgtattcggtgtgtgtgtttagcagtttacccttccgataccaaactggaaaattttgttgcttatgtaccttggctcacagaggtgagagaatcaaggaggtcaccgtatcttgtaaccctcaaaaagccacgctctttaccatgccagtcaggtggcttgcaggccaagaatgttacaacagaaatagtttccagattccccctcctcaacttaaaacaaaattttaataatagaagtattttggactggggagatgacaggcatgacgttgaggtggggaggattaagaagaacagtatatgctaaaatagtatagctagcaaatggaagtcatctactggaacgcttttaatttgctttaaacaaaatactcttttgtatattcaaatggagagtagctcagctgttgtgaagccagaaaattaatggtatttttagtgaaatagcaaaagcatgtcaacaatgtagctgcagatgataatgctggcattttattcatgaggaattatcaatgcaggttactggacaacatagtgtgactgaaaatgattgagtgtcggagaagcccgccatccttctgctcgattatttcattttgcatttaggcttccccaggcttcatttgtgcatgtattttccctatcacaaaccaaaatataaagtctccctggcttaggattgtatgcatattttttcttcctttaaaatgtctccaaatgaaagttccccttgagtattgactcagaagctgaggagttcattttcagtgcacacatggtcagtggaggtggttaggcttcagagataggtccctctgaacagtttatctaaataggtctatggcagttgtttaaaagccagcaaaactcaccaccgtttgatagatggaaattgtcacagaatatgccttctctgacaagtagaagatttggaataagtagtgaggccagaaaaatgtttaaaaaacatgggcaagaataggcagaaactgtatttaggcaattaaaatgtcttttggaagagtgcgtttcagtgatagttgaagagttactaaaaatatatttgaatagtcaggaaaattaagctatgtctttttttttggcctgcagttttggtctgaggcgctctgggcaccatcactcacattgttttgttggtattatttcacctagtgtctgagcaaggaagaggctaaggcttcctttcaacattctgttctccaacctcatttattggattcccctctgctactggtgacaaaaagaatggattatacctttgtgtaattgtgcttgttccagtacttcatgtgaccaaatctaggaaagaataggaatttactgagtttgttaaaagtgggaatggcccaattgttttagtctttgcagcatcttaatcctagagagcagtgaccagtgagaagaggtcaggattttctcagaaatgggggcatgcgttacatggctgtgctccactcaaaaaagttacatgaatgctccccacgtttcagctctcagaagatattttgcttgtttcagtactagatggtcaaatggtaaaggcctagatctgaagttcatgaggaagaaacccctgaaatgacagacactgaatggggataaatgcatctatgtgattaagtagttggtagttcttccagggtttattactcaagagaggaggtagggaaatcgtgcaagtagaaaacttgaaaagactcaccttagaggggatagctaaagagtaaaatgagtaacagttaaataagaaaaaaaaaagaaagaaaaaaaaacttgagaagacaataaggcaagaagtttatcaccattaacaagccagaagaaagaaagagactacaccgacttgactcagcatgactccaaaattatgagaccctgggcaaaagcacaacaaaaggctcacaaatgaaaagaatgagttcaagagaaatttacttaggccacgtcaaaaagattggtacactgcaccctcaggcagtgaccagagatgcaagggtaagcatatttttgtaaaagacctgttttacagacagatatgcctcagtctttcctccccctcctttcccactgctcaagcaggtattcatgtttgctgtgcttttaaagctaaaatatcacccttgttaacggtgactcaaggtgactctacatactctgttcaaactgcatttcttaaggttgggaagctggtgtgtgttgggacctgtctacttctgtgcatgtggcatgctatgaactctagacagccagtaggcaggaaacagtgtagcaataccagctagacactcatcctctggaaccaggtggtctgggttcaaatcatgccttatgctatttaccatccttgtgatttttggcagtcttcttctctatctgtgtaacatgggagtggtaaagttgcccaatatagtaggtccttattggttttttttttgtttgtttttttagtgtacagtatgagtaatttgaaaatgacctggttgtgtttattctttggagggttaatatttaaattaacttgcattccacaaacaaacacaaaactaacagcagaaaggagcaaactagaagtgtgccaggccacagggaaattattgagattaaattttgcctaaaaaaaaatctacaaaatggatcttgtacatgcagatggttgagaattaactttagctgatcctagcacatatttaattccattggggattttgtgtttagggatagttcaaccttggctgagaatgtgacttttatgtattttacagcaaaactacttgctgctcataatggatgaaattggagaccaaagaggaagaaccttctgggttcctgtcagtctaaatcctgattttaaaagacattcacctgccatgctagtgttgtgtgcttctactggtaggaaaagctaataactaccctgacgagctcaacgagtggcccgaggactgtgatctcacagtttaccgtttttgcagagagcctcttttattttcgtgtcagattatctgtaaaatggacttctccctccagtgttgtaaaccataacaattctggcattcctctaattgtgtggggagagggagtatacccaacagatgcttgtcgagcaggagagactcttgctgcttttcattattttactactcatacacctaatccctgtcaataaggttggctgtttggggaaagaacacacatccctgcactataatactgatttatttgcagcttcttttcttcagaccgagttaactgaggagtctcacaaggcagtgagtcagccttgctatggactttgacagaagtatatctgaagggaagggagtgattgcagtattcagggtgctggggaacagcagacctggttcagcaaggggaggttaaggactatactcccacccctactcaagacatgaatgcctctcatagtgtgatccctggttgctttgttttcagtgaagattagcctcagtttctccgttaaaaaaaaaaaaaagtcagtctggaagattttatacggcctatgctttttaggccattgaaacaaaacactttttttttttttttttttttttttttttgcagaggtggtggtgggggaggggggatgccctttcagtgattagtgccctgctacatagttgtcttccagagctacaatgtcaaggagccctcctgtcctggggagagagggtgcgcagaatggaaattcagcttgctcaaagagtcataccaacagggctctagcagatttcatattttcttaataagaatgacaaaggggccagagtcctggaaagtaagatacacactgggcataagatggtgtttgccctcatgggaagagtgtggttttcccacaggagaatccagaataaccaaccaacatggccaagtttcccactgtgggcgggcagtgaggggcccctgagcagacaggatttcaacttcccacatgagccagggtgggtctggcaaaggtttaggagatgtctttcaagtgaatctgtttttctacatgttttctacctctggatgtatagagtcagcttcctgcatgacctgtttttgtgagacagaggacctgggaaacatgaggccatatttgaggcggttcattcttaccaaccgccagacctttgtttttagagaagtggaatcttcaccaaaggcccaagaagcctttgtggggtcagctgtgcttgagaattcttgaatctttgttactctttatcacctacctgagatgccacttttgcttgcttagctcaggtttggaatttgatttaagagggattcacatttctctgtttatcagaacttagcatcaattgtgtttctttgtagagatgtatgttacttaaaagataagggaaaggagcatgtgtttctgtagctcagaaaaccctaagaggaaggaccagataaagtggaaactttctacagcgacaattagagttatgttaaagaaacaagtgcaagtgagggcaggtggagcatagaaaactctcagcacagggactcaattaaaaatgcttttaaaatgtaattccaatcaatgtggatagtcttagaacattgcaagatgtgtgaaaacatgctttaaatgccagcaaccagtgaaaagggcacggttttagaaaccctgctataaattatgtgcctttggctttcaggaacgtggaggatacatcgctgaaatattcagaataaatatcagagagaattgtacagtcttttcattctgcaaggaatgaaatttttaaagagctagttgtgtttggcgtaagatcctgaaatttttttatagtgtcacaacatttgttttgggagatgtacaaatcaaatctgattataacaaatattataacaaaaatatccctctaaccaaacaatttctagaccccaaccagtggtccacttatttaaaacaatattgaatgtaacccaattccattaaggcaaaataatgtgagttagtcttggagtttttctttcatgagttccttaccttttggaattcatataggcaattggcagtgattccaaaaatgtttatttacctttggaactatatgattttaaaagtgtagtttatctttcaaattattttctgcatagttccattttacagtatctgtttttgtgggaagagactactccaaatgaaattctggtttctgattggtttcctccttgcctattttagtttcttatacttttatacctaaaaagtttttcttgcatttaacagagtaatttccccctaaaaactattgaagtagtagcataatttacatgttacttcttgtcaaccaccaaaaccacagggtacaacctgatcaaatacactaaatatgaaacaaaacacaggctcaaaatagagtagatggccattgctgcatgtgagtagtttttgccccgacccctggtcagttgattccagtcacgcctctccatgccttcctggggggtgattttgtagggccgttctgcttaatgtttcctgactcaacctgtccctgggttcagaacccagggatcttcttcctcctaattacccttgccctctttagtcctcccaggcttcaggcttccctccaagtggggatcccttcccagataaaagagttgagaagtggtttattgcttttctcaatgtttaaggaaaaccactagaaggctgcttagtatagagtgaaaaccatgtgctttgtagccgttgccatgggctctggagacagctctgcccctgctagctttatgaccttggacatgaataataattagcactgtgggtgcatatactctgtgctgtcatcagaacagcccattaaggtggagtttgctattatctccgtgttgcagatgaggaaagtgagacacagtgagactaagtaagttgcctctggttcacccagaacataagtgatgagctgactaggattcagttagtcttcagagcccatgctcattatctctattctagggtcagttttaaaccctcatctggatgtaccttacttgatgtaggcaaaatgcaaagattagagataggaggagccccagcaaggggcctgccacgtaggaaaatacttaagattataggagcttcctccttttcctgtcagatcagcaaaaatccaaagtatcgattttgtatatgtgtatttgtagtagtgctgttgtgatgtgttcttttcatgtgacttgtctgtcatatgtccttagagtgtaaacttgtcacgtggggcgggatgttttaatacttcacaatttttaggaccttcaaagtggcggttcaagaccatttcactttggagcattttggaatgtcatcacacagtcccgtgcgtgtttttgtgttaaatttctcatatccaacagatgtatcctcctcttctaccagttcagaatctgctatctgattaattaaaatgtatgcagatgaaaaatctgacaaagattttaacttgtagcctcatcagtttgctggaggttaataggaatattcttgcagtaacagaatcccccaatttggattttctagcttgatgtcatttttatttcatgaagaaaaaagggtagtttttgtttggttggttttttttataaccactaaccagatgtagtgataatactttataacttaagtgtctataatttttaaatctctttgtcctttctgcccttccctaattgatgaacaagcacttacacttgcaatgttttggctcttgtttcctatcagctgacttttggagatttacagcatggattaagtagggaccacttgcttatcctacttttctttgttttcctttccagtattccattccctttttccctgccatctcctcctgaccctccagaaaaggacatcttagtaccttagttgggtggcagtcacagaagaaaacttgattccagtgctatatcaaattgttggggcagcctaaggaattaagttgagggctgcatatcatagtgatttatactttaagaataccaaattggggcccatggctttacaaaggcattttcttatattaatttgtgaatctacatgaaaacaattaagacatggaaattaaatttcatttattcttcatttaaccaaccactttaaaacaaacataaaatcctgaaatcagtatatccttaaaatccagaatgtgtaggcattaactatttgtgactggtggcttaatcattttcaaggttcttctttgattcactaagcactgtcactgccactgtggttggtcattttgcttctcttttaaacacagtcctcagctttacattagggagctaaagtgaggtgagagataatgtcttagaatcttataccagttaagtatcccttatccgaaatgcttgggactagaagtgttttggattttggtttttttcagatttgggaatatttgcattatactcactggttgagcatccaaaatctgaaaaatctgaaattttaaatgcgcaatgaacatttcccttgagcgtcaggttggtgctccaaaagttttggactttggatttcagattttcaggtgtgggctgctcaacctgtactggccactttgaactgattagataacaggcatcacacaagatgcttgaagctagattgccctggtagagtgacaataagggataatgactttacactcgttttatactactgccatatttgatgatctgttaattgccagtcatgtttgtttagatattgtttagtcactgtgcctccccaaggcctttctggcaaagggcacaacaaatagagtaaataaattattgcttttgttactactgaaactattttggctcaatactctaaattaattgttttcatgtagattcacaaattaatataagaaaatgcctttatgaagccatgggccccaatttggtattcttaaagtataaatcactatgatatgcagccctcaacttaattccttaggctgccccaacaatttgatataacactggaatcaagttttcttctgtgactgccacccaactaaggtactaagatgtccttttctggagggtcaggaggagatggcagggaaaaagggaatggaatactggaaaggaaaacaaagaaaagtaggatatgcaagtggtattgtattttgttttttaaataaaatatgtggaaagagagaaaagccaaccagaaatatggtagaaagagcactggactagattcaggggaggcgtggccatcgtctagccttatctatgacgtctgttctctctgagcctcagtttcctctactgcataaccacttaggttcttctgatgtatgatggaccctatgatttattttacttgatatttaatagcagagctttattattttaaaaaatcctcaaattattagtttgagctaaatgttattctatatagatattctcagtgaaatgttggagctgcctcagacatgtaaatcaaagatgtgttcagtattttaatttctttcatgtgtttgaagatgcatttcccatgcatccatggttttagccatgaataaaacatagtattatggaaggtataatggtataaaatccagaaggatagatctgggctcaaatcgcagactagagatagatgacttagcaagttactcagttttccccaactagattctttttaatagtaacagtagcagcaataatatctatcttattgggttattaaaagattaaatgagacagtgtgtgtaattgcagagtgcctggcattttactcaattctcagtaaatgtatcatgtattcaaagtagtaattttggctaattcaaaaactatttgcatgctaaaagttgtagtgcctagtattaatttagttcgtggcctctgtatgattttctgtccttttgaagatgtatccatgacagaagtaataataagcagactgctagagcatcctgagcatgtgtcatgggccaggcattgggctgtgtgccttatgtatgttgtctcattctaagatttccttctctttttcttcaaaatgttaactctacttagttgaaagtattggactatgataacagcagagacaagatgccgtggtagaaacttttttaatttttttgaattggtaatcatgggtcctgataacttgttatagttgtttcttcattttttttttttttttgtaaaacaattctgcgttttgaattgtgtataatctgagatggattcaattttttttcttttgtggaaacaaacttaattgagcttatactattccagaagttttaagatgtggcatcttcacaactatcctgtttgtgaattttgtaggcttgtcattgttttcacatctataaaaatgtggtcaatttgtggatgctcttttacttatagaatcagaagtgggtggtgtaagagattctacacatttatcaaactatggaactttagaaggaagagtactgaaaggttagccttaccaggtacttctggcgtaatttctctcttctattttgaatgcttctttatgtataaagatgaatatcaaattcagtagcttgttaacaaagcaactagtgagtgatgtcattgctaaacaaattcagtacgctgttttatacgtatgcagtctctgtctcagttaaagaaattagtagatatgtgaactataaatatattaaatgaggcagaaaaaaatcatgcatagcctcatcaagcatctagatgcataggtccacagataatgatcttcatcaagttatgtacgtgaatctgcctgttcaataattagtaccattcttttgtcataatcctgactttataatgaacctaatgcagtaaggccaaaaaactttgtagatgttaatctatgtacattgtatttgagtaaatgtccttgtttatcagcagactttcattgcaagcttgaattggaaaccacatacagacctttccctaatcctaacttcatctttttttttaaatcagagaaaaataatgaatttattctatcaataattcttaaaatagcttggtaataactatcatttataaagattaccactgtatctgagaaaaaacaatacacagtcagtaattctcatcaaaatcacctgaacgttgctttaggtttcagtggcactctagtttaaggaagtactttattattgtttttcttttttttttattattattatactttaagttttagggtacatgtgcacaatgtgcaggtttgttacatatgtatacatgtgcctgttggtgtactgcatccattaactcgtcatttatcattaggtatatgtcctaatgctatccctcccccctgcccccaccctacaacagtccccggagtatgatgttccccttcctgtgtccatgtgttctcgttgttcaattcccatccatgagtgagaacatgcggtgtttggttttttctccttgtgatagtttgctgagaatgatgatttccagtttcatccatgtccctacaaaggacaggaactcatcattttttatggctgcatagtattccatgatgtatatgtgccacattttcttaatccagtctatcattgttggacatttgggttggttccaagtctttgctattgtgaatagtgccgcagtaaacatacgtgtgcatgtgtctttatagcagcatgatgtatagtcctttgggtatatacccagtaatgggatggctgggtcaaatggtatttctagttctagatccctgaggaatcgccacactgacttccacaatggttgaactagtttacagtcccaccaatagtgtaaaagtgttcctatttctccacctcctctccaacacctgttgtttcctgactttaatgatcgccattctaactggtgtgagatggtatctcattgtggttttgatttgcatttctctgatggccagtgatgatgagcattttttcatgtgttttttggctgcataaatgtcttcttttgagaagagtctgttcatatccttcgcccacttgttgatggggttgtttttttcttgtaaatttctttgagttcattgtagattctggatattagccctttgtcagatgagtaggttgagaaaattttctcccattttataggttgcctgttcactctgatggtagtttcttttgctgtgcagaagctctttagtttaattagatcccatttgtcaattttggcttctcttgccattgcttttggtgttttagacatgaaatccttgcccatgcctatgtcctgaatggtattgcctaggttttcttctagggtttttatggttttaggtctaacatgtaagtctttaatccatcttgaattaatttttgtgtaaggtgtaaggaagggatccagtttcagctttctacatatggctagccagttttcccagcaccatttattaaatagggaatcctttccccattgcttgtttttctcaggtttgtcaaagatcagatagatgtagatatgcggcattatttctgagggctctgttctgttccattgatctatatctctgttttggtaccagtaccatgctgttttggttactgtagccttgtagtatagtttgaagtcaggtagcgtgatgcctccggctttgttcttttggcttaggattgacttcgtgatgcaggctcttttttggttccatatgaactttaaagtagttttttccaattctttgaagaaagtcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtccttcacatcccttgtaagttggattcctaggtattttattccctttgaagcaattgtaatttgaagcaatgggagttcactcatgatttggctctctgtttgtctgttattggtgtataagaatgcttgtgatttttgcacattgattttgtatcctgagactttgctgaagttgcttatcagcttaaggagattttgggctgagacaatggagttttctagatatacaatcatgtcatctgcaaacagggaggatttgacttcctcttttcctaattgaaaaccctttatttccttctcctgcctgattgccatggccagaacttccaacactatgttgactaggagtggtgagagagggcatccctgtcttgtgccagttttcaaagggaatgcttccagtttttgtccattcagtatgatattggctgtgggtttgtcatagatagcttttattattttgagatacatcccatcaatacctaatttgttgagagtttttagcatgaagcgttgttgaattttgtcaaaggccttttctgcatctattgagataatcatgtggtttttgtctgtggttttgtttatatgctggattacatttattgatttgcgtttgttgaaccagccttgcatcccagggatgaagcccacttgatcatggtggataagctttttgatgtgctgctggattcgttttgccagtattttattgaggatttttgcatcaatgttcatcaaggatattggtctaaaattctctgtttcggttgtgtctcttactagctgcaggacctcagacaagtcccttcacttgtatttttattaatacttagtatttaacaccaaaatatttggactaggagttctctaagtctgtgaatacatccaaaaattaagatttactctgggggaaattatgtactgatgaagtagaatgagtcttggatatacttaatctgctgtggttaaaggaagtcactatcagccaactcagtaacgttattttgttttttatgtttagatgtacaaataaaaatagctgttatatatttgttagattttgatgaagagcttgcttcatatggtaaagagctcttcacatacattgttgtagcagaagcgaaggttcattggatataggctctttccttatagagtgacagcatacatgcctggtaaagttgaaagatctctagctttcatgttactgggtgttaggacatttctctcaggaattgaagatcgaatgtccacattaaggacattctagacattctaagtccttattctaaggatacactgacttttctggctacatggatacagatctgttcagtgattctgtggataactttttaagaaaaatatgctacatattttccaaggattccttaactacttcctggaggcagggagggaaggagggagagaaagagagggagggaggagggaggaagagagggagagagggagacagagagagagagagagagagtgtgtgcatgtgtgtgtgtgtgtgtgtgtgtgtgtgtgtatgtgtgtgtgtgtgtaatttggtatataatatagttatatataatttgatatttttttaatgactcttggatagcataagaaaatgttaccaaaagagtgaaatcttgattagtttgaacttacctcactggtgtctcatgtaacctgttattgttaagatgtggtgccataaagagggccactcagattcagcacattggcagttggttggagtttggatctggaagcatcctattttgtggttttcttaagttaaaactttattttaaaagagaaaataaatatacaggctctttttaagatcaggcaggcccacagtcttttatccactattctgaaatccagaaagctctgaaaactgaaaggttttttttgcatctcattcataacaaaactgaacctggcttgaagtgatgtaaaagtgtattaatgtttgattatagactgttattccagcccctgttagagtatatgcatcatattgcctttaggaaattccccagatactgaattctaaagcacatctggccctcaaggatttcctgacatgccttttccaagtccagccttggaacttgtgtgcttaccttatctctaactctcattgaaaagaggcaaagcggtcaaaaaccttgtccttttcagctttgagccttcctgcattcctgtgaggggcctgcgttgtagtagtcgtttgtcataaatcagtgaagggagggaggaatgttcaggcaggtgttccaaaccagtcagccagcaatttcctgtccagtgtcctaggcttaaattaagccatgaaactcagttgcctgatgaaactgaagttatcaagtaacaatttaggacctttccccggcatttaaaatcatgagaatgaaaatgctcaagcatctcagggtggtaaaatgactcttggttggggttgcagatcacactatgcccacagccattatctcacctcctggatcctattgagagcatcctaagaagagaatgccagaaacttgttatgatcgttgtggtgacagtcttcaggttataaaaaaatgtaggaatacactacattctcctgctcttacatagacaaagggatgagtaaactatggcccacaggccaaatctacttcccagtttgtttttctgtggcctgtaagggaaaaatagtttttacatctttgacagggcataaacaagtaaacaaagaaaaaaatgtacaagaccttatgtgggttgcagagcctaaaatgattgttgtcaagctgtcaaacactttacacaaaaagatttgccgacctttgatgtagaccatcagtttaactcccagccttactgctcctatttttaagattgattctttccttctccattcctattctcctttgtcttcaagagttggctgactctgtggtcattcagggctcatagttacttttttgcatgaaatgagaaccctaaaagatggtttatgtcccctttttgaaatgtacacaggaagaaactcttaggtagaattaaattgagcgtaaacatgaagtttaaacttattttgatattcaggtgtggagagaaccagttaaagagtttacatggtacctatgccaattttacaaaggcaccattactctggtcccttaatcaacaatgatccatgtctaaattatgtaattctggaatatcagtataatttaggaatcatactgtgagccattctatttttttctaaattatgtaagttacatcaacatacaactttttatatcttgccttttaatccatgaactgataaggtgtggttaatctcactgatcttgaaatattctccgtattttgtattaggagattagtaaaaatcagttgagacctagagtcagaaatattacattctaatactagcttgactcctctagctttgtgaccttaagcagtcacctaatctcacaggagttctgtttgctcattaacatggcagtaataatactatccaaataaagttttgtggagggcatgtacaatgatgaaacgtgcagaaatggtattggtgaagctgtaatgaacttatgacgacagtttatcatttatacatatactgactcatttcttaagatatcacaaaccataattccatagaaagcctgagaaccaaaaggaatgaggttgctttttaatttacattattttcatctatttctaatatggatgtcttaaaaatgagaaggagtatttattcctataatgcatatcctcaattaaatggttatattagttaacaattactacctaagaacttcctctaaaccatactggtatgaaatcgaaagcatttgctacatctgattggtctctgtgttggctgcggtggaagcttttctctctaggctgggcttgaatttgcttatatgtctgcagtcagctgggtggtctagaacagggatccccaaaccccaggccatagaccggtactgacctgtgtcctgttagaacccaggctgcacagcaggaggtgagtggcggctgagtgagcattaccacctgagctccacctcctgtcacatcagcagtggcattagattctcataggcatgcatactctattgtgaactgtgcaatgcagggatctattgtgaactgtgcaatgcagggatctaggttgtacacttcttatgagaatcttaactattgcctgatgatctgaagtggaacagtttcatcccaaaaccaaaccactaccgccaccccacctccgtccatggaaaaattgtcttccatgaagccattccttggtgccaaaaagattggggactgctggtctagaacgtcttcagctcaactgaccaggctctccctcatgtatctatggtatccctctagcaggctagccaaggcttgttcttttggcactagtccagagtctaggagagcctctctttgcatcatgtgtgctactgtgccattggccaaagcaagtcatatggctgagtctagcatcagtgacagagccctaccaaatgtggatacagggaggtgtgaaaaattgcagccaatattgcagtcagtctaacacagtagttttagaggtaaaggaaagtctgcccaagtggtgactggcttgtagcctggcacatgcgtcatggttgggcccgtgtgcatgcgaacggcttggtaatttcagtgcttcccttctcatttctcatagctgcactagaaccgtggcagccttaccatctgactgcttcatgagaaatagcccacgcccaaatacacacctcttgtgtttgaaataacacaaagagtattgtttccaagacgactttgatgaaatgtcagctttccctgggttctaaacccatataagaagcattgttaccctcattcctgctgggtaatttgtatactgcaatagtttgtttgaaaacatgcccgttgttctttaaaatatgcttaatgctagattagaacagatttttttttctgtttatgcaagctcatttctaaagcatttaaaataaagagcttgggcatgtgtggtatttaaaaacccctcacatgatgtttttaaaacagatcaatttcagcattaaaatgttaggaattcagccaaggaaaattcagcttggattgtatagctgtaatgataatgtattataaccatcttctttgaaagtgattgtagtaacagaattgaacctggtgaattatataatttaacagtgttcaccagaatactactctagggggattattcaagcctttcctaaagcaaaacaaaacatggattttattatcacaagatagtcatcacaaaatatctaaagataactcatttggattgaacagaaggtcatatgtctgaacatcacttatcccacttaactacttggcaggatattagtatgtaagagtgcatgatttttgttttttagctactttgtcttgtattaaaaatgtcttgagtttgcttattacttacccagaaggtattttcacgtcagaagtaacttcataattgagacattagtgattcacaaattgactcccaagtacagatggccctctatattcctgggttccacatcctcagcttcaactaaccacagattgaaagtatttggaaaaaaaatacaataaaaagttcaaataaaaatacagcatgtacattatattataaataatagagatgatttagttataaagaggtataagtaatactataaataggcattataaactagagatgatttaaaatatacaggaggatgtgtctaggttatatgcagatactatatcattttatatcagggacttgtgtgccctctgattttggtatctgcaggggagagggaggagtgtcctggaaccaaacgcccatggatacctaaggatgactgtaatttagaaagtttatatatcagtcatattatttaggcatattaatctttttaaaacttttttaaaagctttgaaccaacaaccagtttctaaacattatcaaaacatctgtaatgttggtttctcttcggggttgaattgtgtctcaaaaagatgtaataaaattctgatccccggtacctgtgactgtgactttatttagaaatagggtcttggcagatgtcatcgagttaagatgaggtcatccgggaatcaagttggccctgcatccagtgactcatgtccttataaggagagagaggtttgacgatacagaggaggcacagaaaggaaggccatgagaaagcaaagaggaaagactggagttgtgctgccacaaaccgaagaatgccaaggattgccagcaaccaccagaagctggaagaggcaaagaagcattcttccctggagcctttggagggagcatggtcctgccaatgccttgttttcagacttgcagactccagaaccgcaagaaataaatgtctgttgctttaagccacctagtttgtggtggtttgttgtggcagccccaggaaactaataatggctcccaagagcgaagtttatctgtcagttgtgtttcatcatcagtgaagtacttgctgtatgatgctaaatccagtgagcatctacgtttaataagccccagaactgtacatgttaaaagcttttaaaattttgtcatttggtatcatctggtcaggtgcagacactgcacttaggctctggggatactgtggtgaaaaccctgaataaatttctgcccacatgcagctcacatttcactgggaagacacacagtaattatagattagcaataatgacagtattgcctcagtttgcgtttatgtagcctacattcttcttctcccccgaatcgtaattgcccttggatccagccgtgggtgatgcaacgagctcaccatgctcctcacttgctcatgggcttgggttagtgttgccatggccacgtacaagttatacagaagcgcaattcacatgaatctacgatgttctggtgtttcctggagttgtagcatctacatcctgtgtggtcatatgtggtggccccatgggtgccagattttcttccttgtctctcccttcaaaaatatctctcaagtggagacctcagagcttttccttctctaatcttttcagaaaacaaaacaaaataaaattttgtaacattcttttttcctcgtctttcatttttatagaacttaagtagtttttacttcttacatgtttgatagagttctcagcctacatcaaatatatttgaatccagaattgtcaaccctaatgaagcaagtcccttgtcattccttggcctcttccttgcccttccttggcctcttccttgccctcttttcttgatgttgccttactgctctttgtacaggctggtttcttttcacaatacacaagtgtaatttgctgagcctcctataagaggcagtccttaaaatcagaggcctgtcttcaactatcagccctttgtgaccttgcatgagttacttcgtcccctaggattcaagtttcctcctgttcaaagtgaagaggttgaggtagacaagtgcttctcaaacttttaatgagcgttaaaagcacacgattcagtaggtctggcagtgagactgggattctgcatttctaacaagccctcaggagatgctgttggacagtggaccacacttttttgagtagcaagaggctagatgatttctctggtccctcccacctaaagatgagaacttccttcccttgttccacgttgagaaggcccaccttgctggtcttcacattttaatagtctcaccatctctgcacactgtctaccaaaggaaaggtcacagtatacttcgtgctgtcctatagtgcttataaggacctgccatctgcagttcttattttatagcttggccttctccccttcaacccccgaaagactgaaaacccactatctaatgcctaattagaattagccttcaggttacatagtttttgtgactgtttcccttggttatctgccattccttcatttcacagtaatggtagatttataacagtcctcataactgattaaatgtctcaattcttttgctttatgtggcgttcttgggcacttaattatactacattaaatggtgtcttgttgctgtcagtgcagttggattgcagtatagatagcatctttggatattttttaatatgttcctatcatacactttaagcttgtaaatagaagtgctgagcatgcataaatgtgttttaagaaattatttctttattactgtttagctgaactgatggtgacactaaacactgaggctttgatgtttatacgatattcttccccactaattaactgcactaatgaagttaattgtggggaagaatgccgtataaaacatcaaagcctcgatgtttaatcacaacttaaaaagaagttttatactcttcaattgccaaatacattccaattagctgaaggaaggtcaaaaattctgttttcttccatctcatcttcagagcttttctggttgaccattggttacttgagctgcctgagtgttaatctagacaagctgacagtggcatgtggaggacaacatatcttcccccaagctataagccagcataactgagagactcagtttctgcaaaaggcagtgatgacctcttctgtaatgtgttgatgaaaaatgaatgaactcacagagtaatgcatttctctaccctctaattttattattagcttgacccactactccattttcctatatgtttccatatgttgctcttataagccacttctctaatttctgataggcatatttccttgatgaattcagactgcaaaaccaaggaaatgtgtatgtgtgtgtgtgggtatgtttaaaggcatagggcgtatgtaagtggaggctttgcaaagttgataagaattcttaaatgaccagtagtagaacaagaactccttctcaggtcaatttccctgtggtgtgtgttacatcaatttttattgttgttttttttttttcttaatcaggcagggtttacaatagcaataatgtaattcaaataagcaattattgtaattgaccttggcgatgagtatccttggcttttaccacagtttgcttaatacctgaggatgggcaattatctcataatgcccactttattgagattattgttttaattatggcactcaaaatacatcactttgtcagcattgtagagtcaagcatggaagcactgcattcagtattcagaagtgcgtaaagagcatcttgcctcatcttatgacatggttatgattgcgttttttctctctcccaactgtggttttgaaatgtagttcatcctgacgtgactggcttatagggagagaaagtctgggatttgttgctgagctaattgtgctctcagaaaggatgaaggtgacttgtgctgataggtaagcaggtctagttgattaggagtggtaattgatagcaatcacagtggcttgttgattatctgaatatgccttaggtcagaggttgtcaactttagaatcacctgggagcttttaagattgcctgtatccaggccacttacttaagcctaccctctctggacagcgtctgatttaattgttctggggtgggttccagatggggctttttgaaagctccacaggtgattcttatcccctgacagaccttagaaccactgcccggtcctttgaattatttactccttgctgatttgtctcattccaaccatgaccccatcccagattttaagactccttttgggggtccttgttgctctataccttactcttcctctctttctttccagacttagcctaagcctagccacctcacatgcacatgcttgaaatagcctcagtgcagatttgggtcctagtaatgctaattcttcccaagcagttccaggtctacccctcccataggaagtgtcagtgggtaaatttcacctcttcataaacgtgaagtgtcatttcttactaatgcctcattatgctcttacaattcagttttctcttggtcacataaatatggcttaacctttatctaagttttttgagtaaggatcagaatttattctttaacatctgtcttaagtactgggtaccactttgtggaaatttaattctggttgattagatcagtagttatgaagttcctagttgtttctcaccttctttgataaacctggaggatactgttcacacgcatcttgcagtcccttgattccctaaggataggaatattcttttaggttacctaagactcctgcttctttttttttttcttttttcaaatttttagacgggatctcactctcactcaggctggagtgcagtggcaccatctctgctcactgcagcctcccaggctcgagatcttcccactttaaccttcccacaaggtagttgggactataggaatgtgccaccactcctggcttttttttttttttttttttttttttttgtattttctgtagagacagggtttcgccatgctgcccagtctggtctcgaactcttggactcaagcagtctgcctgcctcagcctcccgaagcaatgagattacaggcatgagccaccatgcctggtgattcctgccatttttacactaagaacctgtatcttattgcaaatgcatgaagatggcatcattatattgacaaacttgattccattctaattttgtattcacataggaacacacatttgtgtgaagtgagtcactcatttatatcctaatgtctcagattcatcctcttcccccttccccagtagccctccagtctaaaccaccagcatttccctctggaccacagcaacagctccttactggccccccatttctcctccaaggctctgttacctgccagatccactttagcccacaccaacagcatgagtaaagtaggggcaccaaaagtggtaaaaactcagctttgatgatctgattcagaattttgaaaccagaattctactatttaatgttagcatacacagaaggtttatattgtacacttagtgttgtttttaattgcaaaggatggaggtaggcagtgtaatcttttctgttcttatgggctttaaaaattcttactgtgattcgagcctcctctctgaatgatttttaggatatgtgtgtcatctcaacagtccccttcagtggcccttagaataaaacacacacctcaccgtgtgctgggcctgcacactgtggaccccctttctcccagcatcacccctctgtgctctcccacctgctccctccacgtcagcacccagtcctcctgtgtgctccagtgccattgccagctttccgcttcttcagagctatgcatgtgttattccctctttctagaacagtcttctggctgtcaggaggtttggctccagcttttgcttcaggtgtcagccagaatgtcatctttttgcagaagcgtttcctgaccacctggctgctagttattctcagtctcagcatcttatgttctttgtaacacattgccattcgcatttattttattttttattaatgttattagcagcttgttttacttgatttttaatgtcccttaactagaaccagtgctctgtgagaacaaggtccccattcgccctcttaattgtatttctagtgccttagggcccagcagaatgcctggcaaatagtggggactcaatataataaccctcctgctttgttattgataagggattatgtgtctgcatgcccccctcccccatgttagttttgaggccccactcactttagagcactttagaattatttgtcaaattccagtgaagttgaggatgcaaacctagtcttcacttagcattgtaactcaaggttgccctagaaggcacatttgacatgaattctgcaagttggaggaagagcgcgacttctgaagagaacaccaatccaggagggcaggaagatacccagactttggaatgtgctgtctgaaattttgactgtggagaagtggagtggcttttccccagggtcctgaggcttgaaaaagtgtccattaccctctttcaaaggcttagaggagacattcacagcagctctccaggcctcctgctacccagattggtttgctggcagagacttggccattgccttttaggacagatcccagaaacaatcatgaaaggaagggcggtatgcctccacttcatgtagttatctcgtttaattgtcatgactatcttagtttgttcggggtgctatgataaactaccataaactgggtagcttaagtagaaatttatttctcacagttctgggggctgggaagtctaaaaacaaggtgcctctattagatgcttgatgagtgcctgattcatagatgatgccttcttgctgtccttacatggtgaaaggggcagaggagcttctctaggcctattttataagggtgctaatcttatttctgaggctctaccctcctgacccaatcacttcttaaaggcacagcctccaaataccatcacctcaggggttaggtttcaccatatgacttttgatgggacacagacattcagactatagcagtgacaatcctgtaggcgaaatatccttatctccgttttataggtatgacaaagccccaaggggttaacttgctaggagtcacacagttgataaatgttggagctgaggattgaaacctcatgagtgcatgtgtattcccttcccttccctttagactctactctctaatctcagtgctggctataaagctggtgcctttttcactgttgtgtttccagtgtctaaaacattaccaacacagaatagctattcaacttatgtcacgggattcttctggtattacaacgtgaatctctgcttgtgaagtcgttgttattcttcagatagaggaataaagactcatttttccatctgcctgctagcattgaaaacccttaggcagaatctcccccacccaacctctgtggtctagctggccctgtcaagcctgctaataacctctccagtctactctctattctcagtggaggaaggtcagtgggtatctgttttagaaatgttgtcagtggctcaaatgtctgtgacatgccatttgtttaatcccatgctcctggatacttgcttgtacgcattaggttgtgggatcttctgcgtttcaattactataccctggaagtttataaaccataagacttaccagatagcagactgttggctgtgttagcagagagctgtcctgcggtgggacatgcatgcacacatgccacacgtgtgcatgcatggaaagagagagacaaactcaaccacaaaagttgtacctctgctttgagttattttaatcttccttcatttgttcagcaaacacttatgaattgtccttgcattaaaaagtgcatcatgtccttcgaaccatatttagtattaaatagcaaaagcgcatcactgagctagcattctttttaataaaatagtgattgatcaaatggcattcacctcatttctctgtgtggtgagtgagagtattttcttgcagtccattttcagcatgctgctattactgcaccacttagcttgatgccaaattgcagttggctccattcatttctgtttactgagtagcgctgtagtgattaaatgtcactgggtacaccaagtatacaaaagtaattaacctaaaaggacatgttagaataagggtcaacaacctctttagcccacagtgccaccagcaagacagagtattgacagaggtattgctggcagggcaagggcggaggggggagtgtggagaacggaaaagagagaagcgaatggaaggagaaagagggagagggaaaggtcagagaaacaggagcgatagaccaggactcacaattgtctgaaatggcaagtagaatggagctaagatatttttcatcagtcctttataatttagttctctgacctgtgatcttttgctgggggagggtgagagattagatcataactggacttacctttcaacattttagcactggttagtggagtgctcttgtctggttagaccagagtaattttggcacatgcttggtgaatcaacctgttcttccagtgttttttgtttcctcaaagtctcctgcatcttagatcttgttgtcatgtgaaagctcgaaatcgtttctgtagaatgaactgaaattgtatctcttaagtatctatgtctcatttattttcattcctcagcatactgaagttactatcagtcacaactgatactaataatgctttatgttgctttacataataaaaatttacgtaaagcaccaggtagtcatctatgacttaaatatcaaccaatgtaaacatcttccttaaaaaacaagtattatatctgtctgccttatatttggctttttctttcatcatctgtgtgtggtgacttactaaccagaaaaaaaaaaaagcaggggggaggactaaggatgtttttccttttaccacatacctccttgggggataaacatttcaaggagctccccagggtcactattctctaaatgagcagcacagaaaaactgctgatgcgtgcattcttccctgggtctgtcaggcaggattcctttaaatcctgtcttttcagtggtcagacttaagtaagatttgtttccctgtggtcacagacagctgaggagtgtgtgatgagagacaaggaaagggataacctgttgaaaactttccctcttataggaaagattaatttctattacaatttttaaaaaggtggccttcatacatttatccaacaatgaatattcattgcatgcccacccagtggccaggactgggcactgaccttgggggaggggcctgcatccttgattggtgaggagagcagcagtgaaaaggcaccagctttaactgtcttttcaacatagttctgaaaattatcttgtcaccctattactttcaaaattactatttttgaaggctgcctccctcctttggtgtgcctacaaatgcatatctcacacacacacacacacacacacaccactgttcttgtattacaggcattatattaagcactgaggatgcaaagaaataagacacaatagtgcatgacctttaggaatgcataatctcctatcttaatataatgaacataatatggtaacatgaagcatacatgagcagaaccaagttttgtgcccattcatttgttcagcagctgtcaattaaaacaccgaagtactggattttcgtggtgatccaaacgggcgtggtccttgccttcatggagcttctagtcaagtagatgagataaataatcaaaagagtagccacagccacagtgctgggaaggaagcacacaagggagtgtgttagagatcggctggagggagctccttggatagcattacagataagacctttctgaagatgtgacatttaagctgaaacataaaagatgaaaagatgctagccactcaggctgggaaagagagttcttggcagaagtctgcacagaggctctgaaggatgaaaacgtttgggttgtctgatgctctgagaaggaaattttcagatcagattggagaaggtgggcaggagctagatgacacctgctacttatatcaagtgtgagatgtttgtcttattgggtgttgatttctgttgtgactctgagaacttttagacctgtgttgtctgacatggtaaccacaagccacatgtggcttttcagcagcagcaatgtggccagtccaaattgaggtgtactgttgtcagtataaaatgcacatcagattttgaacagttagtactaaaaaaaatgtaaaatgtcacataattttcatattaatatgtgtattgacatggtattttttgaagtattggattaaatagatgaccacagttaattttactgttatacatttaaaaaaatctgactatccgaaaagtgtaaaatacataggtggttcacattatatttctgtctgtcagcgccattctaaagaataactttaatattttaatgaaggcccttaagaccaatcagttaagcgataattgaaaactgtttagcccttttgtggtgatatgaagaagaccagagttcctgattagcgaccttaaaacttattaggcagccttcctttaaattgatatattgtcatttctttctttgttcctgttgtattaccctcagacattgtatagagtatatttgcatacagaatacataagaatatatatgagaatctgtggagttaacactctttggaaaaaaaagtttagcctttcaaatagattaaagcagtttactggaaaaaaaaaatagcaacatgaaaagactttcttttctaataaatgttaatagttactaaaatgaagattctggtccattaagatacagcttgccaagtcctaaagcttagtaacttatttctctgagctgttaccctacttcagctttgtcaaagcagctgttatgcttgtgttgatattttcattcaaaaacagagcacagtgcagggataggtataaagccagtgcaccttccgtgaacatccaggaaagagatttttgccaaccctctccacttttgtttttagggcagtcaaactcatgtaccacatgagatttgccagtgagacttagtaacattggttataaagcagtaggtgaatgagtggtttatgatatgttttacaggtcatatactgaaaaaaataattccagaagaaagtggccagtgcatgtaactgtaatttacagagttagcatacaagatttatagaatttgtattaaggagagcgagaattcttgctggagaacaaatggacacagaaatgttagactttgcaaactttgaggaggtccattggattgaaaagtgcgaaatgactttggggtgataggtagtttaaacgatgaacacaatacaaagttgtatgcagttggcaatttttattacaatttctgttagactgttaataccatgccatctctaatgatcaggagagggattacttgattaattcagcttgtactttggattcttctctccatcagtggtgaggggttgtacttgttccaactcattcatctactttcttccttgtgtggcccaacacttgcaccacatgcagactagctttcaagagagggcaactaagctccctacataagaatcaaccctgtgtctttggcatcaaagcatcatgtcccagcagctcagtttgtcagctaaagtaactgtgttcaatgaaatttctggggtggagccaatagctttattccaggaagaggaagcaacagtgaagaaacccccgagaggacattaagataatgttctaatttaaaatcaattttattgatatcttataaattattagagcgttttatactgaccaagcaatacataatgctgaggccatgaaaacagaacatgaatgaattaatattgaagtgctgtattttctactacacatgaagaaaaaaatatgtaatacttttgtatcctaagtattttgactcaaggagccctactgaaaaacaaggtgtatatttcattcttcaaggtgtgtattaatattttattcaagacatttcatgtgtttctgtacttagtgggttaaatacttgttgaatgagtccataagcagacaaaaaatatgcggttgtttccacatttgccaaaagggaatagctgtctatgggggcttactagtactagatgctaggttgaattcttctttatccttatggcaacttacaaggaagtgctgctaacaccctcgtcttacctactggagaaatggaagcttaaagaggttcatgaattttcccaaggtcacatagcaagtgttacagcctggtcttgaacccaaggctgtctgacttttatacctgtagcataaccattgtagacactgcctctcttctgttattcttctgactgttggttcctctggtttgataatattttgattacctgcaaaagaaatttaccttgatccaggtttctcttaccagtagagaagcagagacaaaaacaatagaacattttaaagaatatattgttcatgaaatgttacagaaggtgaaacatttgttaagaatagattcattactttatatggagattatattaaatcttcttttaacaagggcagggctttagaaagtcccagtcatttttgaaggtgagttttgatttatgttaatttgaaaaaagcaagttctgtgagagttttatacagattgtgcttttaatgacttccttaatcaagcaggttataaaaaagaaaaacctcttactgtgatgagcagtaaactgacaccagtgactggctcagtcagagctctactatattcaagttttttaccaccagcatgctataaattttaagttcatttacataaatttacatgtgttatgtgttagtatgtgagacttgtgcattttgaccaagtaattttcattttaaaggttttatatttacttttttccaattgaggattatttcttatatatatatacatatatatatatatatgtatatcctggtggtttccctgtaaatgagataataatatgttaaaatgttttatcagttataaagagctcaatgaatgggaaaataaacattttgtgtaattctgtacaataaaatccaagcagaactagctgggttatggtacaacagtagtttgatgtacgtaggtttattcaggatattactttccaaacttactcaaagtagttccaaaaaaacagaaatacagtgctttgtggtctggtgaacatgatcaactctttggatgattcatgactatagagtcaccagtgttcatttttatttttgacatgggtcttttgcttttctaaggggttgcagaggaaaatatgattgaggactttggttatggcatcagtaaaggatctacaggggccttcttcagctttctgtcttctgtgcctccacccctgtccccatcaccaaaaacaaactcaacttgaatcgtccctgactctgattaatgtttgagaattcctatagtgactgaactatagttaagagtaactataatttatcgtctaaacttggccatttttgagagtgaagggaagtctggacaacaggtgtagaaagggcaaaccaggacttgcaattacccttgacatattttagtggtaccttctgactcctcattatcccatttatctgtttgaaaactgatttacccttttgtaccgtgtggatacgatttttgaaggccatagctgatgagcaaacaagccataacgaatgagttttaggctgcttgatcatggtttccatgcgacctttagcatgttctttctggttgttatcgtctatgggcagggaagtctaagcactgcacctgtgtgaatggaaagcaaaattggcatggtgtgcatttgaaatcaaattagaaagtccattgtggagatggtatttgcagtcttgcctctgtgcagtattgaaccaaaaccttatcgtgattgttgaaaggagaaaagttttggtgaatagtagcatattaaaaccctataattatggggcatcagaatatctatgctgggggaagtcctacacaaatgtctagaaaagacctaacataaggtttaaaatagaagatccacactaggtcaccatcccaatctctaaagtaagtagaatcaactggagtccagtatacagtgataggactaagttgcactgttgaggggctaggctatgtgcctgggactgcgcgttgtactttatgtggattatttttcttggtcttcaaagcagcccgtggggctgagaatggtgtgttgttaccccagactaaagagaggctgagactaagcaacatcccttacggctattaagtgaagactctagactcacaccaggcagtctgactccagagagatgctcttgcctgctattaaaatctgtgctccctgttattaaaattagctaattataacaacagcatcttcttttggagggggaagttactttatagaagtctttctcatacattgtcatctttgatcttgaggtggcagaggagtaaaggtggaggggtggggccttccctttcaagttgctggaggtgtcagttttccatctgacttggtcaacagccctagtaaagtctgggatggtctttaatctaggaactagaatcttctcatagtgaaattagaacctgattatagctttttaaagcttaccttttgctaccaaagcaattggggtttccatgtaataagtcttttaatcctttagtatttttttcttggtttctccttgttttcctgctctttttcttaaacagatctaccctgttctttttaaatatcccagcataagtgtttacttttaaaatccagagctttactaaacattcacattcagggtattttgctttctctggatcagccattgcttgtgaccgtgactctccaatcataacagatttgctgagatacacacacacatacacacacacacgcacactcaaactgtagtgagaaagacttgtgtttaatccttctaaatttgtagatttatagggtcacaatgcagcttcagtaagtttcttatgtagtaaacttgagaaatatctaaattgagcttttaaaataataatagagaaataaaaaataataaaataaaaagcttttctagtaaaagcatgactttatcggtatttatttaattcctcttattcacatgcctagcaaagatccaagtggcattcctgtggcagaatggtggacttacaagattcatgatgagagtctgtgccaagtccaatttgattccagagtaattatgttattagaacattgctgattgccccagtgcccactgtgcagcttaacctttaaatgctagtgataattaactactttatcattctaccaagaaactccaacatgtaactctgttctacagtcaacttcaaaaatacaacgctgcctgcaaaaccggaaacagctagcttaagaaaaatataaagtatttggttgtacatatgagccaataaatgaacataaaatctaaatctaaataggcattaccttttagtatttttaagaaattgttttgtttagaaatttttcctcttaaacaatgtggaaataactttcaatagaatatagcagaatcagagaattgttaataaaagatatatatactccatttttcttctttttgtaaaatatgaaattagccagatttagtgcatctaaaggtaagtaaaggagcaaaggtgaggaaggggctgaattgccatattaccgattccaagggcaccacaacacaaatcttactctagtgaatggtctcccatggaattgttcatcctagtgatgctcagaaaaggaatgtatcataagagatttggagtgagattgaggcgtgcagaggggatgttcagccatttgtgttgagaaatatttctgggcagttcccttctgctcatgatgctaggtgccccaccctcagggaacccacagcctaaagtgggaagtggccttgtaaacacagcaataaatttgttgtgagtgctttactcattggaggaacaaaatgttaagggaacaaagaggaatgaatgattaattctgcctgacagcatctgaggaagctttgaaaggtgacattagagctgattcttaaggatagtgggggatttcaaaagatagatcttgagaaaatagtcattgccataagccaggaaaaaaggctacaggtgcaacgaaaatacacagagcccaggggaacactggcttatagtgctgatgtaggatacaaggccaggactctggattggggtgtggagtgaggactttggaaaacagccatactcagaaatttggaatttttttccccctgtgaacagtaggaaactgtccttttaaaagaggagttaaaacaggctgaacctctctttgggaagtatgaattccagaagtgaggtggatagactggagaggggaaaactagaaacgggattgaggcatgaagtatggtagatagtaacccacagatgatgattgcatgcatggtttcagtggtcatgaaaacctactgagtgcattgggttgtgtgaaagcaaagcagaagtgttgacccaagtctcatggcttgggagtgaggtttggaactcagcagagatacacaaaagtcaagaagtagtccactttaaaaaatcgtttggctcgtaatgttttgtgtcaatcttcagccttactgaataatgcctgcagtcttttctgccactaagtttaaggctgaacgtttgataggtctagggctagagtattcatataaaacctcaagaggggctggcacagcagggacggatttagaggtccccagcccgcccagtgggcacccactcactggtcccatctctctcccccaccaaactcccacctgcacatctttggagcttgtaataaagagttgccatcaccacaggtatgaagaaagaccatcaatcttcttaacaatgtgctttggaagttcagaaatgccacaaaagagattgtgacattaaggctcagtggaaataaaatggaacatagacccaaaagttctgggtaacacactttctctcatagttaattaaaagggcctcgtaaatgttgtatgtttttataaacatcagttattaccaacagactaagataaagcaaaaaaaaaaacccgttcaaagagttagtcttatatgaaataaatttataaatgaggaagagctttcctgaccagttttctgaattgatttgcatgccagacagagacgttccagtggtgattgttcttcctataactttttttccatagagattttcagatattctttctactactctccaagatcagccctttgttaccctgggttagggtcattcacacttgggagccctgccctggtgccctgccaagggactgtgttactcaggtttttgccattcaccactcagcagcatagcgcagccctcagtccagctcccgctctcccacctcacctgcatttagatcttttctttggtctgtctgaagcttagtcactaggcagttgttaagattgttccagttttcattggcacttttttcacttcttcatccatgattttaagctctcatattatctaaatgtgcccaataaccacctgaccttcatggcagatagagtcattctctgcttcaggtcttgtcacccacgtctcttgtgtgtataggagacttctccagttgagagctccttgaaagcagaggtgaagcatacaggctgagcctaagtgtggtcccaagaggcatggagcatctttctccattccctggccccagtggcattcctaggtttccagacattgaaaggtgtgggttcatgaaaactataggagtgagaaaggaataatacgcatttctgcaggtggtgtttttcctgccactctgtatcttccaggccctaacatatggcgctgagcaaaacttcataaatatgacctatatgtcacatgactgccatctttggttgctcaaatcccccaaaattactttcccccctttttttttcattgacttactaattacctcttaaaagctctactttatagtttttctatagaagcttgaaatgctggcttcccattagccagcaaactttaaaaacaaaacaaaacaaacaaacaaaaaaacctggctttttctccttcccttttttctcatatatgcttcctttcccaactttctttcttttttttgagacagagtttcactctgtcgcccaggctggaatgcagtggcgccatcttggctcactgcagcatctgcctcccgggttcaagcagttctcctgcctcagcctcctgagtagctgggactgcaggcacgccaccatgcccagctaatttgttttgtctttttagtggagatggggtttcaccatgttggccaggatggtctcgacctcctgaccttgtgatctgcccgccttggcttcccaaagtactgggattacaggtgtgaatcaccatgcccagcccctttcccaagtttctaaaggcacttcaacagtacaatatatccgtaaaaccaaacccattctgttttgagtttacactaattcctgccaccctttttatttcctctcctccctctgtcccatctctctgcctcttctcgttttttctttctttcccattatctttcccccttgtcttttgctacttgtctttccctttatatccctgttttcttcctttcgtctcctccgctttctcctatctcctcttaacagctttgcaagtatatgctaaagaataaaaagaaaagaaagtctcaagtgacttaaaaatcactcggctaaatagatgataatttctcaaccatgcttcctctccttctaattccagagctcttcagtatccccatcagccagtttccgaggtgctgagaagcacagaaactccgcagactactcctcagagagcaaaaagcagaaaactgaagaaaaggaaattgcagctcgttatgtaagttcattcacctttgtgttaggggaggccagcttgcctttttatctgcagccattttaccctttgactattaccagccaacacaggaacacaggataacatcctttaggagacaaaaaacatttattgtatttatagctctgtagccattggctagctgaagtcctgtgtgtgtacagatgcatgtgaggatagaatgcttcattgggcagctaacagaagacctggatgatccatattattgtttctataggtgtatttgcttccccattcatttcagagtggttggattttctgtggttagctggaattgttaagcagaaaaatataaaatcataaaaaatgtgtttaaatgcctagatggattcatgtgctgaaggatataccaaatgttgtggaataaaacatggagagacatccaagatcatccctagcctggaatgaagctcattttcctttagtggctgggcaggtcacaggagtgagatgggggagcaagctggatggagcagtgtggaggcaggcggcccctgctctgcttccctgctggtgtcctacagggccgcaggcctcatgaaaagctggaaatctggatttttacctcccaatatgcagttttttaaaataccaacaaaccagaccacacctatctgtaggccggatttagcctgggcctgtcagtttgcagcctctactctagagtaataagccaaccatcagcttcaagtttgtaactgaaaaatgtaatcaggtcaccctcttggtgcagtgggtagtgcatcagtctcataatctgaaaaatatattacccacctccatagcatcatcatgaggattaaagaaaataggacattgtcaagtatttaacactgtttggtacagctcatctttataagatatgaggaattagtctggacttacttagggtaaatgtggtatgttttgtgaggggagaagataatgcttctcacttgtcaatgcaggacagcgatggtgagaaaagtgatgacaacttggtggttgacgtttccaatgaggtatgtttgtggctactttaattttttgcacttgcccagccatatcaaagactagttgcccaaacaattagtatccaaaatatcttgaggtttgtcgttttgttattgttgttgttttttgaggcagggtcttgttctcttgccctggctagagtacagtattgtgaccacagttcactgcagccttgaactcctacgctaaagtgattctccctgttcagcctcccgagtagctggaactacaggcacgtgccaccacgcttggctcatatttaaattttttgtggagatggggtctcattatgttacctaggctgggctcaaactcctgggctaggattacaggtgtgagccactgcacctggcccaaaacatattcttgatttctaaagggacccactttttatttacataaaaattatgtactactgattttatatgttattgatctttttttttttcattgttcttattctattaagaataaggtgtcattctctactgcagtgaaggcacaccagatctctgtggtcagcctgcaggtctcattgacgtgcaatttgcagatgggtggggttttgatttttctttgggttttaaataagtactataaatactataattttggggccctcaatactgaatattttcgttagtagtttcagtgagtattgttatctgttctagcacatttgtgcttctaagcatgcattaaatgcttttggctagaaatgtccacacccaacaaccccagcattataaatgtgctgtgcttgcattactgtccacgatgttcctttgtaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttgtaagcagctccttaccatctctctgagtgtggcctctgccaatttgatgtttgaatttgatgtttttatctttatatttctcacatttttaacaggacttttatttccaaatgtatatatgttcggtatttaagtttaattggcaaaagtatgtagagcagaataagtttactaacttgttggtgatgagtgtttattttatgattctttttgcaaggatagaagagggatatggggaaattgagtgaaacacgtcttagcgaagatgaacaatgcacattggggttacagagatggttttgtcgcctgtggtttatggtaaatttagtttggggcttgaatgtgattttgttgctagctttgtttgaattaccaagctacatatgacggcaataattttcccttcctatctaaaaagtaatctctcatttacaaaagtctatcttgacttacatcacaaatcacaaatgcaaaaatgaactgctcacccatcaggataatctccctgcaccctattcttctgtggctgtgtagttaattgcaactttgtgtggtgtgtcttttttcctcaccagttatttccttgtaacataacatttaaaaaaagaataaaaagacaaattcagttttctaataacctctggaattcacagctaaaggaaaggaaattcctcacttggtctgcaaattaggggggataagtgcgacgggctagattgttggtgttgtttttttaaattttattttctcttggccttctggccttcttttaatggcacctgctctctgcttagtctctatgacaattcaagcttggatgtgttttctaatgtgacctgttcaccaggaagcctcttgtgacatgaacaatctgccaggagcccacagttaccccagtctttaccaaagtcaccagcaagtggccacagttaggacatcctggtttgtgagcctcatctgactcagaccaatttcctagaaatgagctgctctcctctaaattcagcttcagtttatgtcttcccaaatattaggtctgctgtctcaaggaactcttttgtttctttgttaacttttctattaaagaaaatcaaggcccaagctgaagaacctcttccatttcttttcctcctttccttttctttacctttttactgtttaacgtcattgttaaaaccatgttctaattgctggtatatgtcatttcatcttgttagaatgaaaaatctactactcccgtctcaaagtccaatacccctactccacgaactgatgcgcccaccccaggcagtaactctactcccggattgaggcctgtacctggaaaaccaccaggagttgaccctttgggttagtaagaaaaaagttttttctatatttttatgctcgtttttaagaatttaaagcaatttaaggagtacagtacattaaaagtgctaatgaccagcattgaatggctgttagacaaagttacttaacctgaaccgagcacctgggaccaaccttgtctggcacatggtaagtgttcaatagaacaaagtgaatgagtgaattctgaaggcttgaatgacttttgagaatattaaaataagctcatttgaaccatagattctattttgtgacatgtttacaaatgtcttcactgttgtttcctgtgttcttcatttttcttccatccattttggtttgcagcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgcgtttgtgagcttcacaaataatattttagcacacggaggattgtcatgcttgattgattgcgacagggtctcgctctgtcacccagcctggagtgcagtggcatgatcttggctcactgcagcctctgcctcctgggcttaagcgatcctcccacctcagcctctcaagtagctcgaaaaaacagcatgcgccaccatgcccagctaatttttaaaattttctgtagaggcagggtttcaccatgttgcccagtctggtctcgaactcctggcctcatatgatctgcctgccacagcctcccaaattgctaggattacaagcatgagtcaccatgcctggcctatctattttttaatgtaatttatataatctaaggtatttagagatctgtgggtatttataagttaagctacatgtgattataatcttgaggtccattttcttttgtaaggtgaagaagtttcttttttattttatatgtctttttaaaagaatactaattttaaattttccaaaatgatactaattttggaaacttcaaacctacagaattagatcacatagtataatgaatgtaatgactctttggttctaccatgagcttcaataatcattagtataattttttaatctgtgttccacccccaagtatgttaccattaaatcctaaacattggttatcatttcaccaataaatacttctgtatatatctctaaaaccttatttttaaaggatctattctcccaggttttagaatagattttgagaaggataaaacaagtcaaatgtaactgtgcttatttctgttgtttgcttgggaaaaattctaggtgggatttgatccacaccatcacatgcgtgtgccagcaatacctccaaacctgacaggcattccaggaggaaaaccgtgagtacctttttgcctctgtgctcattgtgtgtcaaactcaggtcccttgctggccccgtagacttagaataccactagacagtgttgggggagttcccatgacttgtatttttttaccttgcaaggtatttttcattttctcttagcacaagaagagaagtaatgaagtggggttttgcattgtaaaattttgagctttaatatgtaaatgcaaattgcagaggcatctccagtagtcaggtcttctctacatctgttgcagatttcaaggcaattctttgttccaaaagtctgattattatgtgcaaacctgaatgttcaaaatttgaatatgttgggaaaagacatgccaaacctcaaaggctgaaaggaaataagggcactcttatgcttagttctgttttcagaaaaggtgacttgcttagttggcttcttataccgtgctctgggcatctggagcctctgtattcacagattccttgagttaggaaagacaaaacacaacacaccagttgttctagccttctctgaacggatctcattccaaatactttattttaatctaatgcacctttttattactacctaatcacagttgtctctgctaattggcttcatcttcccagaaacaaagattttactataaagtagcactggctgtttctttaaaatcccagctggctgctttctctcgcttctcctttgggaagcctcccccgcagatcctccttgccttgttagtcacctgtgtgtgtgcatttttctcatcactctttctgtgggcatcccctctgtcactacacatgccgtgtatgtgctgcctccccagtctccagggctatccagacctgaccctcagtagcagctcaaggcgccttctcccagaggcttccctggtagcttgcctgccttgaggtattttgtccttactgtccttcttcctgcaaaactttctgtggcttagtgtctcatttagttatctaagatgtcattatgtcagagcgttctgccctgacaaccctattatccctctttcccttcctccctattctttcctcttctactacctttttaatgcttttttatagccattatctgcctctccctcttgactataagttccatgaaaacagaacagaactttctgctattcagttatagaagcagtctcactgcctagaatggtacctggttcatagtggtgctcacggtatggatttattcagggaatggatatgtgctgatttctttcttctcggacctcccattgcttgtttattcactcccacacactcgggcacttagttttcaccctggtgttaattgcgtgccctcttctccccacatcccttcagtgttgcctaacctagaccctttctttactttccatctgaggaatccaaatctcagttcttccttttgtagcatattaatacttctctacagactctatcctaaccttcctttgttgtatcaagcacagtgctggctccacagccaagttgcttggtaaatatttggctgattaataggggagaaaagacaaattagagttcctcaagagttgaaggtataaatatcaattaccataaaattctgtgtacctgtgtgtgttttgcaaatagttgttgactaacaagtcttattgaccaagaaactttgatgtatttgaaggtgaaagttgggtctatttcaagcaatgctaaataacaaggttatacaattaatcaaataatgactcagatacctacaagttccatatgaacttgtggggaaagtggaagggttcctttagggaagaagtactatcccttttttttggttacttcttaggtaaccaacagttgtacccagagctacagcataaccactagagcaaatgagatgatgcttcttgcctcagctgctgcttcgaggggcaaggggtgtaagtgtctttaaggaaacaccttggctaagggatttggaccagttaaaccactgtggaatcacagctgctctgactcagatggtgcttctgagtcttgggctgacttcccttcatcagttttaactttcgatgttataaaatgtttaaatgtttaagatcctttagggtgggttaatggattggaggattgttgagaatttttgtttatgagagtgacagagtcacatctactgcagttggcaaatgacactttaccaggaaaatgacactactaaaaagcatgtggtgcagtcaacagagtatggttttgggagtgtgacagatccaagtttgaatttagactctgccagttgaaccactgagaagagtggctttatgcacaatttctttgtgagcttcaatcagctcattcatgaatcagggatggcccctcctcaacaagaaggatgtgaagataggaagtaagataatatgttgtgtgttcattcagtgccacatttgttacatggtggctgtttagtcaaccccagcattatttccctttcagctttgtcccagcatattattcatttttcagctacttatgtagtaggaggtacattgtgttttaggggcagaagtgacccaagaagatgggtcattggtgtgtctttatgtaacagagcatgaagacgtataaagttacattcacttatatgcatacagagataatatacttttattatagatttttacagcagaaatgaatataacagttatgtggctctccagatcataagatactgaattgtgcaatgttgtcttgtgcatatttttcaagacaaaacttttttaagtgtgctagaaaataaaataaaaaatcacctaaagtcttcctccaccatacatacccacaatgtaactacctttctccagaaagacttataaaagttatgtgtctctgttctaattatttcacacaatgaattgctagatatgatcagaaattataattaaatgcatgttccaaattaataaaatggtgtttattgtataattcacattgaatcctcttgtctgctcaggtgaattagcagaggttctacttcatatgtagttggaataacagcatagtttaatttcaacataagccaaaaatggcccttctccttcacctgctactcaaatgagacttctatggctagtgtataactatttgattaacatcacggtactaattgtatgagatgtgacatgtgaacacagcaaaaataaaagatctcacgttagtggattataggctgctcacaattcagaaatctgactcttttgcattgatttatttttataaagcaagattttcaaatgagaataatgcctgatacatagtaaaaaccttcaacgagtatttgttggctaactcactggtctgtatgctacttagaacagaattttctatcgtatttcaatgtaaaatacaataaccagacctctcattgtgacctcaaggtcgaagcccatcttgtgacacattggaaatgtggagaaggtactgtgcgcgtgagagatgagcacagcataacagaactgggcctcagagaggagaatgaggggaaggtgggaaagccagtgaccttctttaaatatgctgggtctttgtcaagatgataatccatatataacaagtttgacacacatgtttttaaaaaagcaaattgcatgtgtctggattgtttaaagtgtagttatgtcagagagtccaagcctagcattttcttcaactgtctcttattctcatcgccatgtttgttggagagccactctgctcgtagcagcttaacctgtggtgtgtgtgttcgtgttgagaggaggtcaggtcactctatttctctgactccctgcaccctctccctccagccctgtatttctagttatttgttgggcatcttagctagggatcttgggtgtatgttacttgcaccacaaattcattatattcagaaagtacttttgtaaattaggtcctcttcccagtttgccctttttttgttaactacaagtaccatgtttcttttttcctgagctcagaaactcagttactctagctcctcctcagatctcgtcaatttagtcctacaggattttatatccattgtaccttctaacttgtcatccttgcccttgcctggttcaggacccccagtacctcttacttaaattgttggaataattgttgttgtttgttgttgttgttgttgttgttgttgtttgagagagagtctcggtctgtcacccacgctggagtgtagtggctcaatctcagctcactgcaacctctgcctcctgggttcaaatgattcacatgcctcggcctcccaagtagctgggattacaggcacatgcgccaccacacctggctaatttttatgtatttttagtagacatgaggtttcactgactggtctccgaactcctgacctcaagtgatccattcccctcggcctcccaaagtgctgggattacaggcctgagctaccgcgcccaacaggaataattgtttttaattcctcctgtccatcctactccttgctaccaagtttattttatgaatagctttgcccagtaatggcacactccctttatccctcaaaaatctcttcagtcaattctgggaaggtctcaggctggcattctggtccttcccttttatagcattacattgattttaattatatagagatatagatctggtatgttttttcagactatgcttggccagttcctccatccacctactgtgtagttattattgaatgaattcctggattaaaaccaattcaaggatttcccagctcattttacctcatccttttggaacttttgctctctgctattcttgctatctggaatattttttccatctttctctttactcgatggtatcttttcattctttaaaaacccatctctattaccatgtctgtctctcatccaacataaactttctttccttttcaaaacacttcagaatactttccattagaatgtgacctgatattgtcatttctgtacttttctctcatcatgctaactagattgttagtcacttgtgggcaagaccaggtgcattacctagttttgtatccttagcatgacgtttgcgtcagagtatatggatgggaggtacttaacacattgtgcattaaattagttagaaacagagtagccctttgcgcctcggtttctctgattcctagcaatgttgacttccctcataccttccaggagtatttgctagttacagtcaaagagtttatcgaaatctgataataagtatgtactagagctttattatttccagttctgagtgccttctatgtatactaatagcaaacagagggccacattaatgtcattaatgaaagcaggctcttggaattcatttggactctttgaaaggactcttgccaggaacatagtaggtgctcacagagtggttgttgttgaggtgaaggctgtcctgttgaaggccttgaaggaaattgtgtgcctggtttcttaactatttgaaatctcagtgctctttaataaccatttagtgattctagactagagaatgagatggcttttctaataaattatcattaagaatgtataacaccatctaaacttggaataatctttctttctcttcctttaagatttagtcttcatgacctcctaattgctaaatcaattagcctttttctcggccatcatccctcagaacctcagcctttcacaagcgttactgccaccttctccttgtctgaactgaaatctggccgtctcctgagatcatcccttcacttgcagccctatacagggtgacctttccatttcattcactgacctcagcaccagcggtggggttaataacagctgtggttgccaccccttctccagcctctccatgaacagaacttttctacctgttggtgaaaaccttgctcctttcaggctcgtgccattggactaccccctcttccaccttgttgggagtatttccccagtgtattaaagacttgatacatggctgagagtcttccactacccagaggctgccataatcctggttgactctggtatctacaaagacaaccccccagtatcttcatcatggtcttggaccccctcatctctagtgaacatctgccctcctcaccttcagttacctgtatttacaggttcacaaagaagagcttatcatcacccctgtgtcacctccagattctaagcgtcccatccagtacaacctactgtggctccagtcagccagagtgctccacgttctatttccaacttaccactatctcccaggctctagccactgcttctcctctagattactgtgtagtccccagactagttgtctttcgttttgccacctacactccattcttcacccagcaatcagaagatcatttgaagacgttaactgaatcatgtcactttttttgcacaagtctccagaatcatatctgtactcatcacagcctatatggccctttttagtttggccttgcctgtcccttcactcttatatcctatatgctctccaccgaatgcactctggcctccttgcttcgttctggtctcaaggcctttgcatttgttgttccctctgcctggcacgttccccattacttatttgtaaggcctgtgtcattccttcagctctccgcgcatatgctgcctcttcagagagggccacctgactgccactgtgtgctcccctactctcttttatctgaaaatgtgtgtgtatatttaatggtattttccactgtctgaggtgtttatcaggtatttatgtttatctgttacctgttttcctctctaggatgtagactagtggaaggatagggactttgtcagtattgttcacctgattccccagcacctgatggtaactggaacatacgaggcatttaggaagtatttgctgaataaatgaataattagcacgctttcttgctctggccttcgaatttgccatattcctaatcatcatactgtcttcagacaattcgtacccattctttatgttgcagccctattgccattttctctgtccttttcactctgttaaattcctagactaccatgcattgttcactgcactgaccatctgacattttgatagttacttatgtgcatatctcactaatgaatgtgcccctcaggctgtaatttcaggagaacaaggtgtgtgcatttctttcttattccattcttaccataatgcttggcacactggcatactcaagaaatatgtgttaagtgaatgaatcttagtaaattgtcatgtgattgaacatcttctccccctttctattttattatctctgctaataatctacttccataactactctggccggagattccttaaatgtccacattctttgggattctgtatctggtctgcttttcactgcataatctgctctgggattcttctttccgtccccttagcttcagccatcacttctttatggatgatatctaacctgacctctctcctgaatcacagctgtttggatttctgccctgaagttcaagaaaaccaattccttcacctccccataggtgtacccttgagttatgctttcctgtcatctttactaggtaatgcagtctacctagtcacccaggttcttagccctagggtcctcttcagcatctctctctcaggtcacacatccagtgtatctccaagtcctgttgatttgatgcaagaaatgtcttctgtccattggcttcctagcttcccacctccttcccctccagcaagtctcacatactatgttcttctacaacgctctgtagtctgtggaggaagtaaaagcccgccactgtctagtgccctcatcttccacagccacaatgcatgcgtcattttttctgggagcattcaggtagttgaggaccattcaataatggactgaattttgatgaacatggccagcctgtaaatttttgcattaaggaacgataaactgttttaatttaattctacaacttccgcagtttggtccagcttcctgtcctttacgcacccacaatgctttcccttggtatgtcttttgtaaactattttctgtaagcagagcagattcccaagctccgtgcccaagtagagtagcatcttttccaaaatgggctgttgcctatgatagtccccaagataggcccagctgcctcctgcctgccactggcgtcttctgcttccagaaacctaacatgcgtcacaacagcctcactcgtcccttcctgacttcagtgccctaaaaataaaaatgagtctgttgggggagacgctcttacttaagttgcattttaggaccaaatgcttttaccacctgagggctttccctggaaatgaactggagatggaactgccaagagatactcacaggtaggcctttggggctgtcaggatgcctttttaggttctcattccatttggattgactaggatttgtgattgtcaagtctgatcaaggttttaaaatagggctttatctttttttttttggcacatctgtcatttcaacgtctaagcctagaggctcttaactccttaaagcttcctgattttggcctactcatctcccttagtaagtcccttgccgggaatgaattgatctataggcgaggtctcatcacaggcctctgattcatccaaaggagaaggcaatgcaggtttatagggcatccctgaaaggtggctactgcacttgacggtggttatctcatttaattctgtgaggtataggtagtgttctcttcattttagagactagaactgctgttctagtttagagattctaagtaactactgatgtcccacagcagcttgtacagagtcagcctgagatctggccctgtagcagcctagctgtatgattctggaaattatgttctttacactgtatggacaaattcgatttgttcgtaaatcacaagtggcactgaaggtgttttatttctcatctcattacactgaacagttaagtgacatttttttacattcccctctttcttttttcctctccattgccttagagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctggtgagtgaacatggatgaacaagacttagactttcattcagaaaacaggaggggctgatgagagaactgtatgtatgagcaacaccacacagtattgatcccaggtggatagttgctcttcaggggactgcgatctttcacttggaggtgtgtcttttgcttcctagacacacagtgatctagttcttcatgtgtggcatgtgcaccatactgatttcattaactctgcctcccatgggaaaaggcaaaccgcttgttttcctctctgatggttaagcaaactaagagcccatacagtgactatgagtgtgcacctaaatatcatctgtcacatgtaaagagtaacttactgcctcatgtggcaaatactagatagcccctcagctgcttcattggccttttcccttgagttccttaggaaatgtcagtttagtagaatttttgctatagcatgaggctacatcagttgaacataattaaatatacataagattcccgtaacctcatgagctaggaggaactttttttttctgtaacttaacactccatgatcaagtcttgcctctggtgcagctttcatcaaatgcatgatgccctttagtcacgtaatgcaggcccaggcaaaaggaacagactgccagggatctaccccctgaaactttcttgacatcagtagcaggacctttcaacagcagaactgagcctgagtctaccaaggttccaagtttggatactccaagactgtgagagctcctgcattagtgtacgtgtgtatctgtgtgtgcaaatgatgcaagcagttggttaatttggtggtggtgggagtgggtctagagctttgcattttgatgctaattaagattaaatatctcagtactacattttgtagatcaactttaagtacttccctaatttcatgtaattttctagcattaatccactttatcattgtcataagtataaacggctcattaaaccaggagggaacacaatacttttatggatttctgctctcatgttaatgctgttttcctttcctcatgagtaatctcttgatggtttttgtctctacagaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggtaggttagcaggatctgttaccaggttgtgaggaggagccgattttaccatattttgccaaagtgctgtgtatataggtatgggtgtgtgtgtgtgtgtgtgtgtgtgtgtgtgtgtgtgtgtgtgtgtgtaaagtgatataattatcttactaaaaattgttcagaacaggtccattttaagatgttaaaaataaattatcagtgtgaaaatcttgttttctgtagtacttgaacttcataaaatgaggtcttttttccttccttgacttatactaaagcatcgccaatttgttttaataaaatgaggtcaatttgacataattaatgtacataaagtttccatgaccccatgagctccatggacatctgtaatttgccatctgtgcttgctaacaaacgattattgttgatagagcctcactgagaagattcacagtgtatggtactgtcttgagtgccatacacatctaacaggttcattccttcagcagatatttagcaactcccatgggcctatgcactgtattgggtgcaactcactctgaaatggtctagattatctgttgtcccacctttgaggttggatagatataactttacaaatgagattataaaagattggtgttggtagatgggaaaagctctgaaatgattttctaggtgtcaataccctaagagattagcaagcaagtagaatgatcagctacaggtatgaaaaggttgtaaccagaggtagctacaagtcaggtgtgtaaaagaagaaggctttactatctgttatttcaaagtactgaaacctatagatcccaaaacaaatcatcactttcattgcttatcaggcagcctcttatgagaagctgcttctaaccctgttttctcctggtgaccttggtacgttttgccatgagtgattcctgggccagtagttcacactgagtgtctttccaggtgccttacttgagagcctcgccttccgtcttgcacagccacccacagacacattgctgctcactggcaggactggtcctgtcgctccctgtgccatccccagtccttctttaaagggaaaattaaattctctctccctcataccacagtaatagaataggtctcagaatatatctttagttagtgcatatatgtgtaggcgtgttttcttttgttaatttcagagatttttttcccattagtaatatcagtcatgttttcatgaaaaagtaatttgaggaattcctaagtattcaaaaccaagcaaaaagtacaggacatgtggcatctctttgtatatgctttgttattactttgaataattagaaaccataataaaccaaaatgaaatctacaaataaggcctgcattgaaattgaatcatcaaggaattctaaattgattttaactaaaagctaacttttcaagggctttccctccattttgacattttcaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccaggtatgatccgtggctgaggcattttaaagatacggttttaggctgaggtgggcggatcaccaggtcagggaatcgagaccatcctggccaacatggtgaaaccccatctctactaaaagtacaaaaattagctgggcatggtggcatgtgcctgtagtcccagctacttaggaggctgtggcaggagaatcgcttgaatgcgggaggcagtggttgcactgagctgagattttgccactgcactgcagcctggcgacagagcaagactctgtctgaaaaacaaaaaaaaacaaaaatgatacggttttatgaaacatatcacctactgaaagaagaggcagttcacttaccgtgtgatgatgtcacttttgactctggattaaccactttgaagtctcattactttgaaatcgcccatttgactttggttctcccctgtacaattcaaattatcttgattttcttcataatttaagtagtatctacagaagagatagtacctcccagataaaagaagcgtgtccactgtggccactgtcaccatcacctgttttaattctagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggtaagcaagcaccttttgtccattttctgtcaaccagaattgctccttcccccttcctgtgtttttatttccaagtcgaatccttgagttcattaccatgcccctcttcagaattctattacttcctgatacatgcctgcttccccaacaccatgtaattttctggcattaatccactttaaccttaaggattagtgactcgattaaatccagaaagataggctttatttttgaagtgaaagttattttttacaaatggatgagttttctgttaatagtttggtgttctataaagcaaatcttggtgtctgacagagtaacacaaacattgcctttttcaaaaccctttacctataggcaaatggtttgtaagcactggaaaggacaaccttctgaatgcctggagaacaccttatggggccagtatattccaggtaacatggaacttgttaactaccacttatgtttgtttaatcaaactctctgtgcattctctcagattaataatgtgcagaagtgtcctgggaggtcagagctagtattatgcacattgtacagagaaggaaactgtgtccaaggagaggttaagtgtcacagcaaagccgtggagctggggatagtccccagtgttctgagctcagagccagtgctgtgcctgattcagtgctcactgttgcttcatcatcaatccctttttggagtagaggttttatgtcttctgagaattttatacatgtatgtcttttgtaatttttaattttaaaacttgagcattttgcttaaatacactcttgttagtagtagtagtttttttattttattttttccaaagaagagtgttatggaaaagtttgataaaaatcagttttataaacttttattttccctattgactcagtggaactttgtatagcttgtgaaattatttgtagaaggaccaaattgtagacatagtacacatatatgcacgcgtgcacacacacgctctcctcctctctcctactggtatgtgagaatttcataggcaaggtgaaagacttgcctttattaaccttctatatttaggatgttatttcctagtgttcttttttacaagcaatataatagacttgcagttttcttgaccaagtggtattatcataaagtagattaattccatcgaatccaaaatagtatgcaagataatcagtaggacaaaaaacgccaattgttgcagtcatgaagcttagaatttaatagagcatttttcataacatggattatcacttgttagatagtcccaactgcactttaaaaaaagagtagtacattttttatagtaagcataagtactatgtctttaagtgtttaaagtattcagagtcctggttaaaatcctgtgttgttttcattttaaatgagcacagtttagttaaaagttaacattgaatccttcatactacagttgaatatggtatacaaaattctatggtatgtttttaactgttgaacctctcccctctcgcaaatttgtgtcacatttttacagtgggaacattaggctttttactaggaatatttttacattctttttttttttttaatgtattctcagtgccatttctcatatctgatctcactgaactctgctgcatccctctgaggtggtagacaggtaaaatgtctacctgtttgctattgtaaggaaactgaggtgcagacaggttaagtgacctgtgccgtgttccacagctcaacctgactccaagccatctgtttgaagttgagggtttttcataccagtaacaccccgtcttaatggtagaatagggtttgaaataaggtcttgctttgccagcagaggtgctcatgccattggcttgcctgcctagctgatgtccccaggacagaagcctcctgactgacctggtgaggtgtcgccaagggtggatccgatccacctctgccattttaagaaagtgccacgtggtggctcatgcctgtaatctcaggcataatttgggaggccaaggcaagaggatctcttgagcccaggagttcgagaccagcctgggcaacttagtgagaccctctctctacaaaaaaagtttgaaaattaggtgtgattggacacatcagtgtcgtagtcccagcatctcaggagactgaggtggaaggattgcttgagctcagaaggtcgaggctacagtgagccatggtcacaccactgcactgcagcctgagtgactgagggagaccctgtcttattaaaaaaaaaaaaaaaaaaaaaaaaaaaaaaaagcagcagtactgtccatgaccacctttcacctttccttgactgggctttctgtttggtcaaggagcacattacatttgcatttgctctaagtcctccatactcatgggattttctttcagtatttaacatttttgattatatgtttctttcctagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagtatgcttatttttctaattctttgtcttgatgacattagtttattttttatctttggctgtgccactcctatatattaaaaatgcctagttttttcaagggagattgttgttaaagtaaagtggttttttttgttgttaaagtaatgtgggtttttttcactgttgctgtttttgttttggttttgtctttacttgagaggagctagaaaaggtaggtgatagaagttaacagtgaccagttggtgctaaatatttattgagtacctctttgatttataaaaatactgcttaccaaaaggttatcatgtccctcaaacccttgatgctttagagctatgctgttcaatatggttaccctaggcatttgtggctctttaaatttattaaagttaaataaaactagaaatctaatttaccagtcacacaaactacatttcaagtgtcaagtagccacatgtggctaatggctaccgtattggactagacacatcaacacgggctttaagttagccaatgtaaaccattgccagccatgtggatttgggaagcatttctagcataacacactgaggtctttacaccaggcttcttgggctgctactggttgggtgtatgaagattcagtataaagaggagtttaaattaagaattctaaagtgctgggactcaaaaatccgacattttaaggttctactaagtaggaggattggaagccccacagtagtctggagggatcatctataagagatacttcggttgctgagttaagtacagtattcatcagttggactggaagccgcacttccattgtgataccatgtgcgttgttacatcaaatgatgacacacaagtcattgaaggctggctgaaaaattaaaaaccataaaaaacatgggggtaagtgatcatcttcaaagatgtgtccctagacaggatgatggagtttatgttggactgggaaggaataatcttcaatatctgctatgtacagagcactgtactggcttatattacatattttatatatatacgtatatataatatatacatacaatattagccacctacccattatctcaggtttttcacagcttgtgtacctatatggtccaaagatttggaaaccctaagggaaaagcaagtctgaggaaggtactaatgcatcgagtatatctgtacacactggaagactgggggcgtctggagtaagagggaggtgattatctaggtaaggcacagagcagagttgtccatgtggaccgacacagtggaccacacattgtcctaataacatctgagctctgggtggctttggagaggaaaagctggtgatccctcatagagtggcaatcccagggtctggacggcagcatcacctggcctccgagagcttggattcccctccccacatgagacactgcatccccttcccgacagcagggattgtgtgaactttctcctctagtgcccagctatatatagtagtagcatatatatatagtagtaatctttgctgaattgggcagattaggagggtagtgagcatagaaatgtaagttcttcccacttttaaagtattcctccattaattcttgtgtaacgttattaaaaatgtttaaaagatgagagagctttggagtaaaatagctttggcacaaaagtatgacacatgcacagtgcacctctagaaggtggaacgtgcctgtctcaaggggttggaattccttttgggtatctgatgggtgaagtctgtgatgcctttagttatctttagagaaatccaaaacattggctgttgaatggaataaaaaactgagatgaatgcatagatttaacttttttagacaagtgggcatctatttcctttcactgctaatgtattaccaaattaaatttttaggtctatatataaagctcagccctggcttgatgtgcacagtcttgatgttcttgatgttgtaattataatgttaaaagtaattgcttaaacttggtttttaggttaccatagtttttgcttcaaatgtagtcttgcagagtctgaagaagaacaaagatgggaatctccctgaaccagggaaagcttagtttcaatgagagaagacagcagaactctcaggacactacaaggaaacccagagtaaggaaagcatcatgaccttcctaagattggcgggtcaaatggagagtgacagaacctaagtccttagagtatttatggatacacacctcgctttgggccactctttagcaatatggcttcatagtctgaggtgcaagagatccagctttgtcctaaaacagtgtatgttggaaccttagctgcagcctcagaatacctgcaagtggttggaaattacacagccttgggatatccaaaaacttggtttcaaaccatcacacacaaccatgtaattctgggttcctgcagccaaaagcaggggaaattgatgttcttcagccagaagtagtattctggatagaggtgctgtgcgcatgctagccttataaatatcctcaactgtcaccttatctacttctagacatgcctcaatctggaaagttttacagttgtgctgtcctagaagcaaagtgtccaacttaaggtatttgttgattgatatttttgacagttttatggaaatttgttctgagattccgtgtccagtgttgagtaagcaattacaaaattatgaagatgtcagtgccaaaaaaattatttatttgatattcttggatgctcatatccaaaaccaccagctgctgcaacttgcaaagaggcattcaacaagctccaaggtcctgcgcccaacagtttctcactgtggcagcagctcataacgacccctgttcttttgagctaattgcatttatctgccttttggttgaaacttacattcagaactaacaatgaaaatggcttatttttgatgacctgagcatattagaaaacctctcatgtattagaacattttaagagtaatgctatcaagatagaactcttaccttgcaagcagtttagtttgcatttttggcagcctgtgatagaatcttgtgggtcccagaaaggaattcacaggagactctagtttacctgtcctcagggaaagaaaattctcggctaagacttcagatatttggcctgcagagagttcccacagggttgcctttagtccagaggaaaatgatgagcacaagtgttttcatgaaagttgtcccatttgatctcactgcaggcctagccagggtggacgctagaatcctgaatttacacacaagagcaccaaggatcggaggagaaaggtgtttacccaaatccgttatctcccgggggtacaagctcaaggctcctgacttgtggtccagaattctgtactgtctgtccagcatggcaggttggaacacgaaatgaaggattcaagacacttcattgctctttgtctctcagtttcacacaaattaactggcttctggtttcagcatcacagaaccttttgacaactcttgaaatcaatcacaaattgtcttctttgttcctgtgctgtgtgttcccactgtggactgaatgtggtacgtacaatgcagatacccactcgcgtgtgagtagatgtcccctgtatgcgcgacccttggcatctgctgcagggagcccattaacttcaccctgcggggtgatgagaacattgggaaggttattttggaagaagatttaaactcacataaatgtcatatttgacttgggtctagcaaaatacacacacgaaggtacttacgaagtagttaagttgttgaaaatttaggcagcagaattttgggactctgtttaggtaggatctaacgaaactcatgccctagtgtttctggatggccctgcatttctccctagacttacggagcagttggccattacccagtctccactagacaccccccctgcctcttccaagaggaactaccatacttggtaccctggctgtatcttatgtggcagaaagtatgagatgagctagggaactttttattctcaggaggctgggaagttgcaggagaatgaatgagtggtgggaactgagtcaagggtgaaatgcaggcattgtgaccatgagggctccatgaaggaagactgtcagaccaagcttgtgtccttcctcctcgtcccagcagcacagggactgggagagatactagcaggaggcaccacaagggcaggagtgagactccaggaccactgtgctgcaagcactgttccttaagatgacttcccattgcttgaagaacttcagttggacgcctctttgccctagaagagttgagtttaaacaaatacctattcacttaaacacctgttaggggtcaactttggataatgtaccaaatgcagagaagcctgttactgccgagaataaagcatccctctcagaagtcagctggtccttcccagatacgtgaaaacaagactttgtttctggagtaattgaagaaatcaaccgttaaaccttgctcttaaatctccgtcagagattcatagcccctttcatgtttcctctgagtaggcaatcagtgttaatgaaatgtgatttcaggttttatggctgagtcaggaaattcaaagttatggtttccacgctgatggttatcccaccaccacctgtgcagctgtaggaatccaggttttagtatgggcaagaacagcctcctgggcacaagaaggttgtaaaggttactttgagaacaaaggccttgatttgcagacacttgttcctgagtgatggtcttaaaaacaaagcataaagtgcccctaataagaaggttagtggtgactcaagctgacagaaagtgaaaggatttaactacaatccctgaggggtagacttacacatttttgagtcacctttgcatttaccttgagaggctctgcgtgaggtggttggcttgtgctttgcagacatcctgctttgtatgcagcatagacttcgagcaggagacttagcaaccagacttccagctcagctcttccaacttcagcacacagcatttgcagtgtgtgcgtgtgtgtgtgcgtgtgtgtgtgcacttttcttgccaaagatttgctcatgcacaaattacagaatacagcgttatggtgtctttttcatatttcataccactaggtttctagaactcattaaatttataatctgacctcagacctgcaggagagaataagataaggcaatctggtgttgtccaagcttacaaagtttcatctatttaaattgttaaaaaattttcttattttcatggtgacaattgtcacatcataatttacctctgtcatccaacattttcaggaagtgaaaaattgcatgttaattttttagaaaactgatatttactccttgaaaaactgaaacaagctttttgattgaaaaatgttcatatgtattgaactctcttctacctttaatcccaaatagctgggattacaggcgcctgccaccacacccagctaattttttccatttttagtagagacagggtttcactgtgttggccagactggtcttgaactcctggcctcaactgttccgcccaccttggcctcccaaagtgctgggattacaggcctgagccaccgcgcccggccaagtaatgcagattgtgtgtgcaccaaacatgtcccatttagtagcaccccataatgaagcacattcatctttccggggcaaagcgtctgaatgttcatgttcagtggagtaggtaatgactataaacatatacaactccgtttaggttggttttgtccccaaatgcatcacgaagaaacttctagcttcctctgaattttttattttggaattgaaaaggagtttgtggatctatgtttttgttctcattttgaagatgaggaatcagattcacagaggttaagtgacttgatcaagggacaatgacagaagcttgctctgatgccagagctggtgtctcagcatctgtccactgtcagtatgtgctgtcatcctcagggactgggatgacaacactatctagaatattcttttggttccctgttttgtattgtctcccacatactacttccatatgttctctgcatcttttctaatcggtcattgaaaattactttttcactatgcccaataaaaaaatccatacttctttaaaaaaaaaaaaaaacaaagtaaggcatgggctttgatacagaccgtgtgtccttggccctgcgaaacttggtttttaatttgatgctatatgtgactcatctaatctttagatgagaggcattgttaaaagctgactgggcacggtggctcacgcctgtaatcccatcactttgggaggccaaggtgggtggatcacctgaggtcaagagttcaagaccagcctggccaacatggtgaaacccggtctgtactaaaaatacaaaaaattagccaggcatggtggcgggcgtctgtaatcccagctacttgggatgctgaggcaggagaatcacttgaacccaggagatggaggttgcagtgagccaagattgcgccattgcactccagcctgggcaacaagagcaagactctgtctcaaaaaaaaaaaaaagctgtgtgtgtgtgtgtagagagagatatatatatatagagatatatatatatatagataattttattttatttttattatttgctttttgagatgcagtctctctctcttgcccctgctggagtacagtggtgccatctcagctcactgcaacctccaactcttgggttcaagcgactctcctgcctcagcctcccaagtagctgggactacagacaggcactaccacgcccagctaatttttgtactattagtagagacgaggttttgccacattggccagactggtctcgaactcctgacctcaggtgatatgcctgcctcggcctcccaaagtgctgggattacaggcatgagccactgcacccagcaactgtatatttcaatggtaatgaaaacatcaacaaaaaacatgcagcatcaaaaatatctttaaaattttctgattggagacgtctcaatccatgttttattttttttctcctccaaacttagatcaatgagacagaaaattaacaacgatattcaggacttgaactcagctctggaccaagcggacctaatagacatctacagaactctccaccccaaatcaacagaatatacattcttctcagcaccacatcacacttattctaaaattgaccacataattggaagtaaaacactccttggcaaatgcaaaagaacggaaatcataaacagtttctcagaccacagtgcaatcaaattagaactcaggattaagaaactcactcaaaagcacacaactacatggaaactgaacaacctgctcctgaatgactactgggtaaataatgaaattaaggcagaaataaataagttcttcaaaaccaatgagaacaaagacaacataccagaatcttggggacacagctaaagcagtgtttgaagggaaatttatagcactaaatgcccacaggagaaagcagcaaagatctaaaatcgataccataacatcacacttaaaagaactagagaagcaagagcaaacaaattcaaaagctagcagaagacaagaaataactaagatcagagcagaactgaaggagatagaaacacaaaaaacccttcaaaaaagcaatgaatccaggagctggtttcttgaaaagatcaacaaaatagatagaccgctagccagactaataaagaagaaaagagagaagaatcaaatagacacaataaaaaatgatgaaggggatgtcaccactgatcccacagaaatacaaactaccatcagagaatactataaacacctctatgcaaataaactagaaaatctagaagaaatggataaactcctggacacatacaccctcccaagacaaaccaggaagaagttgaatccctgaatagaccaataacaagttctgaaattgaggccaggacaatatggattcacagctgaattctaccagagatacaaagaggagctggtactattccttctgaaactattccaaacaatagaaaaagagggactcctcctccctaactcattttatgaggccagcatcatcctgataccaaaacctggcagagacacaacaaaaaaaagaaaatttgaggccaatatccctgatgaacatcgatgtgaaaatcctcaataaaatgtggttagctttttaaaacataaacaattttgtgataattttttttttagaaacatggtgctttttgttctggcctggtttctttcctttccttttctttctttttttttttttcttcttaaaaacaagtactttgtaacatgtacattcttgtatgatagatgggccacaagggaagcttctccttgattacttttgtgtgttttgattcatgaccccataaaggcccaaccatggtggttaaacaattgtttacagtcatgttaaagttacactaagataacaggaggccccgttcacagaatagattgatgggcttcaaggcaaaggacacaggttgcttgaaatcttgattgccacaattctgggtgcacaaagccattttaatctgttgctcaagtctgagggcagtctgattatgtggcctgagggctcagtgtcacatacatgtattaaagaaggctgactctctccccattgccaagaacttagggaattcagagagatgactgtagagttttaattaagatctcatcacagaacttggaccagttaagttactgtctgaattgctttcctgtgaaaaacaagggctgccagagccactgcaggattcatagctatttagatgagtgcataattggctccctagaggagaattgggcagctatgagtgttttaagtgagatcatcttttcgggacgttgcaaaactataatcctattcatctgtagttcctgagaaatctttcctgaaacctccactgtccagggaggtatgattgatgtaagaatggaaagttgaccccttgctccttccatccttgctttggacataacaatagcatgcaatgccagtggcgggcacagaggcagtaataagcatgaggtcttccctcgattccttcctcttaagctaagactgaattcttagtgaatatttgttcttggaaccattactcgactaatatgtataaaagttgtcatataaaatgtgataacgatcaaacagattggttagaaaagttgcacaactttttacaatgcagattgggggcagataaagttttttaaaaggcaaattctgtttttactgtaatgctttctaagaaagaccatattttaatgtctaggtaaatacacaaaccatcagatgtgtatggccacccgtattaaagtcaagcattaggtccaggtgtctggcttgggcagctgaatggctggcagtgtcatactctgagataagtgaggtgtggggaatggcatttaccatgagacatacacatgaaaggtctcggaggaaagtgaaaattaagtctggagccatgagaagaacgtctaggcagaggtgatagttgtcagtatctccatagaaatactgccgtggggatgaaggagatggcctcacagtatgtagtgaggggaggaaaggcttggacagaatcccgagaattaagataggcagatctaagagaagagaaaacagagctaaaataattgggccacgggctgtagtcaccagcctataagatggctgctaggccgggtgcggtgtaatcctagcactttttgggaggccgaggcggccgagccacctgagggcaggagtttgagaccagcctggccaacatggcgaaaacccacctctactaaaaatacaaaaattagctgggcgtggtggcgagcgcctataatcccagctacttgggaggctgaggcagcagaatcacttgaacccaggaggcggaggttgcagtgagccgccatcaggcta

SEQ ID NO: 369 - DNA, 22940 bp, Homo sapiens
ccggtaatcccagcactttgggaggccgaggtgggcagatcacgaggtcaggagttcaagaccagcctggccaatatagtgaaaccccatctctactaaaaatatgaaaaattagctgggcatggtagcacatgcttgcagtcccagttacttgggaggctgagggaggagaattgtttgaacccaggaggcagaggttacagtgagctgagatcacgccactgcactccagcctgggtgatacagcaagactctgtctcaaaaaaaaaataataaaaataaagataaatttatatatatatatttttttctgggtctgcctctcatgtggcctactgtgctgtcactcactcccagcatcaaatagagtgacctcacatgtgcccaaagcacccagattttggtctcaaatgcagttccccagtaaaaggaattttggtctcaaatgcagttccccagtaaaaggaacgagggttccttgaaaagtatctgagcaaggataatttacatcctagagcaaggataattaagatgggtctgaagcatcaatttgctgccagaaagaaagtatgcttccaaaactatccagagcagttttaaaggctaaagaagtcggcttaaagggactctcaatcagcaaagtatgatggttttcgcatttgaaagaaagcaatagttctctgcagagccgtatgaggcatgttaaaggaaacaaaaagaaagagaaaagaaataaagaagaagaaaggcatgtacaatattttaatgatgtttacagttgattgaccaagctgaactacacgcatactatattcaagtactcaagttttggtcaacttcacaatttcattattgcaaatcaagcagttaaaagattcattgcaatcctagtagggggtccagaatcttaacagctctactcaggcaaagaaaatttatggaggatcctactataacagaaaagataaatagtcttggatagtctaattctgcccacagatacccagcctaatagagcccagcttatgatgaatctcctggaagcctttctggccccctgtcctgcgcacgaggaccccccagcagctcagcttactgcacctcagcatgaagcggcctgagatgatggctctgtgaccttgggttaggagagtatgtctgtaaccccaggaagaataaaagaatctattcaaattttccattgatacatttatgctggttagtttatctgtaataaggagttctgtaatcattccaccatttcatatgtacttcagttttaagatgtttgaaacagttaagagaatctggcctggcacggtggctcacacctgtaatcccagcactttgggaggctgaggcaggtggatcacttgagcccaggagtccgagaccagcctgagcaacatggtgaaaccccgtctctaccaaaaaaacagaacaaaacaaaacagaacaatttagctgggtatggtagcaggtgtctgtagtcaggaggctgaagtggaggatccctggagcctaggaggtcaaggctgtagtgagctgtcttagtgccaactgcactctagcctaggtgacaaagcaagaccctgcctcaaaaaaaaaaaaaaagagagagagagagagaatcttaactgttacatttctgtgtctatttttttttttttttttggatttttgagagttgctttaaggcttaggaagattttacttattaaatttgaaacactactttctgtgggagacttgatggctagttttatgtgtcaacttgactgggccaagagacacccaaatatttggttaaacattctgagcatgactgtgagggtgttttggatgaggttaacatttgaattggtggactgtgcaaagcaggttgccttccccagtgtaggtgcacctcctccagtccattgaaggccagaatagaaccaaaggcacagtgagaaggaattctcctgctctgcctgactgtcttagaactgggacatcagtcttctcctgccttctgactcagcctcagccttggctctcctgcctttttagcactttggactcagactggaactacaccatcagccctcttgggtttccagcttgccagctgcaaatcttgagtcttctcagtgtccataattgcatgagccaattccttataatgtctctttaaataaacatttgcacgcacacacacacactcacacacacacacccgtgtgcatgcacacatattctactggttctgtttctctggagaaccctgactaatacagcaggttaacatatttaagagaatcagctaaattaaatttgaaagtgtggtttgaaatgtctaaggaaatttgatcaattaagtacagaagtggtacagtataattaagaaagatttaatctgtaaaccctaggaattaactgaatgttaatcaaagacaagtagaaaaaaatctcattttttatacaaaaattactggacttattaataagatgacaatatttgtaaattggcactttaggtttaagagacatagggtattcaaacttactgctttaatacagtactgaaaatgttagtaactcttaagtattccttttatgtccaaaagccccccaagaaattttttaaacccatcttatgctgtgtcaaccatggtttcctgggggcttatccatgtattcatttcctgtttatcccctaatctagccccggtcactcacccttgcaggcctcccagggccgtttcactgtgactttggcaggcttggtccatcatcagtaaacccccgccccacctcctctcgtttgcttgctctccgcaaagcttggctgtctttgctgaggacaccacagccctctccagtgaagtcactttcttccccatattcccctgaaatcagggcagaatgcatgttcccttttctccccacagccatttcctcctatacataccccagctcctttgaaacgcatgccaccagaccattccagtaccccccatccttgctgctatctaccagcttcctggttgcttcctctcattcttgaattgtttcagtgctgtggtgtgatccctgatctttaccactccccctttccccagtggccaatgccactgaaagaatagtttattacttgcagttcctgagaggagggaggcacaccatgccacacagagccacccacctggggaaacaccaggtcagtcaggagggaggcagaaggagccaggggaaggcatggcccagaggcttcattgtggttttttgaaggaataggcaaggcagggtagtcacactgaagcaagcgtaggattgggtagttaagatgctttcagtgggctgtggaggataggggtattctccagttgtccagtacctaatcctggggatatttagagccaggagaatactgacttggagtgtgaaaagtaaataaaagaggtggttggggtatgggctgtggattggttggtttgcatatgaaaggcgtgctcatgggagagtcattcgccatcactaggaaccagtgccctgggaggggcagtctttccaggattagtaaggcctcccagatgtcaaagcttcataaaatatagaaaataaaaatgattaatataccccctaacttttaatcatcttctcttccacctcaccgcagctcccgcagacatgcccttgaccttgtcatcaccaaatggataccacctctgaaaggtccatttcaagactcccacccaccctgtactcacctccttatacttctacctggcttactatggtgaccccattagaacattccttatgttccaccaggccaatgatctcgctatctcttccttctgcaaagtgtctaggaacaaagtgcttaggagcagcacagggcacatggtgtgtaacatttaggtgttaagtaaaatagacaccccacaggccctcactgtcctccctgctggctgagagttcatggtccatcactatgtcatcacttctttgcaaacaccctcaccaaccttgcccctttctctccactttgtacttgactggcaaacccagctctaattaaacccaactatccatctatttattcttgtacctgagcatcccaacattgttggaaagaatcacacaaccatactaacttgtctcaccaacgttgtggttttgtcccagatcccaaatgggcactcaacggtacacaacaatcatttcattttcctggtagaaaggtctttcttttcctcacctagaaatgtacatctcttctgctttcttcaaaccttcaccactccctccctactctgtccccactgcactttcacctgatgacctcactccatagatcactgggaaaaagaagcagcatccaataaggacaacctctcttcccagcacgacttcaccagcctgggcccattgaccatagcttccctcccgttacagtgaggaagtgctcctgacccccctcctcctccctaccccggacccatcccctcttacctacccatggagaaccttcctgcagtggtccctctctctggcaacaaacaaaacaaacgaagccctccttgcaccccatgtgcaccttgaaccatcaccccatctttactcctcttcacagccagaagagtggtccatattcctcactgcccattctctcttcaaccattcgaacattcctgctcacctcacagatcagctctcatctaggtcaccagtgacctgccattgccattagaataacatgcaaggacctcactccagcttacaagactgtggcagtccagcccctgcccacctccccaaagtcccctcccaccttcccctcaggcttccctctcatccagccacactggactttctgccccctgggcccacaatcccattcctgcccttgggccttggacctggccatttcctctgctgaggacattttccacacatacagccctctcatgcttcccctcactcaggtttcagcatagacatacccttttcggagaggccttcccttaccaccttagctaagaaccccctaccctacctttttttttttttttaactctggtaagataagtctttatccctgccaggcacagtggctcacacctgtaattccagcactttggaaggccgaggcaggcgggtcacctgaggtcaggagttcaagaccaacctggccaacatggtgaaaccctgtctttactaacaatacaaaaattagccaggtgtggtgatgctcacctgtaatcccagctacttgggaggctgaggtaggagaatcgcttgaacctgggaggtggaaacttcagtgagccaagatcgcaccactgcactccagcctgggtaacagcgtgagaccctgtctcaaaaaaaaaaaaaaaagataagactttatccctaaagtaaaatatcttattttcttatgtttgcaagtgctgaataaatacaaaatataaaataaacgaatgagcaaacacttacgggaagtttggccaaacccacaagtagcagagaggagggggcaagaagtcagactccagctagcagagccagggcctgtgtgtgggttctgccgctaagatgcctggctggctggcagcccaggagcaccatttatgggcacaattgtgggcccaattcacaacccccgcagtgcactcctgggtgttgtccccagccagggccacctggcagggggaagacgggctccacagcaggagcagaccacagccagccccagacctagagtaggacattcctgaaaaggagaatcccagcagaggaggagaagggacaagagatctgtcacagccattcctgaatcccgacaaacagcagcagctcagtgctgcctcccacccagctggcagccgggcagccgggcagcctgtgctgacggggctggacatttgcaacactctggcctcacctagagggttgtaaggaggttttggaaccatataagcttcagctctgagagcctgcctcctaaacctaaagtcacccaaggtgcttccctctggggccttgcccgttttgttgtggctgcttctttctcaatgccatccacttctgcactcaggagaggatctggctgagagctgggattggaccaactctcacctcaccagtctctacaggaaaagcactccaacctgcccctttgaccacccataaattccaaagagtcttctagagttcagatacccgggaaccaccctgtggagaagtggccgttacctcctttgtggccctaccagagggaagaggggaggactctttgctcccaggggttcatgtgtctgctttaatgatcagggagctacggaggactgtgactttttcttatcggtgttttgcccccatcacttggcacagggtaggagctgaatgaataagtgtaagaacacataagtgggagcatttcagatattcagaaagcgatgaaggaggagctgttggagatggttgtacctgcaagcacgggatgcagatgaccacacactctgactgggaagcccagcttcaggcaaaacacctgcctaccccatgggttctcactcctgactcctgaaaaataactctcccaggtgcttcagttgaacggttgataaatgttctatcagctctgcggtaggattggccaacctacatatatatgcattttttaaattgagattaaatgcacattacttaaaatttaccattttaaccattgtaaagggtaaaaatttacgggttttagtctattcaccatgttgtgcaaccatcactactatctaatacacaaacatttcatcactgcaaaaagaagccccgtacctgttagcagtcactcccatttaccccctccctcatcccttagcaaccactaacctgctctctgtctcagtggatttgcctattccggacattttatataaatggaatgatacagtctttgtccttttgtgtctagcgtctttcacttagcataatgtttgtaaggtcatccatgttgtagcatggctcagtatttattcttttttatgactaactaatattccgttgcatgaactatgccataatttgtttatccattcatcagttgatgaacattttgatttctacattttcactagtgtaaatagcattgctatgaacatttaggtacaagtatttgtttgagtgcctgttttcaattattttgggtatatttctaggagtggatagctgattcatatggtaattctaagtttaactttttaaaaaaattactatttttttttagaaaacagggtctcactatgttccccaggctggcctcgaactcttggcctcaagcaatccacctcggccttctaagtagctgggactacaggcacaagccactgagcctagcttagcttaaggttaactttttgaggaagctctaaactgttttctacagtggctgcaccattttacattcccaccagcaatgtatgagggtttcagtttctccacatcctctccaacatatattattttctaggttttctttttccttatagaaatccagtggttgtgaataatatctcattgtggtgatttgcatttccctagccgctctgtgatcagccctagtgactgatactagtgagcacatttttatatgctttttggcatatatttgtatatattttttgagaaatgtctactcaagtcatttgcccatttattaattggcttgttgagttgctaagagttctttatatattctggatactacacccttatcagatctatgatttgtaaatattttctcctattgtggattgtctttccacttttcttgatagtatttttcatgcacaaaagtttttcattttgatggagtccaactggccagcctactttaaaaaatttttttaaactttttattatggaaatttccaaacacacacaaaagtagagcatggtatgatgaagatccctgaacctgtcatgcagcttcacaataactaacactttgtcaatgttgtttcatctgtgcccctgtttttttgttgttgttgttgtttggatttggtttcgttggaatattttgaatcaaatagtagacattgtgtcatttcacctgtaaacacttcagtatgcatctctagtaagaattttttggtttatataaactccatgtcatcatcccatctgatgaaataagcaataattcattaatatcatctaatattcaaatccaaattcaaatttctccaagatgccttttgtttgtttgtttgttcctttgtttgtttgagacagagtctcacttagccacccaggctggagtgcagtggcacaatctcggcttactgcaaccaccatctcccaggttttagcgattctcccgtctcagcctcctgaatagctaggattataggcgtgtgccaccatgcctggctaatttttgtattttagtagagacggagtttcaccatgttggccaggctggtcttgaactcctgacctcaggtgatctgccctccttggcctcccaaagtgccaggattacaggcgtaagccaccgcgcccagcccaaggtgtcttttttacagttagtttatttggttcaggatcccaataaaagtcacatattgcatttaactgcaatgactctcaagtctcttttcttttgagtccccctccttccctgtttatgccattgatttgttggataaaccacgtcatttgccctgtagaatgtcccacattctggctttggctgaggtcacattgcactatttacatacaaacaactgagcagccaaaattgggggggggggctcagaaacagaacagactttaataataatagctaatggctaggcggcacaaaccgtgaggcacaggttacatatacaccaactcattttatcacacagctagtaaggggtggagcccggctttaaccctaggcagtctgttttcaccctctgtaaaggattgggcatggctgtgttccaagaaaactttatttacaaaagcaggtggagagctggatttggtgcacagattagatgatccctcatctacctcacagagcagctggaaaggagaaatgacagatggcacgctgctctgtggactgtacagtgtgaagcacctgggaggagcttggggggcagcgaacatggtaataaacataaagctcagagctccccgccaagggtgagcgcttccagacggagaagtacacgggccggccagtcagatgggcatgggttctgatgggggccctgccataggccgcctggtgacccacgcggggctgccgttccttcgggggttcaacggcatgatcaaagacaccgggatgtgtgtgtgtgtgtgtgtgtgtgtgtgtgatgatcaaagacaccggggtgggtgtgtgtgtgtgtgtgtgtcatgatcaaagacaccagggtatgtgtgtgtgtgtgtgtgtgtgtggcatgatcaaagacaccggggtgtgtgtgtgtgtgtgtgtggcatgatcaaagacaccggggtgtgtgtgtgtgtgtgtgtgtgtgacggagtctcgctctgtcgcccaggttggagtgcagtggcgtattctcggctcactgcaacctctgcctcccaggttcaagcgattctcctgcctcagcctccccagcagctggggactacaggcgtgcgccaccacgcccagctaatttttgtattaatcaaagacgcatttcaacgcagaggaggaagtgctagcggacccaccccaaggtgcacagttagagaaggagcctctgcggcggccggagccccccacggacatccccttgaggcccccccagccacacccccaagagtcccgcccccagacccgtcgagcgagctcccctccctgaaatcctcgccccgagatctccggccggcgagctccgccccctgaagtccccatcccaagatccggggccggcgagctccgcctcccgaagtccccgcccccagatccccggccggcgtgctttgcggccgccctgccgcgcgcacatgtaggcgttccgagcggcggcggaggtgagcgcacggacgagcgggagggacccttctccggcctgatgcgacccggtaacgcgttcagactgcggagtagcctaggggcccagagtggaagcgtagcgaggacccctctgcggggctcctgcagcccctcctcccccagccaccggcgggctgcatggtactgtgttctaggcccaccccgcagcgcgatggccctagggacgttggactttggtccagacctttcctttcttagcctcactttccgcattgggaaaaaaaaaaagcccgaatgataatgattcttataggagttcttgattaagataggccaagcggtaccctgcgtttttgtttgcggcaactcattcgttgctcattaagcacttttcacggacaggaatacagtaagtttcaatcaaagtgaaataattgtgaatttttactgacgtattcacggatgaagtgataggatgcccggggatgtttcaaaataaaccagttggacggaagtgtggtggaaagagaaatcaaacaagattggccatgagttgatgggattgaagttgatggatgtactattttgtctactttggtatatgcttgtaatttggcataacaagttttctaaaacaaaaagtttgctgtggacacctgactatgcctgtgttagcttgctagagctgccatgccgaagtaccggagactgggtggcccaaccagcagaaatttgtcctctgggagttatggaggctggaagttcaagaccagggtgttaacagggttggtgtcttctgagacctcccttcttggcttgtaggtggtagccttttccctggatcctcacatgatcttcctgctgtgcctgtttgcatcctaatctcttcttataagtacaccagtcaaattggattaggatccatactgatggcctcattttatcttaattatctccttaaagaccctgtctccaaatacagccacagtctgaggtactgggggttaggacttaaatatatgaactggggaggaggaggagacacagtgcagcccataacactgtcacttcactagcttaggattttggccatttaagttttcacagctttgaaatagggttagctgtagtaattaggtcatggggttgtgagggttcaatcggtaagagtgctcagaactgagtctagcatatagtaagcactcaataaattgaacacgtttttccttataaattagtaatcatagggctttaccatgggatgagtggaatgaggcagttggagtgccgtgcccagcgatgggaataaaagtcattacagccattattataaggaatatctgctgctgtgccagacactaaatgttttatgtatgtttattcatgtgctcatcaccgccaccctagaggtgggccattacgacacacctgtttggcacatggggaaattgacgcacagagacggagctgggatttgaacacaggcactctggctctagagcccacactcttcaccactatgctgtgttactttggtttaaaaaggtggtgtggaccctggaggatgttcagtctgcaggctgacccagggaaactggctgacttctctttttcttggcccagattgtccgcagtgactacactcatggcaggtcccctgtggcggaccgcagcatttgtgcagagacacaggacaggcctcttggtgggttcctgtgcaggcctgtttggagttccaatctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccaacctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgcacggcctccctctctgcagcctatgcctgtggtggagtggagttctatgagaagcttctgtcgggcaacctggccctgcgcagtctcttgggcaaagacggggagaagctgtatacacccagcgggaacatcgtccccagacacttgttccgaatcaaacatttaccctacaccacccgccgggactctgtgctgcagatgtggagggggatgctcaatccgggccgctcctgatgggctcatcacaaggacacttccagcttgtgcagacaccaccctgccattgagtctggagggccctgttggagcctttggacctatagctcacggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgcaagattgtagagttgggtaaggtcatgaacataagggcctggcacaaagggtgcactgtaaataaacagacatccctccttcttggtcgttttttttttttttttgagagcatctcactctgttgcccgggatggactgcagtggtgaccatagctcactgcagcctcaaactcctgggctcaagtgatccaccctcctcaggctctcaaagtgctggaattacaggcgtgagccacctcgcccagcctccttcttggtcttgagtgccaccaggctgtgggagtcagggcacacctcaacaccagggtactagcagttatgtgaacactttcctacagtgaagaaccacccctcaatttaagtggtggtcaaatcccaattttcctccactctgttagaggttaaaagactagagagcccaagatgagaagttagtgtggtcctgagaggctgttttaaggtgagggggccttaagagtgttgtgtcagtcaaggtcccgtggatgcagatggcacactcagggagaaggagaccagcacgtgccaggagagtccctggacctgaggggaggggaggtgttccagaactccgagatctgtggcatgggagacttggcaagagcttcactcaaatgtagaggaaggaacaaaccattgtaagaccgaggccctgcagggagggagcccactggcgccatccagagctgtcagcctccccaggcacagcgtggccagggcttggagaggagaggcagcaaggtgggggtaagcttggctcgtaggggtcagcaaggagagcagaggggtggaggtgggcagtgggttaggcctggtcccactcaggacccaggggagactgcagccctgccctgcttatttcccttgagccctccggtggtggatggagccgggcccctgggttagatccttggacaggaccacagcagggcaaggtgaggagagttgtgatcagggagccagacccaatttggcttcatgacatcttttagttggagatgaggttttccctgggaaagtatttgaacacagtggtggcaggtcctggcagtagacctggagaggagagtgagccagtggggctgcagaatgcagtgggaatggcacacctccctgctgggcccctcactgtgggctggagctcagtgtgctgggccagctcacgggtcctcacactggacctgaacaggctgagttcctgagggcagcacatccttgctcattccccaggccctggtacctaggacggcactgggcacgggcttggaatacataggtggatagatgaggcagtggctgggtgaaccagtcttcactcagggacacaccatttcatggggccccttggggtgtcacccacctgctgctgctgtacttaaagggccacaaggccatgtgaggccacctcattcctgagcagtacggtctggggcctggatttgatgggctccactttctcaccactcccacccccaacccatctgctctcagtactgcaggagccatgatggtttcaggcattcctgctgatctgcccgaaccattagcgaaggcagcctcacgatggggagaaaaggctgcttactcagctccctctgctccaagtcacagaccttgtctccactcacaggctgttcccagtcctcacacaagccttacatgctaccctccaaccttggcgcacacatcctccagccgtgtgtatgtgtgtgcgtgtgtgtgcgcgtgcattgctccgccttgctgcactgttcgcatcctccagtcctccacagcccggctcaggccacctcaggccctcccactgagagcccccctggcaggttggctgagctccgtgtcccttcttccccctcccaccctcccactgcatgactcacccagcacccagccttggtgctttccctcccagtagctctcggctccatccccttttcttcatctccactgggcctcctgactcttctcccagttctcccagctcctggaagtgcaggtttgactgggtgactctcctgcctaaagccctttagagacatccccatgctttctggcgaaaaccgcatctcctgcccatccgtgtcccactttcccttgctctggatcctagcctcactgcagtttggttcctgaactgctctcccctcctgcccacacagctttcgtgttcgctgtgtccttgatctgggctgcggtctcacagcctgcccggtgctcagttatttagtgttcctcctgctggaatgcccaggggaaactgttcactcacacgttgcttctcccagggaagcctccctgtctcacgtcagatgcccgtttatacactgtcatacacccaatacctcttcctcgccctactgctgactaattaagttaccgtggagctagcggcttagcatctcctccactgaaatgtaaaatctgcagtggcaggatcgtgtatcttgtttacagctctaaattgaggctctccataatatttattttttgcagtttcagtaactagaaacaatattttttcataaatgaacagggctctaagctataacagacacagccccagcttcctaaaagcctctgagcaattacagcaaggctggttgcattccttgtatgcggccattctgaatcctatccgaccctgtcctgtttcccaccttgggacttgccaaggacagagcctggccctagtcatccatgattgctgacatcagtggggaaatcaggacacttctgggtcacttcctgtagggcacagattactacctagggcaccagggaccctggctttaggaagatttttttataatattgcgtccctacacacaggtcagaggttgatctcagaaaggtgaagaaacatgctctagggctttgtcgctaagttgggtggtaggcagctgccttgtaactgtcaccctgcacttttccttctcccatgcctgctgtgtgctggaatcattagcactctgtcctagatcccttgtgaacattgttctcctggcttaggcctcgcctctccccatcccaggttcatggttctgtgggtatgaacctgcaaggatgcccgacatcccagagcaaccaaaaacagacccaggacttggctgacttacagaaaactacaacacacaaagactccccctcctcagcccgcccccccccccctttgcaggcacacacacacacacacaaacacacacacacacatctggatacagccagaatacagggaggggagtctcagagtcatggcgctgatgctggctctgctcttcactgaccctcctagccctgctgcctcagtccccaccagtgtccacaatgcaaggttccactcagccttgcctggagctgggcgcgcacacacacacacaaacctgatccccatgtgtgtgtagatcacaggctgagttccagatcaatgcatgggtcctcacccggcgaggcctcctgcctgtctcctccccaccatgtccctatagtaacataatggggcctttattatcctccagacactgtgctaggtttttagagacattttctcatttattcccaattggggcatgtggttggtaatattattatttcaattttacaggaaagggaacatcacagaaaggtgaagaaatttgccctaaatcataaaactttgtaagtggcagaacaaggatttgaagctggcagtctggttccaggtatcgttcttaaaacactaaatttatactgtcctatttagcctgaaagtttcatggtgcagacttatactgtggactccatagcccttttcctcatgctgggttagaagtaactttttcaggctcactatttttattaggaaaaaatagtcactgagcagaacttccgaggagacccctccagctaactgaagagaaagggacaaccagcctaccatgtttagtgcagcagggggaacaggacggaagggcagggtgtcatggagctctaggaggcaccagctgaggaaaggggatctcaggaggtagggagagagcagagtgggcagccagctgtgggttcaaatcctggcctaccactttaacagggcgatctggaacaagtgacttctggtcctgagtttcctgtctgtaaaatgggtgcattcctatctatctttcaggattgttttgacgatgaaagtgaaagaaagtttgcaaaatgtggagcctggtgagggcatatagtaggctttaaaaaaaagattgattttctaaatgttagtgctcctaaatggcataaggtgttcaggtcttggagttgctgcccaaataccagcaatttccagagaactcgctgctgcctaatacagctttattttaaagcttttcaaagccccagttcagttagggcagttttcccagtggctatcagttggcatcttctggaaggtacttggcagcagctgaaagcagaggacacatgtggccttagggggaaacaccaggctggagaagagggcattagcgtggacggtggtcctttacacctactctacagggaatgtttttctttttctttctctctctttctttttttcttttctttttcttttgagaagagtcttactcagccttggcctcctggactcaatcaaccctcccacctcatccccctagtactgggaatacaggtgtgcaccaccatgcccagctaattttttttttctttgttgtagagatggggttttactatgttacccaggctggtcttgaacttctgttctcaagagatccacacacctcagcctcccaaagtgctgggattacaggcgtgagtcacttcacctggcccatactggtaattttaaaatactaaagcattaagtgttagtaaggttgtagtaaaattgatacaagcatatgcccttggtgacatttgtgttaggcagcttttaagatgaccctaatgatccctggtcctaatatttttggccctggttcataatccactccccttgctcctcttggttctaaacaatagaatacagatatacattgagggtatatcacctcagtgattagattacaacagattatgacttctgtcttgctaagaggcccttgtcttcttggcttcacatgttttatcttgaagcacgttgccatgttggagagacccacatggcgaggaactaaaggcagcctctgagcaaacagccagctaacagctggggcccttgggccacaaggcactgaatcctaccaagaaccgtgtgagcctggaatagaatccttccctactcaagctttcagatgagactgcatgtattaatccattctcatgctgctatgaagaaatacccaaaactgtgtgatttataaagaaaagaggtttaattaactcacagttccacatggctggggaggcctcaggaaacttacaatcatggcagaaagcaccttttcacagggcaacaggagagagaatgagtgtcagcagggaaaatggaagtagaaaatcatcagatctcttgagaactcactcgctatcatgagaacagcatggggaaaccatccccatgattcagttacctcctaccaggtccctcccgtgatacatagggattatgggattacaattcaagatgagatgtgggtggggacacaaagccaaatcatagcaccccagcctcagccagcaccttcactgcagccttgagagcccctggagcagagaagcagctaacctgtgcctggattcctgacccacagaaacaagaagacaataaatccatgttgtagtaagccatttggtgtggtaacttggtatgcagaaatagataactcatactctttattaactggcataatgtttttggaaagcaatttggcaaaacttgatacaatcataaaagtttatcttttgacccagtaatttcaaacctatgtatttcctagggctgtaaccccatagaaactgaatactacatgcccaaagaggtacataaaagcattagatataaatacaacaaaatgacaataatggaaatgttgaatagcagtgactttggaagtatccacttgttgaacattttcagccattaaaaagtataattatgaagactacagtagaagcatggggaaatactagttataaatatcaaatctttttttaaaaatgaggtacaatctgcatggtgattgcaataatgtaaacatggtaaaacctaggaggaaattcacaaaatgtaaagtagttgtgttataggggaattttaagtgattttatgaattcaaataataaggacttagcactatatatatttacggtcacgcatcacttaacgacagggatatgttctgagaaatgccttggaaggcaattccatctttgtgtgaacatcatagtgtacttacacaaacctggatggcacagcctcctacacacccaggctagatggtgtcacctttgctactgggccccaaacctgtaaagcacgttgttgtgctgaatactgtgggtagctgtaacgcaatggtgaggatttgtgtatcaaaacatagaaaagtaaaaatacagtagtattaatctcatgggacactgtcatatacgtggttcctcgccgactgaatgtcatcatgcagcgtgtgactgtgtgtaagcatgaaggcctactcagaggtaccctggacctccaccctctccctgcatcaaggtgacagattctggcatccctgcttctggccctgcattcttggggcatggccagccttctgtctgtcggttactgtggtgcccatgaaaatgtgccactcagacctgctgcggagcggatttgactgacagccccagctgctgtttctctccgtccacccatgctttgcctccacaggctgctttccaccagcgatggagcgtggggacagtactgctgcaagtggatcgtgggactcctccagtaggtgactgtggctcgagaactccccagtggcctgggcaagcctttctcagaactgctctgaagtctgaggcccatcctccccactcctccacagatgtcacacctgtactgtggtctgaaggatctccctgccttctatcccctccttctttgtccttcacaggcggttcccccaatatggctcttactcatgcaatcctgtctttgtgtctggttctcagaggacctccactaacacggttactcctcactcagtcaggtgcagtgtgaggtcctggggacacttgctgtgagtaccctcagccagctcagagttctaccgaagagactgacaagtacacctgcagtgacaacacgtgagttcagtgctgtgaagatgtgtgagggagcataggaggagggcagccaactcagctgggatgggaggtagtcagggaggacttcccaggagaggtgaccctgttgctgaaacccctacgagtgaatggaaggaagtcaacaacaataataccaaacacttatttaacacttattttgtgccaagtgctttacatataagaactcataaaatttccacaacaatcctattatccccatcttacaggtagggaaatcaaggcataaagaagtcgaatggcttctcaccagccagtgctgggcttgggaactgaacccaggcagtctggctctaatgcctgtgcccttaaccactccaccttcacttaggcaagtgaaactggccatgggaacagcctgtaccaagccaggaatgagacagtttatgtaggctttatcagggtccaaccaagagattgaaaccacactgtaatgtgaacagagagaatttaatataaaggattattattctataaggaatattattactattataacaacagagggttggagtgatgaggactggcttgtaagaagtccagagccacctggactcagagccaccctagctttggatttcttccagtctcagccccctagagcccttgctccccaaagagccttgctccccgctagaggtcaaaggtaagtcatagcaatggacccagactcttgttattacccatgacatggtttgaatctgtgtccccaaccaaatctcatgttgaattgtaatccccagtgttggaggtggggcctggtgggaggtgattggatcgtgggggtggcttctaatggtttagcactgtccccctggtgctgtctcatgagttctcacgaaatctggttatttaaaagtatgtggcactttccccttcgctctctccttcctgctccagtcgtgtaggacgtgcctgcttccccttcaccttccgccatgtttgtaagtttcccgaggcctccccagaagccgtcatgcttcctgtacagcctgtggaaccatgagccagttaaacctcttttatttataaatttacccagtctcaggtagttctttataacaatgcgagaatgaactaatacagcccacccctaccccatacctctcctaccctctccccagcaggctgtgaggacagggtgctcatgccaaaccctgaaagcattacaaaggctgcagggcctaagctggggcctgggcctgaggagcaaactgaggagcagagcccacgtggagagagggagggagccggcgtccacatgccacacggacggcagtgtcactgctctatcatcacatcctgcgtgtttatagacttcattgtcatcatcaaatgagacctgccagagtcttaaccccttgacgctggctcgctagttaagcgcggacagctcacagcctggctggaattatgctcgcttttacccatccgcatcaggtggacactttcagctcactggcttggttttccaagacctgaaatcaacgtcagtgttgaattttccctaattttatccacttgtgaaagaccaaagtcctagcccttttcccccacagcagggacaccctcactttcccaggtccctgggctggtccacttcagggttaagcacagcagattgggaaggcccttctggttccatagctgtgagcagctctgcaggcctgaagcatgcatgtctttgttgattttctgaggcaggaaggatctggaatcagagtcctggaagcctggagtccactgaggtgcccttgccggggggcaaatctgtgggcgcctctccaggcagcctctggcctcagagccagaccacccgggctaagatcccggctctgcaactcactgctgtgggcacgttcctgagcttctccgtgcctcagcttccctcatatgtaaatgggaataatgacagtgcccagcccctggggttggtttgagtgaatatttttaaagcaccttggacagtgcctggcacagagttaaagcctgaggaaacggagcatagtttccattcaccagtcattgcccaaggtgcagttgtcaagcagtgactgaattagagctggcccagggtgatacttttggagatgtctcaggtggcagggaggtgagtcagggttggcagcactgcctcacacaacattctcaagcacccagtacggttttattgatgttgctgacgcccctgccagctgggacctctgtaaggggcagcagtgggccacatccacctcttcttcccagtactggaccatgtcgctgttcaggaagtgtttgctggacacatgacctgtgtgagagaagggaagggagtgtggcgtgtggggaggccccagaggtcctgacgtgtcaaggtcagttcagcacacacttctctgggggccacatgggagaggctgctgcggcaaggcctgcagaccccagtcttgtcccctctggattaggctcctctgaaaggtccccatcacctggtgacattgctgtggcagcagctggaggctgccctcagccaccgatccccaggtccggagccacgtgcccacgtcctgacacctgattgtcctgtgctggtccctgcagatggcccagcctcgcagtctggactccacccctgcagaggaagcacaaccgatgtcacaggtgcaaagaccactcgggagctgggccacagcttcccatcctgtcccgtcagtgcctccctctcctaagcctggagacccttcacttcctctacctcctaac

SEQ ID NO: 370 - DNA, 284448 bp, Homo sapiens
ctggctgatttttttgtgtgtgtgtatttttaatagagatggggtttcaccacgttggccaggctggtctcaaactccagacctcaggtgataccccagcctcggcctcccaaagtgctgggattacaatcgtgagccaccgcgcctagccaatgaagtttattttcacgttgattcccaagtctaggtctcgaaaatgacatgtctcaagaccatagccactttggcactgtaaggccattgttcccccagcaatctgtgtgcagagatctaaggatgatggcccatacactgaggcctcttgagtttgtctttagtctccttttagattcttttataatagctttattgagacataatgcacatactgtgcaattcacatatttgaagtgtacgattcaatggtttttagtatatccaccatcactgcaatcaattttagaagattttcatcacctcataaaggaaatttcttttgttttatctcctggtatttctttatagttatagacagatggtaaagatggctgaaatgtgggtggggagcacaaaggggggtgaggaagttgcatagtaggaaagggagaagggtctgcactgtcctgcctgaaggaacttaccatagtgatgatgtgagctgttatgtgcactgagacgggagacccccagaccaatgcatcagtcacgtgaagatgggggcagcctcggccccagcagtacgaggagttcaccttgaccctttgaaaagcttaccaacccctgtcctgtgtgatcactattacagaggataaactagtcatatgggaaatgggtctcaatgtttcacagtttgagatgctgaacatccacaaatcctgtcaaatgacttcatggggattacagaaaatcctattcaataatttttaaaggtaactctatctagatattatttagtgaagattccttgccaggcaacatctgaatcacttaatgtgtactaactcatctgattctcaccacaatcttggcatgtaagcctgattgcttttcccatttgacaaatgggagaagctaaataacttgtcattgtactagagtgtatacaaggcagagccaagatttgaagccaggcaacgtggctccagcatccacatttctaaccactaaattttccatttcactagctttccattttgaacctagccactaacatatgcagccctcatctttgcaaataaagttttaaaatacggccttctgtagtaagtgacgctgcccaccagggggcaggactgccccacaatgctctcagtcactcccttcattcactacagtccctggcccactgaggttgtaaattgagctcaaacctttctgtgaaaatgcagggcaaagggcagaaagagggaaccactcaggggaaatggctcactggggacgtgtgtgcacagaagtcctctccgtgccatagcagaggacacaggctctggaatcccgtgggccaagttttcgcaacattctgtgctagttggctggatgcctctatacaaagaaattaaagcaaagagaaaagcagggggtaaaggggaccatagaagaaaaaattcttcatatttttctttgcctgtctcccgaccatagccaaatcactaaacttttctgaccctgaccttcatgatctgtaaaatggggatgggccagctgctatgtgacccctggagaagaaacgtcccgtcagcagggcccctcctgtcagggagaacctcagccgccttcaacagctcatttccaggcagctaaggtcacctcactcttcttgagcccttcagtgtggagctgccattgcagctctaacaagttaatcataagccacccctcatggcgccagggcgaggctgtttatagacttatcaactcatgacacacagggtggttcacgtgacttaagctttgagtcctatatcttggcccagatggcaggaaggatgctttgacccatgaccactctggtttgttcctgggttggacattccttgggctttcttcagtagagggaagcttgaatacataaaccatagctaacatgggaagtgcagacattgcgttctgcaagcagtaggcactcaaccaatgtctgctgtgctgtcctaatcggctgaatgtggcacaggaatccaggagagtcgatacggcctgggaaaccatgcagaatctccccaaggaggaggcacttctccatattcattctactctgacccaagcacgtggcagggcttgctctgttctttgcaaaagagacagtttgattgacattttcctcacctccatctttcctgctctaaaccacaagccagacagacagaaagacagctccattacttcagtgctgagccagtctccgcaaggagacagccttacgttgaccaggcagtgggctggcgggtgagtgacgagtgacaggtgtcaagtgtgaacctgcctaggtgctcctgaagcctgaccctggccttcttacacatccgtctggaggacattcccagtgaaaactgaatgcctgcaacttcatcagcctttaggggaaaaaaatgaagccacgttaacttataaaataataataaacttggaagttagacatagaggaaagtacacaaataataaggaaaaagctccattaattttcacagtgaatacacccaaatgaaaaaaaaaaaaaaaaaaaaaaaacagaacagcatcagtgcctcaaaagcccctctaatattccctcccaaacagcactgtctctttcctccccaagaactgccatcctgccctctactgccacaggttagttttgtctgattgtgatatccatataaatgaaatttgataataagtactctatgacaggtctggcttttttggcctgtggttatgtctaagtttcatccgtgttgttgagtgtagccactgataacacctagaccaccaggtctcaactcagtccttttaaagtgggccccaggtatctcagggcctcctcaagaggtgccttacatgtacttaagaataggtctgcctgaggcaccatgcaacaccaaaagatcacagtgcttctagtactatgggctgagtcaatcaggctgcagaaggcagggagagatgctgaaactcactgctccaacccaacccaagccacatctgttactgatttgagacctttcctcatttctagtgtaagcatttagtgctataaatttccctctcagcactacattagctgcatcccatggattgtgatatgttttattttctacagaattcattctgttctatgttttaaaaaaattatttttgagacttctttgatgggttatttagaagagtgttgtttaatttctaagtaatgagaaattgttaatcttattattattaaatttaacttttattccattatgatcagagaacatgctctggatgatatccattttttaaaatttgttgagatttttttcgtggctgagaacatgacctatcttggtgagtattccatgagtgcttaaaaaatgcataattctactattctgtggagcattctacataccaattagattctgttggttgcttgtgttgttcagttcttctgcatcctttctgacttgttgtctagtcatttgtcttagtctgtttgggctgctataacaagaatattatagaattataaaatgcaaacattttttctcacagttgtggcgggtgagaaggccaagatcaagatgtcagcagatttagtgtctggtgagggcccattcctcatagatggctccttctagctgtgtcttcacatagtggaagaggcaaacaagttcccttgggcctcttttataaggccactaatcccagtcataaagtctctgccctcatgacccaattacctcccaaaggccctatctttcaatgccatcgcattgagtattaggtttcaacacataaactttaaagagacacaaacattccaaccatggcattccaactctggcccccccaaattaatatcctcctcacatgcaaaatacattcatttcatttcaatttctccaaaagtcttaacttgttccagcatcaactacaaagtctaaagtccagagtctcatctataaatattatccaaatcagataagggtgagactccaaggtatattttatcctgaggcacattgctgtccacctgtgaactgtgaaacaaacaagttatgtgcttccaaaatgcaatgatggaacaggcataggatagaccttcccattctgaagggaagagataggaaagaaaggaataacatgtcctaagtaagttcaagacccaacagggtaaacagcacttaatcttaaggcttgagaataatcctgtttgacttgatgtccaccttctggacacactgggccaggcgttggactgccaagacctcaagcagccttgcccacatggctttgctggacacagcttacatggcagctcttatgggttgcagccgcatgcctgaggctctcccaggctagagttgcagccggcggctgcacctgtctaacatcactagagcccctgctcctatggctccactaggcattgccctagccgaggctctctgcagtggctctacctctgtggcagttatctgcctgggcccctagattctctggtcatcttttgaaatctaggtggaggcagctgcacatccatagctcatgtactctgtgcacctgtggaaatggtgtcatgctgatgccaccaaggttagctacctatatgtcatctggggggtagcctggtttctactgacccatactaatctcctaatcaaatggtcatttggtcacacccttgacgttcactactgaacatgcgatctcattttgtattaatgccatactgccagactaagaatgttccaaatctttaagctctgcttctcttttcattataaattttgcctttaaatcattttctcttctcacattttactataagtagtcaagagaagccacgctactccttcaacatcttgcttagatatttcctcagctaaatatcccagcttcatcactcacatcactcacaagttctaccttcctcaaaacattagggcatggacacaattcagccaagttctttgccacttgtttccttcagtttccaatacgtgttcctcatttccatctgaaacctcatcagaatggcccttaccgtccatatttctactaacatcatgctcatgaccacttaggtattatctaagaagagtgagactttctctatggctctcctttccttctgtgctcccagctgaatcctgtttaccattaacagcaatgtaggctttttttagcatgtaccttaaaacccctccagcctctacacattacccaattccaaagccacttccacatttttagatatttattatacaatatccctagtccttggtacaaatttctgtcttagtgcatttgggctgctataataaaaatatcataaactgggtagcttataaaaacaaacttcagttctggaggttggggagtccaagattaaggtgctagcatatttggtgtctggtgagggtccattcctcacacatggcaccttctagctgtgtcctcacactgtggaggaggcaaacaagctcccttgggcctctataataagggcactaatcccattcatgatgctccacccctatgacttagtcacctaccaaaggcctcaccttttagtaccttcacgttaggattaggtttcaacatgtagattccatggaagaacacaaatactaaaaccatggcatagttctaccagttagtgagtggagaatgttaaattctccaactataattgtggatttgtctatttctgctttcgactttatcagtttttactttacgtacagtaagtcctcacttaatgctgtccataggttcttggaactgtggcttaacacaaaatggcatataaggcaacactttttttctcatcaacattaaaacggaactatgaagaaagaaacatcatttccagcatctgctgtaggccatttcactgaaagtcaatttccaagagcctatcaattattttaagtgaggattttctgtattaaggctctgttgtttgatgagtacgcatttgagacccttatgcatttctggcggattgatccttttatcatcgtataatgtcactcattggctctagtaatttcattttctctacagttgactttgttaactgtagagcaaataaaactgtagagcaaataaactgattttattacattaatataatgattcctccttttaaaaatgtttatgtactatgtttttatatcctcttattttcaatctacctatgtcaccgaatttgaagtttcttgttagcagcatgtaattgggccattttctccccactttgccaatctctgtcttttgattgatatagttgctccatttacatttaaggtaattagtacgttaagactaaagtctaccatgttattgttttgttttgcttcatctttgtttttctgtttctatcttcttgtcttcctgtgggctaggacccatcttttaagattccatcttgattttttaattgctattgcatgtatctttgtgcatagtttttgtagtggttgctctggttattacaaaaatattcataacatcactatttttatcaaccttttactacttgtgttgaagtctcacctccatatacgttctttcatatttctcactttttcctttcattgtcttgagtatcagacggtggtgtaatatcttttccaatcatcagatgtgattgatgacttgtgatgagaaggagggtttgttgtatgactcatgctctgctcttttcattcttctttcttccctctggatgctccaaggtgctttctcttaccatttcctttgtgtttgaacttcttttgtcaatctttaaatgtaggcttgctagcaactaattcttttcgtttccttcatctgacaatatctttatttcctcttcatttctaaaggagagtttcactgaatatagaatgcatggttgatttttattttctttctgtccttggaaaatgttgcatagcttccttctggcctttatggtttcataggaaaaatccactgtcattccaattggtgtgctcctattcctattcagaatccatcatttctctgtggctgcctacaggttgtctttagttttcagaagtttaattacaatatttcttggcatggattttggttgtggttgttgatcctgtttggagttcacttggcttcttgatgtatacatgtctttttgctatatttggggaatttttatccattaatcttcaaatattctatagcctctctcttctcctttgggcacaccagtgatacaaatgttggatcttttgttagtgtcctacaggttcttgtgggtgttctttttcttttttttagtttattttctctgtgttattcagattgagtgaattacattgtcgccacagtcactgattctatcctgccatttccactagtctactactgaatccatctagtaagattccttcacttctgttattataccttttagccctgtaatttccatttggttcttcttcatcacttctatttctttactgtggctttctattttttcatttcttcaacagatttgcctcttgaagcatttttatgatggctgttttcagatccttgccagataactccagcagttggttcatcttgacgttggcattcattgtctttctcattcatgctgcacatttcttggtacttggtatgaaaggaattttctattgtatcccattttacctattagggaattctgggtcttatttaaatatttaattttagcaggtaattgccctgattctgcttagggagcagggcctggcctgatttgtggcctgtggtcccactgacagtttaatcgtcagagcctttcagcgttatgttagtctgcttggtttatcaggtacctctggggtccctgctgacgttacctgagggacagaaggggtgtctctcagtgggagagggaagctgccagcacacagctatgaaaccttcctggcctggtgtgtgttctggtgggtcccctgcctgtgggagatggagtgtgcttcccaggtggggctaagggggatcctgctgttttctccagccccccaaccctggactctctgagatgggacagagaggctccctcggccagatcaatcattgcagtggagtcccttttgctgtttcctcttcctggtcatctggcttggtgataggctcttggtgacctatttgttctgttgcctcaggccaggcttcacactgtgaactgatttttcaggaatttaagggcgacttgtgtttttcccacttatcttgtttgccagttcaacagcccttctgtccaaatgtgtccagatctcaccaatccctgcatcataaaatgtcccttcccagtccaggccccaagtctacctggaaaactccaattcatcctctgagaccagcccaactgcccctggtctgtgaagtgtgatccccaaagccatcaggcaggcaacctacctccctggggacaggatgagacacagaagcccaactgagctacagacctactgtcctccagtgggcagatccaaagtgttcattacacaatagatcaatgaccccccaagtggacggaccaaggtgcccaccacattaatagaaggacgaccccagtaggtaaggcccaggtactcattaggtaacagattgctgagagatgaatgggggacccataacatcctcctgcagcaagtggcaggggcctgtccagctgaggtctcatggccactgggtctctccaacagtccccagggctggctctggtcggggacctaggcacatgtgcacactgtacggagcccagtaattgtgacaagtatggtgttcttgggaagcacactccctaagccgcagtgaaatcaatgccctgtccacctttccaccttgtgacattggtcaaaggtctgggcaatgactggcttcaaagactcaatgggagcttcctgttggacaagatttaatctgccaccacctgccctctcttctgctccaaagcagtagtaccgggaccatttcaagttcactctcccaacatagctggggtgaaatatctctgtgtctcctcagagtggaaagctacagtctctgggggctgaccacgcaggcagaaaactgtgcacagggtggcagctaactgccatctttatctgtccataaccaaatgagcccaaagcattgcttcttttctggtttggatctgagggagtgaggttagatggggtcctgtgtcccatcacctgactcaggagggaggggacaggcccaagagggcagagtccgtagaaaagggcaaactcccttaaggtggggagggaggagccttggctgggggaacagaagaggcaggtgacactggctgtctccagcatctgttgatgtgtaagtgaatccaccagtctcaatattcacttttagtgcccacttcaatagacactgggaggtccttcaggagctggcccacttcaggggtgtgtttctgcagccagtgtgtgtgtaggggtattcatagcaacatcgaaaacatgtcaggacccattatcaacactgcattgtggttaatcttcaaagatctttgaatataacatttcaaaggtctctgggcagaaatcttaatatattcctgacagcaaaacatttgtgattttataactgaatccactgatttgtaaacacacagacacacattcatgaacgagcacacacgcagacgcacagacacatgtggacaaagatacatctgtgcaagcacatgcacacatttgcagagacacatacacaaaagtgcacacatgcacacgcatacacacatgtgcaaacacacacaaacatacttcagggtacacaaataccgtctcacggaggcttaccaagttcataattttattatactctgaatagagatgatatttaaggagcagagaaaatgactatacaaaagatttatagaacattcatttacatactggatatattctttacagtatcagaaaagtaaaaatatgcactaacaaggcagagaagacgttacaaggtatttgatgctgagaataaatgcacagtgacttttaacatggctatagcttaacactggaggaatacaacaatacgttcttttactgagtagttagtaggaccctggctataacatgcgttgggcacagttcgtgaactctccgcatttactccccagggcagtacgtgcctgtccagcgggagccctggagacaaaatgcctggaaacgttccttttcctgtggccctagagccggtgtccacggtgggggctctctcacggtttctgagcccacagtacaatctgtgatgacacacagcttgttctgtttaatgcacatgtaacacaaaaggaagaaagaaacttcctataccagctcttcagaaatcgtggaaacttgcttcctttggttcctcagagggagctatctgcttggagcaaattccccgatgcccttgaccacgtttaccttgtgtaaaaatcacacctggccaatgagttcaaaaagcacgtttgcagggcttcctgaatgccgtcgaggcatggcttcatgagggccatcgcgggcaccccgatgtctctgtgattccctggcaggctgcgtttctcaatactgagaccctagtttgctctgacttctaaatgagctctctcatccttcatcagaaggataaggaacctggcctgcactctttgggttaaacatgggtagagaccgtctcaggatgaggacctcttggggaaagtacaaacctctgctccctgtggccacattcctgcagtggatgaaaaaccgagatgctagaggcctctgctaaagacatcagggtcaacacatgaggatctgctgaaaatgccagcacctcctgacagtcatgccaccgcaagttagagaaggaggtccacaacgaccaaggcaaacatttggcacagaaatgaggcacttggtttggtgcatcaataggagctaaaaagtggaatggtccacctgctttcacacacgcatacacgcacgcatgcacacacgcacacacacacaacacccactgtgatttggctgcttccaactctgcctgtttctaagttttcctcggcccctcactttaaagcagagttcacaaagcacattcccaaaccccagctccctgacaggagcttgtgacaccagtgtggcctaagaatgggggatttgacttttgaaagcagaggagggaatttcgggctggatcgcaatcaggacagtcagcatgcctgcagagcacctaggctgtgagaggatggggccaaggccttattctgatgtggcccagctccatctttcactctggggatgttccagggtcacaaattcccccaaacctttgaccacgaacagattcaagcaggaaaaccagggcattggaatgttgaaataagcctgaaatacacttgattcagtggcttagatgatggcaaacagtggcactcaaaaacagcttgtcagtaccggggtttcttctctttttcctcatcctcccttctgctcacacatgccacaaccacacatggtccccagcaggaaccccaaggtggcaaggagcagcacaaagagggctgataaatgcaggcgaacttcaggtcgtgcagcttcaggcctgaagatgatcgaaaagcccatgtgggggatgctgagcttaaatccaggagttttccatccctcctggactctctccatcagaaaagaagtcatccacaatcggggaaaaacattccaatgagtaaaacatcagggtaggttgcttgaggcaaagccacctttgggcggcaccgcatatgggagacccacagtccactgcacactctttcagtggccaggggcctgcggtgcatcctacatagggacaagcctcacaaaatcacagcttggcaggctgcagcatttgacactggtacagtatagcaatggcaaattatcataaataatttggcataagtaaaatataaattacatagaaataatatttttgttccttcttctcatttctcctctcggtcctcacaggctctccccagcccagctcgcccagctcgcccagctcgcccagctcaccacaggtgagcaggaggcacagagcactcaccatggtggggtggcatggggtctccaacgtggccaattcttcccaccacccccatcctcacagcccatcgcaaaggcccctcgttgtaggccctgctgtgttccagaagggcctgacttgcacaaaccttcgtcaaacatacgcccccttctcagtttcgttagcatctccatcttgggaagaccgaggtgagggaaacccccggcctcgggtgcagctggacagaagcgcccatgcggacgggcgaagcatggcagtcactcggcacctctgcctcaagggctggggattcctcatcccccggaatgctagtgtgccagggacatggggaccacctcgtgttctgtgctgtttccttgcatgtccctttcccatggggaccctagggggtggggtgcacccatgcccagcttcttctacccaaaaagcatgtggctacagagatgtgtcagataagtcactttcaggaaaggccaattcacggtgatgttgtttgttcttgtttttgcagagctggaagatcctctttcccctcatgggcctggaatgtcaggtttactagtttggtaaaaagtgggggccccaccctcacccaacggctgtctccagggcttcgagaggcatcggtgggtccagggagggaggggagttctcagaccttctttggggaaccaatcatgacctttgatacgaagttgacaatggcactggcaggctgctcagggtcatgctctgcaaacaggtggcacacattatccgtggcactgccctgcttccgggccacaaatccaaagactctgccaaaggaaagtccagtcagagtggtcagtgtcccacaaagtaccaagcttctacttcctccagctgccagcggcactgtcaggaggaattttaagtggcacctatcaaaaatcaaccacgtgcccagcaccctgctggccacctgttcatgcactttacctccagccttcacagacctacagatgggatgtctgactctagctctgcagtgaggaccctgaggctgagaggtgagtgccctgtccacagccccaggttaggacctgaatcaaagctgaggctcaacttcctctatagatgcttccccacgccagggccagaatctcctgggcacctgtccctgcagattcctgagccccagtcctgacatactggaccacagtctgcaaggcgagtggcaagggactcaggggctcctgagatgatgccagaatgcaagtcctgtctggacttcgacactcccacccactgggaccgaaggggaaatacactaggcgctcctctcaggccttggaagcctgcattacaaactacatagacttcagggagctgtttaaaaagaacagcccatcgaattatttttcttagaagaattagagccattatcttaataggcttttatgagtcctgcacttcacacaataatgaccatatccctatccaggtcctgggcaaaggactttcttctctttcttagaaaaatgaaggattttttttgtttaaatttagcagtttccgcatcatgaagggaccagtcaatgacactcaggtaaccccaatacagtcacaaattccaagcacatgaaagcccgtgtttctgctaccagccagagtgggagtgtgcccagaacacagtccccaccggggaagcccagctcgtcagtaccagggtctcttctccttctccccgcttctgctaacgcatgcactgagcaacttcctggacagacaagccatttgaaaacaggattccagggaaggatgcctgtgatcaggcactgtggtcattaaatccgggttatgccgaggaaaccaggctggggggatacagcccattgtgcctccaagtgggaggttaggatgaggtccctcagctggccctgacaggaacactgggccaggaatgagcccaggccaagcaaggccacggtactcagggagccagggaaaggtgtgcttataaaaggggaactctaagccgggcacggtggctcacacctttaatcccggcactttgggaggctgaggcaggtggatcacctgaggtcaggagttcgagaccagcctgaccaacatggtgaaaccccgtctctactaaatacaaaaaattagctgggcctggtggcggacgcctgtaatcccagctatttgggaggctgaggcaggagaattgcttgaacccgggaggcagaggttgcagtgagccaagatcgcgccactgcactccagcctgggcaaaaagagcaaaactctgtctcaaaaaaaaaaaaaaactctaacagctgcctggactggctgtggagcaacggtgtgatgaaggccctcctccgttgcatttggtaaatttggaacacccgcttcatccacacacctgcacaaagggagcaattccttctagctgtgcagacctcagcactgctgagcccatgcattcccaaatggccaaaaaggctgtgccatccatctccctgtatctatgccacagtgttatatgacacatgtaaatattgcacatccagccaacagccggcagaaaagttaacagcatccagatccttgtccataatgagaacacttttacttttttcttttttaaaagaaattggcatggtgtagtcattttcttataaggcaccccctgtgcaaatctggaagagaattcaactttggagtacaactgcagacaaggagagaatgtaaagaaatctcagcaacttactttgaggaagggccatctttgatccaccttgcaaattaaagagaaaaacagaggttaatttttttaaactaaaggatagaattaagtacactccttgctcaataaaaatgcaaatttcttacttcctgtcttgtgggtccaaggcacagaaaatcacactgttcacggggtaatgcctccggaagaagagcctgttgggacatgggggagagaggatggctcctgttactagggcttttgggtgatgggggatgcactgggcgggctctcccatacatgaagattcttccagcagaaaacatttcatacttttactcatcacttggagagaagaaagtgcgtgctcattcaaagtcaacagatgtcatgaagctgggcagaacagttgttaccagtagacggaagcaccacacaggctgaaactgtcagccgtgtggaaggcgggaatcgggtcaagaagccctaacaagccgggtgcagtggctcacgcctgtaatcccagcactttgggaggctgaggcgggttgatcacctgaggtcaggagttcaagaccagcctgaccaacatgtgaaaccccgtctctactaaaaacacaaaaattagtcgggtgtggtgacatgtgcctgtaattccagctacttgggaggtggaaacaggagaattgcttgaacctgggaggcagaggttgcagtgggctgagatcgctccactgcactccagcttgggcgacagagtgagattccatctcaaaaaaaaaaaagccctaacaaactggaaaagctggtagggtgtgagatggacacaaggaagcacctctggccctgccagacactgctggctgcaggatcgtggggaaaccactaacagcctccaggctccgagccttggtttcctcacctgtgaaaagtggatcatgttaccagcccaccccttccacaggacagatgcccaagtcagatgcagtcacaggtctgagagcactgagtgaacaataaagtgctgtgcaaggaatattccttaaggaaggactccacatggtcactgatacgacccccatagagacctccttccaggctcacctgacagcccttagtcactgacatgaccacctggggcattctcctccggctcacctgcccagcccttccttccaagagtgctatccacccagtccacatggtccccagaggatgcccaactcaacactctgctgtgtccaggctgggccagtctagctggctttggggtcacccctctccttctgggaatgactctgcaccggcacagagtaaagctcatctggagatgaagagagaggccaggagataggctagggcagaggcagagcctgggtgtgcttcaattcaaggtgaccctgcagccacctgcagcccctctcaaacaggtgccttttaaggctgattgttggtgagaagatcccccttttgtctagaattagccagtctgaactcaaacgctatctcttacagtatgaaagatctgaactgatgtggacatgacccatctccagggaatataaagaatacagggaaactaaagagacacagaaaaaagacaactctgacaagggcacatagaacagatcctgtgaagaaataacatatcttccaagggcagcagggaggagggaacagtcaacattgtgagggtccttaaggagcccaaccctgaccctgagtctaccatgtcgccaagctatgcctccagaccctgagtccaccatgcagcctagccatgcccctgaccctgaccctgaccctgagtccactaggcagtctagccatactcctgactgtaagcctgagtccaccaagcagcctggccatgccctgagcctgaccctgagcccaccaggtagatgatccatatcccaaaccctaagtccaccatgtagctccgctatgcccctgacactgactctgagtccaccgtgcagctgagccacacccaacgggaaccctgagtgagccatgtagccgagccatgcccctgaccctgtgtccaccatgtaactgagctatgcctgacactgaccctgagtccaccatgcagctgagccatacccaactgggaccctgggtgagccatgcagctgagccatgcccctgaccctgagtctaccatgcagatgagccatgccccgaccctgagtctaccataaagccaaggcacaaccctgactctgaccctgagtccaccaaacagcaaagctatgccccctgaacctgaccatgagtccaccatacagctgagctatgtccctgaccctgagtccaccgtgaaactgagccttgcctgtgaccctgaccctgagaacacagtggggctgagccatgcccctgaccctgagaacatggtggggttgagccacaaccctgaccctgtccctgcgtgtgccacacagggcacttgctgagtgcccttttcatttgagacactaaaccttgaaataggtattttggtgcaggattgaaatacgagagcatcaagcattgggaccctgcccagggtcatctactggtcagtgtcaggggcactgaacgggtctgaccagcaaaacccacgttctgctttgtgctcatttttttcagcagatgaagggtgatgagctaaacctgcctaaactcacttattcctgaagctacagaggggaagatcctgccttcaacctcccaggtggtttgggcagatgaagaaaatgtcttgcttctagggacatgggcaccacagagaggcatgggggccctgctcggggagcatcctgggaaagcagccaggctggtctgagtgtcccctgccggcctgtctgctgtgatggctgctgccatcatgctgctgccacggttgatgccaacgtgcctcctcaaccacacaatacaaaataattgcatctgaaatgctctgttcctaggccacaggctgcactcagggatggcattctggagggagggagacaggaacagccctgtggctgctctgttccatgcttatgctgggcattcagtaaagatccacatggagaacatctgctccagcataactggctcagtaacagctcaggcgtaagtcatttgaaattggccaacggaaatagtacatatcaaggtcatacgctcacctgaaaggaaatgaccctctgttaaaacaataggttccaagatcattggactctgatcatagtatcagagtgtttttaaggaactgagttaaaagattttttgcatttgcaattatgtgtgtatgtgtgtaattttaaaacgccaaacgtctttttttattttattttactgatttctaagaaaaatagccttgcaaacaaatgctaagagttcctatgtggttcccaggacgtatttaatgacagaaaaatacctagacagaccctgggtgactcatgacctcaaagacggctaatgatttacctggatgactactcacactagggaagaacaagaggaacgtgacagccccgcccctgctggacggctcctgcctccctctaggcactcacttcctctgattgtctgtcagggtgatgccctgggctgacaccttgaagtgcacaactgtggacacaggtggaggctcctggaccagggtgatgctcagggccttctggatcgcctggtggccggtgagggactccatctccacagagttcaagtaccacacattgcaggctggaagacaccaagggagacacatgttagttgcaactattgggacaggtgtgtcctgttaacacacaggcagttgctgatgtgcagactgggtttatgaacaacttgcgcatgtggcctatgctgggtgcatgtaaggcagatggcctttgcccctaattctgaaaacatgaacagtgagtgctccaaggatgcacttactcccatgtcaaggcagagaataagcgagttactagagcaaagcagacccgcctggtgtggctttgccttcccaccagccagagggagctttctattcgccctgcagcagtattaaaccctcgtgtcccaggtggagcccaaggcaccttctctggtctcagggtgggtatggacaacagtcacattaatatgaaacccaactactgttataggtaaggagcccagaggcccttgagaaacaaccatgagggaagcatgtgtcctcaaatcctggttgccaagagaaggaatggcttgcagtgagctcagagaacaggctggaaaaagccaaaagtggcccggcctcacctgtgtcctggctccccatgctgccaagggagagctgtgggtcttgtccctgaccatctcctcttgggagaagaaaaacaactgggctccataacaacccttctttcccttctagcctgtgaccctgcagttcaagcataagtgcacgtgtgactttggggcatgggtgaaattgaggtgttccaagacatccagccttagcctgaagctcattcactgaagtaaaccagggcctctcctgcccaaaggctgagtaggcttcctcctgaggaacagaactgccctcactcacttgccccttgtctactgtatacatgtccctctatgtgagcatgtgggtgtcttaattccgtggttaaaggcctctaaagtttcacttaacagaaaaagagtgttttcccacagtctacagcaacacatctcagcactcggatgcacggtacgcgctgggtagtgttgtctccctcggccgtgtcctcctggggtaggcagccctgggaagcagctccattttctctttgcctttaagtctgacttttcagaaccagcaagggccatgcctattggcaggtgtgttggcaggtgcacagacagatgtgttggcaggtggtttggcaggtatgttggtagacgttctggcagatgtgttggcaggtgcactggaaggtgtgctggcaggtggtctgacaggtgtgccacagggtgcattgacacacaagcccacagatgggctaggatgtccctgggtgtcacagtgcagggtgacttgtgagttgctggaccatcctttctatccaccgcaaaggccatattgtttatagctgaagacactctgaggaattgagcccactatttttgatgatcacttggtgatatggtttggctctgtccccacccaaatctcatcttgaattgtagctcccataattcccatgtgtggtgggagcaacctggtgggaggtaattgaatcatgggggtgggtttttcccatgctgttctcgtaatagtgagtaagtctcacgagatctgatgattttataaagggtagttcccctgcacatactctcttgcctgccaccatgtaagatgtgcctttgctcttcctttgccttctaccatgatcatgaggcctccccagccatgtgaaactgtgagtccattaaacctcttcttctttataaattacccagtctcagatatggctgtattagcatcatgagagccgactagtatacttggcgatatttatcaggtggatatgaaatgcctagaagtaacctagtggtcccgcttctgaggagattgagaaaggaaatattctgtaaccacataggatagctaaccttcagggaaagacatttgtgccacatattcattacagtgggaaaaaccagaaacacattagaaatgagagaggggtgaaattagctccctcggtgtaataccaagcaaccagcaagcggtaaccaggaaaatcacatggcagcatggaaagacgtcatcagcaatcagcagggaaagcagaataaaaaccacgtctgctatgattagaacgggaaaatgaaaagcatgtgtgcatcagataggagctgcgagggagcctggagaattcaaaacagacttcacgagagggacagtccgcctttgattttattagcattactgtcatgctgatcatgcagttatgaaagagagaaaaaagggaaaattttgacctaactactaggaaaattccacaaaattggcacaatctcaatcagttcacacagaaccacagctgccacaacccagacccatgctctcttgaaggagtcacagatggctttctgatgaggagcagtcttgctggctagagtttggtagcaatctgctgtttggggaatctctctccccaaatgcaggaactatgtcatcattccttaaagcagagaagaaaatgctgccactagggaggctgttctacggagcacacatcaaccaactgacaccaagtgccccaaagcctctctccagcagagaacaggcatgcctgcgcctgcctatgattgtccaactgcacctgacccaagaccatccaatgccacttgacaggtgctcttggccagaggtgaagattcagtgcccagtaagagttaccaggaaggcacccaccagacccatggcatggagttctgtcaattgctaggctactctgggaaagggacttgataacacagaacaaaagtctgaggcccacatgtgggaatttgtcctaaggcaacaatccagatttcagaaaaaataaataatgcagaaagatggtcctctaagcattgtctgtggtattaaaaattagaaacatggtaaatgaacatccataaggaggtgaattatatgatggactattgtgtagccatgaaaaaaatgagacctgcattatgtttgtaaaaaccatgggtaaacttattatgctaagagaagagaaaagaatcgtacaggcagcatgaccccaagtacaaggaaaaaggcagcataggattggatctgcttgacatcaggagtggtctttgggctggagaacactttacctgctgtccactcttcctcccaatattcaggggctgcataggggcaaccgatctatgagtagttcatttttccttttcttttattttccatttttaaaacttaaagaacatataagactctataaaaaaaaaaaagtatacctaccatatgctaaaaaatgcaactgcaacatttctgggaaatctattagaaggctactgaaaagaagtaagtctttcttttcaggattatattatattcctctgcttcaacaagaaacaattaagaaccgaggcttaaaacacaaatagaaattgttttagagattggaacaaaggcataatggccttaatatttaaaaaaagggattaaactggagagcattacaagtttattcccatctttgtgagttgtctgctaatatttctgagtttcagcttcctgaatctttataacggggaaattggacatgatcatctcaaagaacattgcacatccaggagtctaggactctaagtgaattaggacaacagatgaagttcagtttaggaaagaaaactcactaaattgctggaggtcatcagagattgcaataattccaccgtcttgctacaatggttgttctgcactgattctaaacacctgcagccaatcctccaggtgaagacgacactagctgaggggtggtcactgtgacagcctcactcctctggtgacagatctgctgtcctggttccgtggcttggaatcgcggttaatgtaatggacagcagacattcgcagctctcaatgtgtttcagaaatgagatttttaaaggaaagaagctcaaggcagtcataatttaagcttcatatataaatgcccaactcagatgatcagatacaaactccaagttctgaatgaagtcttgactctaagaagacccacccttaaaaaacatttggagttattgatacatttcatacgtaattttaaaagatggaagtgcacttaaaaatgataagtcaagatagaagagaaagttttaatatctaaaaacaagtgctattaggatgcactgttatgatcaactaaattcattcaattcatttattaattccacacttactgggtgaatgcaggataactaagaagcttaaggagaaaagtgaaattgcgtgtgccctggtgctaccatatagggctgaatgggcagggctgtgtccctgagacaatatgggcacagctggacgtgggagctgaatgccaggcctagatctaccattcaggagccagagctgccaacttgggtcctctgtctatgacatgggatgacaggacactacacccacacgccctgtgggtgaaggggaggagacaataagctgggcaggacaagtgctctgtgcctgttgctatcaccgttcttctgcgctttcttgaacactgccgatgcataagttgtgattttaaaaccactaattaaaggttttcaaaatttcaaatacatttttaaaaggtgcaactgaaacaaataaatccatcagagtggagctggttttgtagccctgtctcctcagttgagagtgagtgagctgctcatcagataggtctacagtaaattcctgcatccttctgggcacttcactgggacccacagacagggtccactgttactttaacagaagaaagctaagaaccatgatgggctccagggaccccctaaaacagatttaggggctgtggcccaggaccagcccaggtccctcacaagggaaagggtgaggccggcttcccaggaaaggccattcctcttgggccagaaaaatgctcccaaggcattgtcaatgtcctattcatttaatcttttcaactgctatgtgtggaaatattattatccccactgaccagatacaaacctcaggtccgcatggctaagtgatttgccagagatcaaaatcctgagtagcagaacatggccggaaacccatgaccacagctacatttttcattttggagcttcgagttttagcacacttgcaatttggggcaagctattttcacctttgttttggccacagataacttatcctataaggagagtctaaaataacttaaacactacaaaattccattcaaaacagagtaattttactttagcttggtaacagacacagtgatgtataattttacagggaaaagctacatagaagaataatacaaattgtagaggaaataagaaaatgcctatacatttcatacaccttcattgtggagttacacctgtaaactactctgcagatatgaggtacagaatggaggtatttctagtccaattttctaccagactcagaaattccctccccaacatttctgacaataaacacctaccttgcatgaaaaacttaaaacagttttgaaagtcagggtttgaaagtcagcagtccccactgtcctctctagctgtgtccctccctcatggccacagaaccacaagagccctatggtgtgtggtttgtttacaaccttcttaaactggggccactacgactgcatctaatgctgcaaaagtaacctggcctggaactagtaagcgattacagaaagatgctggatacaaggttaatgtacaaatggtcaactgctttcctacagaccagcaataaacaagtaaaatttgaaattaaatacacaataccatttacagtagcacctcccaaaaactacttacatataaatctaacaaactatagacaagatctatatgaggaacactattaaactttgatgaaagatacaaaaaactaaataaatggagagatattccatattcatggacagcaggactcaacttttgccaaggtgtcagttcttcctaatttcatctatagattcaatgcaatctcaataaaaatcccagcaacttattttgtggatattaacaaagtgattctacagttaatacagaaaggcaaaagatcaaaaatagcaaacacaatattgaaagagaagagcaaagttggaggactgacattatttgacttccaggattactataaagctaaagcaatcaagaaaatgtgatattggtgaaagaacaaataggtcaattaaagaactcgaaagtagacccacatgaatatagttaactgatcttagacaaaagagcaaagggaatacaactgtgaaaagacagatttttcaactggtggtacagaagcaactgtacatctgcaggcaaaaaaataaaaaatgaatcaagacacagaccttacttccttcacaaaaattaacttaaaacggatcacagacttaaaggtaaaatttgaaactataaaatctagctggccttgggtttggtggtgacttttaagatacaataccaaagtcacaatccataaaacaggaaatcaataagctggattttattaaaattaaaaacttctgctctgtagaagaatgaaaaggcaagccatgaaatggaagaaaatattttcaaaaggcctatcaggtaaaggactagtgtctaaaatacaccaagaattcccaaaatttaacaataagaaaacaaaacccaattaaacaaacaagccaaaggcctttatggacacctcaccaaagaagatatacagatggtaaataagcatatgaaaaggtgctacacatcataagtcatcagaaacaatgagataccactacgctactattagaaaggccacattccagaacactggcaacaccaaattctggagaggatgtggggcaacaagaactcacattcattgctagtgggaatgcaaaatgggacagccacattggaagacagtttgcctgtaccttataaaaccaaacacactcttaccatacaatccaggaatgcgctccttggtatctacgcacaggagttgaaaacttatatccactcaaaaacctgcacatgggtgtttagagcagcattattcattactgccaaaacctgaaagcacccacaatgtcctttagtaggtgaatgggttactaaactgatacacccagacaaggaaatatttgctgctaaaaaaaaatgagctatcaagccataaaaacacatggaggaaacttaaatgcatatgactaagtgaaaggagccaacctcaaaaggctatgaactgtatggtttcaactatatgacaatactggaaaagttgaaaatatggagacaataaaaatatgagtggttgcttggggttggtgggggagggagaacgaacagaaaaggcacagaggatttttagggcaataaaactattcactatgatactgtaacggtgattacctgtcattatgcatttgtccaaacctgtagaatgcatgacatcaaggtgaacctaaatatcaagtccctaaactagggactcaggtgacgaggctgtgttaatgcaggttcatcaaccataacatgtgcatcactttgctgggggatgttgacagcggggaggctatgcgtgtatatggtgtatctctgtaccttcttctccattttgctgtgaatctgtcactgctctaaaaaagaaactctatgaataatttttttaagtgacctgctctgtctggcgagctggttcttgggtgttgtatgtctcactggggttgctggcagtgtgggtcaaatcattgactcatgtcaagtgacttgttgagtcatgtctctggaacatttttacatttacagttgccgagacagatcacccacatcctgtcttactatattttcccccaaactaaatccagggcttgacatttattccactgaatttagtcttgcttgagttagaccggcccatgaaggccttgctgatgtcccaacaactgcaccccacccagctctgtgcaagcttctataaaaggaaacctccttcaaggctcacagaaaagaaaggaaacctgaatactgaagtgcaaaaggaagttgtgtcagtgagtcctttttctccccagtcaccagatgtagaaatggagctgcatttactgacctgccccctgcttcaacagctcagctgctgaattggctgccgtctggggagaactttctgctatttcctccaatggatctgtaggaaggggcaagaaaatacagaaatgagtcctgctcctgaccaagaatcctcatgacaaagttagacaatttgatgacagaattcccagatggtgacatgcaatggttttgcagagtcaagagtttctctttgggacaataatttggcccatagaaaccatgatcacattctgaataaaagtagagatgacaaggcctaacaaaatatttttctaatcaccgaattagtcatatgaacaatgacactttgaaaagtaaatcacatttacctatatattaagttagaccatttttatgtgaagttgtgactgcttaggaaagtgggacatacggtcacatcgccctgacatgctgtgggtgttatttaatttcattatggatattgtttaacaaacataaaagtaaaaagaacagtgcatccatcatctaagttcaacaacatcaacattttgcccattccgtagaaacgtaaaaattaaatgtcaatgaccctgaagccttctttgtctgagggttttatatttttaaactacagaatctttgctctatagaaatctttcatcaaaatccatgatgtaaagctatctgggagctgtcagtgaagtagaatctcctcttctctccttaatttggatgaactcattggccttttcttgggttcaaccaagagaatacgaaaaaacttccagtcttattatttttctcagtggatcttcatggatctctaaaaccggtggccttgactgcagacaatctacacagagcctgactagcactgaggaccccttacctctctctgggataagcagcttgcacggcaaggccaagggcgtgatggaatgctggcacaccaaggccgtcaggctccctgcaaagtggacagacagcaaacaagagtcaacaactgctgtagatgttgtgtgctcagccaatttatcagctggaatgaaacggatgcaaaggctgagcccttatctttttagcaactggtatgttagattagtgtgcagctttgtgtaaaacttcaaagaagtataaagttccacaagatagttgagaggtaagtaaatggaactgtttatcattcttatcatagacacatcattaccaaattatataaagactaaagcatacagtttgttggatcttgaatcaggagggttgacatcaagccaactccaacttcaaccatatatattacccctgcacaatgcttcttaacaaagctctaataacaatgatgcctaaggctgcactgtgctttgtgtggattgctcaagtcatctttccaacaagctcgtgaggtagggaaggctcccaatttgcagggaagggagggtgctctgttgggagctctatgttgttccttgtgctgtgggatagggtcatgctggagctccaaccttctcaggacttacctgcctgccaactaggatagaatcttattgacgtctgtaattcctacgtctgatatggtgcttttcatttgtttggttttgacagagcttttaagaacaacttcaaatctagtttatcttaaagataataatgcagatcagcaggatttcagaactggggactgaaatatgagtaaaccaccataagagtgatagtcccaaatctcaggttggtgagcagagggaatccaggcctcatgagttcagaacattgacagcaacctctcaagcaactcaccgaaatatggttcattcgagcaccctttcaaccgcactcccttcggggtacactcgatcaaaaagtgccggacgagttcattggccaaatctccagctgtggcaagaaatttaaagaaagaagaattttttgaaaatgggagcatgggagaattcaatagagagaacataaaagccaggagctacagttgaaaaggctcttctctgaatacgagtccagtcactgcaaaagaggctgccaagaaccatcttcgtcctaggaatggtagccgggctgcaggacagctggatgagcacaggctaggccagatacagggcgggaacccttgcaatgacagtgtgggggctggagaggtcccttgggagaggccctcaaacattgtgcaagaatccccaacgaagggaatgagcttgcagctaagaaagaggatcatgaatctccagctgaatcctctcccaaagaggagaggtgagaaaggctcagacacaaaatgatacctataatgaatcactgaaaagagctggaaggaggtcagtcttctgggtgggatttaaccaggagcctggatctttaaaaccttccagaaagcaagcactcagctgcacgggagcagcactctaccacattgctattaacagtaaacagtgcatctgctttaggccagcccatgagtccaaagagaaaacacatcataaaaagccactgaatggcaaaactatctgagagtggaaaagtacaaacagcacaaccaaaagaacaagaagtcactgccctatgctaatgagtccaacagaccttcacagtgtgctgtatttctgggatccagtgcttccttcatcaccctccattggggcatgtctgcctaaacttctaatatttctggtgttggaaacctcctggcagcaagatccactggagttgggcttggtccccagtgccttgcccacagtaggcttccaaaagatgtttataaacatgacaaatatcactgtgtcagcatttcacaagggcagtaaagcttgcagaaaaggaaatgatcagattccataaaaggctgtgttgaattaaagtgggataagaacatattgacattcagttgtgggaagaaaatgacgcctggcttccaaactgaaggggacaccaagcgtgggtctggattccacttgtgagaaatggctcagtgggaagtccttctggccagggctctctggagaacagcatccagaacgtccctagctgtcccatctccagtttactggaggtggtatggtgaatggttgtggctctttatgacctggtaaactctttgctcaaatctatccttggattgtgaaatctgaatgtcaaatccagggacaagatgaagacacagcagtcagataagatttcacccagaggccaccaacaacactcggtttcctcaagtctgctattctaatatcccctattttgttcctttcatcttaagattgagtccaaagtctgtcagagaggcaggatgcacgcacagaggtaaaaacagttatatactctcatctagattccaaaaagataatgcatgcagaaatgttatttgtccttgctttaaaactttacacggaaacgaaggagccaaccaaaaccatccatcattcctcctctcccaataatctctcatctctgcagactcgccagatgctcttggtcctgcgaccctctttcctgccatcatcattattcagtttcagtcctcaacaatcaggtctaattcagctctccagctacaaaagcccttatctccactcagaaatagcatcgtgttgggcttcttatgctggaattctggatgctagaagatcctacttttcaagaattatctgtcctttctcccctacacaacgccttctctctacttcacttcaggacaatcagtagccacaggcttcggggctgagctttgactgagccccgggtctttcccagcctcactccccaccccttccactctcacaccattacctgtgccaaaatgaacccatctatgtttcccggaaacgctacagccctgcctgaggctggacctcctggcagccaaatcatacattccacagggtgtaactccaaggcgattttctccaggaagcatgaagcagaggtttcatccaagaatttggaaaaattctctcaggtattaggcacagagcatgagtgaaccaggtgggtgtctcacttttctataaacacagggagtttaaaatccgagctgcttctgatttccccactcctagtgaatcaagctgtccttactgggaaccaacgacctgcaatgtcccctcagtccacaatttccatttggggagacagacagagtgaaagaatagcttccctttccttagtctagtctgcagcatggtagcacacaaagatgagtataatggggcaaaaagggcagggggagaaaaaaaaaagaaaactgaaaatcaagtgtccaccaacaatagaatggatcaattggctgtaggattttcataagatagaaagccagaacttccaaagagaacaacagctacaagcaatcttagaaatatgattggtggatgctggtgaggttgtagagaaaaaggaatgcttttgcactgttggtgagagtgtaaaatagttcagccattgtggaagacagcgtggcgattcctcaaagacctagaggcagtaataccataggacccagcaatcccattactgggtattatacccaaaggaatagaaatccttctattacaggttggtgcaaaagtcattatggtttttgccatgatttttaatgcaaaaaggattcaggcaggcatagtcctttacctgcattagagatcatctcatgagtctaggcttattctagtatcacttttaatccatctaaaaatgccctactgggtatagatacaagaatagtactcaacagtatgctagttttcatataaaaaatgtgtttgcctgcatttggacaggtaaccagtgaaaagacacacacgaatctactccagatggttgcccaagggaggtgacagggtggtgaggggggtagagccgaaatggaagcaaaacgggcttagtggatgccttatcccatggttctaatttttgaacaatgaaatggattacctattcaaaacaatagaaaataaaattaacaaattaatgttctttcttaaataaggtgaaaactttgtaaaatatacctgaaaaaataaatactaagaataaaatttgtgagtattgttaaagtcatcttttattttattagcctaaaaataaaccaacagagtttctctgtggatgagctgaacagatcaatagggagcagtaaccttacctttcttgttcagctgcaggactgaaggtgggggcgtggccaccttcatggccaggccataggcccctcggaaggaatggctgtctcgaacaatgaatgagcccggctccttgtccttcaacatggcgatggctggagaaagggaggagaaagacaagaaggtctgccgggtggacaaaggtctatgcccactcataaccttgggtaggtcctctccccttactctttttgcaaactggatcagtggggacctggccgggatccctctgcttggctggaagaactacatgtccatgcagttgagggaccttcagggaggtctctgtggtgtcgtgtatgtttcatgggtgggcctgcctgttgaggaggcagaaaggacaggaacatccctctctttagctagactgaggtgccgggcactgtcctgtgggctgcccatggaagaacacaggatttctgttaatcccacaatacctgtgatgtccaaatgatggtccccacctgacagcccaggaaaccaaggctcacgctgagtaagaaacaagaccagatccaaatatacacaaaggggagaaacaggcagtgggagggaggctgtcgcagaacaccctgcctctgcttggacactgccccctgtggcatttttcttaaagattttagaacatgagaacatgaactctttcaacagcataaaaggaaagaagttttttttttttttttttttgagatggagtctcgctctgttgcccaggctagagtgcagtggcatggtctcggctcactgcaacctccacttctgggttcaagcgattctcctgcctcagcctccggagtagctgggactacaggcacctgccaccacgtctggctaattttttgtatttttagtagagatggggtttcaccatgttagccaggatggtcttgatctcctgaccttgtgatccacccgcctcagcctcccaaagtgctgggattacaggcgtgagccactgcgcctggccaggaaagaagtttctaattacattttctgatgatagaaagggcatacccaaaatgttactgaaaatttaatacaaattccaagattcaccaaggaagtaacaaaaacctggcctgcaggtggccccctatcccgtggctccatggctgatgtggccaaatgggcccagcctggatggggctgaggacacattccccatgtgcccgccaacccagggcctcgcacagtgggtcacccagcttccctggtgaggctggtaggcattcaactaatcataatcattgcttcaaaaaatctctctccttcatggccaaaatctggcatttccaagaagagggagtgggttagggtaatagtaacctcaactcgatactgcccagacaagccagagtgttccctgataactagactacatctcagaatttcttttctagacatttactctttattttaaaaaagggaaaactggggatttagagtataaagttatacataattacagccatggaaatgctgcctttctggaatgccaaaggctctgcctggaagcgatcagggcgcagaacatgaaccagtaagtgctgggatgcccccggcatgcctcagtaaatacctccacggcgcactcccacagaggcccctcacatgcccccaggcctgaccggacccacagccaaggcatctgtctggccataggatgaaacgaatggtttcttttacacatttttcaatgtctgcaccgtggccctgtgcacaggatgagggcacggggaggagctcaacatgcccctggggatgaagcaggagcttctaaacagcacgcagtgggaaggatgggcaggaaaacacaggcaggctcaccgtgcatgcccgagactgctggtagctccagccaggcctgcagccgcccatgcaagggacccagggctgggtggggggcctcctggggcagggcacaggccctgggaataaaccctgaattctggtgcacgttttctcacagcgtagtctataaacttgggggctgaacgtgaatgacattttttcagtttttaatttttatttttttgagataggctctctcactctgttgcccagactgaagtacagtgacacaatcatagctcactgcagcctcaacctgctgggcccaagtgatcctcccacctcagcttcctgagtagctgggactacaagtgtacaccaccacacccagctaatttttaaaaatttttggtagacactgggtctcactatgttgcccaggctggccttaaactcctgggctcaagtgatcctcccacctcagcttccctaagttgctgggattataggagtgagtcactgcgccgggcctacttttttgttttctctaagtaggacaaaagatcacttacattttgtttcaactgtgatatacctcagagcttttctttttgtaagtcatggttctacttctctgtggtaaataaagtgtagaagcctcacgggactgagactttgggcacctgtggatggcagtggagggaacacgggctttgctccgaccagttctccccatgccaggagggaagccccagctgccaggctgcaggggtgcaagggggctgtgctctcctgcacaggcaatgggagtaagaggagaattttagacccgctgtttttccaaacagaagtaggctgaggagcctggtgtgctgaagttggaaaaacgagcgtccacacactgcacacagcagctgcgtgctccaccctggcactggcatcgcattcctcacctggagacagggatgaggggaggggaggcaagtgagtctcctcgcaccttctcacactgtcgcgccctgcatctggagaagcatctggagaagcaacaccccagaagtacaactgggacagtagtacttaattttgattttactttaaggtcctcttttcctcctgaggtatttttatgttagctttaagaaacctcaaggaattaagtatgtgacaaattgcactcccaaagaggttatctgggtgttttttttcctcctgcatcaccctgaaatgtcattgtagcttttctagaaaaaggcacatctgacagttaaaatccaaataaatgacacccaagggcagccttccgctgtttggagactctgacacgggcagtagaaggttcgtctgcacaggtctcttctatgtaaaatatgtagaaaatgaaagttatccttttagagctcagctggaaaaaccaacactcgatgcacatgttggccatcctgagatggggtcctcccagcaaaccttctacaatgtgtgctgaagatcaagcacatgccaacagcagcccctacacatactgcacatccacatccacttatcctgcatctaccaggcgccagcaagggcaggtaccttccacatggcactgctctcagcaaacccccgcggcaggctcgaaccttgctaccctgccgaggaagccagcagtgcactccaacccaaatctgtctgtttcagatcccccctgctacaatgacattgcacaatgagagaagggggcatccagccccacacatcgccctgccctagaagacggcaccaatagagtggaagggtctgtgcagaatctcttaggtgctggataggcacctctcagtttggccagctggaggaggtgccgaggcactgggggccacagtcatcgggattcttgagacacaagcagggccagggtggtggcaacaggcacacagcatccggccgcagagaggccctcagccatggtgagcagtgtttcacaaaggccaattcagggaaatgaaggtctttccaggccacaggcttttttttctctctcttccacttaaaatgacaatcgcttctttgagatcataagagatgcacattcttaccatttctgtcatctacataactgaatagcagaatttcagtggagagctggacagagctatttttctgccactcaactattcatttctaggcattcctgaggcatcttcataaggagagagcttgattttcttctgaagttgaggtaaagaggcacagaggagccaagtgggtctcctgctgactgcgggcagcttgtcatttctcaccgctttaaaccaacccattccctctttcactccagcctccaccaggtggccaccgggattcactttggttcctaggaatcctgactccgtcttccaggcactggaggcatggccctgccctgccttgccagtcacacaccatctcttctgaggtatatcccagaagcaacaaactctatgcactgccaaaatgaggtatccagaggaaggtacgctcagctgagacacagcatccagggagaaaagccatcccacagccgagggaagcaccttatgaattctcctcattgcccaggggctgtctccaagcagggctgcccagaagagcttgctagccttcctctcccacatctcttctattcatgctctggtaaaaagtgatgctcaaaatattcaaatattcattgctcaaaaattagtattaatgatttcaaattagaaaaaaaaaaaaaaaaagcctgacattgtaccaagcagagagatgctctgtctggtttgtgtgtgaggcatgcggctaagtccacaaccgggtctcattattaagtgcttatgtaggtgttcacaaacacacagtgtccctgacttctcagaggagggtgtctctcctgcttcctcaccctgtcctctctggtttcatggagatgcaggagagtgtgtctcctcctcacagtcagcagttgtgggctggcatcactggcaagccagtggctggtgcaagcagccagaaattacaccctacacactggaatgctcatggctggggcccattcctcaccaactccctcattagtagtgagttttcccctataaaaacttaaaggttgtagcatgtccccaggaggcatggaataacgtgtgggccctgctcaaactcaatccatatgaaggccacggctgcccgatgttcccaccgcagggcccatcttcacacaaggcagcgaagcgggcactagggcagatgcccaaggaggccctcatcctccccacataccttgttctcttgaaatatccgccttgtaccagaacttggaagtgtcttgaacaaatttcacgatcacaagtttatcacctggactatctgtaaagcaaaatttaaaaacagtgaccatgatgggcacttttcttcttgcaacctctcatctgctgtgatcccagaagtccaaatcccatgccaagggcaagcaagcgagcgatgttctaaggaaagggaaccctgcctttgaaatgactgagttggaggaggcagtgactgttttataacacaaaacagaacaacaggatgcttggattgagcctttgcaatacattttaagaatacataggaaggtagtgaggaaagagagggtaaggttggtgttgttcaacccatagaccacactgcttcttatacacttgaaatatttcataatgacgttttggatgaattaatttaatttgacaaggaatttgttatttacaaaaagccatgttcccaagtgacatggaaagtagaaccactgcaaatgtctgcactttctacaactggaaggaatccaaggtggccaaacacagaagccaagaagagtgaatgaaaagcctgagccagtgcttggttttggacgaggaaaatggaaaagtaccccaacggctctggatttcctctccaggtgcccagcccagcactagagatatgccagctcagctgcaggtctgaacccttcccttccccagtgaatggacagaggggcccttccaaccagctggaaacacacctacctggcagaggtgaggccgcttctgaagccttggaaaagtcgggaaggacatttgggaaggggatactgatggtgctcccgctgtgcgggctggagaagccactggaggagggagagactgagcccaaagaacgatccccctccgaggcccgcttcttctcagggaggggtggctgcccgggcagggtcacaccctggccctgcaggcctggactgtggtggctgctgtgtccaggcgccaccgtgagaaagttgtgggacaggaagccattgtcggcagcccctgtcgctgtcagcgggatgctgggggtcggtgacgctccatgagaattggccagcaaggcccccaggtcctcctcgggcggaaggccacttcccactggggcggtgccgaagcccaggaaggcctggctgctgggaggcgccagggagtccggtggctctgctagggacagctcatggctgtggaaaggagcctggagctctgacggcgggaagcaggacagcactggggagtccttcctggtaccggagaactcagcgctgaggggacttccggtgggccggccgctccccagcagggaaaccatgggcttggggctgctctccacccactggcgttctgcagaagaggagctgttcaaaagacaagccgaccaagacagcatgtaaggtacaaagagacacctgaagaccagcaagcgtcacccacacgggaagacagggatggggaagtgggtgctgaggccctccaggcagcacaggaggtattttccaaaatatgtacactaaggccctctctgagctcacgctgcctgcctttcaagcccccatttcatgcctggatgctgcagcccgcatgagggcacccaggggagccgccccatgaaggcctccacatgcgcagatgctgctccctcggcccctgcgccttccctcctgcatcttcaccgggtcaaggccctttcgtcctttaagacgcagctcagctgtgcacccactgggaagccttttcctagcccttagccagcacctgtggccacatacacgtgtgccctcgggagtagaaatgccctcccgtcttgtcccacagcactaggcagggatgccacccacattcatcccccgcagccaggccgttggttcactgtgggtcccctcctcctcgcagcatgatccctctgccccatctcctttatctgccagatacaccatcagtcctcaatccatgcttgctagatgaaccagttgattaacggataccacaaagactactggaaattaccaaccacttacgagtacggaaagacagctaaaaccacaccacgtgacacacgtatttcactagcaatggaacattcatgggtacagagtctatgcgtaatgtccttaaatgagggctcctcttttattttaaggagaacagaggtagaatttaaaaagttaaatagggagctacgtgttcatacaacaaagcataaagaaacttattcctactctgagcaagtggaatggtctcacgtatgaatgtcctcaggggtagtatctttgtgaagcagaaataggccatttttccctgttaatacccaccctctcccacccccaggtctttctgtaaaccagaagccctctaagactgatttttcctgtatttcctgtatgtccctatattttctcgtatgtcaccacatacacctgtccccggcggtagcagtgtcgtgcacacagccctggtcccctgccccgccccatcttcaggccagtccctgcctggtctagcttcagcttctctgaagagcaagcccccgctggtcccacatgcctctcagcattctgggtctttaaggggaacttgtgccaagtttaaagatccatcttcttacctctctctcctctgcccagggccgttgctggaaatggtgcaggaagaagcaaaagcctgctgaaaggagggcgtcgaggacgcatcagcccggagcatcgtggatttgggtccgatggggctctctgacatccccacagcgtgagtgagcgtctcagggcagcttcgtggttctgtagcgggaacacaggaagcagagagacctcggttgtaggactggagaagtcataatctctgctgcttttgcatgttccacaagaaacagtgctgactttgaggctttctgtcatccatggccatactgaacatgacatcactacccgtaataggctggaggaggcggccagccctgcacccacaagcatgggtttattctcacccatcactgtttccaaaaataaagcgacctaattcagtcccccacagtgtccagcccattaccacgagctggtcatgtgaggagatgcacattgggccgcctgggctggtcctcccagccccatcccccacaaaggctgatgtcctgtaatgtactctccactccatgatctaggctgcacctcactttagaattggcatggcctttcctctgcaaaccagcaggcgacttctcccaataaagaccataagtgcaggccctgcggcagccgggcggcctaggtgtcctccaccttcctttggtccctaccctccccccagctggtaactgggccatcaacatcgagcactatgagggtgcaaacccatgctgctgctttccaggtcaaaccccgctgcttcaaaggccacaccgtggggtgcagaagccaccctcgcaggtgggccagaacgcaaacctgcttgtgtcccatgcctgagcccaggcacattcctctgacagaatttctgtttggtttcttgcccagcagctgcattatttctggatatttaaaacatcttaccttttatattttttctttttttaaaccaggcttcaagaaatggacaaatctaccatggtcagtaaaataatattattagaaatactggtcagtttgttttctgtttcaaaactaatgaggattgataagagaatattaatgtagaaaaaaactccatattattcatttcctggagagggtattgaaatttagagatttccaaataatgctgttttccctacaactcacaggactatcacctcacatgcttgaaatatgtgttattttaattatactgaaaaaaaggctaccttctttacccttcaaatgaaaaccaataataaaactgaataccagaatcacactttataaaaatgacatttactaagaatactctgaaaggaattatcaacagcatatgtgatttctgaagatgaaatacctagggggttttcattaatccaggtgccaatgagcactggtctgtggattattcagaccagtgaggaattatatccaaaaaaagcaagggaaagccctgaccactcaactaaattacctccacatacaggatgtaatatcctggttttttaaaaaaaattgatctctacagaatttgcactatcaattcacaaatggaatgcacttcactccaatgaggtaaacaagctccatctctaccaagacagaatgaacattctaaaaattatatggtatccccacatatgtgaagtgaagcacttttttggtcacacgtcatttcaatatgaattaaaaattactatttttatttagcacgaattcttttcctaaggaaaccttagagaatttttttttttttggagacggagtctcgctctgtcgcccagactggagtgcagtggcgtgatctcgactcactgcaagctccacctcccgcgttcacgccattctcctgcctcggcctcccgagtagctgggactgcaggcacctgccaccacacccggctaatttctttttgtatttttagtagagacggggtttcatcatgttagcaagcatggctacgatctcctgaactcgtgatctgcccgccttggcctcccaaagtgctgggattacaggtgtgagccaccacgcgtggcctagaattttaaaatatattaatcagcacacaaaatgtctggagttatgcctaaattaacaactatcctaagttatctaatagaccttggtagagaaaaagtgaactttaaatgtttaatttttcatgaaactttaaaaaccacacctttatatattgaggtataactaatatacaaaaaactggatatgcttaaagtaaataattcggtcagtttgtcatatgtaaacgtccatgaaaccatcatcatgattgagataattaacagttacatcatcattccaagagtttcctccagccccttctcctgctcatctggtttatgtcactttgctttagtgtgcatttcctaaaattctacatgaataaaatcattcatataaactctttttttcctctactttcacttaagaaattattttgagattccgccacattgtagaatgtatacatagctcattgcttttcaacggtgagtacttttccattgtatggacatatcacattttctctgtccatttacctgttgatggacacttgggttgttgccactatggggctgctacatataaagctgcaatgagtatttttagacacttttgggtgaatacctagggatggaatggctggaccatatggtaagtgtctatgtaactttttaagaaaatgcaaagctgcttcccagaatacttgcagcatttcacatccccaccatcaatcctgcccctacttggtatggttggcatttcgaattttagccattctagtgctggcgtagtggtataacactgtgtttttaatttgcaactttattaattactaatgatgttgaacatctttttgtatgcttattaataggcatttttatgtgttctctggtaaaatgtttgttcaaatccttttcctttttttcactaggttgtttgctttcttaacactcagttgtaagagttctttatatattttagatgcaagtcccttatcatatatatgatttgcaaatatttcttctgagtctgttgcctgtgcatatattcacttaagaatcttttgaagaacaaaatcttgtaatttaagtccagtttatcaatttgttcttttaggaatagtgtgtttggtgttgtatctaaaatagtatctgcctaatccagtcacaaaacatgtttttctgttttcttccaaaagtgtaatagttttggaagaaactataaacataagcctatgatccattttcagttaatttttacacatggtgtgaggcatatatatcaacaaagtttagttttttaaatatggatattcaatggtaccactaccatttgttgagactatctattcttcattgaattgcttttgtaattttatccaaaatcagccaaatgttaaatccatctaggttatttttcatttcagacactggagtttctctctccagtgaagtttggtttgggtctttttatatgttccacgactctacttaactttttgaacacattaaacatagtaaaaataaatgtcttaatgtccttgtcttaatgttcataatcttaacattagttttgtgtcctcattagttttgttttgctttctctcttaactatattgctattttcaggcttctttgattgcctggtaatttttgattgaatgccagacactgtgattttatgtttttggatgctggatatttttgtattcttataaatattcttgaactttattctgggatgcagttaagttgcttagaaacatttttatctttttgggtcttgctcttcacatttgttaggaaggcctggagtcatgctccatctagtgcaagttatcccccactactgggcaaaacccttctgtatatcactcaatgcccagtgaatcttgatactttcctctcttgctcatgagaacaggcactcttcccagctttgagttagcactgggttagcctctctttccaatcttttcatttggttctttccctggccttcaatgtccctaatgtcctcctacccaacgctcagttgaatacgtatggcggatcctctgcagatctccaacagctctctctctgttcagccttctctccatcctgcaagtcattgtggtcccctggagtttcaactccaaatgcccaactcagagtctcccagattctgcgtgagtttcctctccctgccttacacctggaaactttgtctaggcggtaaactgggacaactgtactgtcaccatgtttgtttcttacttttcagggatcgttgtctttcactgcctgatgcccattggcttggaagccattatttcatatagtttgtccattttttgtttgttcagtcaggataataaatcaagtctctgttactccatcctgacctgaagcatacatctctaatctttcatatttaaagacgaacaattcactgaaattaaagttaacttatcaattattcaataattataaattattgaaaactctataaattaatatccccaagacttaagagtatttaaaatgaaaaagagcaaaaaaaaaatatgctatgagagtatgtttaaaacataactgtggaataataaaaatagctcaacaagccggaggtttgtgtttgaatttaaagtaatttgttttacctttctcagtttaccacctcaccgataaataggattaatactgctacccaccacagagggttcattagtaggctaaaagggaggatgaataatttacacaaatgttcaatgttatggctaaagagaaagaggttaaacagatgtttatccagtgaggtagaagaagccagaatgttagattgttcactgcaggtcgtcaagaaaggtggaaaaacatgcttatcaacaatcttggagacattacaatctgtaaacccttatctatcaaagatggccacatcagctgcatcagctcaaagccagtactagaaagagagagcatgttaattttcagttacagtgcaggagttaaacttccactaaggacaattatgaaagctacacaaaatactaacaacaatagtttgaacccattcagatcgcccaaggcagccagggcttactgggccaaaacctccagggaagggagcaggagatccatggccatttttccttctcagacatggacccgtttggaagcatgtggtataggggccatacacaaactagcagtggtaatcacactgttctggggagaccaagtttggagttcagagctaccaaggcaccagttctggaagtgccaaggtctcagagaaatgaggactgcagagacagagtcaacactctgagcatgtttcccctcaaggcatttctgagtcctaagtggcagaggtacagggcccaatgcccagtaaacaagacaaagccagctgctacgaatctaaaaaagatcagcagggattgtggcagtctcttagtggatgctaagtaaccaaaaacggcagttcaagatgcacctaggaagaggggcctttgcaaacaccacaaggtttcaaggtgagacccttgaagggctacaaactagaaacaagaggaccatgacaggatctgattaggcagcctggaagaaaaattatatcctctctaaagaacatgcctcccccacccagagcctgactttgtctatactctaaaaatacagtatcaaatatttaattgtaaaaaaatgatcatcaatgccaggaaacatgacaaatgaaaaccaagactgccaccaccccacacacagaaaaaacgcccacagctagttcaaaaattgatgttaaaagccacagatactaacataactgaacagaatgtttaagaaagcagaagcaaaaagaatttcaccaaagaactgaagtccattaagaataatcaaatgatgttccctgccctgtgtccaggtgttctgattgttcaattcccacctatgagtgagaacatgcagtgtttggttttctgtccttgtgatagtttgctcaaaatgatggtttccagcttcatccatgtccctacaaaggacatgaactcattcttttttatggctgcatagtattccatggtgtatatgtgccacattttcttaatccagtctattattgatggaaatttgggttggttccaagtctttgctgttgtgaatagttcgcaataagcatacgtgtgcatgtgtctttatagcagcatgatttatagtcctttgggtatatacccagtaatgggatcactgggtcaatagtatttctagttctagatccttgaggaatctccacactgtcttccacaatggttgaactagtttacagtcccaccaacagtgtataagtgttcctatttctccacatcctctccagcacctgttgtttcctgactttttaatgattgccattctgggggcagggggagggatagcattaagagaaatacctaatgtaaatgacgagttaatgggtgcagcacaccaacatggcacatgtatacatatgtaacaaacctgcacattgtgcacatgtaccctagaacttaaagagtgtgtgtgtgtgtgtgtgtgtgtgtgtgtgtgtgtgtgtatacatatatatatagagagagagagagaaagagagaataatcaaatggaaactctagaactcaaaacaaaataaatgaaattaagcattcagttcatgattttatcagcagactaaacacagcaaaagaaattgtgagtgaactgggagaaaaataggaagaaaatatgcagtctgaagcataaagaggaacaagactgagaaatacacaaaagacagtaagacatgagaaatgattcttaaaaattctaacatacctataattggagtccaagaagttgtggagaaattgaatgaggcagaggcaatattggaaaatatacatactgagaatttcctaaaagactcaagaaatcaagccacaagttaaaaaacaaaacaaacaaacaaaaaacctaagaaggattaataaaaagaaaattacacataagcacttaatagtaaaacttctgaaaaatcaaatacaaagtctgaaacacagtgccttgtccattttgggggaaaggacgagacaccaatttccgcactaatgttttcaacatttaatcatgtttccattatagaaaagcccagtactaatgttctgtttgtatgaacatactgttaagacccttgggaatggtgtgtctgctgcacccaactgtaaataccatgaccatctcaaggccaggcctggcaaatgctcagtttgtgtcatgaatacatgtgcacgttttctgctatgactgacctgtaaatccatagagcagatgcagttgtgtgactgaccgcccctcctcccagtatggcccacaggaaatgtcctaaaataagtgtttgctgaatttattatttctttctattaaagctgggatagaaaaacaaagatgcatggagtttaaaaccatccctctgcaccctcacttctattcccagtactaagatgacttatctccatttgtgtttgtccgtatttcttttccattaaaaatgtctttgctggggctgggtgcggcgggtcatgcctgtaatcccagcactttgggaggcgaggcaggcggatcacctgaggttagaagttcaagaccatcctagccaacatggtgaaaccccgtctcttctaaaaatacaaaaattagctgggtgtggtggtgtgtgcctgtaatcccagctactcgggaggctaaggcaagagaatcacttgaacctgggaggcagaggttgcaatgagctgagatcatgccactgcactccagcctgggcgagagagcaaaactctgtctcaaaaaataaaaataaaaataaaaaaataaaatgtcagggggaggggggagggatagcattaagagatatacctaatgctaaatgacaagttaatgggtgcagcacaccaacatggcacatgtacacatgtgtaacctgcacgttgtgcacatgtaccctaaaacttaaagtataataataataaaattaaaaaataaaaataaaaaataaaatgtctttgctgggcaccagttttccactaacatggcctacaccagccggagaacggaagagagaaacaaaagcgaaacagggagtgcctgcgtgtcctgcttgtgtcagccagatgagaccatgtgcaaattactactgcatggaggaacatgtgaggtgcagctcttgagctgcaggaggacccacagggagacttgcttcatctggagggagcttcatctgaaggcttcctggagcaagtggcatttgatgaatgccatcctggaaggatgggtggcatgcattctgacaaaaccacctcatgggttctttgcttattgggcaggggccactcctgccattcactgctgtgtccccagcactgggctggcacctgtaggagctccatgtcattcacattgtgaattaatgaatgaactagcaaaggcttagaggttagagggagaggttcagagcatgacgtggaaatactgctcaggggtctggttcagaggagtaggtggacagttggttgatcagttcctagggtctcatgccaagaagcagcacagaactttggaataaaaaaaagtttattaatcaagtttaatatgcccaccttatggttggttggttgagctttcaaagagtcatataagagaggagcacatacccagcacagcatgcagtacctgtttctatgactgacattgctcttagtggttcccacaaagccacgggggcaatccctggtgcttcacatccctgtttacagagtccccgtgcctcaaggctctagaagaccccatgccatgactcagaagccctcaatgcactcccatggcgcctgggaatttcaccaaatgagaagaggctgaaggaaaataaaatccactttgttcctgttatcacagtgcttgtcccagaaaacagcaagcccagcaattcccatgaaagtggctttgtttatcattcaattagcaccaactctggggcactctggctgtgtagttccctctgtcagaccagttcctgaccgggtgacaggacttaaccctttatttggagaaggggctgctcaaagcatcagattccatgtttatcccaaggacttcagcacagggagacttgggcttcctgggccatttctcctgaaggtccttggtctttgcctgtgctcagagatgcaagtcggctaacagagtgccacacagctcaatgccacagcaattaatccacttattagatgggccttggcattcccagataagttgggtgagtgtcacatcttcaggtcagtgcagtcacttccagtgactgggactgcagacagcaaggaggatgctgacagcagctacactttacacagaacctacaccctgcaggcgctgtgcttggcacctaccatctccacttcccttaggtctgcacagctcctcgagatgtgcccatgcttaacggaagaggagagcgaggcagcgggagcctgggtccctttctaagtgctcctctgcactgtccctgctgagcatctagcaagcacagaacaggagccggcagggctgggggaggtgcaccaaaaatcgtatagtcaaatgcaccagtcaagtgaggatgatctacctactgcaaacccttttgcatgagttcacttcatttctagaaatgtggctcaccataagaacaggcagaattgttgttgttgctcaacttgtacatttgatgttcacggttaaactaccatgaacatttttagcaatgttaaaaatgaggacaggacgtgggctgagctccttgttgtggggcgatcaggtgcctgtatcctcagctctgtacctagaagagcccaggagatggcccggggtggggatgaccggggtgaggagcagatgggatttgcaccgtcttggacaggggcatctgcggaggcattaagcccgctgctctctccagagccctgcgcctgtggcagcctgtctctctgcttcagaggtggagacataagggcaccacagtgagcataatggtccctcaaagcaactacatggagggttttccggtgcaggccaacttctactaaggcaaaagccgtcttcctgaggccatgcacccctcccctatgaagatgtgtttccacaacgtgggaggctccagaggccacacagggatgctgtttagaccgtgtgcacgccagcacagccctgccagccacagccgatcttgggccctgaacagacgctccttttagttccagcatcctgctggctcggcctccttctgcccttaattcccacaatattctcacattttccctttgctgctcagacccagagcaggaggcataataccgttagtgtgtggaaacaacactcatctcactttctggtattccgcctaagcagctggtgtccctggtgccctgcgggggtgaggtggccgggaaggctgctgctgcggggcagccccccgggaccgggctagaacttgggaggcgcgtgcccgtcgttctgggacttcaggaatgtctatgctcctctcctctcggcttccacctccttcatttcctttacccagaacaagggtgacagagggtcacgggcccttttccaaacgatctatttttatgctctcatccaggcttctgtgggaagctggataccactcattctccaacggccactatttacatgacatataagttaacaggaagaggagaaacccacggggctcaggcagggccactggctcgctcttcggaagccttagagcctggccaaaacctgcaacctaaatgtgtaaggagttgtcagacatattaaacattcatgagggatccaaacatcaaagttcatcctcaggaaccataacttacttagcaaaaaatcaggacatgtgacattaaaaacaaaatcagcattttcctgtgttcccaatttcccgtgttcctgataaggcataaaaattattcactcatacatcaattagtaactacaaatcgcctttgaatgttttatatcacctttaatgaaaaataaaataaatttagctgaggtcaatattatagtctcctatccaagtgaagaaacttgagttttgttaactacctaaaaatacagtctcaatctttggcccataaatacacagtcatattcacaataaactttcagaagtaagtgagactatccacctaactaactatttctctctctctctctctctctctctctctctctctctctctctctctctctccattctttcctccctcctagtcacatcccgggattattatgcagttaaataggaagtatctttttccattatttgagagagttctaaaaaaatggaacatcaaatctctcgtatccttcttccattacatttctaggcggggaattggggctgctgcagagaaacagctcagatctccaagttctagcctgagctcttctgccataaaccatggggtgttgggcacattgtcaacccctggggccttcaggatcttcatttacagactcacttcaattgggatcagattagatgatttctagggtttatttagctaggaatttttaaattctaatttagaaaagcaagactttgtattggagtttcctcagtagtgattagttttatttttttgtttgtttgtttttgttttttttttttaaagtccttatcttcactttgggaggccaaggcaggcagatcacttgagatcaggagtttgagaccagcctggccaacattgtgaaacaccgtctctattcaaaatacaaaagttagccagaaatcacttgaacccgggaggtggaggttgcagtgagccaagatcgtgccactgcactccagcctgggcaacagagcgagactccatctcaaaaaaaaaaaaaaaaaaaagtcattatcctataattcttttgttatttgtctatgaacaatcaggccatttaaccaaccttcttgaaagcaaagagaaaatggcaggcagccagatataatgagaattaattagtgaccaccccaacactggaaaagcattttcatggtttccgatgagaatcaaagtcctacagatacaaacaaacaaacaaaaatgatgaaaaacccacaaatggataaataaatactttcttggtgttgaatcttttctttttaaaatcctgatgtcaacataatacaaataatatgaaatttgttctacagcttaaggtcaactgatttcagcaaatatgagaaatgctctcaaaaggataaattgtttctgtctttttaaaggaagcaaggttcttattcccccagtgaagccagaattgctccagccagggctgaaatgggaatcctgtccaccaaaagccgggtgacccttttatgacattctcatcacaattggaattatccccttcaaaagagaccatgccacagtcttccttttaagcaataacacaaaaggaagtagaaaatgtagatgcaatagttcattacagttggagccctattttctcttattctttgaagatgtcccatttatattcaaggttttgatcagactggaaagaaaacacatttaccagtttagttggtgttgtgtagagaattctaatgttgaaacagtgaaaacagcgtttttcttcatagtgagtgtttcccaagcagtttttacacttgggatgcactaagtgaggccagttcctccagggactcacatagtcccttagcaacctacaagggatgagagttgtaaaaaaatgtgctttggtttgagttctcaagaaaacaaatgacttccttccttctagactttaaagaaagatgacactgaagtggagctactgaggctgcctagagaccacatcaagcctgcagacagagccaacacacagctgagaagatcagggtctagggagtcactggaaataaatgtgtgagagagacagagagagagacccacccgctgagtggccaaggagtcctcatgaagccaaatctgaggccacagccacccacagctgctcagtgagtttcgttatttttctcaaattgtgataagacatacataacaaaatttaccatcttagccatttttaagtgtacagtgctgtagcatcaagtacattcactttttcgtacaccaactatctccagaactttataatcttacaaaactataactctttccccattgaaataatttcctatcctccacccaagtccccaccatcccactttctgtatgtatgaattcaatgactctagggacctcatgtaagtggaatcatacagaatttgtcttcttgtgactgacttacttcactgaacacaatgtccctgaagttcttccatgttgtagtgcgtgtcagaacgtccttcctttttaaggctgagtaatattccactgcatgcatagatcacattttgtttatccattcagctgtccctggacactcgatagctttcaccctttgactttgcgaacagttacattttctcctctcttgttcctttagccagtttgagttgggactggttacttgcaacaggaaacagactcagtgacacaatgtccttgcctcaaagctgcttccagtccagtgggagtgcaaacagacaggaatgcaccagcacagggcagtcaggccagggtgagggtatgcaaagcagcaccagaaaagaaaagagccatctgaccctcctcagggaagctttccttatgctgagccaaaacaaaacaaaaacaaaaacccacaaacagaggaagtattgcccttcacaagcagagagagaacctgcataagaggctttgagagccctgggctgattatcatgatggagaatggaggttaccataatgtatacaccacgtccacacaggagtggacagcggtcagagaaagcttcaggcagctcaagatgataccggcgagggtctatgccaatgaagaggctgtacctaagatgcttggttccaagtctttagtccgcagaataattccagtctcataactggacttgtccacaggacaggaagtcttgatgttttctgttttcaggcagaattcccagagaatctggctttcctttagaaacggcacatgggacacagatgacatgtgctgaactttgccacagcccttctaaggaaaggtcactttagcctggtggctcaacagctgaagtcccgaggagtcctggtccaggatcatcattttgtcctacaaccactgtctgagtccatgtgcaccgctatataggaacaaccgaggctgggcaatttattttaaaaagaggtttatttggctcacggttctgaaggctgtagaaaaagcatctgcacctggtgagggcctcaggaagcttccattgatgtgcactctgcacaccctcaccctggcctaaccaccccatgccagtgcattcctgtctacctccactcccactggacttgtgaaaggaagctggcatcacatggtgagaggaaggcgagagagagagagtgagagagtgatagagagagagacagagagagagagagagaggaggggaggtgccaggctctttttgacaatcagttctcgtgtgaactaacagtgagaactcactcgttaccatgaggacagcaccaagcccttcatgaagtatctgcccccatggaggggacaaatatccaaactgtatcaatgactgcaccatggaagtctaaatcacataaggcccagggggagaaacctcccctgtaatctcagaagtctcttaccatgacttgaaaaccttattctatgtggcagatttcaatggacctgaatagaatcaaagacacccttaaaggacctgcctgtctaagaacccctgtggcactcggggcatctgcatcccttatgcccaccagcccatgtgccagggaccacaggcagctaatgggggtttctcatgtagtttcagaaactggaagactgctgcttttgagagaatatcactggtcagactctaaccaggtccctaaccaggcgttgccatcttcacccagtatttctaaagcgtcctgtgagcaatgaggaatgcaacactgggaatcctgtgttaggtaagaattcgaaacctcagcttcacttaaacccttcactcagttaacaaaaagatgtactctcattgcagtaaatataaacagagactcagaatgcattttatctttgttcagaaaacataagttatctttataaattatcactattttactaatagtgactatctgcgcggtgctcagtgggcttacttgaccctcagaacaactcttaaaggtgtgcactctcgtccatctatacctgtgaggaggccgaggcttcagcacttcccctcacctgcacctggagggaaacacacgcaccacccagctggagcaggactcaaacatgattcttgggtttcccacctctagctcattagcacgaacctcattccttttccttttcactctgtccacagctctgtgagttaagaggaatcctggtattccacgagttgggagtattagtcagcttgggctgctataaaaaataccacacagtgactgaaccaacagaaatgtatcccctcccagtctagcagctggaagtccaagatcaaggcattggcagggctggtttctcccgaggcttctctctgcggtgcacagatggccatcttctccctgtgtcctcacatggtcttccctctgtgtgtctgtgtcctgatcgcccccttctacagggacacaagtcatgttggatgagggctcaccctaagggacccactttcaccagtcaccactgtaaaggccctttctccaaacactcacatcctggggttcgggttaaggcatcattcaacataggaatgtgcagggggtggagggagtcacaattcagcctaacacgaattgtgtgtggtttggggagatgcagcccctctataaatggcaggagagtgacataggccctacttcagagttctcagggaatctgccaagttagggcatgaaaggtgtttacagcagggcctggcccctggcaagcactcgaaagatccatcgcgacgaggaagaaatgaaaactgacatgaggcatgtggcttttgaggagaccacacagactttctaatgtgtcccttctgactcttggagcatgggaattctgaccagcctgaggcaggactccaggaggagccaattgtgccagaaaacctgcatctcatggggccctgagccagcccgaggagggagatgatgcggcttcacccgccttccttcttggtcccgattctcctctctttgtgtttttgtttcactaaggtttccgattcataccatgcctaatgggtaggctactcactttgctgatgcaagggtctcattctcaacccactggttttcggtggtaccattctccttcaggctggctctatgttcttcatgggcagcgtctccacggtcatgcaccatgccactggcttctggaccccgaaggtgctatggagcccagctccattccactgagtccaaaactcacgaatacagaggccaccagcactactgaaatgccagcagggtgtgtcggcatttggagggccttccagcaaagctttgaacatgctataattgctccaatataacaagtgatgttccaattaataagataatttacagcaatccacagtctctgccacaggtggttctctctccaagagggctgtcccgggacagaactggacaatgcttgaagctctcatctgtccctctgcccataattactcctgtctcataggaaataaatttaagaaataaccattgtgctctgaggggaaggagggaacaaacacttgggagttcagaaagaccttcgctcaaatagaccaaattgtcctgattttactctacattgttttcttcccccaaagaccatccacttagaatgcacaacacaatataaaagacctccttgtctacagcactcaagcctctctctaaccagcagttcagggagggggacccactgctgaagcttccctcctgcccatcatccaccaaggttttcctgatgatgaacattcactgaggacttcccgaccctcccagctgtcctggaaggaggagtctcattggcattctacaaaaagattaaaggctaaagaactgtaaaagcatcaagcatccctcagaactggtccctcagccccaggaccagggtctgggtacattacatagccttgacctatagaaggaagctgatgcaacagcaaaaccacaaaccaatgggaaagcacatgagagtgaagtagaacgggcaaaaaaaaaaaaaaaaaaaaaaagcaaaggccaggtgcagtggctcacgcctgtaatcccagcactttgggagactgacgcaggcggatcacgaggtcaggaattcaagaccagcctgaccaacatggtgaaaccccgtctctactaaaaatacaaaaattagccgggcgtggtagttcatgcctgtaatcccagctactcaggaggatgaagcaggagaatcgcttgaacccgggaggcggaggttgcagtgagccaagatcgcgccactgcactccagcctgggtgacagagtgagactccgtatcaaacaaacaaacaaacaaacacacacacacacacaatcaaaaaaacaacccagtgaaatgaaaattaacaaacataccctaggaatggaatgttatgattagaaaaagaaaaaagaaaatggtttgtgaaagcctgtatatgacgaacataaaactgaggggagtgcctaaatattctaagttgctgataatatttaccatgagtcgagtgcagtgctcaagctggaaggactggagaccccgcagaatcacagaagccctacccggggcatgaagccctctaaagccctcaagagcagcctgcctccgctccctgattccctcttacggaggccctcggtggccacggaccctgctctatctggcacatggccagtagcacactgctggaaccgtgtcagaggtgaggctgtgtctcattcactgtcacatcaccagggcttcctacataggaggccagcagggaggggtcccctgctgaggattcattgcatggtaggcaccccgtctccagcccacctgcagctctgcacaccctgggccgaccatgcagccagtctagggctggaggtaccgctcctcgaggcctcatgtgcccagtccccagttgctttttctcacggagccacatttctgaaatctgtgcataccttttcacccacagtgcatcctgttttacctggcactgttttccctatcttagtgtcatataaaatgacagcttttctgagaatccacctatcttcgaatcttcaaaagaaacccaaaccaaagaggccagaaagaagtggcacatgcttccggtactgaaagaaaagaactgtcaactgtgaattctatatcctgcagaaataccattcaggaatgaaggaaaaataaagaaatccagagatgaaggaaaatgaagagattttgttgtttgcaaatgtcccagtagggaatggccaaaggaaattttctaaacagaatgaaaatcataagatttggaacttccaaaaggaaagaagaatgttcaaatgagtcaaagtaagggtaaatataacagtccattcttctcatgagtttcttaagtcactttttatagttggagcaactagcagacatcatcacatgtggtactcaccataaacggataagatacttccaacaattgtactttaaaaatggggagggtgaagaaacttaaattgaagtaagatttctatgctacgctccaagtgataaaataatacaagtagccataaataatgacaagttatgtatataccaagagcgaggactaaaaaaactacagggagggatatactcaaaaatactatcaataaataaagacagagtttcccctaaatgataaataaatccacagtaaggcaggaaaagagaaacagaagagcagaagacaggaaggaaaaaatccggaaaaacgtatgcacccggattttctactaagaatttatttgacattgacatccttggtccatctggaactgatgttggcatgtgttataaaagggatccattaaccttttctacctggcaaacctcagctctatttatgaggcagctcctctttcccctcctgacctggctgcctgttttgtctggcaccaaagttccaagcatgtgctggtctgttttgcactttcatctgtttgttggtcaatttatctgtccttgtaccagctcatgtttaccgaattttctatctttgtggtaagtcctcatttctagtagttgtatactggctactgagaatttttactttattatataaattttgaatcagcttatcaagttccacaaaataatctgctggcactctgactggaattaaattaagtacacagatgaaattgggagggtccaacatgtttgtgacattgtcttcctatccacaaacatggctttctctccatttatttttatctttttaaatgtctcttaacagggctaggcaaggtggctcacgcctgtaatcccagcactttaggaggcggaggcaggcagaccgcttgaggtcaggagtttgagaccagcctggccaacatggtgaaaccccatctctactaaaaagacaaaaattagccgtgtgtggtggtgcacatctgtagtcccagctactcaggaggctgaggccagagaatcacttgaacctgggaggcgaaggttgcagtgagccaagatcatgccactgcactctggcttgggcaacaaagtgagactccatctaaataaatgaataaatattttttaaaagtctcttaataaaaactttgaaaatctttgaaaaactttgaaaaatgtccctgttaagaaaaaaatagtgtctttttaaatagtctgcgcataactgtataattcctgtatcccttcaattgtcaccaagatatccttgacttgatttcctccagtcaagtgcagcatgagctacaaaggaaactgggacttttctcgtgatgataaatctagtaggcagcagaagtgatgggaccactgggaaaactatcaagggaaaccagacttggaggagtcagcttggaagcatgatggaccgtgtggttttgtgtatccattactcccatcaacagatgcacaaagaggggttcccaagacccacatcttccagaagcaagccttatctttggtcccatttccttcttacctccacagagcagtaaatgagttccatagcattctagaagcttttctatctgtacttggtcactcaagaaagccaggcatcccactggtgaccctcgtcctcctgccagctgagccctcattcctctatcttccactccacgtttgtaaaaccctgtttaactttaatttacttgggtgacccggtacccacctgccttctccacccagctatccattctacctgaggctaatcaagaatcatatgtccacagagaacactgctcaaggaaggccacaggccactctgctatctcgtggtggaacgagaagttgacattccagtgatttcttagtcctgcgttcttaggttatctcctggtaaaatcacagtgagcaatgggacggagcaagaaggcagagtgtgctgtgtgacggggaccttctggtcccttgactcttactgtaaactcattctgtttacagtccctcctgataggagggagaggccacctgtctcaggtgagcctaatgtaaacaaaatgggcatggtattctcatcagaccacaggacttcgagccatcccagacctgtgtctgacagcagtaagaccaccttccatgcatcacacccaccaggcttcctgtcctgatcctacatcaactaggcagcttgattgccttggatgttattttttttaaagacagggaagtggaaacagaagggtagaggagagaaggtcaaagtgcgcagcagttagaactatgttgatgcatggtcctggctgcaaactgcctttttagaaccatgcggattatcagatcccagctccaaccacgggagctttcactgtgcttttggagaaatgttgccatcagtacaggtgccaatctgaatgtcaacagcttttaaatcacacagctcttgggactgttgtaaaatcctgtttatatgacacatatcaacttttcatataaagaaagtaaaatggaaatcagaattacagctccctttctctgagtgcctactatacaccaggcactctgctaacccacacataggtgttatctgatttaatcctcatacaaacatttccacatgcaaatcatcttatggatgaggaaacagattctgaaaagtgaggttaagaagcttattcaaaggaagccaactcatctgttggactcagaaaactatgttctttccacaagacatccctgcctcccaccagcagggtctgagtcagaacgcagaatgtaatacaattactctgcccctacaggaggacaaggaaccttctgcacaggtttgccctggggattaggaaggcacaggtactctgggagcaacttagagccctgtcactgaggttcccccttagagtgcaggaagccccagcagaagacagcaccaggctccccacgggccaccatggctacaggttggccaagggagaaaatcacccctctctcgaaataggtggaccaaaattcttttaatctcacctccaaagtcagaaaactatgtccgtcctaaccagacaatctctaatacactgacacgcatatggaattcatgaaaaattactaatgtatataaaatacattaaaaggacaggaaacttttgaaaagatagcatcttccatcagctggagagcaatccatcaatcctggaagggatactgggcaagattttcagcctgggaaggagaagctggaccttgagccacttgggcttgtctcagagcggctgcagtgctcgtttcacaataaagagctctgggttttcccctcgctccctcttaatcttccccatccttccagctggaatacacacacacacgctgtgtcggctgcagggccagcagaatcacaggccagccacgcagaggagggagcagatgcccaggaggcccaccctgggcccaggcgccagccctgcccgtgctacccccagtgcctggctgactctcccagggtcccacagagccccagccccagttcagacatttgggagggaagggacagtgaagaaacaaagcccctaggtccagaagctctgttaacataatctgagcaggttctttcagtgaatgcatgggtttttgtttttgtttttttcaatgacatgaactcgtttagaaatactctctttgcttgcttcaaccacagaagagacaacagtaaatctcattttagaacccagcgcctgatcctaacgcttgctttcggcatttagtagaaacaactgtgctgggtgctcagaagtgcagccttctggtcctctgaaggtcctgctgcccgctgcccgggatccctcaagggccctggaactggggtgggggcggtgacagccctggaatggggcaggctcgctttatcagtttcagtaaaggaatgcactgtgctaggaagcagtcctgttccagaaaagctgcacatctgtaaaccaggcttttgttagccctgagtgaatctcagcaaagacaaagcatgactttcttctggaaggactagccctccaggctcaagggctggggcgttttgtcccaaagccttggcgacttgagaactgtcatcaagtgacaaggggactcttggaacaatcagccctcctcccaagtcctgcccaggattcctggcccagtgacctctgcatcccacctcatacccctccccacccccctccactggagcccaggagatcaagtttcagcaagggcaactggatccgggccagaggcgccaggagcacagaagacaccaggcgtgtagggactgagcaggaagaagcaatgagtcccaatgtacagcttacctggcacccaggaccctggtcagtccatggaagggcctgggaggatgtgggccagacagagggaactccttgggctgtgtccccagcagccctacgtggtgagcagagtcccgagtccctgtcccagcggtggcgtcccccacccacccaggcagggctctgtgttccggcctgtcccgagggagtcgtgcagggggcggggcggccacctccaaagaggcccattcagagggcggccgagagagctcaggcccgggaaagaatcccgggattgttgagctgctgctggctgtcgcgggcggcctgcccagtcagtgcctccagacggccctggccccgccttgctcactgctgcggtttgcttccttttcatttcttttcactttttcctcccccaactttaatttcttgcaacctccctgctgaaacccaaccaggcttagtttcagcctcaggccagccatcacccaaggcacaagcggcaggacctgcccaccatgcccccaaacctgcccctccaaaatcaaacccccattcccctgggaccccacactcacagcagagagaggcttccagcaactagccagagaggaagtggaagcctgaacagtctctaacaacaaggatgtccctagtcagtcctctgccccccaccccggcaggagcctacacccatgtccctttcctctggatggggccatctgcctctcatctggcctggccaccaggctggaagcctttcactcctcaaggcagcccaggggaccttccaatgcaaatcccaccctgtcactgcactgctcaaaccctgcaggttttcttccgggccccaatgggctataacatcctgcccaaaccctgtcctagagcctgattctggatccctcagcctgttctgcctggctggcacctactgtaggctgttggcagcctctacgcactgtgtcccctttcttccatgttctttgctcatatgcttctctcatctaaaaggccaaactcctaagccaactgctgaaaaactcctatacattctacaaagcccttttcaagtgaccccacatttttttcagcatttggaacaccatctccctcagtcaagtcaaagtgctctgttcccgtgacccgaaatctgactataacccagtccacatggcagaacataggggcctgtcatgtgtctgggccttagagacacggtacattactcagggttttcacaaggggaagcacagaacagacactcactcctggcttctcttgtctcttgtgtctggcaaaatcccactccctcttcaaatgctggtgtgtcaccccttcccctagaaagctctccctggaagagcaggtccccgttcctcctgggctgcctcctttcttacagcccctgtgcacgcctgtgcttccagcacagcttgctgcccagcctgagccgagccattggccggtccagcccctgcacgaccctggcacactcatcaacctgtgaagagtgggcaggtcaatgccctaccccaagagggacacggcttgcctgggaccctcagggccaccgctccgcacatgggccaggaagatccctgggaccttcctcccaaaggtctgagtaggcatttcctccctggttgtttatgtgttgcagagcagcagctcctgcaaatgatgctgtcggaaatgcctgaccacggacagagcaggctcagcggaagcggatggactggcctttcccgtgcctgtcactccccaagcagagaggaaggcggcacggggcggcaccagcatggggcagccaggcccaggaagggtgactgtgaccaggatggcactcccaagggtgggtcccattccctccgtggaactgtgggctcagtgactcggagcaaacccacagggatgggcagcagggaggaggaggcagggcatgctgcttctgtgcccgtgtcacagccatgactgggacaatcctgagtgtgaatctacagatttaagcatcttctggagatctgtttatctttcctctcttgcttctttctcctcagctgcagtgccagggactaaagtgatttcaaaggtgggctccaggtggcagcaagtccactgaggaaaaaacatttaaaaattcttcccggacagtctgctccccccacccaaacacccagagatccccggggacgacaggacctggactgtccacatgttgactctgctacagccaggaccacccactgcaccttagcaaaatcaagcaggggtgcaaatcagacacctggaagaggacagcccaccccaccagccggcaatgccaggtctcctctcagaaacacaggtgctggtctcacgcagctcccactctgcgggctcaggccctttgcaggcatgatgcactcagctccctggagctgagagactgtctctctccttccacttacccatcagaaaacaaaacaaacttttatccagatccttctctgtgttagatgccaggagtgtgatgaagactctgctctggaaatgtcctgaggctgagggagggagggtgacaccaaatcccaacccaggtcccactgggaagtcacatccttcaaatgcaggtgagagcgaggcagcagaaacaaaaggacggagggaaggtgaagcaaggagggagaggaggaacagagggagagaaggggcaacaggagtttccctttcggaggaagacacaagcagacttggttgccagagggaggtgagaaaaggggcattaaaccaaggagaagggaggagctggggcgcccagagaagacacacgggaagggatgagcaagtttaaaggtctcgcagcctccatagggggcacgtccttcctgagacacgacctgatcagctggatggaattctcccttaacaccctcccaccagcccgcactgcctgtccaccagcctcacgggtcctacaggggctgcatcccatcacctcccacatctctgtcccaccggactcgggcgaaccttatgtgtgcacacaataagaggaaccctggaccagccctactcccagcgatcaggtgatctgcaggtacctttgaggactgggcacatgacttagcaaaggaacttcagatgctttatgtgaaagctgcctcaaagacggtgccactcctgcaaactgtgagtctctctactacatgcaaggcagttctcgaaggcctgggaaggatagtcagggtgacccacaggttctgttttcagcaacaggctctgccccaataaaacaaaactaagagggatactagaatgcctccgagggaccaggcactgcagactgagatcctcagctttattcgaatgtacttgtttgttcctgagaattacgtgctggccagcaccccagggcgagctctactctggggttcttgagactcaagtggagtgctcacttgggcattgcggagaaggaattaaaaacaaacacaaaacacaaaccctccacaacctcagcgacactgggacttcacagtaacccaatctcatgctcctctggaaaaatcaaattccagtgagctgctcacaccatccctctgccaggtgacacatggagacctgacctctgacgcccatcgcacacttggttggccctgaagcatcagaaaagtttactttcattccaaatgatggaattctcacttgcctggctttcaggattttttgtaaacttgttcatttgctctttctctacatgtgtgcatatataagtgcatggcctgtaagaagtgctcagaaagtggcaaatgcctcaatctaggcagagccataaatacctgcacacataacacacatatgtaccatataacatgtctacatatgtgtgtcactaaaatgtgatagaatttaaacagacaacaaggtggttcctggcctaagtaggacagcctggccaatgcctatctgttgaggaggtacactaatctggggggcaccttggtaatgccctcaaaggctctgatggggcaggcccgggccagtaacaaatgtcaagaagcagactacatattccttcttcagccctctcagtgactcaagacatctgacccttctgcaagtctcacaatcccagaccctcccaagtgtgtcaaaaagaatgggtgcattttggccaggaatcacagcctgaagggacagtggtaacaggtgcttcagagaaaatgcccaggcattttacctcttgacgcccagtgctcttgggacaccactgtgaggcaggctgctgtctagaggggatggaactgtggggaggtggattacaaggtgagggccttcggaggaaagtaaaaatgcaagggataccaggtaaatgcttccagcagggaaacatccttgcacattttatatgctggggcttcataagcattttcttccaagccattcccagttctaagaggcatcctgctgggctgaactgccttttcctgttcaaagcagcgaggaggagacaagcccaggctcaggcccgagctgtggattccggattccacaccagccacaggctgcttcagaagggaccccagcccgcgagctgccccagggccaggaccgcctcccttcctcaatcccgggatggagcacaattctcatagacaatggggctcagaaaatgcttgaataaggaagtgcattttgaatttaaaaaatgaaattttaagacaaatttttgttacactaccgtattcacaggctgaaattttcatttttaagagacttcccccaacaccatgcatggcacacatattcttattttacttagatttaaaagatgctttcagaggttatgcaaactgttcaagatcacagagctacagacgggcaggaccagagccacatctgtcaccaagccccagggccagcatcaaatcctgttagcagcacttcagaataacttctacatgctgagggtcaagaacagtccaccaggagaggagggggtaatggaatgagctgataaataaatttagaaaagcagattcctctaaacccaaagtgagcaaacgagaacattcagcatggtagagaagtctgcaggctgacatggggacacttccaagctggcctgctccgcggatgaggtgtcagcacagaaagccaacaccttttttttttttagcttcatcaccctcaaatgaattcatgttctcatctcaaaagacccctaaaggcacattcacaggccagcactttaggctgacctccacgaacccagcactgatgtttacttttaaatataatttagaagcagtcaacttttctttttcatgttgttcatctggggcaggggttggaggaggctgcgatgtttgctaatccacaccagttttttggggtcaccatgcaccagtgtgcattctttggcactaattggaatgcaaagtacatcacaggcatgtatccaggcatgtctattcctatgcacacttacatatgcctacgtacctgaatataaacccatggagaaatccatataggaatgcatgtgcttttgaggctctagaaaatccaaagtaaacaagggcctctataaatgtcacacatattcacattcagtacatgcctttgtccctattataaacattctcattcagagctcataaaaattcaacagaaaagggagtcgagtacaggaaagaaagaagaagattggtaaaagcattgtatctgtcaatttttgaaggatgacagctttttcaataaaaataaagcattgtgtcaaaataatctctctgtctctgtcttcctcttgtcctcttctcacgctgtgtctctctatcagtccctggggctctgaaactatttcaataagaaagtgcattctgaattaaaaaactaaattttaagacaaatttttgttacactagcatattcataggctgaaatcttcatttttaagactgcccccaataccatgcatggcacacacattcttattttgcttagatttaaatgatgcttccagaggttatgcaaactgttcaagatcatagagctacagagggtaaggaccagtgccactggtactgcccttttcttcctccctgtggcaaacatcatgaccctttgaaacctaccaaatccaggaagtccgcacagcaccaaccaaacccctgtgtcccctcttgtgagccaatgaggaccacttcacatgctaccactcctgatcagtctcatgcactggcacttggatggaggcaatcctcccagcccttcacaaaacctccaatcgacagcagagaagaggctgcatgcttggaagccaggcccctaaaatgcctacaccctactctccagaagaactgaacacaaaatagaagttgcaaaatatataaaggcatcctcttgaagtaaactaacattaactgctaatctttttcactgaagcctaaagtccccaaaccccctctgaataccacttgtaaagctgttataggataaggatgctctggaactacctaggggcgatggtctcatgactccgtaaatctactgaatgctggtgcaatgttcaccttcaaatagatgcttttatgttatgtgtttatatttttaaaaaattatgaaatagtttggaagctgagatgtatcagaaccacgactcttttttttttttttttttttgacagagtctcactctgttgtcaggctgcagtacagtggtgcgatctcggctcatgcaacctccgcctcctgggttcaaacagtatttaaatcctgcctcagcctcccgagtagctggaactacaggcatgcgccaccatgcccagctaattcttgcatttttagtagagacagggtttcaccatgttggccaggatggtctctatctcttgacctcatgatccgcctgccttggcctcctaaggtgctgggattacaggcatgagccactgcgcctggcgagaaccacgactttttaaaggaaaccttttctcatgtctttattattcatttgttttgaaaatatcatcaagattaaggatcagctaagaaacagaataatttacatcttacatttcataattttatctatttttgcttataggggagacttgagattaaacgactcccattgttacatttttacaaatatttttgttttcaagaaaagcatgtccatttgaggctcccatgtggaatttctgagaagcctaaggatactgtcctccaacacatggctcctggggcataatgtggccatgtggcaatacattcaacagacggacgatggcgagggctgccactgacgctcccgcttgagggccccaaatgggtgaagcctggttgggcccgtcctcataaagctggaggcattacatcagtgcctacagctgctctgccatctcctgctcctgtccccagtccttcatgctaatcacaacctcttttaaatgacaacacatccctaggagaattaaacagtatttaaattcatatttaaatatgcataatgtgagcagatattgaaatacccatcattttcctggagtaggtgctggcatttaaaacatgagcacactgggcacaagcacatctctgggaaaagcaggattcccagggctcagccacccagggccagatgcccaggggccttctccgtcccccgactcatgctctgaacccagacttacagttgtcactggtctccccagctcagggaaccgcccttcatatggatgctctgttctcctaacagcatcagtgtccactatttgctgagtgttgatcaggtctgggccaggagccagagctacatgttctggtccaatcttctcaagaaccatgtgcagtaggaatgactactgttgtacaggacatgaaactagggctcagagaggtccctagaactgcctgagctcacccagataggaagtctcagagccactatatgtgtgcatccagcatttgaccagagagagaagaaatgtcaggagaggacccaccagacaccactctgccgtgtccttttaggcctccctatctgctgagagatgcttcggacagcagtttccaacagctgagtgttgttatcacagagcttacttgagcctggcaatgggactagaatccaaatgctgaatgcggaaaatctttccaaatatttgaatgtcaaaatgcagaaagatctctttggtcacttcagcctctattcttcatgactagttagctaacaccaagcagagttaaaaaaaaaaaaaaaaaaggcagtgaatttctactgtttggtgtgtcagggaagcttggggccgatggaggggttgattcataacgtttgctaaatcctgtggtgtaaacaatcccgccctggcagatcccaagctgccaatgtgctgtcagctggctcacaaaattcctcacacttcagcaatcagctctcggtaccagcaggttctggcaagccccagctttgggcattcatcccccttggcttctgttagtcacattatttggaaaagactcctttaattcacccatctattaataaatctagagatgttttggtttgctttttgtgtattctgtttattgtttattgaagaatcgcttgtttgtgagaagggtgggtgaaggatgcctgtggcagaagctggccccagctggctcccaggccacttggcacggaagccttatggctaaactaagtgcccataataccctgttttccatgatgtgattattacacattgcatgcctgtatcaaaacatctcatgtactccatacacacctatactatgtacccataaaaataaaaaatagaaaataaaaaattataaactaagtgcccaaaggacctggagagaaacacagagaagcgtgcgggctgcatttggtcaccctattgcgttagcctggatacagatgggtctatcttgtgacagactctccttgaccaaaccttagccaggctcctccaagccctcttctccactaggcctcaacattggccttccacgtccaaccgtggcaagctcagttccagcaagaatcctgcttttcatcccccacacttgatatctaatcccccttgacacgtcatcaagctcctcatccctcgccatttgtgtctaagtccctggcctgtctgtagcagaaaccgtgttaggccagtttagcaagaacccccctacccttgatgtcccttcttaatgactttccatccaccagatccttttgctctattcctcggtcataaatctccagctgtctttgctgcatttggggctgagcccagcactttctcctgttgcaataatcctgaataaaatctgtccttacagcctttaactaactgggctatttctcttggacacctatcctggtggttgtctggaaaagaacttaacacatggggcttatgctgactaaggaggtatcaagttatgttttagtaatgcgatctgcagaggaattttatggagatagtgttatactaactgcatactaattaacaagaagccagaacctaatttaaacaataatgacaaaagcaatacaattagaaagagcagtcaggctccaattccactgtgttaaggtcagctgattgcaccacctgaatcctacacaaatgttctgatttcctcctatctcttctgaaaccatttggtctgttccagcccactgtccatcccaccgtgttcttcatgcagcagccacagtgatgtgtgaaaatgcaaatctgagcagtcacctccccatcctgaggttcagtaatgacctcacattgcatgtggatgccacaccaccaccttctgggaactacagagaacggctcctggcctggctccaccttcccgacctcttactccaccactcttctgccaatctcctgttgcctttttggctactccattccccttctactcttgcccctcccaaccattagcagacatgaatctcttctctgtgtctacaattttgccatgtaaaaagtgtgacatatatggaatcatacactatacagacttcaggttttgacttttctcactcaacctaatgttctagagacccatccgggttgttgtgtgtatgaataattcacttatttttattgctgagaagtgttccatggtattgaggtactacaatttgtttaaccactggcctgttgaaggacatctacagtttggggctattaaagtaaaaagagttcctgtacaggttttatgtgaacataagtctatttctttgggataaatgcccaggaatgcaatcactgagtcacatggcagatgtaggtttttcatttttaagaaattgccaaaattgttttccacagcagctgtaccattttaacaatccctccagcaacgtataaggggtctagtttttccacatgctcaccagtattggatgttgtcactattttttattttagccattctgataggtgtgatttaaatttatattttgctaatggctaatgatgttgagcatcttttcacgtgctcataagccacctctacgtcctcttcagtgacatgtctctttttttctttgaaccattttctaattttttttcctactgaataaaaatccatttatttaatttagtcagtggcttttctttttaatttcaacttttattttaaattcaggggatactgaatttgcttaggacaatggcctacagctgcatccatgttgttgcaaaggacatgatttggttctttttttacgtctgcggagtacttcgatggtgtatatgtcccacattttctttatccaattcactgttgatgggcacctaggttgagtccaggtctttgctattgtgaattgtgctgtgataaacatacaagtgcatgcgtctttttggtagaatgattttttttcttttgggtgtatatccggtaatgggactgctgggtcaaatggcagttctgttttcagttctttgagaaatctttaaactactttccacagtggcttaactaattcacattccctccaacagtgtatacatgttctttttctctgcagctttgccagcatctgttgtttttcgactttttaataatagtttggctcattttctaagtgaattgtttgttctttactgctgagtattgagagattatatacattctagatgatattcctttttttggacatgtggtttgcaaaccttttctcctactctgcagtttgtcttttttatcctcttcacaggttctttccatagcaaaaatgtttaatttttataaagtctaatttgtcaacttttccttttatggttcatgcttttgtcctaacctcataactctttgcctagtgatcccaaagattttctcccattttaaaaaatactatgttttacattttacatttaagtccatcatccattttaagttaatttttgtataaagtgtgagcctttggtggctgttcattgttttgcctgtgggtgcccaggtgcccccgcatcatttgttgaaaggctgaccttccccgacttgcttctgtacctttgtcaaaaaaatcagctgggcatatctgtgtaggcctgtttctgggttctctactctgtttcatgaacctaagtgtctgttcctccatccacaccacagtcttgatgactgtagctatacaataagtcttgaaattaggtaacctcattccttccacttaattctttctcaaagttgttttggctattctggttccttagcctttccacataaattttagaattatgttgtctatatctacaaaaaaatcttgctgagattttgataggaattgtggtaaaactgtctgtcaatctggaaagaagtgacagctctactaggttgagttttccatccatgaaaacagtatgtctccccacttattgaaatattctgtggtttccttcatcagcattgtgcagttttcagcacagaagtcttgtgcatggtttgctaggtttacatctaaccatttaatttttttgagctattataagtggcatatatatatatatatatatatatgtatacatatgcgatcatatgccacctctatgtccttttcataaatatatgtatacatatgtgtatatgtgtgtatatatatacatacgaatatatgtgtgtgtgcatatacatatatatatatatatatatatatttttttttttttttttttttttttttgagacggagtctagctcgtcgccaggctggaatgcagtggtgcaatcacagctcactgtaacctccacctcctgggttcaagtgattctcctgcctcagcctcctgaatagccgggattacaggcacgcactgccacgcccaactaatttttgtattttgagtacagacagagtttcaccatgttggccaggatggtctcgatctcttgacctcgtgatctgcccacccctgcctcccaaagtgctgggattacaggcgtgagctactccgccgggctgtgacttatatttttaatttcagcttctacaggtgcattgctagcgtactgaaatagaactagtttttgtgtgtcgaactagaatcctgcaaagtggctgaatttgttctaacagtttcactttttgttgttgttttgttgttccctgggattttcttttttttcttttttttttttttgagacagagtctcacactgtcgcccaggctggagtgcagtggtgcaatctcagctcactgcaagctccgcctcttccctgggattttctgtttggacaatcatgtcagcagcagactcaagattccctggggctttctacgtagatgatcatgtcaccagcaaaaagggacagttttatttctttcctctcatctgttgtcttaatttccttttcttgtattatgtctctgtagaacttccagaactatgttgaaaaagagtgctgtcagctgtggggctttttagatgctttttgtaaggttgaaggagtacctgtcttctattttgctggaagttttgagtcatgaatgatgtgaattttgccaaactctttttattctttttttggattgactgatatagtcgtgagctttttctttagcctgttagtatagtgtattacatgaatgaattttcaaatactaaaccagccttgcatctcagaatatgtcccatttggctacagtgtgtcaatctttttatatattgctgtgttctatttgtttatgttttgttaaggagttttgtatctgaatctgcgagggatattggtctgtagttttctttttctgttctttttgcctggttttggtatcagggtaatactagcttcacaaaatgaattaggacatgatcccccctcttctgttttctggaaggtattgcgtagaatcagtgttaattcttctttacatgtttggtagaattatccagtgaaacctgaagatttcttttttgggagattataaattactaggtcaatttccttatagttacagggtattcaagtagtctatttcctattgggtgagttgtgacagttcatgctcattaaggaactggtctatttaacctaagttttaaaaactatgcatgtagagtagtttgtgtattccttcattattcttttggtgtctgcagggtctttagtgatggtgcctgtttccttcctaacaatagtaatctatgtcctccatttttttgttagtcttgctagaggtttgtcaattttattgatcttttcaaagaaccacttctttcatttattttctctattacttctctgtatctttttaaatttctgcttagatttttattatctccttccttctgcttgccttgggtctagtttgttctcctttttctaggttatggaggtaagagcataaactattcatttcagaattttcttcttgcccaaaatttcctctcagtgcggctgtattaaagcagtggataaagccatgtctcacaatttttgatattttatcctcattttcattcagttcagtatgtttttggatttccctcgagacctcttctttgacccatagattatttataagtgtgctgttcagtttccaagtgttgaaggtgttcctgttgcccttctgttactgatttctagtgagtccattgtggttggagaacatgttctgcatggttcagttacttttagtcctctgaagattgtttcctggcccatagatattataaataaggcctaccgggtcccttggccctgaagtccatggctagctggcctatttctccccatctttcagagctttcttatatttgtcttatacttactgtccaaggttttaagttgtacttagcaggagaaatagagaaaagtatgtctaattcaccctccgggaagtgaagcctctccctaatggtattttaaagcaaatactgtcatttatatgcacatcagtatctaggcctaaatgatacgcagttaagcattactgcagatgcctaaagcctactacttcaaaactgcacagtggctgtgaatggcaggtactatagtctgcatttttagataaggaggtggaggttcataggggttacctaaatgtacaaattacatggttattccatgactgtgagactttccatgtgctttttagttgtgacattaggtcacttctaggttagacaagacaaagtgaaacatcagccctgtataatctgcccatggctgtggagtcggctgatggagctgaaactctgactttgccacttactagctactcaacttcttcgtgtcaatttccttgcctgtaaaatgggggtaacagtaagagtgacccatagaatgtgactgtgaaatggaaggaaatcataaagatcaggggacacattctgtatgggcgagctacctctgttattactgtgcccttggaggagtctcacaactccacttgactttgcagagtgggtggggcctcctggcaagggcactggctcaccacactgtctgatgaaagcatccactaagtcagcactgtgttatctctgtgctccttgtgggctaatgtgaagttgaccctccctggggactgctgaaataaaaatctagaaggctcacattaatattgttatcatgtcacctttttatatttaaaggcaaagccctgacttcttctgtgtgaatatgtacatgcagatagtactcaggacaagttgaagccactggaatctaacacatgctggtgtgcagagccatcctcatccacacatagtgcagcgctcatccacgcacaggacatggagctcatctccaggctgggacaatcgggccagcataagacagccaggccactgggtaccccacgctgagcacccaggcttcctgcagcctcctagacccttctggagtttagacggggctccacattctcttatgctcaatacagtgatcttagaggcctccctcaggagctgttaatgagtttgcaggctgtttctagtattttatttcctcaggcttattacccaccttccactgtttgtcatctacctatttcaaacaaacccggttttggtgttgcaggagaagacaggattccaggccagagggctagatgccagcccaaacccactgaacactttcaagctaggagccaagtacagtcacctccatgaggaggaggggttacatggggtggaagggacatccctctttctgcatctattgaaatgataaaaaatatagaacagatgcatggctacctatgtgtgagtccatcatgctaatgcatattggaacatacacacttctcatgtaatgctcacataatgtagacattaaaatgcagcttattttaaatttcagtagcacttactgagaaatacaggcagtataactgctatatgctacatatgaagagagcaatttatggtcctgaaaccataaagggaattttaggagaaggatgtctttctattacatagtccacaggcttggtttactatggagaaagagagagaatggagctagctgtcatgatcacaacactcctgggtaaggggtagatgaaaatacaagttaatgaaagtctcagtctcaggtaacgtgcctaataaccattaacagcagccttcactagggcaaaaaagcagcagcgtaatgaacgaaactcccagagaagagtgattttgaaatgtgcacgagctttaggtttacattctctctccacctgcctgagctcggccttgtcctggactctcaggcaagtcctcaagtccacccagaagaagtgcacagtaactcgccctaaacaccgcccactaacactctctcgcctgagccagctatgcagacagacggacgcgatcaggccatggacagagcccctgagttcctgcagagatccagggacagtgattaggcacccactaataacagacaggaggggccacaaggtacgtgtgagaaggcagctggggtggcagagctggggcgcccgtgcggcacaatccccacagagaacgtgaagtgtggggtgggcattctcgtttcttcaaaagcaccaatgctaagctgcccgacagtcaccactgatggtcccatcaactgcatattacaggagggttccccacaggatgccaggcagcgatgcaaggccaggttgccaccacacagtggatttcacggccacatccctacatctttcccagcaagatccatcctcatccaaggcttctgagatacgacacaaatggaaacatttctgcatacgagttcttctctgtaaaaatggcgaccccgcgatgcagcgcctgagtgccgcgcgcctgtgacccgcgggtagatttcttaccacgtcctcctttgtgctgactggctgggctgctcagcgggggctcaggtgggctgaacggaggatggcgcagcgctgttttcactggaaaagaaagcagagcaaggggctgttgtcaccctccttgggcatggagcagcacatgcagctagtgttacttcattcttaccatacggtgtctctggagacacaggaaatgctggagttgaacacatggactccttgctacttaaaattctgccatcgataatatcgaggtcctggggatagccaggggtcatcgtctgaaattggcacagggagtagaatgtgagaacagggagtcaagtgaaggcccctccaaacagttgtggttgtggctcccccaggctggcccactgagcaaacccctcctctgacagtaggacaaggaggctgaggtctggatccactgcacaaaaccagcccgcctctcctagccatggaaaactggaaaacactttcaccttcaacagtaaaggaaacggaaggtatcttacggcccatccttctaatacaatatacagctaataagtgaagtagacagagtttgtaatggtacaggtaaatgagtatctcaatattaagcgaaaaagctggataaaacagtccttacccatggtattaatatattcacagatgcataaaaacacatagtattttaaatacatagcacagaaaaaaggccgggtggaaatattctaaatattaacagtggtttcctttgtgagtcaagactatgaatagcttttttttcttgtgaattctgtagcttccaactttgccaacttgaaaagaaatcccacccaagtctaaaataattaatcgttttggatacaccgacctgctttacatccattctgactagaagccttacctaggcctcttggaagagcaagaagctctcatctgtggccctcatctgtgggtcacctcctagggaggtctcggagggaggactgaggaccctgtgtgagtgtgatgaccctgaaggaaggctgtgtgtgccactggctgctgctgtcgggctatggagaatggctaaggccaggcctataagagccctacctcgaacccacacaacccacccacatgctgtgctccttgtgcccattctacagattagaacatagaggctcgagtgccctgagtgaggtggcctcaccagcatagctatctctggggtgcattacccaggccagctgactgcacactgtgctctcccagccacaccgcttgccaggtacagaggagccacgaccatatttgtgaaaccaggacggaaggtgggtgcggaggataatgtgggctgtattcagggacaaggcctggtcattgcccattcactcggggttccaggacaagaaagggagtggaatgggcccagaaactgggacctggctgtggcacatacctctttgacgtccgctggtgaggggaatggcggcaggtttggggcatagtccacaccagcctttccccatgcacatttggagaagggcagctgccccccagcatcgttgtcgtactgccccaggctcagcttcctgagtctcccgcccaggggctgttcagcagaggagcctgttaaaagggagacaagcaggctgcagggcgcttcctcaaggcggagtgaggcgccccttccttaaatcttgcctgctgcttctcaaaggtgctgtatgctgcatcctggtcaccactgctctgggaagatgctgtggttgctgaaggcagctgatgggaaacccagggcattctcagactctcagggatgaacaaggccacagccttggaaatgtgcagcttccccaggccagcatgctccttccagaacaggccacttggagataggaccaagcacccagactcactctcagtgctgggaaaggacagtgcccggatggaatgctgggtgggactgacgatgacccagctgggaaggaggcccccacatgccacccctggtgtcctgtcaggaccagagtgccctgaggaccacacacctgcggtgaccttgggcagagcatggcccgactatgataatttgaatcttagcaatgagaaattctggagagggaaaaaacctattatttcaagcatcaacaataaatattcaccatcccaatctttccttgccagaaacaccacaggcggttattcctgacacagatccctggggtccccactcttgaccaaattctgttctttttgtgttggtgaaaatgggggtcgggctgggatctaattttctaaaacctcttcccagggattcttatcatttggcagttaggaaaaacctgctgccggctattaaaagaggaatgtttctattgatgacatagtctgaatatgcaaacccaacaacactgtcccctacagtttagatttaaactataaatacatagtccctgtaagtgtagagtgcagagtagcatttcactgaaagatggagtttgattcataaacatgagtggcccacataaggctcctcttagaatgactttgttccaaattggttgatggccaccctccaaaatacatcatgatagtgacatacagtcgtgctgagtccatgatatgccactgacacctcctacatccagagacttcagaagctcacaggaatgcaaaggtcggcatgataaagagaaggttccacagagagcgacaagacatcaacccaccatgcctgcctgagaggagcagcaggaccgctgtaaggtttcttgtttctgtctgcagcatgggggggctccactgcccgaccctaccagctactagatgccattcaggtgaggcttaaggaggctcctgggctgagccaggctgtacaccaccctccctgtcccatgggacatctgctcagcaccacacaacagcgaccaagcaagggagatccaaacacaggtccttccaagcaaccttccacctcttccttccatcctctcttcggttcccagcagctccctccacagatccagggaaagaaggaggaagaagtgtgcgttaggacctgggatttggggtctcacgtgtatccctcaccagctgcaggacatcctcagcccccatttctttatgggtaaaatgagcataatgcttgctctcttttccctcccacaagggggaggattaaatgaaatgaaatggcatatctgagagtcctactcacacagcagcccctcactacagcatcctcatccccatggtgcagtggtcctcatcctcacactcaccaccctccacaggacgcaagtgctgcaggccagggaggggaccaccctcactccagtgctcttcaacacacacatgcatttgcagccattccaagaatgagtttaaagagggctagcagaggtgtgaggtcacaaagttgggctggccccacgcaccacctggtactcagctcagacgtggagtttgttcctgaagcagtcaaggtggcaggcgatagccctgggtgttagtgacggaaaggaagtgtcatggccacagacaagtgactgagagcctggtccccttcctggaaaaaggagccatgcagctggcctcaagggaaatcattccaccagggaggacctatctttggagagcaccaggagctccgctgccctgtactgacattacagtccactcactgcctagaacttcagaggtcacttctagagaggtaattttcaaaggggagggaatagtacttctgttcaacatgcaagataatatgtggtgttttatcaaaaatgacatggcagtatcattccaacatgcagtgttgcatgaagaacacagaaaaaatggctatgcaaatcaccgatttgagcattgtacattgtatacatttatcaaaatatcacactgtgccccataaatatgtacaattattatgtctcaactaaaaatagtaataataataaaactgtggacagtgtggtcaagtgttctctttgatctggagaaggaggatgggaagtgcatgttaacgcactctgatctcaggcctgaggttggaaactcactggcttcagaaactgaggtcccattagggttagctgacaacagccagcacagccttgcagctgcactcgaaggcacaaccaggtcgtaacagggtccgaaaaggaatttccaggactaaaacataagtctcaatgcaggacgcttagacttcttctaacctttcaacttggaagtttccttcaacatgtctcctttagagcagctagggaatacaatctgtgcatgagctgacacagagccaacagtgggctccgttctgggcctcccacaccagaggaggctctgaaacacaggcattctgtgagctggccccagaaatgttcctgttgaacacatggatttgaaactgttcctcaattctctctctccccaaagaattacaacgaaaaacaatgttcttcattcaaaaagagtctcaaaaaaaaatcaatcttcatttaaaaaaagtctcaaaaaaaatcaatcttcatttaaaaaaagtctcaaaaaaaatgttcttactgtcccacctccggtgcttgtgctcaaatctgtgtggcaccatgtctggttaagcagaactacatgcctctccctctggatggatcaatacttctcagtatcctgccactgggaccaccaggagtaagatggtttccacaatggagggaactcagcgacggagagcagctgtgggtctgaggccagaaagaggctctgcaagcgcaggaagaatgggggagtcaaggcacctgcaaaagcagggccaccgggccctggattccaggatgtggcctgtacagaaagtgtggcttcagccctgcagggtcctgctttccattcccaaaagggaaaagacacaggcacacaaggtcagcaaggctcaggcctctgtggggtgtggagatcccttcctctcggactgcaaaccttggaaatgagaagtttgaaacgccaggaaaaaacaggacaaaatgagacagggtttaagatactgcaaaaccactacgtgctaggatgcacccacatctgcccaggaggtagttacaaaagaaagaaaaacaggagaccaacgtttatccagcaacagtgacagtctaagcctgggcaggtgctctcatagagaaaagcccattatcactccattaaggcggcctgctacgtcttttttgcagacaaggagaatggaggctcaggtctgagtactcatcctacaccacacagcatgtcagcagagagcaatgatttgtcaccacatgtatctgactttaaaatccacaactgccaactctattcctctgtggtcactcttccttacccactggtgcctttccttcccttccatcccttcccaccccaaaaagcctacacggggcagacaggggccccatgagccctgggaggcactgcccacttccactgcctgtggtgacagaggggcccctgggaacaagatggctaccctcatcctgctgaggaaggggcactcttcctcccggacatgtcctgatggggcagccagcaaaggcttcacaaattcttctgtctctcgtgtgaatttcagatttaacaatggtttattcttcccagtcttaggaaatctgccaagtgtctaagtaaatacatggggtccagcagagaacctggtgggggtgcatttccaaagggtctgagtgcacagcagtctagagaaaaggaaggagggacagttttcaagttcttcccatctgagagtccttggctacggggaaggtcagagaagaagagagagggcagcttgctcaaggcgttgctaccgggctggcgggagctgctgttgaacccatgtcctgtcaccagcagtagatgctcactcagaggccagcccaggggccacttggcaggggtggactctgcctctctgctcacaggggacgagtcctcaaagccatctccagaatgaaataagaacaacacaaagctggcttaggggatcctacagataatgcagcaaaggctggggcttggcacacagttgcaggcagtaagtgttataatgggccacactcaaaatgggctgttcatgttgtcattaaaagtcaagtttatggaacttgaagtggacaaacacgctccaacattaagtgacaaaagacagtgggcaaagatgcatgtgtagtgtggtttcatttttattttaaaaactaagaaaatgtcctaaaatgctcataagagcttctctctgggttgtgtaattctaggcaccattcatattttttcggaaatgtttctatctttcagggttttcgccagtaatatgtattactttttaaaattagggaaacaacacacagattaccttcgagaggaacaaagcttcttttattttgtagtactctgtgctgctgtactgaatttccctaaatcccgttctaattttgcattagtattagttcctgtattctcccaaactcacgtgtttgatccttacacttttccttctctctgataaatctcccatgtctgatagccatatgaaaattaatgtgggaggtagttttctggaccaatatgctcagaggagatgtggaagtgacattctcatttatagcgagcagggcttatgcttcccagaggttacaatgcaaggcgtcctgcagcaggggtctctctctcccttctttaattattcaacagaggggatctcggtgctcctttaattgttcaacagagacccaaggcaggcccactagctgtcttcttcaggcaagacaacttgaacgtgagactccacgctaggtccaaggtagatgcccaggaagcccagtagtggaacagaatccagtcaaggctccggtgccacatccaagcccaggacgttccaccaggcgctgcctccctttaacccgtgcacaacgtctagggcagagatggcaatggaagccaggccacggcacctatgtctgctgtgtgcaagaaagaaccaaggaaggccctagggcacgggtgcaacagcgagcaggaactaagctcagagtggggttacaaaacgggctcctgtccgtgaagaatggaccacgctaggagtgctccctggagactggagctgcccctcccacacaccccgcacctctctcacaggaacacacccacatactcacatgcacacagtcaaactctcatgtgctcccagtctccggcactttttcacacccacacacttgcagacacatgtatgaacactcactctcacgtggtctcttacacacattttctcataacactcatgcagactcagccactcatgcatttgcacacacactcttacacccacgtcacacacacctgcatacttcacactcttagtctctcacacactcttacactcacacacccttgcactaacactctcacccacattcacacaacagtcacaagcagacacacacactcatgctctcacactttctcatatacttacactatactcactggcactcacacacgtgcagtctctcacagtgtttttcatgatacacacattgtcacactcacattcagtctcagtcttgtacactcacagacagcctcacacagtctcacactcattctcacactcacactcacgcacagtctcacacgctcactcacacccaccctgtgctccaacacggccccacagctgcatgtgctgctcacaaacggatggtccgtgatggtggagggtcaggttctgcattctgaatactggccccacctcatcaccctgtatctgcaaacctcacacctgtgtcaaacaagcccttctccccacctgggagctgcctgtcaggaagccagggcgctggctgttcctggaggtccgtcctttccatcctggccccttctccaggacgaggccacccatcagcatctccactgtagaggggttggttcctggctcccttccaggggcagatgcagccaaaggcaccctcttctcactgagagctgcccctccactcaaggcccccagatcctcatcccatctactgctctgactagcccagcccctgggtccacaggtgactccatggcagtggtgacttgcgctgggtctcgagtgtgcacacagagcccacagcccatgtgctacaccaaagttacaccagggacttccagaaccactcttttcatgtggctacaggtggggcagaggtgggagaagcaaagcacttttgcttcacactctgatgtctgggtgacctatgagaggccacagcttggggacatttcctcaggcggttcatttgctagctctggtacgctgcctaccaggatcaatgctcacctctccagagaaggtctgcataaacagcaagctccgtacctctgcactgccagctcagagagctcttggattgctttctgaggacagaggcagtagcagccagctgtcccaggtggggacaaggatcaggtcttattcagctccaaagtctgtccaagctgagacaccctgcgggttcagtacttctttgctaagtcggtgagctctgaaggggtgaagaggtgaggggtgaacaggtgagcccaggccacaggttaggagccctggcgctgaggcactgacttctgaattaaacccaaaggaggccctagcacttggtaaaacactctctctctaccccaaatctctcttccaaagtgactgatttatggttttctttagtatgatgttctatcattgcagaagattagaaaaacacatagaaacatatggaagcaaaccaagctccctggaacctgtgaagagccacatatctcaatgaagacacacatgacttttacatttctttttcctcactgaggcttaattcctgagcactccccgagggaatcatttaattgtttgagtccatcaattacttcttacacacttcacatcaatgtgaaatgaccagcacctgaagcagtctcttcctgtcccctagcctccctcctaccacagcccagcacccctcctcctccaccctcctcagctgccctggtcttgcttgggaccacaaggggcctcaccctacaaccatcctatccttgagcttctggtaaaactgcaggggccagcagtgtagcctcaggtctcactccgcaacctgcagccctcccactcacacctgcagaaaggggaggtatggccttcaccaagaatattacattatatgcatcaaaaggaaacaaacaaacaaacacagaggacaaaacacacacacacacacacacacacacacacacacacacacaaattccaaggtacgacaaagaactggccgtaatgcaatgagattgggcagtttgaacaatgaaatcatgaattgaataattatattgttaaggcctattctccaaacactactacaaaactgtccatgcctatatatttttctgttcagttaagaagtcaaatccaggaaaagagaagaaaaaggagacctcatgggagcaggagagagctgccaccacacagatggctgtcacctctggaaggagctgataaggggacaagagggaatttgccagcactggagagcacctgcagggctctgggcgatccgccctcccacccccagctccccaacgtaccccttctcagaaaaaccaaggagaaagggaacaaaacccaagctcccacacagggatgttcacgggcaaagggcagctcccaaagccctggggtggggcaggggggcacctgcatctggctgcacccatggcacacacaccctgatctctcacacctgtgcccaccctgctcccagcctgaggcccaggtgctggggaagagctgcccttacttccctgccagttcccagccaggaaaaaaaaaaaaaaatcctgcatcctctccttacaaaggtcatgagtactcagtgcagaaatctcaggccccttgaaacccccagtgaacacagaccccggtgatctgcaggtgatgtgcagcttcacccactccatgcagctggggtctctgtggagggagggacaggcagtggctttttctttacacagtcttgtgcccctcttgtcgcggtgacacgctcattgtccaccaaaacatgacatggtaacatggtctccaaaggtcacatgactggacgctgcccatctctttgggcagtccccacaccaggcatttagctgtcttcgcccaagcctccttccctccagacactgggtgctacccacccagagcctcgggaaccacgtgaccttgagtataaaatgggacacatgccccaaagtcccctacactgccactcccaaagaccagcatgtttcctcatttagcagtctcactgttattcacgggtggagccggcgtcaaggacagataaggaaacgtgctgagggctgcccagccagcaagttgcgcagggtcacctgagactccgccacgcccagcgggatctgggattcaccacagggtgcaaaaggacaccgagcctgcgaggcaggaggacgctcagtcattccggccccacaggaggagctggggatggtggggcctcagccccaggtgcatcctatgacgtaccttatccaaagccaccacaacagggtgggggacggtcctgacagggaatcctcacgtgctctgaggaaagagcaggaaagccagtccttgactgggggcacccaggggcctcgtgagaaggggatgcatcgccgtcagagccctggagaatcagggattcaggccaagacactgggtgctgtactaaacacatgtgggactgaactcagcccagcctgggggtcagcactgttgccatcaattcacccctgagcagtctgaagtgcaggagagggcttctcagatcgcttagccagaaaatgttttttaaattttgtttaaaacacccacaaagctcttcggcaactttccaccttgtccaaatacactgaactcccaattatgtaaactaattgagagtgtaaaataacacatcctgataggtaagtcagtacttatgttgaccctgagctgtgattctgtgattcagactgctcttggagactgatctttgccagcgcacggcctggcagatcccaggccctgaggctctgctgggaagtgggatgagggaggggaaggaagatgggtcaagtgttcaggagcggacacccaccatgctgcccactcacacacttcatgtcactgcattctctccactgtggggtcacatagcccactctgccctggtgaaataaagccagcacccaggtggaaggcagcccatggggtcgcctgcctctgcctctgataaccaatacgtgactgttggctgtcctctaaattccacagcagggtcacaaatcttagaaccaccctgcggcacgttccagcctcaatgagccaagggccagctctcctggaggctgggacacgcacctaagttgagaactgcaaatatacaacagtggttctcaaaggccattgtccaccttttatcactaaaatcctaaagctcgggcctcacctgtgaagtcagaacctccagcggtgagacctaggtgtcagtatttttaaaaactccctagtgtttccaacacacaaccaagctcaagaatcacagcaggtctcaaccctgaattagcactgcattatttggggagcatttttaaagcaagtctgacatccaggccccaccagggccaactcaatctgccaccctctggaggtagaagcaggtacccacatttttagcgtctgcatttttaaagctccccaggtgactccaacatgcaagacaaagtgtccaacctctgttctaaaagagacggaatccgctccctgagcaaatcttcaggatgcaatattgactaagacagtagaccttaggtgctcttacacaaaagtaactaggtaaagtggtggatatgtccattggtttgactgtagtgatcctctccctatgtatagatataacaaacaaaatatcatgttaaacaccttaaataaatacgatgataaataagttaattaaaacatagaaaaaacaggggccgggcacagtggctcacgcctgtaatcccaccactttgagagactgaggagggtggatcttttgagcccaggagttccagaccagcctgggcaacatgatgaaacccagtctctacagaaaaatacaaaaaaaaaaaaaaatgatccaggcatggtggcacatgcctgtcgtcctaactactctggaggctgaggtgagaggatcaattgagcccaggaggtcaaggatgcagtgagctgtgatcacaccaactacactgcagcctgggtgacagagtgagatcctatctcaaatgataaattaattaattaacttaaaaaataagaacaggtgaaaactcatgacatgctagaacattacctattttaaaacatgccttctttcattttctatctgggcactagaaggtaaagtccccataagctactgatttatcttgatgtgatcttctaggaataaagcgcgacatcacacaggtgtgcctgataggttctggaagctcccttgcattcctaggagtgaaaacaaataacaggcaaagactgcttcacggtgagcttgaggcctccagacttcagctcattcacacacacacactaatcttttcgagacagtgtgtaaaaggaggcagggtggcatgacaaggatgccccaacactcctcccagctgaaatgctcccagaaatggttttaggagtcttctcccaaaactgaaacaggactgattgaccagccccttccacgtggagggcatagccttaaagagccgcacaacttgcagttttttacagcgtaatgtgttaggaaatcattagccagggttctgacggacatatcaagaccaacccagggaagagccttcccctcccaggcccaccctccctcagtcgtgctgtcttcatgtctaaccctgattctaagagaacgggtaggcgccggcaaaactgcaacagaaggcggaaggggggaatcccattttttagattgcaaaattgaaaattctttccactgggaaacactgaagtccatggctaggtggtggcatttcttctaaaaaggcatatttaaaagggaaatgatacgtccacacaacgaagccctccaacatgagaaatgccagcaataccccatgttttgtaagtcaactgtaaccttacgtgcagatgtgaaaagctgcaaaccacagaagggggacccccgcctgcctcacacactgccccgccccaaatacctcatcaatggggcttctgtacaggcttcaatgcctgcctgttcacatgcattggttttctttttggatcaccccccatcacgtgaccttactggcctcttccactaacacttcatctttttttttttgacggagtctcactctgttgcctaggctggagtgaaatggtatgatcttggctcactgaaacctctgtctccccagttccagtgattctcctgcctcagcctcccgagtagctgggactacaggcacgtgccaccatgcccggctaatttttgtattttttagtagagatgaggtttcatcatattggccaggctagtcttgaactcctgacctcgtgatccacccaccgtggcctctcaaagtgttgggattacaggcatgagccaccgcgcctggccaacatttcctcttttaatcactgtggcgtttattatcccatgcctcagtacggatacaaaagctgtccaccttcagggccacatgggctgcgctgaacataagtgtggccacaggtccaccaggctgatgaactgtggggagcgacgcagccggtgacttctggcagaagccgtgggagccggcagtgctctcgggagtgtcggcagccttgggtgcacagagagggctcacccctcatcccaggtcctggcatgaggcccatgtcaagccacaatgcagtggacatgtggcatgattggaaaaagaccatgttgctttatgtccctgagactgtggatttgtcgtaactgctccaccctgacagagggagagaattctaccaccacctacctaggattccataaattagcagttcccctgagccagcactcaggccgttagggtcacacagatcagcccactcccagtgcagcttaggcagagcttctggggacaaatgaaacaccccagagacctggtgataccaaatgactttcaagcatcagtggggaagttccccagcaagttacagaggtgccacaggacctagcaacccctctcctgggtaacgccccaaacaactgaaagcaggtgttcagacaaacacaggcacacccatgatcacagcatcaccattcaccgaggccaaaggtgggaacaacccaagtctccatcgagagaggaatgaataaacaaactgtgctctatcccagctgtggaatattactctgccaggagcagtactgaagttcccacatgggctgtaacacgtccggctcgaaaacatcacacaccacgtcacaggagccagccacaaaaagcacatactttgtgatgccatttatgtaaaatgtccacagtaggcacatccccagggacaggaggggatgagtgagtgccaggggtttggcagggaggtgtggacaggaagtgacttcagggggtataaggtttccctttgggatgacgacaaatttctgaaactagatagtcatgatggttgcacagcaatgcaaatgtccttactaccactgaacagtacacttaaaaatgattaaaatgctaaattttatgttacatgtatttcaccacaataaaaaattaatgagtattttttaaacctgagggatgatttctgttttctactgtgggccggaccaaagattttcatctcaaaattcatatgactttattgtgaattactttctttttatttttcctttgacatgagtgttagggtgttaaatttagttttcagtatgtgcttaaggaggttatattcgctatgactttcatctcagaagagtaaagatggcgctagaaggtatctgttatagaaacgatacttcattttgggcctgaaccagtgaaggtcccttgatgtagctatcacgggcagtgtggactgagcagaaggtgggctggaatccacacctcaaagtcccagaaggcccagatagcaccttctcctctgtggccctagcctctcagcagtgtcttcagagcgcccaccaaggtggtagggtgggaaaccaaggccccctgctttgcagagtgagagtatctggggcaaatggaaagcttcatcaactctaaaatttcaaagttggttttatgcaataaaaagaaagtaattgcaatggcagtttccccaagcagactggagtttctcattctaaaacgttttccgaattggacacccacagagctccctgcagtgcagtgggctgactcggttattaaatgtgcactcacatacacatgacctgttcatacccacggccctaaagcatcggggtctgaaggtggagaggagctgtgtctagtcctgacccctgggcaggagtctcttttcagagttctcaaggcacataaatatcccatctctctcagaaacctccagagactgaagctcacagatggagaaaaagccttgttttgccagtggtagcaaacaaagagcaagagtccctcacggacgcatgtccagcgcccggggccctggctccttggctcccagacctcctctatcctggttctctgatgtgagtaccaggaagtccctttataagacctgggtcctaggacctcactcagctccctggagggggtggtggccaagggaagcatctcagaataaaggtgaccctgggctgactgagaccatccagagacagcccccaaaaggcagaggtgctgccatcagccctggtctcttgctgacgcctgagtccttggagggctccaggagtgtctatgcctggtgctgcggtcactcctccatcctccacctcagatgcgcacgctgctgtcttcccccatgctctgagggcccggcactggcaggatgatgcccataactgggcactgctcagttataacacacagtacggaaataacgacacctggacttttagaaagtaccatggatcccctgtgtccctagcacggatctgaaacccccatacccagatcactaatagccaaattcaaggccccttcattcttccaatgtccagctgctacgggcgcaggcgctggggcccacttgcttacttccctccctccctcctgagattcttcctctgcagagttggaggccaatgccaccccatggaacccccatcctgcctaaatgctatcctccattgtctctgggaccctaatagagctcccaggctcagtgcaccttctcagtgccttctcttctggtaagacagtaaccatgccaaaaaaaaaaaaaaaaaacaagcaagggcccagcccaagaccccaaggctcgcctctgccctcagggaagagccacactccttggcccccatcctggccctccatggtggggcctatctgcatctccagcctcactccccagcactgaacttccctggcacactatgctttctcccggtctgcctctcctccagaccatctgcctggtaaggatccctctgcctcacaaggcctggctgagaggctctggctgagcacccccagcacgttccccaactctggagttgaaatgaggtgggactgtctgcctgtctccactttgtgaggctgtgagccttctgccacggaatcagagcttgcagataagctgctttctgaatcctaaagcgctcttccagctttcacatttggttcctttggttggggtttagcacacaatttaaatcaacgggctctccatggtcaattattaaaagcttacagtttccattgctctgaactttctttaggatgcacaggttatcagccatgggttagcactaacagagcagatgccgagtctgggagggacattaaatgcctggtgggaatgccacagcactatctgcaagcagaacagggcctgccaggttgctgtcatcacagggtggaggttgatgtaacatgaataaaatattttgacaacatgaagcaaagagccctcaaggtatgaaaaaaaaccacagaactggctttttgccacccacggaatcatgaatttcacaggttgagtcatttcttttgttactgggatatcatcagttgaaatattctcccacttaaaagggtatgatacaaaaaacccaccacgtgcaggctgaaaccaggctgagacccagagtggggcggggacaatgagcctggcagcagcacccaggggctcttccacaaaacaccagtggcagcagaagtcagaccagagtgagggagcagggcctcatggctggcaggcacttgtggggagtaaaatgtccccaaaccaactccctgaatctcacccattctacaagaaggatacaaaactgtgctcactggcacacagagcacccaggtctcagccaccagagctttgtgataccccacctctggagggcctctctctgatcttgtaggtgggcagggctactctacactgtccagcgataaatctcccctcagtgcccattcagcagagtagttcaggtctcaaaaggatcatttgcagttccgcctgtcccagacccctgtatttgcaaacatatgtcgaactcttcctgcatgccagggaaaaaaaataatgagcacttccctcaacaggtttactggctggtgtaagagtgtgagtttagtggaattaggacatagccatggggtgcagagtcagagagacgagagctctgttacgtgtcctggtgaaatgaaggtacctaaaacagtgtaggcactcagagtaacagttcttactattaccaacatcatcaacatcaccatcactaacaccaccataaacatcatcactatcatcacagtcatcaccgtcatcatcactatcaccaaagcatcatcaccaccatcagcatcatcaccatcatcacagtcataaccatcatcactgtcatcatcaccatcaccattaccaccatcaacatcatcacagtcatcaccatcaccatcaccaccatcaacatcaccattaccaccattaacatcatcaccaccatcaacatcaccaccatcatcagagtcatttaccatcaccatcaccaacatcatcacagtcatcaccatcatcagggtcatcaccatcaccatcaacatcatcaccaccatcaccgtcatcatccaccatcaccaccatcaatatcacagtcatcaccatcatcatcatcatcatcatcaccatcatcactgtcatcatcaccatcatcatcatcagtcatcaccatcataagggtcatcaccatcaacatcaacatcatcaccaccatcaacatcaccatcattacaatcaacaccaccaccatatccatcaccaccatcaatatcatcacagtcattaccatcatcaccatcaccatcatcatcaccatcaccatcactgtgatcatcaccaccatcagcagcagcaccactattattattatggtgctggtatgaaagactttctcaggaaatacttagccttcacatataattttcatctcataaataatgcaggatgcacagaagtcccccggaggagcacagggcaatgctattcccaactctctaccacaagtggtggtctttctcataatgaggacataatctgcaaatagtgaaagattctggtaacttcaggatgctgaggtctctgtgacaaaccttcatccacagtcagaattaagaaagttgtgtagcagtttgtgtccagggatgagatggaaggcaggccagcaagaaggggctcatgtagacatagtgctctcagaacttccagtctatggtttccccttgtgagcgagactcaaggtagtctccagtcagtcaggcaatgccacactatctatggggctgaacctcatgcacacagatgtggaaatgatgccccttgcagggttaggtgatggtaccattctgggcatgtcatgagccttttggacgtgccagaatccttcctattcacacatggatctaagctgaaagaggagggctccagctcaacagccctggtctcctttggctggctgaggagacggatatggattgagggatctaggacaccttcaaagtgcaggcactccagcagcatccccaaccttctgacgatgtcccagggactcggaactagctgctttgctaccacacttgtacgcgtgtccctgctaggatctagtaatttttgttttctgccgcttgccaaagtagccatttcctattgagaaatgtcaatactgaaatttaaattttaaaatcaaaagagttccagtgttttctatacctgctagtgagggaagaaacaattccttccttgcttagctgcagtgcctgagagctacagaagtaagcaataatttttttttttttttttttttttgggccagagtgcttgctctgtcacccaggctggagtgcagtgcacggtctcagttcactgcaatctctgcctcctgggttcaagtgattctcctgcctcagcctcccaagaagctggaattacaggcatgcaccaccatgcctgaccaatttttgtaactttgtagagacagggttttgccatgttggccaggctggtcttgaactcctgacctcaggtgatctgcctgcctcggcccagtaagcatcttttaatgggatttctatcaggtcagaaagtcttggactgagatccaaaagcctgccatgcaggctgttcagagaccacctctacactgtgcaggcttttgacactaaatgaagtgcaagtctcaaggcttgctccatctcccagcttggtgcttacctagcacaagaggcacgtcctggaagaggaagcggagctcccaggaagggcatggctcactctgccctgtttccaatgctgcggctaacccttcagtgtccattcatcactgctcatggacagttgctcatgtgtggcagggttcctacaagaaggtcacttcccaattttaaaaagctctggggagactggtaaccagttttgcttatacctaatcttctgacatctttttagttctgaagctatgaaaaaaatggaccaatggccccagatgcctgtcaaatatgaatagattaataaatactttaaatttgtattgtcaatacccaaatatgcactgaattttactggtctgttgttgagatatgaaagtccttagacttcaaaatgataattaaataacttttataataaaacgcattaaagagtatctaaaatcaaaatcaaaatgtgttattgggctgggcgcggtggctcatgcctgtaatcccagcactttgggaggccaaggtgggcagatcgtgaggtcgggagttcaagaccaccttggccaatatggtgaaaccccatctctactaaaaatacaaaaattaaccaggcatggaggtgcacgcctgtagtcccagctactcgggaggctgagccaagagaatcatttgaacccaggaggcggaggttgcagtgagccaagattgtgccactgcactccagcctgggcgacagagcaagactccatctcaaaaaaaaaaaaaaagtgttctcaaagtaacgagtttggctgggagcaacggctcatgcctgtaatcccagcactttgggaagccgaggggggcggatcacaaggtcaggagatcgagaccttcttggctaacatggtgaaactccatctctactaaaaatacaaaaaaattagccgggcgtgatggcgggcgcctgtagtcccagctactgggttgaggcaggagaatggtgcgaacccgggaggtggagcttgcagtaagctgagatcacgccattgcactccagcttgggcgacagagtgagactctgtctcaaaaaaataaataaaaaaataaagtaatgagtttaccaagtaatttaaaaacagccaaactgagggtggataatatgatgtggctttcgaaaattccaggccttataactgtttctttgcagcaagaacagggaatcactaaggattgaattcaatcaattggaagacatattaacctcaagagactactatatgttaacctaagccaagagactactatatgttaacctaagtatgtggagtcctcttctccacatacactcagatgcctccagcctcctccaaacctacatgagattgttatccaggagaaaagacttctgattttaatgtttccaagtaacttcttttaagaaggtttggtgaagtaagtcaggtatgatactgcagatagttttttcccattagagcctttttagtaaactcagaatttcccaaatatatttgtttaatgcatcgacctggacctattgttcagggactgctaccctgctgtggtgttgtggttgctatacggctgtattgtaaagtccaataatctactcatgggggactctccaggctccttccaactcccagcacatgacatacaaagagggagttactcaggcaagctggaatgacagctgtttgctcagtcacacacctagtacatgaaaggtggatgtgaacgagcgtttcttcacaccttccccgggccaggcactgggatagggtttccttctcacagatggagtgaagagaaattcacagagacgctgccctttacccacttgcatcactcaggcaacccacagcacactcagacctgaagccaggaccaacatctgcagggtgtgtgctccttcgcccaggccaccccagacctgagtcgggactgcagtcctcacctgtgtgactccaaagaggatggagacactgagtccacacctcagggcactgacttttgctctactatgcaggtcccatgtgaacctgggcaggccacataatctactgacacctccatcaacacgactgtaaggcagagactggtgcctgcagccggggtgcttaggacgatgacatgggccagcacacctaaaccaagaaccacgccagcataaatggtagcatctctcatccgtgttaccagcacatggtgggaatcacatgcacggcgtcacacagccatgtcccttgtcctttacctctctggtcttcacttttagaggcaagtccctctaaggagccagcagcccccagatggcaaaacaccccaacgtgccaatgtgggaggccctggcaccacacggatgccacactttctggcccaaggttatcctttgggtcctggtccttgcatggcactgccagggctcccagaacacagctctgtctctccaccttctgtagcctcccagtgcccgcaggcacagccgctacagcctggccgtcctctcctggcgtgcacctctgtgcaggagcttccagaccacatgatctcacccacacagtcccctacctgagacaaccctgctccgtcccaatgcccctctctgcctgctgagtgtttccctggccgacctgaccacctccagctctctggtcccctcagccttcatgctttcccaacagaaagaacactgtatagtaacctggtcccaacatgcaacttgccccattacatcgatgcagcttgaagatagtgctgctgtaacccaggcagatgtcactgcctgtccaccactctcagccctggttcctcccaggcctcaaggctgcacagaaaggcactgtgctggtttccaaaccaccagcctcacgggaaaaggacatgtgcagtcctggcctccctgcagttagcatgaccccggcctggttttggggcatccccagaggccccgcaccgggtcccatggctttgggtcccaccacagctctcagtcccctcacccctgggcctgttcccccaagcccctcccatcactgagctgctctccacagtagaaccccttgtggaccccaggcctctgcccagccactgccttccataaccagtctccccacaccaccacggccaactctgacaggtgtatttgtaatcagaacattttataccacgactgcttaatcaattccttgtgccaaagctgtctgagggctcagtagtcttcttcatccccaaccttcagccccactgaagtacctggcattcttccacaaagccctgacctataccgcagggacagaagtaagtatgctttctttgtaaatccaccaacattcacgaaggaagaatggtttcactgttaagcccattctgcaatggaggcatgaccggccctttccagcagagagcatgctgtccctgcccctgcactgacgttaacagcaagtcttctgcctggttcttcccatcctccaaatctcctaccaagggaccacaccagcatgacagcatttggatcctaggccaaaattcacaagagttgaaactgcaagggaaatgtccctcccttgtggatttcgccaaaagctaacctactaggctgatttctcatcacacattagcctcccgtggagcacctcccgtggagcacctcccatggagacccagctcaccttgccgcccggtggccctgctggggccctctcctgtgtcaggcagcctgctgcttgcccggagcccacctcccacgctgtctggagacacagagccattggcctggctaccgagggcgttcatgtgggtagggatgggctcgaaggtgggatccagctccaggatcagcctgttgagctgctcgatggactggtcgatgtccagggtgggcgagcctggggaggggcctgtgctcagctctgggccggctccattcacaacctggtctcctggaaacctgggtttgaacgctttgctgggagagggctgctgtgtgtcagggggatgtggcccactgcctacacccctctggacagccaccctactgctggtccctcgggtgggggtgagtggcactctgggctgggcctggacgaggccaggattgtctgcagggcagcggctcaccagccgggcctccccatctggggcgaagctatactggtgagctacaaccatctgctgctggcgcacccaggtctgtgtggagtagctgctctgcccataggcctgcatctgggcggacactgagggctttctcagcaggggctggggctgcttgggctctcgactcccaaaagtccgctcccgctcataggggccgtccatgccaaggcccaggtccggaacgagggtgccctgcggatcttcaccaacgttgctgccaaaaccgtcagataggagtgagttctggctgctcttgtggcaggtgaagggacccaggtgggccgactgaggcccttccgaggaggacagggtcccaaggctgtccacactgtgcaggtcgtggtggggcatctcgtcatccagaatgtctgtctcccgatccttcagagcagcgtctccattcacgtgaacctgggctggcaccacgtggcgggtcccactgtacttgcttcgagcatcagtcatttccttgagggagcttccaggatcttccaggccaaagccactgagcagctggtccaactctgccttctcctgggcactcaggcccctcctggttcctggggccaggcgctcttccgtcttatccgtcctggcagaggctgtagagtggccggagtcactgctgacagacaaggtgtggtcactgtggtctgggctgttggtggccgggattgcctgggggccacctgggatgccaggatccgaggagcttttcttcctcaccttcgcgtaaaggctgccatcgacagggccctgcgtgtgtagcactgcgggggagaaaaccggagagaggctttcagtcagggatgaaagtgagcctcacaccctctgaatgggcgtgtgcatctgtctaaacaaataaatggattcaaaatatgacttacaataaacaaggacaaagattcctctaacatcacaaagttctatatatactctggaggatgccaatgaaaaggcattcaaataaacatcttcaggtgctagaatcacttctacctttccatgcaaaacaaattgtcattttgaactctgggattcttcaccttttgaatcatcttgcctttagggctcatggttaatttcatcatgattgtgaacattgagctcggcttggatcataaatccccaagaatggactgttcatcttagacaagaagagcttccgttcatagacctgtctaacatttgttgagcatcagctaggtgctgggtagcaaactcctactaaattgaatgtcttggtgaaacccgtctctattaaaaatacaaaaattagctgggcgtggtggcgcatgcctgtagtcccagctactcgggaggctgagtcaggagaatcacttgaacctgggaggcagaggttgcagtgagccgagatcatgccactgcactcactccagcctgggcaagagagcaagactccgtctcaaaaaaaaaagaaaagaaaaaaactgaatgtctgctcaaatgtcaatacgaaattcaatgaaaagagaaagtgcaggaattgatttgggtcttcctgtttggcacagcaactttgggccacgtaggtgccgggtgaatgtctcaggatcacagacacttgaggctgacctgcatgcgctgatttccatacatggaatgtcaggaaaatgaaactttgaactaaagtgtgggcaggaagggctgaagcatcagctgctattattaatcacggccatggctctggcattcggggactcccaagcctcaatctgctgactggccaattgccgcgaccacacatagcaggtccttaccaagagcctcctaaaataagcgggagtttgtagtcagcacatgcctcaccccatgggcctcccgcactttcttctacttcctcgactgtgaaattgcaagcattccacagccagggagctgctggtggtgggaagcccacgctgcgtgggcacctggaatttgagagacgtgagccactacctaacagcagtcactgagcctggcccaggagccctctggagggacctgccctgagcatgtgcctcacagccccgggctccaggttgatgcaccaccatggtcagcagctgctggcctttttgaaaacactgggacaacgtgttgggacagagtcccaaggggtcctggggtgtggtgctgaaaacgcgcccacgccaggctttcttcttgtttcaacagtgcccaagggaaagcacgcagagaagtggggagtggggagagtggacacaggggtatgggcccgtctgcagtggccctgactcccatcctaaagtcaagcctaggggaggaagggtctgggagtagaaatgctacataaaatgctgaaaataaaccaaggcttcaaggcagggaaagtgatgacagaacatatgccatgggattaattcaaggtaacagtctcagtgacagctactgttttctgagtaccttttattgacagggcaggagcatcgtgcattttctctaattctcacagtatgacctatgttgttattccttgtttatctataaggaactgaggatcaaagagaataaataacttgcccaaggtcaggcagctgctaggaggtggaggtgggcctagaacccaggtgcactggccctgaaacctgtgtgctcctgctggcccactgcccacctgcccagagagcaccaggagggcacacacctggaggctctgtcagtggccctgcccacaaagaggtggcattgaactcacattgctctgaccagggatcagtgagtgaccaggcttcagactaggcagagactaaaaaacctatttcgcccagctctgtgcaaattaaacaaagggaaagactggaaagactggactaaactataaggcatgtgcaaatatcacctctacaatttcaaaaatggaaaatgcaatgcatttgttaatgccatcactaggtgactgtgaagtagagtggtcccttgaagaagctctggcatcagatggacactggttcaaatcccagctccatcctgagtccacccttagggttctaccaactggtgcattcaccttgaccttcagcttccccgctataaaatgagggtgtgggtagatggttctatgtaaaggttgacctgagaattaaatggcatagcacacgggtgagtgtctttataggccctgagtaaacatcaatttaatttggtttctgtttagatttcctgttaccaggaaaatttaacaaatgaaagaacctggtaaatccttcctgctgttttcagcgtgtgagaaggaggtgctgataaacggcttctgctccgtgagaatgacagaaactactcctcctccccacgatggaaggtgttgtatggccatcagcccagtccctcccacgcctggcgggcagccaggacacacactgcagggccactcagcccagagcatgagcctacccattacggtcacagatttcacgctgctaagtctatatgacttcccacactcttctccctaaatctgagttaaaataaattggcacaatgacttaaaaaaaagcccaataatgagttgtaaaacaattcttctaatctaaattaaaatgctgtcaaaaagtgcttattaatcagtctgaggtggaatccttcagctagctccctgccccgtatgctaagaacagtacctgattagaaggccctgtaccaaatggtaaggcacaggatagtccctctcctggggggagggtatgaataatcctattttattagtagtagaaatcttaaaataataatagatgcattaaaaacaacaacttttccattaccattgactaaacactccatctacgtcaggcccattctgagcactcagagcagggtctcatcgaatcctgacagcccaggtggcgttcaaccaccttcctattaatacatgaaagtacagccatgggacagagagagtccaatccaactgtgtccagtgccaaagaccaggctggactcttgctaaacttcctgctacatacataggtagttttctacatcagaaaatgcccaataaatgttaaacgtacaggaaaagaatatgaaacatatcaagtgaattccaagataggactggtcaagcttctgaatcactctgtaggagcacagatcttcctaaaggtgcagagctctgggtaggccatcccaggagctccacagacaaccccctgcacctacacctccgtggtcttcagtgggggcaggagagtcagcctcagggggagggaaggagaaggggcctctggaacacaccgttcctatcctgttttctcataaagggctatcattttgcaaaaggaagagcttgaacttcagtcggacaaaggagacggccgtttccctttatctttgaagatgggatccccattccaccatttactctgtgtgtgttcctggtcatgacattcaggctgttcagtttcctggttttacgtttacaaaatggaatgcttcctatctttcaagggaatgaaagatacaaagatgccatccatttttctcttaaagttatgagaactagagaatatggacataaagtacccagctcataggctccaagtaagagtactcataattactattaaaggctcttcccatagtggacagggccttgcatccgctccctgggctcatctctttaccgcctgccctgttcctagcagtccactgcaggcatgcacctgccctgtggccttggcttttgtctttctctgcatctcagctccctcacctcctcaacaggtgctgccctaccaccctttcctcactgagtttttgtccacagcacatacttgcattcagaagaactgcacctttacccactggaactcaggctcactgagggcagggagtttgctttattttgctctcccttgcatttctagcattagtgaacagcctctgacacccggtgaatattgagtgacaggctaaaagtttgagctttttcacacatgacaaaatgtggggagctattttggaaagctcagctgccttagcaggcaaaacaagcaaacgaagaacaatcaccaaccaaaaccaaacacacacacagcccacaaggatctgaaggtagaagagccgtgcagcgcttggccacctgcaacccaggtgtccccactctctgggcctcttcccaggcagcacagccaggtccagccatccgtgagaggcgggagcagggcagccatcactactgacctggctggtctccaactgataatgaacacaactggaaaaataactgaagtcacccaatctaagggttctaaattccaaagaaaacaaaagtcatgacctaaaggttagcccatttgcccatgaagcaggaagcatgggccagagatccagggaacatttgaacattatctggccacagtgtgcttggaaccaggggcacaaagattaatgagacagagccctggcaaacagcagctgcaagcaaatggcaccatgctatctgccatttccagtctcctttatcctcctgccacctgtgaggctggcgtttcgttgctcaaacccacacagctccaagtggcagggctgggtaaatatctgtcttctgacctctgtatcgtctatcttctcacctatgaaactgctacctctacactgggcacataggaaagagcctcatctaaacactttctgccattgctatgctttctaagactcaatgcaaaagctgcaggataagagcaataaaaagagaatcatgactagaaaagacacctaacagaggtgtggaagcagggtcactgcatggctgactgccagtctcgccaatgagaaaccaaacaggagcccgcaccctgctgtttgcagcccccaaaggcgctgatccatcattaaagaataccctccttaactgatgagagaatgctactgataatatggttctggtttggaaaagtgatgtagaaagaccacagaaatgacatagccaactaaactcccatttgtggttcctggacatgggttgtgggtggggttcctggtgccctgatgagctcctaggagcaggcagggtgaggagcccccaccagatgagggaggctgcagggctttaagtctccactctgtctctggcacctgatgtgctattagggctgacactgctgtgaggaggtggtggggtaaggacagagttctaaaaggtggggtcctgccactcgtctgctccttccatctttttatatcattaaataacatattttaacattttgcttccatctcaaagggagcatggggaagtctgaatcaaccctcattctgcaaattcagaacctaatcttagagtgggaggaagtaacttgcagggatgccatagctcttcagctgcggatgcaggaggagaacctttccacatctcagtccagggtaaatcatcccattcggtgtcccctttcccttgcgttgccaccagacccagccaacgagcatcaaggacctcccctcccaagggaggctgtccactgtctggcaacgatttcctggtggccagatcttagttaaaaatccaacaaacataaatacagccctgaatgactttcactgcatgacataccagtgaggtttatcgcctggaaaaggaccagaaggaagaaaatacagagcatacattcttgtctccttggaggacttgcagcaacagacttcctcacccaccttccctgcaggggatccttctctttccaacccaaccctgctactgaaacgtggctttcccacaaggaggtaagagggttaagaggcactcagaaagtatttcaaaagtcacccaaaaaatggagaagaccaaaaaaatatatgaaaacatcccttccatcccggttgaaaacagattaggcaatgcccaactgtgctccccggcatgctaacaatcagatagccaaagggacagctgatctcacacttcagcaccctccatcatcaatcactcagcaaccaaaaatattcatcactgatgtgtaatccactgaactgtccactggccctgcttccaacagaagttggtttgaagcaaaggaaggacaaatctgatagatttatgaagcgacgtggaacctttcctttttctaggtattgatgctaagaatctcatgttctatttttgtgacaggtgtgcttaaaaagtaactttttcatttcaaaagaactaacagtatcctccctgcaattttttagtttcaaaggagaaactagaaaattcttctccatgaaagttggttagaattgactaagcacttgctatgattgctagtcataaacggggacttaaaagcaatactcagcccagtcctgatgatgtgctggagaatggacaagcccccttggggaacagagagagaaacaagagatggaaagggtggtgggcacatttcacggcatccgaatagacagatcaacagaggcaagggaaagacggagcagtgtgtgagaagaaaggcatccactgatgctgaagcagccaccctcaggtgagccaggtgaggctgcaggaattggcatcttcatcacctgacaaacagagagaattctggaaacacccctctcttacaactcagctgacctcctaaagacaaggccaccgtgcaagctcctcccatgcgcccagcacactgttaggccccagggatcctactcaattcccaaagcaatcctgtgaagcaggaaacgggaagtccattttacagatgagaaatcagaggctgagagagcctgcactaacattaacgattttttttacaagcctactgaatagaatatctgaaatttaaaccaacctccctccactccaaaaaaagataaaattctaatcctagtcaatcactttttatatttcacagatcaactatctagatcaagacacacacacacacacacacacacacacaaactcatatacacctcactcactcttcagagactattaagtgctttgtgctttcctccctaactcctaaaattattcattatcaggaacagacccttgtggtgtcacagccgctgcagtgatggtcacagtttttgttccgtttcttaaagctagtgcatttctatcctcacagttagtggatcgggtgctgttcctagcatggagtcttcagttctcccacacacccatggtaccagcagccccatcggggtcaggagccatggatatgccagaggtcctgcctgtgcctggaccaccacagggaacaggtagcttctccagacacagccaggaaccatcctgtccctaggtcaccctcaaatgactcacttggggccgtccagctgaatcaattcaccatatccaaacagtcccaataagtggaggcttattggaatgatgtctgcagctgcaagtgcccatggtgggctctgacaaccacagcccagggaaaatgctgaagacagagaggcttcggtttcaaaaacgagtgctcatctgcaggcagtctcctggaggggtctcaaggactatgccgagtgaacactgccagactcaaagggctcgactgtacgactccacataggtgacattctggggtggagacactgtgtctggacacaaatgggtgtggtcggggccaggagaagagtggggctgcaaagggtgtgagggatggtttgggcaatagaaatatttgcgtcttgatagtggtgggagtgtcatggcataatgtttgtcaaactcagactactatatactaaacagagcaaattttactgcatgtaaattgcatctcagttaaaacaaccgttgtgagatcaagacaaaaatgagactcacagcagactagaccccaacctgaggtggctcctcttgatctcctcccttccttccctcttcctctttttccccctcctccctttcctcctccttctcctcctccctttcctcttcttctccctcctcccctccctccttctccttctcccccatgccctcctccccctcttcaaaggccttccctcctcttcctaaattccatgagacaatggaaaccctctctccttgggataacgatcatagtccctttgcgcctcattgtcacataaagcgtcttttgacatttccattggagtgattcatgtgcacaccttccctccccttctagaggttctggcataatccaggcttgagtcctggcttgatcatagctgtgtgacttcagatgaatcactccgcctttctgtgcctcactgtccttgtctgcagagaagcaacctggagaagggggtgtttgctgatatcagctcccaggaccactgggattcaacacaaaaggcatggcacacagcaggcattgggcaaaccctcctttctgtgctttccccctctctggtcaagtgaagaattcccagaactcacaagtgattcatgtgtggaccctctgggtgcagagctgagggacagaggagtgctccatgaacatctaatcagtgagtacacagaacgcaggtccactgacctcccgtctcgagaattacactgaggaactgttctctaatataaagctatggtgaaagatgggtttaaaaaaacgtattcagaagttccctaagtcattttttgatatgactgaaattgtcccaggcaccaactttgctaaccatccacccagtgcgactttatggccaagctgcccagctcaggatcttaccagctgtaaaacagttttcccatcccatactttgtttgtttcctcggtgactgacagcaatgatggcaaaagcagcagtaataagctaactgggcaaccactgtcttccaagcacttcgtacctattgtctcattaggctcaaaccaaacccagaaggggtatggattctcctctgcttaacccacaaggttagggggattgcaagggaccgaagcatgtccaagtttcatggggggagggctaagggttttctggcagattgtgtcatgcacacccagggttcccatcactgcatcacatgacctcccctcagcagtgagagaacatttctcctggatttgctaggtcaactgacacatgagccatggcaccggcgctggacttgtgagttttccagcagaccattcagttgatgggtctggtgctgcacaatgtggaacagccagtgggggtttcagtgctggtgaggacaggtgctaagggactgcctggatttcaggctccggcgcatggaagagtccatcaccaagccaggagggctgaaaactaggctgtggcccagagcacaaggcagggttgaatggggttaacaatgaagcaaggggcattctcacatttgcgaggaggggaggtacgggtagcccgggcagtgtcccaagggtacctgatccctggaggcctggtaggggctgcagacaccgaaagaccttcccagtcaggaagcgatatctgagccaagaggttccttctcaaggggcgttgtattatcttacccatagcatatgcaaaaatcactctcgttttttccatgtggacatttataattagagcatgtataacctctcactcaaacaaggtctgctttaattttattacaatagaattctgactctttgctaattaatgatttttggagtttttattaaatcattttctattccacagaaaattcaagagctaagaaatgaggactacacttgggtctttgagaacactgcttttaatctactaaatcagatactctatgattttgatatatttcaagacgcgatgaaatgtgcccttttcctctttttttatttttgtttttacaaaaaataaaagacggtaataaactctactctgtagggacaactctttctctccttaggcagaataactccattctaaggcattgctcccttggtgcatcagtctcaccttgagagttaactccttcccaagcccccaaacccaaatcaccctctgagctgccaggaggggaggtgcccagcaggaaagaggctgcagcggcagcaccaggacaccttgctgagactgccggagggcgctggaaaatccctccctctgaagtaaagctgagctgcttgctcacgctttctaaaaatgaggcagactgtaaattcttagagaaatatagagcagaaaaaaaattaacaaaagcaagaaccagagcagaaccttccacacagaaacgcctgcccagccacacactgcctctctgggaagggaaggcatcccactgcagagcaggagcgactcaggagctgggccagattccaagcgctcccgcggtctcctgggtgaggctctggaatgtggcgataaaggagcactgtgctccgagtggggctgtggcaggcgtgtcacagacgccgccaaggtgcccccacagccgtactgacagcagggcaggccagggcggctccccgggcagacctctcacaccagcacgccggtgcaggctcagcattcagcaggcgcctatctcaggcctctgactgggcagctcagttcccttttgggcactcctaactgaaaacacaggggcccaagcccagaggaaaagaggaggtcctgttggccttatctgaggccacccacgccggctggccacagaggcggccagagagcttgcaaacagcatgtcagaccatcactgactcttccccaaaaagaagtcagtaagttaagactcctccagcttgcaaaccaataaaggcattcctggacaagtcctgagcgacattccttcttgcccggttaaagcatccgttctgctgattattccactccataacgccctctcctcctggctagtaccagctcttttcctctggaagtcttggcaagttggtaaatctcagcaggcacacagctcagtttcaggtctttgtagcattacagaagccacacacatgcacacacacactcaccacacaggcacagacacacatacacatatgcacgcgcgcgcacacacacacacacacaaatgctctctgcttaccttccttcaaaacagcccagcggctctctcagtctgcacctctgagcccagttttccttgacacaggctttcacagcaggacagtggcatgccagaggagggcgggggcgtgccacctccctcccaggcacctggcctcccactagtgtagaaggtaaaagatctccttggctatgtagggactttgattccgccaaaaaggccagggcaatgtaaataagagggtggggtttggtgcactcaggttgagtgaaatttgaactccagaggctgaaaggtggagaaagaagctcctcctgggagtccctcaccaggtttctgccttcactcctgagtgttctgaactgacgtccaggagccagcaccaacccatgcagcttacaaagcacagtttcagcctccttttgctttcttcaaagtaaccaggcggaaaatctttgccacacatgctccatctcctgggagctgtctctctgtcttttgtgcgggatgtggctaagagtacagcgtgaatgttcactgcacacagcatattttgtgtggttagcccagacctccacgttctgtgttcagtgtagcagatccttttcatctcagcctcattacattcaacgtaggtgggcttcagacagtggcttactctttgctttggctcaacatgggccacaataccaaccacacacttttactctttaaatgaacagaatatgacacagcaaacaagcaaaagcccgttctgatgccttcaggttcccacagcacaatggaaacccttttaaaaatcaccaatcagccatccaggggagacaggacatacctgggctataagtgcacgcagagggtaacaaatcttttaaatcacccgagatggccacattggcatatgtcgcttacaggaggttaaggtaaaactcagcgcacccttgggagaaacaatctcttttatgatgagacataatgcacttattgtgcaaaaagttctatcaaatttggtattctttaaagggtattggctaacccaccttcctatcaagagaaccgaaattattgttaccattctgcaaatgatgtgatcactgcaataaaggcagtgactaatttatcacaaaatactttgctttaaagaatacacatcaaacgaaaagagattagaagtagtgaatacaacgcaatgaatgtccgagtctctcctgagcaccggggtctttccaaactgtagctaactgtatgtctagatatggctagggggtcccagcctcctacaggatacaaatcttaaaatcagaccactgcatcacaaaactgtgcaagaaaagcaacggccaaggtacctttatccatttctaatggaaagaggcagcaggattagttgtatgttcaaaaggagtgtttcctttcatgttgttctgggttgggcttgatttgggtggggttggggtttttgttgttttgtttttcggtggctgagggcaaattttcttcatgtggatgacagctttgtaaacgggctgccataagcctttgtgaatatatggcaacaggcacccactggtcttcagatcttgtttacgtagctggcagccactgagcaggcaggctcagaacgctctcattttctacaggttccctgctaatgggtcttgattatatggagcctgtgcaggctgttagtattaacctttcttgaaacaacgtggtcttttgaagctttgctgatgtttggccagaaggcagttctgtggctcagagtgttttgaaagcccccaagccttttcaccctgaagggttgtaattctgtgcaggaggctggccagtccacccttagtatgtgcgggggattggttccaagacaccagcaccccccagtcccccaccaccccctgtgagtatactaaatctgtacatactcaaatcctgcagtcgacctcgaggaacctgagtataggaaaagtggactctccatatacacagatttctcatcctaaatacaccgtattttcaatctgtgtgttggctgaaaaaaatctgcatataagtggactcacacagttcaattatcgttcaagggaccactgtgcagctaatgaagaaaagacttgttgagtttcccgaatatctctgaaaatagcaagcgggacaggaggttggcagtatgtttagtgccactcctatttgggactccctaaaggcagaagaaaattccagaatgggaaaccaattagaaggatgagaaaagatgtggaaatttcaaaaagtagtgggaaagattagaggtataagaatatcctagggccaaaacacagacaagaatgttcacaggcaacgttattcatactagacaaaaagtgttacgagcccaaatgcacaccagctaacaaatgaataggcagagtgtggtgtgtccacacagtggcacaccacagccatgaaaggatggagcgtaacaggaatgcagctggaacacaggctgagtgaaagaagcgaatcacagaaggccactcattgcacgactccagtgagtgagatgtccggaatgggaaacagagagaaggaaagtagcttcgtggttgccaggggctgaggaaaggaggaactgggagtgaccactaatgagtacagggcttcttttggggtgatgaagatgttctggaattagataatggcgacagttccacaaccttgtgaacgtactaaaaatcaatgcatcgtatactttaaaatgattagaatggtaaatttatgtgctatgaatctgatctcaacaaataaaaagtaagaacattctcaggctagaaaccacatggtaacaagggcatatttagaaagcaacggcaaccagcccgaggctcgcacatgcactcaggttttatacaaagcgtctggggacagaggcaggctctgaccccaggtagacaggggatttctgcaagggagcctggggcacacaacattcaaggagagagaagacactctcttctgtgcactggtcaccggaatgaaaccgacactgtgatcacatgctgcaccctctagtgcagggttccaggccaaaagaaagctgtccacctagacagatcagggtgtggcttctgaggaggccattacctggactgcaggtcagaaagtgacacgcagggcctcctgtgaagttcctcctcataaggagagacacatgaaagtgacatctaaattcagatagcttctggtagaaagttctgatttgaaaacatgacaccaccaactttcaacaaatgcaggtccctccagcccgtgaccacccattctccccccactgtctccaccgtttgctcctctcccaactttctttccaaggactcatcctcctgagctgacatccctacctgtccaccacactgagcctgtgtgatccctgctccaatgtcaggcccctccccacccacatgggcagacaggcccgtcccagggggtctctggaggggcagctgtgtgcctagaggccgggaaggggcagcctgtgcctcctgcactccacttcagaacactttcacccaaaactcatttctctctggaaactggtacccctggctacagcgttctccagccctgcgggctgccattgcccctcacttcccagcccatcccccaaacgtccatgcctcccttggtccaggttcaaacactctcatcaccggcatttctgtggcttctcctgggaaaccatcaacattttattgaggccctggccttgactctttggactttagataactttctttggtttgactttagaatttctcatgacataccctcaacttccaccaaactttgaaagccttgagctcttcaggagtggtggccaggactctcctttctctagcagccgctacagctccctggctcctgctcttctctgcatgtatccagcccttccctcagcacagtggagtcacagccaatgtatgtttaactccagcaccaaatttaagacatcgagggcaacacagatccatggtgcttcctctcctagcccatctagacccacaaggcctgctgtctccctcgcctgtggcccacgtccatgcccctgctgatgtgcatgcctctgaaatcacagaggccgtaacagtgtggcgtccacacatcactgggcacaccacactgctcacccaacaaccacctgttgccaggggaagctcctccaagctgtcccagctctcaacacctccactccccagactgttgtccactcccaacagacaacctcgcctgccttgtacaggtcaagtgacgccacagccagtgaactcactcccagtctgctctctacccttctctgcatcctggctcctgcaccaggcaccctgctttggacacactcatggtgctctcagtctcctgcctctgtcaatccagtccctgcctgaactgagctcagcacatcagcagaaggagattcacagccggcgaccaagcccccactcttggcttcaccaactagccctctgacccctcagtgtggtaaagattagatatgttaatgcaagctgcatgctcggaaggttgtgcagctcgtgagcagcactcagcaagggtgagctctgacaacaacaaccattagccattccagccctgtcctggcctctgcacggagctgtgccatccaattcagctctgtatctgcagcatccagcactgccgatgctcagagaggcagggaggagatggagactgcatcctggatcctacagagcctgcctgacaagcacacgtggcctctggttttctttcatgagcttcccagaaggtgacactctgccttcactccccaggtgacctattggaatcctccgatttatgattaacaagagagcaatatattacatgtacaggaataaagaatgaactcccaatactacgagaaagatggtttcctcgcagcctcttcccaccctcaggaaagcacccatagtgcccatcactcggtggctcccccgccgcttttccttctgcctcatcctagtcaggggcccagcagcatcccagactcactgctacgagttcaggggcaatgtatggctactgctgccaccaaaggacggctgttgagatcttggcagaattcccacaatcaatcaacaccaaatcttgctattgctctaaccgtttggcctaatttcagtgagaatatatcccaggtcataaattagctcacattcacactgacaaaaataaatactattgaattttcatagtataatttcccatagactgtcaacaccatgaatcctaaattaattcaactttccatagtgaagtctgaaagactactatgtcaaagggtgtattttccttgttaagaaatcatcactatgcacttataaagaaacactaaacacatctctggctcttgctatgtggaagaaaacttcctgggagcagttgtaccctccacctaggccctatcaactggagggggtccccccacatccacaacaggcaggtgcaggcggagcgcacacaggacatttgctggggacgccctcctcctgtccacagaaacctgttttcccagctcctggggtcaatggctttccctgcacttcgcatcagtctctcgggccctagggatttaaatctgggctcccagctccagagcaactgtcactgggtgtccaccctcgacaggccttgaccttggctccctctctgtgacatgctctaataacactcctggctcacatagcaaagtggtcaccctgtctcttaccccgatccatggacctccatgccaggtctccccgacagacagccaggcaggctctaggtatatggctgtgctgaggcaacgagccgaggcggtctcagctttgctcagcctggcatgcgtccccatccagcacagtgtccacagggggaaaggagtgctgtgaaaaccagctttcatccccaaagtaggtcagaattgctcctatcggcaagataaactgagcaagtctgaagatccattaaagctcgcttttcttacataacagcacaagctgccattatatcaaccctgtttttcaagaaatagctggatgttttacataaaatatccctgcaatctgtgctatgttaaaaaatttaagtaaggaacacacccactagtctctgacacctatgccttctacctcacatgccctgccctccatggcatcttagataacagtaacagaatacaacaactgcatcccctctgtccttggacttacagagagagtaagtgacaatttatatgcaactgaatgcatgtttaacatcaagtagcttgcttgtcaacatttaaacacaactttaactatctaaagtcccagaatcaactgtacagggccagagtgcccaactttcaatagcagaacttgatcttcaaacaaatctttatgcagaaacccaatataaaaacagaaaaagatcaaggtggggctggggctgtggagggttcttacaggagtggatggagagagactggggctgctccttaagaaccaacttggaatcctggagccacaggcatagagtttgaaagctgttgaccccaagagtgttgttactcctaaggtcaacgccagcaccaagaacgtcactctaaaaggcagaagaatcatttgcttaaagggagcgtgcatgtggatggtggtctcctagcccagatggccgaatggggccagagatgcaggccatgagggtgcacctccatgtaagggtccctgtccccataaggacaaaggacccaagtcaaagagattgtcccagctgcaccttttgtatgaacacctcccttttccactaagtcatccgcaacctttccctcccctaggaggccctggcagctccatcttgtagcactttccaaagaaagaagtagatgagacagtcttgcatgcataatctaaaacgcctccccagacattccttcaaggctgaaagagaagagccagagcacgcacaagttctactcttccagccaagggctgaggaagatggtgaggatgaccctgtgggccgggcacacagaagcatgttcatgtgaggaagagactctgcttttcttcagtcccagcctcgttctctctcacattttggttctgtatatcaaatacttaaagtcagcaggtgctctctttccccgacttggcacaagtgcaattgcaggctcttatagacaggcacaatgaagttgcagccctgcctcttccaggcaatggagagaaaggttctacgcacggaagacacagatggaaactcagcaggtttgatcgcctgccattcaggccccctactcctaccaggagatggacataagagcacatctgggaataggggcttgactgagatgtgacttagaaaggggtggcagcaagggccttgtaagaagaataaggaccaaaccctcattacaccagggtctacacacacacatacacacacacacactgctgctcacgctaggtgtgagaagcttcgtggctcagggtcccagggagactgtggggatggagccctcttccaggttcatgtctcagggaatccaccaacagaagaacagtcaaggttgtagtccccataggtgggaattagagtccaaagatctgcagctttggggaaggaatgtagggcaggggcatgaatcattgcatgcatgttggttaagtgggcagggtcaccaaagagcaatggagatactgatcacaaacagcagaggaaagtgaaaagagattaagaagcacagctcctctggactctaagaagacatagtaggccaggcgtggtggctcacacctgtaatcccagcactttgggaggcccaggtgggcagatctcctgagttgaagagatcgagactagcctggccaacatagtgaaaaccccatctctactaaaaatacaaaaattagctgggcatggtggcaggcacctgtagtcccagctactcgggaggctgaggcagggacaactgcttgaacccgggaggtggaggttgcagtgagccaagattgggcagctgcactccagcctgggtctcagagcgagatttcctctcaaagaaagaaaaaaaagaaaaagaagaagaaagaagaagaaggggagagggagagggaggagaagagaagaagaaggagaagcagaaacagaagaagcagaagcagaagaagcagcagaggaagaagaagaagaaggaagaagaagaagaagaagaagaagaagaagaagaagaagaagaagaagaagaagaagaagaagaagaagaagaagaagaagaggaagaggaagaggaagcggaagcagaagaagaagaagaagaagaagaagaagaagaagaagaagaagaagcagaagaagcagcagaagcagaagaagcagaagaagaagaagaagaagaagagggagaagacacagtaactacagaaatacaaacaagccatccaccttgtagacccgtctgcatgcacaggacaccccgtccagtgggatatcgggggtacccttcctcccaggaagcagaggaggcccaaggtttgtgtgccgactgggggttgggaggaccctgaggacccaggacaaatccagccaactctcagcacctctttctctgtcccagggggtgatgctacttaactattaaggccactcttgtgggctgatttctgcaaacttgtacaggacaacatacaacttgagccaattcctctgattcctgtcggattcgaaaagtaacgaacacttaatgagatggcggctcagggactggaacaactcttttgactgcccccaatgccaccctcctcttctgatggagtgtatcaattttttgaaagtaacacccacatgacttgatcctggttttaacagagggtacgcctctcgcacttgagacaggaggaagccggcgcccccaggccactctctcaggtgacattgaggaagatttgctgtttggtctgcgatcacgcctgcaagggggtcctttggtgtttgtgggttgaaggcttgctgcctcaattcacaatcaagagatgcagagggaggaaatctcaggctcagaacaggactacccgcccatctggcccgtttctgtctcatacaacttcagttgcctgatgacagctgcttttcactggagctatctaagcaagcaatgcttagaaaagcctggtttggggacaagacctaaagaaatattcttctgcctggtgcagagtcaaatgtcatagggtggctgaataccatgcaaagagccctggagcagctctcaatgctgggggacagcactccacgttgccaacaaggaccgaggctgcagacacaaggcactgtgtatacccaagcactcagcaaaaagcagagccaagactgaaggatctgtcaggtgccatcggccccctcctccactaaagttgtcaaagtttacttcaatttccaaatcttaaaacccaacaatgtctggggaggaaagttttcaaatccattttcaaagtggcaatacttgaatggtctcagcttgatctggcacttccgggccagctctgcacactgcagccagcacttcctgacccaacatgtcctcgtggtagcccattcctggagctcggaacagtactctgagaacgcggtatggccacttcaggactgtgtcttattgcgaaggctgcagacaaatgtgaatctcctctgtctgcctgctctagcagccccatgggagccccaaagcgtggattctgggaatgttcatcaaggtatccacttaaagtggcagagcccaggcctggcaatgccacggccctcgtcctgcacactcttggattggtaagtttgagctgcactcaaaaagtcctaggtcaaggcaagaaaccaaggacaagagtgacagagcaggccttcatctccaaccctcagacattcttgaagcttccctgctgctcaacccttcctctaaatctgtcatagagtctcactcatctacctcctaaatatctaaaggcccctactctccatcgccagagccacatccaagtccaggcctccgtcagttcttagctggggagtccagaagcccattctctactctccttcctctccagactctgcctcccagagggcgtcctccagcctctttgttatctttctgtatcctccagtcatgtggcacctgggatcctcactgtcacccagcaaagaagccaggctcaggaaaggaagctgacattcccccgatctcacgatccaccacacacagcacctcttacttcctcctgcacacaccagccaggcggaacacacttccaccccgtgaatatgtgctgctcgcctatgccccatgcccagggctaggcataccctgtctgccttccctacctgcaagggctgtcctcttcgtgaatctccttggattgtacaggcaaagtggttgtttctcttcaattctttcctaattcctggtacccaattatggtacacggtgcaccctgtggcaacaactgatgtatatctgtgtcttcccaattagagggtctgctgtgtttcttcctgcgcccaccccagcatcagagccatggcaattcccaagaaaatatgagatgcgtgaatatgacaaatggtgtgtatgataacaaaaatctcagagttggagggaggtatctttagagtcatccaattacaacaggccactttacagactgggaaagtgaaagggaatgaggcttatgagagcaagtagaaagcaccccaatggggagtgtggccactgacaccgacgctccagagatgtccagcgaggaaaatgagatgttctccatagggctcagcaacatgggggtccagagctttgcagagcctccctgaagagtactgtggggacaatcctggtggtgacaatacaaatccagggacacatatgctgctgtgggcattcccttagaccatcacagcaagtctgatcctgaaagagcaggtacatcctgctagggtaagaaatccccccacccacagccctcttgtgtgacgaggaggtggggcacccagtgagactcagcccagtctcactgagtctcaaagtctcaaagaggaaagtcaagggtatgagccctgtcccgcacggtctcgagcacaagacacactctgagccacagctgccatcgccgacagtgtacgccagaaggctaccagggtccctggccagttactagcttttgatttctctttggatctgctctctttatctctaaaatgggctcacaggctctctcgaggattaaaacaccatagtgaggcttccggcaggcagccacactgtgtgccgcgagatattcttccctctcctcagggacagcaactaccccagggaacactgacacgactgccgtcccccgcagccaccacctgccaggaccacagacccacggggagaccaggaccatgtgctcctctctgtgctgaagacagggcgtttgtaatcacttgcccacattggaacggattcaaggccggctcctttctgagtatagaagcagaatgttgcgctcacacatcaaagccagcgctcccctaacaggcccagattgaaggcagctgcagagggctccattccaggacggcaaccactgctagagataaatgcggcttaagtcaacatttttggggttttttaaccaggcggcggggggatagaaaaggcaggggcaggggtggaaaagagagtgccgcaatacatcattttcccagctaaaagagaatgtttcagaggctgccaaaccttccttaactcctcaaagcactggacagctctgaagactaaagccctggtgggaatgcggctgggactcagcctttcacccgccaggcggcgtccagtccagggacctgagccaggcactgctgaccgcaggcaagagcgaagactgcctggagtaatagctcaccaatgcagcacaccggcctccatgccaaagaggggctgaggagggctgcagagtggaagagaggagggaaattcaacaaggatgagttttctatccaaaggtgactactctttctggggaacaccttctcaaaaggacccaagcctggggattctgcagaactttgatggcagaggtggtgatggcagcctcgtgtctcacagggagaacttggaaaccctgcaggagtgcagcaataagatcaaacgcactttggaagcccctctaagggaatccagtgtgctcagtgagaaggacatgggaagaaagtttaaagatgtgcacagatgctaaaggaggtgggttaagtgaaaaactcaggctataaaacaatgcacaggctgatcctactatgagaaattacatgatatttagaaatcatgccaaaaatacaccaatgacgagtgcttcatctctagacagtaagatggcggtaattattccttctttttgataatttacatcttcaaaaaatattgatacaagcttaaatgtatgtaaaagaaagaaagaaaagcataaaactcattccattgaatcaggtaccccagacacgccagacagcacgtggggatggagggtcaggaggaggggatgcagatttgaggaaaggctccgtgcttgtctgtaactcaggagctggaattctcaagaatactcaggcagtggttcaagggaaggttgctgagatccagttttgggagaggactcagattccgtgtggcgggttctgggctaagcatccggataccagtcctgagctcgctctgagtcctcccctgtcactccacctccctgggggtgctcatgggcttcagatatcatcgaggctgcaagggatgaaccaggcactgggaggaggctgcactctcacccactatatccctgaggagtctgggcatgactctgcccataaagggggtctctgctgctttatgaagcctggaagcagtaatgacaaagctgtgaatctggctgcaaagtgtacctggctgccttggcgccctatccgactcctcaccctcctgtctgggaaccactctttcccgggtgtccttcccactctgccctgtccttctcagtttctttccagaactcctatgcacccactcccaactggctccatcttttgcatggcaatgccagaccttctctactcgcccctagacccaactctcggtgacacagagtcccgagtgcatgcccagaccatcacctgcatggctccaccacctccaaccacacaatccatagcagtctcccacctgctcacaccactggctcagaagatgctgcatgaaaaatacaccaatgggaattgtgatttgtaatgtcagggccttagatatttaaagttcaaattgcttctctaatcattcattcaagaaacacgcattgagtatctgctatggactgaatatttgtgtcccctaagattcatatgtcaaaacctaatccccagagtgatggtattaggaggcaggacctttggcggtgctcagagcataagggtggaacccctataagtgggattgatgccctcagaaaggaggctccaaggagctccctctcctcaccaccacgtggagacacaagaaggcaggagttggcaaccagatgacagccctcaccagaatccgccaggctggctgcctgatcttggacttcccagcctctcaaagtaggagaaatacacgcttgttgtttaagacacccaggttatggtcatctgtcaaggcagcgtgaatgggctgagagggcctcaaagtaaagaagtatctccctctgcatcttcaggagacactgcggtggctgagagtctttaagactgaattctgtctatttcacccagtgataacggcaagtcctccacatgtatggatctatacacacacgctcacacacataattccacagattctccgtaaagtttcatgtaacccctaaaggatggtgaacactcaactgattttctgtctatatgttttctacataaaatcaacgtaggtccttcaccacctgtgagtgacatgctgcaggcgcccagctttcagttccctggttgtgacatgggaaggataaagcctgccccgcaggcaggtcacaggcttagctgggagccagcttggggacaagagcggggcacccaatgagggactgagcacagagctgccctccagagcatgctcctcacaggagctggggctcctccacactgtccaccggacttcactgctcccctcttacggcattggcacagagaacacccacctgtgttttagaacccctgcctccctcatggtcaataaccctccaggctcgcccctcccttggcaagcaaggaacctcccagcatcacgagaatgacctttccacaactcgcctccctgttctccatgagactcggcacagccactgattcatcacctcaggacagagcgctgctcactggctcccatgcagcaagggacctctctggtaaaatccactcgcctcagcctggaatttaggatgctaagtcagctgtcctcagagtccccatccagctctccaaattagcccctttccccatcttgccttgcgatgattatttacacacttcaccagccaccgcttcacccttctctcctccagtggaaaacatcaccatgtgatggacagaatatagctatgcagatgcaaacagacgttactggaaaaagagctctgtgatcaaaaagtttgataactgttgtttgataaatcttatgaaattattctcacagctttaagattccagtgtgcactgtgatcttttgaaagacaatgtatcattttgcaagagttttcagctacatttcttttaacgtgctggttatctggaaggactggtgtgctgaataattcacaccagcaaagaacactctgtttactttacaggccagagcaaagctctccccgtccacaacttgcccactagccccagatatcatctgtgttttaatgtccttaccatcaacattccatctgtgggtctccacctctggtctaggtgtatttgggttgcaacaattccttgagttgaaattccatcccacaaggcctatgaaggagcaagcttttccccaggacaacagagaggagccatgtgctgccctgggacacacaattggtgtcctttctcactaaccacagacacccccttcctggagtcatgggaagctcagcgatccacaaagatgaggcgctactgcagttctttccacaacacttgcttttagctattttacatctggatgtaactaatctgacaaaaagtgttttaatttctttcccaaagcaagtctgattctcaatcggtggttgaaaaagacaagggatcagcatgacatgctaggaaaagcctcaattcccctcctttgaaatcagcctccagttgtgtcttgtggagattccagcacacagctgccccttccttcctttcctccttcacgctcctagctatgacccaatgtgcatattacacaggtgaacagaggacatgtttgggtgagacggtttcacgaaaacagagatttaaatgatacagccataaatcaggaacactagactaacaagcaaacagaaattaaaacaagatgtctgttgcatgtggggccgtacaacagtagctagtttggctgtggccagcgcttggcatccccatatgcaaaacggaagggacggaagaagggggaacggtccctggcattatacatacacacaagttcaggccaaggagctcctggatataacttcactgacagctcatccacccgttacagcttcacaaaaagccctgacccaaactcaccatgccttattctcacgaagaccctcaaaactcacaactgtgtcacacgaaggtgtgattctggacctctgagaaaacaggggaaattttttcttcttagcagactgcaaaatacttcagatatttgagtgggctgtcttccctgtgccctttgcctccataactgcacacaagatgaacacacgcaccttctccatctgcactgaggttctcgtacgagtcccagcgtatcagtgggtctgttgtgttgtagtccacaatcacaccgtggtcgttgtacaagtgttcggaccctgcacagagcacaggcagcaacattagtcccagtgaaacccatcacctccatccaaccgactccaccataaggacaggtgagcagcctgacttgagcaggagagagaagcctctccatcctccaccctcctgccaggagccacaacactaatcagagactgtggaggattttccacaactagaaccatagttaaagccacgagggggaagggataagtaagcactgatctttcgtccactgtgaaccaggcttggacacttctgcaaaacgagtcttcagaccacctcactgatgaggacacagaggcccggtaagctgtctctgagcctcagagtccacagatttgaatccaggctccaggctctcagatccacactcctcccttcaagtctttttaggaataccaaggggatttttaacacacaagccatgtatttaaaggtttttgcctaaatctatgacaatgaacatagaaaaagcatgattatttccacagctattaaaaagggaaacaaaactcccatgcatgtggatcttggtgatggatctggacaattcaccttgatgataaagggactggtttcttttgaaatatattttttagggaaaaaaattgtttcgcacataatacttgcagcctactatacttctaattctctttttaaaatgctggttactttggggttaatgatgaaatcatgatggaaatttaaaaattccttgaaatgaatgataatagtgacacaagttatcaaaacctctgggatacagcaaagcaagtgttaagaggaaagtttatagcactaaatgcctacatcaaaaagtctgaaagatcacatattgacaacctcatgtcacacctcaaggaactagagaagcaagaataaactaaacacaaagctagtagaagaaaatgaaaaacaaaaatcagtgcagaactaaatgaaattgaaacaaaatacaaaagatcaatgaaacaaaaagctggtattttgaaaagataaacaaaactgatagaccattagctagattaaccaagaagagagaagattcaaataaattcaattagaaatgaaacgaaacattacaaccagcacgaaagatcattcaagactattatgaacacctttatgtatataaactacaaaactgagaggaaattggtcaattcctggacacagacaaccctcctcgattaaatcaggaagaaatagaaaccctgaacagactagtaaaaagcagtgaaaatgaatcaataatttttttaatgccaataaaaaagagcccagggccagatggattcacagctgaattctaccatccattcaaagaagaactggtgccaatcctactgaacaattccaaaagactgagaaagaggaattgtccctaactaactcattctatgaagccagtatcaccctgataccaaaactaggaaagaatataacaaacaaacaaacaaaaaagaaaatcacagacaaatatccctgatgaacatagatgcaaaaatcttcaacaaaatactagctaactgaatctaacagcacattaaacagataatacaccatgatcaagtggatttcatcccaggaagcaggggtgatttaacatatagaagtcaataaatgtgatacaccatacaaacagaattaaaaacaaaaaccatatgtcatttcagtagatgtgaaaaaggcattcgataaaatctagcatccctttatgataaaaacactcaacaaactaggcatagaagggacttacctcaaaataataaaagccatgtatgacaaacccatagccaatgtcatactgaatggggaaaggttgaaagcattccccctgagaagtgtaacaagacaaggatgcctaccttcaccacttctattcaacatagtactggaatagtactgccagagcaatcagctaagagaaagaaataaagggcacctaaatcggaaaagaggaattaaaactgttgctatttgccaatgatatgatcatatacctagaaaacaataaaaactcctccaaaagacttctagatttgataaacgaattcagtaaagtatcaggtttcaaaatcaatgtacacatatctgtagcactgctgtacaccaacaatgaccaaactgacaatcaaattaagaactcaattctttttacgacagctgaaaaaaaaaaaaaaaaaaaactagaaatatacttaatcaaaacgtgaaagatccatacgaggagaactacaaaacactgatgaaagaaatcagaaatgacacaaacaagtggaaacacatcccatgctcatggattggaagaatcaatatactgaaaacaaccatactgtccaaagcaatctacagattcaatgcaattcctatcaaaatactaatatcattcttcacgaaattggaaaaaaaaaatcctaaaattcatatggaaccaaaaaggggcccaaatggccaaagcaatcctaaaaacaaaacaaaacaaaaatctggaggcatcgcactattggacttcaaactatactaaaaggctatagttaccaaaacatcatggtataaaagtagacacacagatcaatggaacagaatagagaatccagaaatacaactgactacaactgattgatcttcaacaaagcatataaaaacataaactggggaaagaataccctatttaacaaatggtgctgggaaaactggctagccacatgtagaagaataagactggatccccatttctcaccttatattataaaaatcaactcaagatggatccaagatttaaatctaagacctgaaaccataaaaagtctagaagacaacctaggaaaaactcttctggacatttgcctaggcaaataatccatgactaagaccccaaaagcaaatgcaacagaacaaaaataagtaaatgggaccgaattaaactaaaaatcttctgtaccacaaaagaaataatcatcagagtaaacagaacccacagagtgagacagaatatttgcaaactatgcatctgacaaagagctaatatccaaaatcttcaaggaactcgaacaaatcctcaaaaaaaaaaaacaaataatcccatcaaaaagtgggcaaatgatatgaacagacatttttcaaaagatatacaaatggccaacaaacacatgaaaaaatgctaaacatcactaacccccagagaaatgcaaattaaaaccacaatgcaataccaccttactcctacaagaatggccagtcatgcccaaggctctcctggctgagtggttgtgagcaagtcacgccacttctggggcttactgacacaagtgggccttcttgttccactatccaatatcctacatttaaataaaattaatcacagaaatctccaaatatgcacaaaggcaggagactagtactacagccccagcgtagccatcatgcacctttcaccagtgtcagcaaggaccacccagtattccaccaagctacccaccttgaatcttctcaggcgtggcagagaagactaattcaaccttcccatagtcaggaaaacggtcatctgaaaaaaacaatgtattttaacacatttgtggagacaattaaccggaaaagtatggactgactttgtcctttattccaaccagtacagcaccactcccaaatctgcaataaagacaccccatgatacagaaagtataggcagtttcattggttatccataatttttttcccccagggatcaatgatcattttctcctactttgggaacaattttgtcagtaggctgaattttggaaagagggtaaaggggatagtgaaagaatcaaccaaggaggttcaaccgcagctgcccacaagcacagggccgccagctccgcgcctcacctttgctggcattgtccagatcctccttcccaaacaccagcccgtagccctgcacagccccagtgtgaaactgcaggcggaaaatgacgtcacgggtggccgagcggtatttcttgtggtagcatttcacctgggttagagagacaaaacaaaacaaagtagctgcagcgggggacacacgttcccggcaaggaacacactccgcggaggccggcacagcagggcctcccctctggactctggctgggagttcacgctttggagtggaacttcagccctggggcacaggcgcctgcagacagctggggtgcaggcagaggcaccacactgctgctgctgggtgcggggctccactggaggcttcaatgtgttccctgtgctgctcctgtggaaccgcagctctgaacaccactatcgctagtcctcagagaggccacacctaaaccctttcagaccacgtgaatgtgccctgttttggaacacatccgaaaaatagaattccatggtctcttttttctagactttaacaactgattgtgatagcttttctttgatctcaatgctccatgttgcaacttaaagctttttgttttccaaaaagcagcagccggtcattactgtgtgtactatcctaaatgattatgtgcatgctgtaatttagagacagagatacaaagaaggaggaagggagagagggagacagagagggtgttggcatttagacaagtgttcagaatcaccctgatgtgatctgaactcaagctggggttcatgaggtccccagggtgcagctcaagcaccctaaatgattgtgccaatgagccaaagggtagagcaagcccctccttgcagatgcttggcatgtggggaacggtgggcagagcaggagcctgagtgtcctgacctgcctgtataactaggtcccccctgcttcttgtgaccgtgcgcagcactggcatcattggaagggttctcaggccacagctgggggagctgcagggacagggatacccctcactcagagatcaggggcaggaccaccaggtagtggcactttcccaaatccccagaaggccgaaggccctggacaggctggattctgctctcagaccaaatcgtgcacaggcaggtacctccccaaccccgaggctgtggggtagtgactaccagagacagccacgttcccataaaagagacttttcttggagaaagatggctttaaaatatcacatgcctcacaacagtaaatgagaagccaccgcagcaggtatgatccggaccagcatgcgggagaattctgcagggagggtcttccctaaccagatgaacatccaccagaggaacaaaaagcccagaaacccagcccaggaggcagggagctgtgactccaggcagacccagaagatgtttacctttgtgctatctacaaggaaagggacgggtaaataaaccaaaaaaatataattaagactgtggaaggatgttccctgttgacaaacatgactgggtctcccttgtacggcctggcgctggccagcggtgctgtaaacatggggctcagactcaggcctggcctccaggggcccaggaaccagggcgtttgcaagtagaaaactggcattgtgaagaaatgttgcctcaatttgctttccaacagccaatggcacgttggccacaaatctaccacctctgtccgagactgacttctcagcaagactcaatcaaaggctgcccttgcagggatccttccaggatgttctgagagtatctgggcccctcctttgagctccccatgccccacactcactacactgaccacccatcaaatgcttcaacctggggcatattgtagagatccccagagggaggtccttctggccaagggtaaatccacacatgcacccccattgatagagatgatagcacccacctttccctgtctgccttcaaatgtgcctgtctgcctccactagtgccttgcaaatggggagtgaaaagtggttagggaagggaaaaggaaaagagatgccccaattcaagccagtcttgctctcaaattttataaatatttaagggaaccagagatttaaaaaaataaaaacaacaacacgatgtcagctgatagctcacgcagcctgtgctgccatgggcgccaacatttgcccacaggagtcaggaaactcctcaggaggcagctgtgggctcagtcctggcaggcagggagtgtcctgggtgaaaacagagggagctgtgggctccagtacgggccacataaggggcacagtggaatatccccaaccgcagctcaccgtgcccctcccgtcagtaccgccccgcccagcgcagggcctccttccaggccaggtcctgccctccctcttcaggaatccaggatgctcccccaggtccccccactgctcctcatagcagctacacacaaacacactgctcctcccgcagcaatcccagctccctccacataccagaagggaggagaaggcaggccacggtgcccaggaggtacagagtggcaggagatgggaatcggcctgtcccaaacaggttcctctccaggccccatatgattctcctgtaagattcctatttttcacagcacaagctttcaaatactcctaaggctccacagtgaaagaaagagcggtctatcccactggcagagaacaactgctgcctgaaatcacgtggccctcccttcaggggtttctctgtgtattttaatgctaactttgtttgctggcttgagatcctaacggcctcatcatacacaatccctgtttcatattaaacctctttcctcttgattaatggaggtaaacaccaccctccccagtcctcctgaccaaatcatgaactgactccagcttcttctgaaagacacggaaaaccacaggattttccctaactcggggctcccagcaaccaccatcaacacagcaggtcagatcttgagacaaaatccactcaccaaccaggagccctccatagtgtgcaataattatgcattatctacatcaacaaatctttttaggagcaatggcaagagatcagaattatgcttgtaatacttaacagaaagaacaatcaacatggtacttggtacgagggcccccaaatgcctccctttaagatataatagtaatgcaaacatttcgtaaagattagactgattcaagtctataattttcccttcatccctccggctttaactttatttacctgggtctccccagagtgtttctagaatatgttgatcctttgccttcagattttagaatatctgcatttaaaataacaactcaaagatgtgcagtcacaattttgtagcatagaaaaatgaaataagaaatagcaagcaccacaacaaaggctgcgcacagcctgtcaccatgctatcatagagccaaccacaaaagtacgtgggtgtgatgttgacatcacaaatcgctgggagcactcagatcttgagaaagttgcagcctctttagactttaaattctctgactgcaaaatgagtattatgatattgacctggctatgttgttataaagattaaattagcactacatattaatataattcattatccaataatgatatgctatatttatatgaatatattatttaaagggcataagcttctagagagagggcacttggtactcaaaaacatatagggtgaatgatgatctcaatgggaaggcctgtaagcactcttgctttcttttagtctgatgaggcaattcagaaaccatcgccaaaatttattttctaatagtggtataaaaatatgcctgtgcccggccgggcgcggtggctcacgcctgtaatcccagcactttgggaggccgaggcaggcggatcacaaggtcaggagatcgacaccatcctggctaacatggtgaaaccccgtctttactaaaaaaatacaaaaagccggtcatgggggcaggcgcctgtagtcccagctactcgggaggctgaggcaggagaatggcatgaacccaggaggtggagcttgcggtgagccaagattgcaccactgtactccagcctgggtgacagagagacactcagtctcaaaaaataaaaataaaaataaaaataaaaatatgcctgtgcccttgactggactggacaagttgctggtgaccaggaacggagccctgccttgacctcatttgctcctggagtacaccaagtcgaaggcagacacatggaattctcaaagaagttatccctcaatccagtgtttaaagacactgatgacttgcttaactttaggccacataagtgtatttttatttcaaactctccatcaacaagagaaaaagcaccatgtaccaagagagtcaaggcttaaggtatcagccccaggaatgccagtccccaattcagaagtcagccctcaggttcctatcatcccccaatgccagccgttgctgggcagctcctattcagctctgcttcccctaaatttactaagcaaaagagcagaaccctcaaagcatccctaacagaaaagagtaacattctcactcaatgctccactggtggcccaggcaactgtctacgcaggcctcaaggaatctgtgaactcagagaatgagttacaaccgcatatttggagggtaaaaagttagatagctaagccccataggtcaaagacttaagtcaggcagggccaacactaaccatgatttcttcacttggagctgaaaatgacttcagatgttcgcaatattgtaattcatgacctaaagcaattgaaaggtgggtaaatattggctgcaaacgaaaacacaaccaagtccactatgctgagatgacagcatggattaagacccagcccagtctaaaagggagaggaaaaggcaatcacaaaataatgctgtgatgcgtccaacagagatctgtagaaacctctcctggggcagagtctcaggagaacactttcattttccctggccttatgtaagtgccctcggtaagaaacaaccagcaacagcactatttgtttgtgaaaacttcttgagcaggcaacacctttgtttacaagtcgggtcactggagcgaggttctagagccagcaaccatgaacacaaaattcaagtggccgtggatttgtccaagcaggggcagcaagatgaagcatgtgtttacaaactgtggacctgagagccgagaccagggagggagcaagccggatcaggcccctggagccctgccagactcctgatgagcccgctgcccgcatgaattcctgaacagggttacataacgcctcggctgccctccccatggcactgtctgacaatgccatatttactaaacctcttgaggttctgcccttttgaaaggagcagacttaagaatctgaccttttgggaaaagcacactgcaaagatgggatgggtcaggtgtgcagctgggaggggccaagcagggatgggctggctgtgtcgaggcgaaggcagacggtgggtcaaggtcagctttgctgttgcctgcagcagctccatctgctagtaactgagtccagggagtggcaagtggggctctgttttcccaagtcactttctgcagttagacttgactctggcccttccttctctgtgaacttgaccactgtgatctttgccagtaagtcccagtgcagaggccctcatgaggaaagccaggcagatgtccctgcaggcaaggcagacaccagaaccacggaggggaaaactcaaagaggacaagaggccttttgaaggaggaggattaaggatggctaccccgcctgggaagccactttccgccttcaaaagtacacagacagcctcagaaaacacccagactgagggcaccaagccatctgcagtcttcagggtgtaaatctatgcacatgctttctgctcgttaggatcctctccaagccatgactgttgccaaaagaaataaaaccacctgcatatctgaactttacacagaaaaggccctgtaacttcttcccccactacagccttctcaacttaaggattgctcagtgaacctgcagcagggcacgtcacgcaggcacagggaaaaactgaaggaagggcaaagtgaaggcggcgtgggcatcctgtgctgagcatggcagagtgggtcactggaaggtcggaagaggctggagaggaggaatccggtgctgctcctgccctgcacaccctcagaacacccagaagaagcatgaacgggaggaggggatggctcccgctcctctctagggatgctttgccaataatgagaaacgtgcaaccgcatttttttcttcctgtgttgttcccttaggtcgttttcagagggagtcaacagcactgagatttctgggctttggcaaaagatgcactcccgactctgatgggagtgctggcagtgacaccctgggtttctactctccaggtcgaccacagatgtgagctctgctgtgaagccactccttctctgacacgctggaaatcatctctcccacctaacctttagctcttgccgccgcgcaccttctgccatgctcagttccacctgccctagctatctgcatgctcatctccctgaaggacccagactcccgggagcaggagccctgcactgcccactcacgtgtccaccgcatcttctcatgcaggccgcacgctgaacgtgctcaggataaaggctggtgacaaaccacagccacagggactgggccgtcaatggcacctgactgcgctagtaatcttactaaactttctaggagaggtttatttaataaacagacttgttacaggctgaatggtgtccttccaaaatccataagttgaaggtctcagcacttcagcatagggctgtgtttggagatggggtcttcacaaaggtaaattaaaatgaggtcattaggctgggcccgaatgaatgataactggtgtccttgtaagaagagatgaggacatagacacacagagggaagcccaggtgaggacacagggagaagacagccacctccaggtcaaggagagaggcctcaggagaaaccaccctgcccacacctggatctcaggctcccagcctccaggactgtgggagaatcacctctgttgtttaagctgagaccaaagggtgaagcctgagttgagaggtcagggccagggtgggtggacagtgctagatcagcagggcttggggacagaatggcgggatcagctggggcagcaagaggcggctggcgggttccagtggcctgagggacacagagtctgaatgccaagcaggttagagccagcaacaggtagaagaccaggaggagatggcaggctggagaacgccagcccagggtggcctggaggccattgggaacactcccaagggctgcaggtgggacactgaggaaaggaggccaccgcctccttcacccactcacggcccctctctgccctgccccaccctgttcctgggcctgcctcatttatcaagtgccaaacccacacctccaccacaccccttccaagtcccacccacaccgcccactcaaagcctcattccaactgctacaacagagatgcatgtaatgtctactcagaccacacgcttgggctgcggtgcccactacagggtgggacaggataagacgcagcaccatggggagagggcctatggggtgggtggggtgctgggggctcttccagagggaagaggcagtggctgccccaaagactaagccacagtctggtccgatagaggaaagtgacctggtgatgccgcagggtcacatcgatgcagtttcatcctctgccaggcgctgtcctgggagacttatgtgactgagtacatttaatccttacaaacctgcactaggcagaggtctaacacttcccaaaacaaaatatgcaaatatgtaagccctacaaaatctggtttcaaccttccaagacaacgactttccttgcaagacagacatccttacaacagcatcagcctttgtgggtgcctcaagcctgggatgcttcatctgtttgtataataacaccccttccaacctggagccaactcacaggacacgtccatctgagtcctcctgtgacctctcccaccccgtctcatcaaggcctctgtaggctacacggtatcagtaggttccctcctgccagaaagcccatgtccccaacgggatcctctagggcaaaaacttcactcatgggcctagagcaagcatagcaactccaaaagcacaaaacattaaaaaaaaagactactggatgaatgacagtaggaagaaggggccacagaaaataatgaggaggaaggagggagggagcagagaggaggaaaaggaagaagggcaagaggaggagggagaagtttgtaaaggcagggtgggagagaagagaggggagaagagaaggaaggaggaggaggtagctgggaagagaggagaggagccaggcacttcccaggagactgcccccgcccgcctggtctcaggaagaccctgcagctaccagcccataaacagcccaggggagagggccccgcctggtctcaggaagaccctgcagctaccagcccataaacagcccaggggagagggccgtcccatgctcttggtgggcggtaggggggaagacacatcttagcctgagggtcaccctctatgactgagttgttcagctgcctcccatgagtcatcttaaagggacggagccgtggggcaataactactcatcactgaagacctggttcagggagcaccctgcccttgagatgctgcctcccagggcaggtagaacactacgcaaacaagatgagggcgggtgcaaatcctaccagcatcgcccccagcctctcttggcctattcttttttttttacctctgagacggagtctcgctctgtcgcccaggctggagtgcagtagcgcaattttggctcactgcaagctccgcctcctgggttcatgccattctcctgcctcagcctcctgagtaggtgggactacaggcacgcgccaccttgcccagcttattttttgtatttttagtagagatggggtttcaccgtgtcagccaggatggtctcgatctcctgacctcgtgatccgcccacctcagcctcccaaagtgctgggattacaggcgtgagccactgcgcccagcccggcctcctctttaaagctggaacactagacccagttccagagtgggtggaggagtaaagtgctgaacatagccggtgctcaatacagactcaggcccttcgtccaacgatcccaggaagtgtcctgggagaaggagcctccagggtgaagcctcctaggaaacaagcccagggctgccttctggaccacaggatgtgaggaacaccagagcggatgtttctctcccctcctggtcctccctctcacttccagccacagggatgctgcaccatcgctgcagcacagcactgctgaggacagacttccagcccaggtcctcctccttaggacagtagaacagagagctgaggaaacgggcctataaaaacgtatgacgcaccccaaacctcagctttcttgcctatgaaacaggaggcaagatgtttataaagtgcttactcaatgccttgaaaagggctgggcccagctgttgttccagacctgccttccaggcctgaagaacccctcaattaggtggtgagcatgtgaaacaggacagacctggaggccccagagggaccccgcaggcgtggatgggtttagactgtctccaccttcaatcctctccaccttcgatcctcgctgatttgatttttgtaagaattcaggaccagcaaggtagggagttcaccatccactaagctaagatttcaaaatctaggggttacagggaaattaatgaaaatcctcaaaaactttgtatagggtatttataatacaatgaaaagctatttctcgagtcaccctactgccttatagaagtgggtcttccaaggccatgaaatctttacattctatgattctatgcatgctgaaagtcatacatatgccttaaaagcttaccttatttcagataaaaaattttcctaaaattattttaaatgtatgaattgtttgtattcaagaaagataaaaggcaaaaatgtaatggctaatctcctccaagaaccaacacacataagaatcaaaattatctggagaaatcattgttttgatcattaatcaagctgtaattgcaccagctgtatttcacactttggctattaatgatacataaatattctatttctgcacccacactctgggaggcctgtgatcatgtgaagaatgcaaattatagtcagaacacaggggttctcagaagtgagtggccgagttaggacattaatttccaggttgtatatctcgaggggctctagaatgaaagagaatcaagaatgaagatttgttccgtccctttaattaaaatagttttattcagaaagttaactaaatgccttaaggcagtggtcaccaatctttttggcaccagggactggtttcacagaagatgatttttccatggactggtggaggatggtttcaggatgaaactgttccacctcagatcatcattctcctaaggagtgtgcaacctagatcgctcgcatacacagttcacaatagggttcgcactcttataagaatctcatggcgccgctgatctgacgggaggctcaggtggtcatgctcgctcgctggcccggttcctaacaggccacagaccgataaggtccacggcccaggcgtgggggaccccagtgttaaggtaaaagctacttttccttcttcctacagggtactttttttgggggtgagggttactgttttaacacagaatcatgatttcaagtcatcaccactgggagagtggggacaccaacccatctgcggccacagcgggcactcaccatgacatctcccttcagaagctgggccggctcgatgacgatgcagatcctgctggggttttctgggccaacgttgctttgggatgaagaagaaggtagatcattatgcaacttcatgattttgtgggaagaatacatgtagagaaaagcaaccctacaacccaaaactcagaaattacacagaatgcccaatcagcccagaatctaattcctgagaatctaaatgaatctaaaaaggtaaagaaagctcccaggccatggagggtcctcatagcatcatcatggtcagtgactgacttgaagtgactaaggtccaactccagaggcccgagcttggagacgaccatgcaggcttagaggaaggggcccagggtgtgcacagccacagtttcagttacaaactgagggtgcaattccagagtgacatcagtgcacagagggcccagagcaaacccagaaatgtgacaacagctctttgtgagtaatgagaatatttgtttcctttactgacttttcataaaatgcctgtccacatacaaaaagacaaagaaaactcaggaatgtgtacaaatttgggggatgtgtggctacgtattgtttaaaatgcaaaggaggctagacatggctcacgcctgtaatcccagcactttgggaagccaaggcaggcagatcacttgaggtcaggagtttgagaccagcctggctaacatagtgaaaccccgtctctacaaaaatatgaaatttagctgggcatgatggcaggtgcctgtaatcccagctactcgggaggctgaagcaggagaatcgcttgaacctaggaagtggaggttgcagtgagtggagatcgtgccagagcgagatgctctctcaaaaaaaataaataaataaaaatggaaaacaaaatggaaaggagcgagaaagaaaaaccatagtagtgagatcctatcgtaggactctctccagtaggctcacagttaaccttccctattcttgggttccacattcatggactcaactgactggggacagaaaatattgtgggaaataaataaaaaacaaaaatgcaaccataaaaaataatagaagttaaaaaacaatacattgtaacaactattttcacagcctttacattgaattaggtattgttatgtaatctagagatgatttaaagtatacaggagaatgctcatgggttatatgaaaatacaatgccagtttttttgttgttgttgttttctttttttttcagaccgagtctcgctctgtcgccaggctggagtgccatggcacaatctcggctcactgcaacctctgcctctcaggttcaagcaattctcctgcctcagcctcccaagcagctgggactacaggcacacgccaccatgcccagctaatttttgtatttttagtagagacgggatttcaccatattggccaggatggtctcaatctcttgaccttgtgatcagcccacctccacctcccaaagtgctgggattacaggtgtgagccaccaagcctggccttttttttttttttttttttttttgactctcgctctgtcacctagcctggagtgcagtggtgtgatctcggctcactgcaacctccacctcccaggttcaagtgaattctcctgcctccacctcgagtggctgggtttacagatgcacgaccccaagactggctaatttttgtatttttagtagagacggggtttcaccatgatggccaggggctcggtggctcacatctgtaatcctggcactttgggaggccgagacgggtagatcacttgaggtcaggagttcaagacaatgccgttttataaaacacacttgaacatcctcggatttggtaatcaaagggggtcctggaatcaataccccttgaaaaccaaggggccaccatactccaaaaagcaaatggcccactctcccctcaaaattccagcccccacgtcctttaatggagccaactagtgtgacagcccaaagacacttgtgcagggcaggagggagggccaaggcgtgatgctggagcacgggccacgagaggattttccccactggactcttctttggcttcttggcattctctgacctgaaccctcccacactcttcctgcgggacaggcagctgagggtcagctgcagttccctgagccgtccaggtcccacaacagcagcagcagcagcagcagcactcactagatcccggaggtgtacacaggctgcatggcttggtagagcttcagaaagggccggcacactgaaagaaaggcacaactgtctgtagaggcatgaccggtacagaacgaacaggaatttggcaatcagaaagacagaaagcgacgaggagaccaggagactgcacctgcggcctttgaggtctgggaaagcagtgcatggagccacagggttgctgcaggaaaaggccggacccggtcctagaagcctgcagagcaacacagtttgacctttatccaaagggtgccaaaggctcctgaagtgaagccaagctgcttcaaaaccaactagcagcttggcaaggtcactctggccataatgaccagggggacctgaaggcacagatgtacttcagagacaatagaaacctctgagcaagcacctgcatgcgactggcgaggaagggcaagggtcctgaatcccagccatgtgctgtgtgtgcctgcataggactgggaaggagaggacagggccctgaccctcagccatgtgccatttgctcctgcatgggacaagggaggagggatagggccctgctgaccctcggccatatactctgtgcacctttggggaactggggatgtggagacagggccgtgatccccagtcgtgtgctgtgctcatctaagtgggacaggaaggagggctcagggccctcaccctcagctacatgctgtgtgctttcctgtggggtcattttaaaggaggaggaggagatgggttcatgagatgcgtcaggggagactgggtcacattcatgcctcttactgggcttcttccatggcttgtgacctcaaggccaactgcacagctgacccactagggctgcagcccagaacaatgcttgtctgccctagtcactgtgcatatacacaggggtatttctgatcccccttgctggccgccagtccctcccctgattaaataacttggcccaaccacataaacatggggctctgaccactgaagggggacccagtcaatcgccagggaggcagaggagcagatcctgggccctctcggaaggaaagccgaggcttatctaaattgaggggcccaggaccagctccaagtctgggccagccaatcgcaggtgccacgtcataggggacactcacctccacctgtgtcgaagttgggggtgccgtggaggatgacaaaatgcaggaacaggggagaggcattcattttcaccgatccggacaggagcccactgaggaactgaacatacctgcaaaacggacagctgggttacacttcccagaagtgtcttcagcctctgctgagaagggaactcaaggagaaacacatcctggctgagtctggggctctgggagagaatcggtccactgctcacagccaggggttctcagcatggtgctgcgcttacaggtctgagggcttcccaccagcgcaccaggcaccaagcaccagacaccaaggcacaaccggcctcttggcttgagcatcccacacctgaaaggcctctgtgcctgtccactgaacctatcgccaggcaaagccaggccacaggccacaggccatcacaatccccactggtgagcagcaggaagcagaggcctggcacaccggtgggcgtgtgctctgtcactagcattgcacctatggcagggtcacatgacccaggcccagaaccactcactgcacctgctgctttctgctcatactcgagagccctaagaaaaggctggagtccatactcccctcctatcccgcagccttccacgccacatctgataagaggctctccttcctgctgtccccctcttcaaggcccagctccaaaggcgaaggccatgtgggccatcagcctttctgagttctaggagtcggcctcatgcttccaacactgactgcacacaacttccatgagcatttggtggtcaagagggaagcttctacactaggagcatctgactgctggggtcctcatgaggcatgacgtggcagcagtgaccacaggatgagccggaggcttaccaagctctctgacgcttccctggcctgtcctgcctgttggtgccctgcctggcgtggcccctgccctgaggtccctcaccatggccacttcacccacataacctccactgtagcctcaacaccttgcatggaatctgtgtttccatatctgtctccaccaaagtactgtactctttgcaagaaaaacccaaacaatcaaaaactccgcaatatttaacaatctgtgcatctctctactgccatggcagactgaggcaggaagtggcaggtgactgtgttgccagcacctacaaccatcctaccctaagccagaaacggccatcatggaccttgtgttaagacaaaagtctctcacttacgctggcaattcacacccagtcccttattcaagcagttaaatttgtatacaaacaaactaaacaagagaagatttctgttaaacattaacaaaaaaggaaagccctacttatagtccacccactaggaaaatgttagaaaagcgagtttgcttcagttcagttacaattcgtagtgagaaacagggcatgtcagtatttccatcttcctggcagcaaacttctcttctgctctctcagaacagggcaaaacctcacaagagtcgcagaggacagatgctcagcctggagacgtggggaccctgtgaggctgatgaccagacttcagtggacctccaggcagctcccacacgcctctcctgcagggtactttctaccctggcaacaagacttctcaccctcagttgtacgtaggcagaggaatgcatgaattgtatatgtttaatcatgcaaattttacgcattgtggatttcatgggtcctttggctccctggttttgagtaaaagtgaggaaccacaaatgcccggattgagaggcctgagtcacctcctctggagcagttccgccctccttccagcacggggcagccctggtcactgggaaatcagcttcctcagctcgtccagtttgtcagtggcaccctgagtcccacactgcctggccatgtgctgcagtgaccacgcggctaagacggacctgttccctgggggtgttctcagtgccccatgtgcacctggaccaggcatctaggtgaagtcgatgtttgttttatgacttcctgcaaacatggaagactctggagcgctgggcctgaggggctcctgttcatggcagcataaggggtccaagtagctaagcccagagttagcgccaaggtcctatgaggggcaaacagccatcctccgggaaaccatggcctctccctgacccaggtcttgtaccatactgtggtcacacagcttcatttctgctgatgtggcctggccgaaattgttgcccctgacaccagacgaagcacgagaagtatttccttcagatgaggagggccaagctgacagcagaagaactttgttttgccacgagctcccaaagaaggccaaagtccagggccacaagcccagtagtggtcagaggggaagggaaggaggctgtcactgcctgggacccaggactccagagtcttctccccaaaaccagttctcaacagtcatcacctcccaggtcagtctacaaagggctgctcaggtggtagcttaaccaatcaaaaagtaacctcttggaatataattctcatctgtcctttatagaaaacaactttttatgcatcatattttcaggtaaattaaagacataaaatgctaaggtaaatgtaattttttttcttccttcacatgctttcttaataaggtaagattaacaacaacaacaaaaaaaaaccaacatattgttcaaaatcccaaataaaagcatgcctttaaaaaacattttttaaaaaatagcaatgccttataaaaacaacaaagttcactgcaactataagctgtagtgaatgctatgagattgcagacagatagccaacgtaggtaatagcactgagtttgtgagtgacttcttagagaaccaccatcagtaccaaagaacagaacattcaggtatggatgaaaataagggaggccaggcgcagtggctcccgcctataatcccagcactctgggaggctgaggtgggaggatcacctgaggtcaggagtttgagaccagcctagccaacatgctgaaatcctgtctctacaaaaaattaattaattaattttaaaaattagctgggcatggtggcatgcgcctgtaatcccagctacacaggaagctgaggcatgagaattgcttgaaccaggaggcagaggttgcagtgagcctagactgcaccactgcactccagcctgagtgacagagcaagaccctgtctcaaagtaaaaaaagaaaagaaggggaaatgaacataataggacagaattgcacaattagttcatccagctgactatggaaaggatcaactttaacttcgtatacacagtatttatctgtggcattaaaggtagatataaatgaatcaattgtagggtatcagatgccctctaaagaccatcccaacagccttatccaaaataaaatgttcctacttagtcaacacagttttcagagctggaaagattagaaaccagatactttataaaaacagctccattattttcccattgctatcttttctttctttttaggaaataactccctggagatgatgttttccatgctgcttctcaaaccagtgagtacattttaaaaactaaaggattgtttttaaacttgtaagcaaacgaacataaaagcagcttgaaattttcagttgtcccttgcattattcacagccacttctaacagcaaaaacttccatttggaatctccataaatctccctaaacatttgagttgcactagacgttagcttaaatctgtctgaaatggtgggtgcataaaaatcagcattcaaatgttactttttccaagcaacaggaaccatcgtcacaggacatctttcccaacagcttactcattctacattcccagcactcacagagtcagccatggctgcaggggcagcaccaaccggccaggaaaggtgagctgggccacctgttggtgtcagccaagcctgggctgtttcttaacgttctgctgagcattcccttccctctcatgtaatgggaagaataatgagacctacacattggaattgctgcaaagatgagtcagttgcatggacataagggtcagagtagaccacaacacatctgccacagcctctgctctcctgaggtatgctgccagagtgtaggtggctttgcccacagagttggaggctcagaggggatgtccaggcccaggcaaagtgtgtggctccctgaggaatggtcaccctttttccgcaggctgtgggcagcaaggaggatgtgcagggaggggccacaggggcatgaagtaaaatagcctttgcaaaaattttaacagtgagagaagtatgacagtgaaagagatctaatgtaaccaacccccatcttgcctttaacctcctagctgcccttggctattcctgggcttggaccaaactaactttaggagaaagtaaagtttatagtttaaatgataatagcccaaaactaaaccacttttgtaaaactaatgcaagaccaccacattggtaggatgaaagcggcttgaattctgccaaggtatagacttaaaagattactctggggatcacaagatttgcaacttcctcaattactgctagagataacatcaccattgtagaacctaagattggccttttgagatgtctattcaggcttttgcatttctgacaactgacagctctacctgacctgccaactgttctctggccccacccagaagtggactcagaggcaaaagggtcactttcccctatgattgcacccccaaccactcagcagcaccccattccctagccacccccttctccccaaaatatctttgaaaaaccctagcctccaaattttccagggggctgatttgggtagtaataaaactctggtctcctgttcagccagctctgcatgaattaaactctttctctactgcaattcccctgtcttggtaaatcggctatatctgggcattgaataatgaacccatttgtcggttacagagactatctgaggagcctcatcctttagagaatgtggaaaactactctccttgtatctttaaagtattctttcaggcacctgaggtactgtgtcaaaaatgacagaaatatgaaaaatcaaataatgccatttttacaggcagttagacaggcatgagcagggcagcagagggctctttccgcacgcactaggagaatgtggggtaatggttcggcaattatcacattgcctctctgaaagtgatacactggcagctggtgccaggaggaggccgtttcctgatggtccacgcctattgcactgttaattgaatgcaggctccagggagacacaacttcttgggcacgtgcattaacagaaaaaatggcagagtatgaccttctcagggtacatcaccagaaaagggaagaaaccctcagataggcatgcgtacaacttcctaaacatactgcatgtgctcacttcccaagcaaaaggagggcactatgcattcgggcagccccctctgagggaagaatcacgggaaaggggcacaagacatgggaagtgggccagcctataaagtctaggaccaaggttaaacaccacacttgaccttcatgtgcccgcttgggtctcttctaagcgtactttcctttctttcttgttctaaagccttttaaaataaacttccactctggctctgaaacttgtctctgtctctttttctgccttatatccctcagtcaaattctttcttctgagcaggcaagaattgaggttcctgcagacccttatggattcactgctggtaactcggataccttccaccagtaacactatataggataatttctaggacatcctgatttctgtatgccaagacatttgtttggtctgtcttccctttacctcaaagggacacccaaatgtgcatagacaacatgactgatggtcttaggtgactcccacatggggcctcccagggtcaccttggcaggcaacactcaggagagatcagctccccaaagaaacaactggctacctgtcactttccccattaactccgtgatggggccaagaaacatgtgctgctgtctcaactatctcagaaagaaaggaaaggcagaaaagaaaagagatgtcagaaacgttaataattttaatattatttccatgatgctgataataaaccaaaactatacccggatttttggggcgttaggaggagacagggtctagctctgtcatccaggctggcatgcagtggggcaattacagctcactgtaacctccaactcctgggctcaagggatcctcccacctcagcttccagagtagctgggactacaggtgtgtgccatcacatccagctaattttttttttttttttctgatagagatggggtcttcctgtgttgctaaggcaggtctcaaactcctggactcaagggattgtccggcctcagcctcccaaagaatcgggattacaggttagagtcactgtgccacacccagtatttctttttaactacttctcaaagaggaaggcttccaagtttagggaaggaagttcaggggtgcctcaataacacaatggtggtcatgagcaccaacaggaggccacactggggtgtcaacaagctgcttctcatgatttgctgaagacaaggaaggtataaaaacagaaaacttacatgggcacatgtgagttttacgggtcagctccatgggccaactgctccatggcgtttcagtgtaacaaagattgacctcccatcagagttgctgttgagacttctgagcttcccagtcacaaattccttgctaattaattattctcaagagtgattattacgagtttgactttaaaatgatttcttgagctcagtcctaaagcagcctgcagcgcacccatcccactccccaggccattcaggacaacagagaagcctcccatcacagagcctattcccatacaagctgtcctcacacgttcttctggtctcaaactttcctccagatttatcttatgcattcattcgtttacatgctcgattaccatttggtgagcatcttttcatgcaggctctggtcaaaataaaaagaaaagagcaaggagtaaggggcatttccctaatctcaggagcagagggattaaccttggaatgtaaaattgaatccagcaagcattaaaaaatgcaaatgttctggcttcaaatgtgcaatgacgggaaggatgcatgaaaaccctgggcatgggaatgtgagaagagcagggcatggtggctcacacgtgcaatcccagcattttgggaagccacagcagaaggattattcaagctcaggggttcaagaccagcctgggcaacacagtgagacactgtctccacaaaaattttaaaattagctgagcatggtgatgtgcgcctatagtctcagctactcaagaggctgaggtggaaggattgcttgagcccaggaggttgaggctgctgtgagccaagattgcaccactgcactacagcctgggtgacagagcaacactctgtttcaaaaaaagaaaaaagaaaagaaaaaaaaaatgaagagatatcttccccctttttccatattcttttaatgttataaacaagctgctggtgccgtaagaaataagaacaaaaaaaagaaaagacgacagctggacttcctgtgtgccaagcattctgcatgggttactccctatttacacctcattttccatgcaggaggtcatatgaatgtcacgattttggaaactgttcaacaaagaaataacatttaatggttccaaaaaaaaacaaaaaaaaaacccaagtgactgtttaactaaaatattttagaaaatgctaggttttctgcacacaacttgcattgcatgtgggccctgttgctgaccacagtcctacaccctagcccatgttcctccaacacacccggtttcaagagaaacagagccatgccattggaaatagcaagacaaaaggaaaaggtgcctctggtgatgcttgaaatccctttctgcccgtctacccccatgtctgctgacatagccctcagttgcactggagaaaatagatacaaggcatcaaaacttgcatacacaaggtcgggtgtgcaactacctgtctccaaaacggaacaccatttggcaatcaccttggcaattctcctacaaattccctgctgtgggctttgaaatatgccatggagctacctggttggctctaagtgtcaccatctgtggaggaagtaagtgcacctggatggggagccagctgtgggtccttctcactgcctctcagccagccctgctcaggttcttgacctcagcctgctggggtgggcagcaaaaggagaaagttctgcaccccaccatgactattccccatcacttactgagctcattccaggggccacgcccaggagcagagaagggagagatgggcagcatgacagaaaaatactccgtggcctcagggaactgatgagctacaagaattggccaagtgcaactgctaatgtgtttgtgtaagtaaagttttattgcaatacagccacattccctgatttccatattgcccagggctgctttcatgttagaacagttgcgataaagatcctgtagcctgcaaagcctaaaatatccactctctagtccgttgcagagatagttcactgacccctggtctagccaatagaaccaagttccaacataataatggaaatcaaaactcactcactgcaagagaggaaaatgccaactggagcaagtcctccctttacctgtcagtgcaagccagcagcatagggggctgtctctcaccacagacacacaggatggctaagtccttaacctctgggagggacaagtctccccaccaccttcacagtctttggcatgacccaagaatactattcatttaggtgtcgggacagaggagatgcctcttctgttttcacatttttatatgtaaaatttcattcacctcttcactctggctttggggatctatacataccgtttttgggaaggctgcattaaagctgaaactttgtcatcataaaacttcttcattgcaaacctgtcaagggcctggtcggcgctgaaggggagagagagagaaagagagttaactcagtggagcccacaccacgtgggtacttgacgggggatgtgtctcatggctgttcaaagcgaccagctcccacaaggggcttcaccctttgctgcacctgtgcacacccaatccacctgtcccttgttagacttcatttcccccgcaggaatatgctgtgctcaaagtgggagccatagtgcagggtcagaattctcatctgaaataacagctccttatctaaagatattattcttaagagtgctgaatacccagcttgcagaagaaccaactgaggcttctcagcaggcaggtggtagggctggtgtccaaaactgtcccttggccaccctacgtcctaaataaagaagaccattttaagtgggctctgtgcaagacaagcaggcagactcaagtttcaggaccacatggatgcagggagcaacccagggcaggagagtcaacagacacccccatgaagtcccaagaggcaccctcgggacacaagtgggccagcctgtgccccgccagtatgtcactcccaggactgggcttgagaaggctgtagggcactggggttggaaaggtgtctcaggcctcggggctgcagcattgtttttgaagtgactgaaagtaaccctgctttccaacaatatatttgaccttcaatgccaggtccacagtgcccacaggaagtgtctgacagaaacttccagaaatctcacagcagggcattcatgggatttcttgatatgacttcagcacaaatcctggaatatgagtgcagtgtcttaacaattccaactcatttgggccaaatgcttccttaaaaccctgataggctgggtgcggtggctcacgcctgtactcccagcactttgggaggccaaggcgggcggatcacctgaggtcaggagttcaagaccagcctggtcaacagggtgaaatcccagctctactgaaaataaaaattaccgcggcatgatggtgggtgcctataatcccagctacttgggaggctgaggtgggagaatcacttgaacccgggaggcagaggttgtagtgagcagagatcgcaccattgcactccagcctgggtgacagagtgagactccatctcaaaacaacaacaacaacaacaacaacacctgataaagtgggcccgttacttagaaaaatgtgtctgtgcccctccagaaaaatgatgtacataagcactgcggacttcataaaaatcctggtagagagacaggcaggaggaaaaagaaacatactcaaaagtaagttgagtgtgatttgactttcacagaatactataaaatggacaacttgctacgtgcatttgctaggcaaggggctgtgctggtggggcagtcacacacagaagggcccactttagcaccgagtccatcacatactgagcagcagagtgcagctccatagcctcccagtgacttttaagcattcctttttctgaaatttacttgttttattaaatgctgagaatacattttgaccaatgtttattttctatagtgatatgagtagtagtaataatattagtactggttttgtctttataactcttatttctatggtgttgatacaagaatgttcttctctggtgacttgaagtttcttttttcttctgtttgcagtttgtgataaagatctcaaatgtgtgcttgtgctatctgggattactctacttctggaatataatctaagagggaacattgtagaaatgatcaaaaatatatgtataagaatgtgttcatcatggcaagctttgcagtagaaaacaactggaagcaacctaaattacaaaaaaaaaacacacacttaggaggctgaggtgggcaaatcacgaggtcaggagttcaagaccagcctgtccaacatggtgaaaccacgtctctactaaaaatacaaaaaattagctgggcatagtggcgggcaccagtaatcccagctacttgagaggctgaggcaggagaatcacttgaacctgggaggtggaggttacagcgaaccaagatcacgccactgcactccagccccggcaacagagtgagactctgtcttaaacacacacgtacacaaaactggaagcaacttggataggcaaaatcaacaaatgcttaaatacataacatatccattgaataaagtgctatgctgccactgaaatgatgtcgggaaatgatgcatataaaatgatattaatgtagaaaatcaagtcacaaaaagcatgtggtatcagcccatttaattgaaaggcacttaatactattactcctaataatcacagcagcgttaatgatagccaatacctgagtaccgatgctgttctaagtgctttttgtgtaacatatgttgaactgtcacaacattctgggaagtagagctaccatcattttccaggtaaggatgctgaggcttagagagattcaggtaaattgcctgacacatgcagctgaaatacatattgactattgagagaaaacagagtttgtaccaagagcgtcaaaggtgtgtttttagccctaagacatctacccttcccaaaaaatccgggactatccacagtgcatggaacttcggttcaggcagtactactttgctggggatagaaatgctcaggtgtggctgggcgtggtggctcacacctgtaatcccagcactttggcaggccgaggtgagtgatcacctgaggtcgggagttcaagaccagcctggccaacatggtgaaaccctgtccctactaaaaatacaaaaaattagctgggcatcttggcacacacctataatcccagctactcaggaggctgaggcaggagaatcgcttgaacccgggaagcagaggtggcagtaagccaagattgcaccactgcactccaacctgggcaacgaagcaagactctgtcaaaaaaaaaaaaaaaaaaaaaacagaagtgctcaggtggtctctgtccagaaccagccaggctatgtttagtcaccaaccaaatgtctttggcatcattgagggatggatgtgcccaggaatctcgattttcctggcacacacacacaccgatgattattctcaccaagagggtatctgattttcacttgggggttggtttcctccctggcaggcaccaactcctcagttggtttccagagaaaacattcagaaagtcaaatttcactccttggtgctagaaaggaaaaggtttatcggctgatatgaataggcttctatttcctcagaatggaaagttcaggctttacaaagaggccattgagaagacagggcagatgcaaatgtagaccccataaataatattttctgcactgcatttcagcgagagtgaagatctgcactctgggaagggtccgggtgtacaccacagctgcccagggccagaaggatgggcatagggctgaggtccttgtggccctgctgtgtttgtgtcatgtctggcttaggggacccgagtggcacctccaaagtctccacgattacagttccatctcatggaaaccagcccagacctggctctccactcctaggctgtgagatcatgagcaagctgcctggctcctctgagcctcacctccctcatccatgcaatgggaatgatagtaactgcctcgtggattagttaggagaattcagggagaaaaggaaaataatcagtatacttcccagaggcccagtgcctgcaaaagaggtggctgtcatcatcattatatacaaggtatgagctgatttagtgagaccactctgttcttttcataatggtgacttttatctctgttattttttgttagagaattctctattaaagaacaagggacagtggggtcacttatttttttaatgcctccatggaagtacttagaatcaatcacacagtcacccaacctggaaaatgccactttcacaagtgtaaacgcttaactggaaactgggtttctaggcactgaccaacccagcactggggaatgggaaacacaggtcagccgagcccttggtatccagaacagctcccgcgcagacagccttcagccccatgcaggcccagcttttagcacctcaagacagcgagctgacatcttcatcctacctggctgagacgttggtgaaatgcatgtaggatgatatgaccactcctatgcgtcctttcccgccctgcaggagacaaaagatcagctgattttctctgaaatcccacagcagagatgtaattagaacaggaaaagactcactagtggacaaaacaatagagagcctgctttggtggtaaggccagcattacccacagccttcctgtctgggaaagtcagtacccagtgcaactggagtctctgcaacagggaacccgcacgctgggtgcaaacagtaagagtgggtgctaactggagcagctgtagaagcccaggagggctgaccaacacagcagctgcctgtcattttacccaattaggctggaaaaaactgtgccaggagctgcagcaattagcatgacttaattatccaggtcagacagaagtgaacgcctgcctgctcacgggctgacaatgatcagggctgcaaacacagctcagcatgatgggacatagattccagcttactggcagcactgccggcacctgagctccacatacaccgccgcagcccaccctcattacacataaaggaaccactgtcccaggcagaagttctggaaaaggactcactcaaaccataaccacagacaccaacagcccagcccacagaccagcaacaccagcaggagaagcagaaactattggacaggccaccttcacccagggccacagagtgccaccttctagaacatactcttacaacctacaacagcagattgcaaaccacagcccaggagctacttctgcccattacctactttcccacaacttgtgagctaagagttagttttacattttctaactattaagaaaaaattttgaaaagataagattccatgccatgtgaaaatgtgttgaagttcagatttcagtgtccaaacacaaagtttgactagaacatggccactcccatctgtttacctacatccagggctgctttcactctcactgcaggggtaggtttgagtatttgcagcaagaccacggggactgaaaagtgtaaaatacaatctggctcttttttttttggagacggagtctcacgctctgtcccccaggctggagtgcagtggcacaatctcggctcactgtaagctccgcctcccgggttcacgccattctcctgcctcagcctcccaagtagctgggactacaggcgcccgccaccatacccagctaattttttgtatttttagtagagatggggtttcaccatgttagccaggatggtctcgatctcctgaccttgtgatccaccagcctcggcctcccaaagtgctgggactatgggactacaggcgtgagccaccgcacccggcctaatctggctgtttttaaaaatatttgccaacccctgatctggaatcatataaagccaaaaaggcagggcctctaatatgtagctccctaacttcttgagaagaaactactgatcaaattcaagtcacaattctgataagcccagtcatacatgaaagtcacccaggagcatccttctctctgtcagtgaaagtcaagagcatgccttatagatactcaatgcgggcacttgatacactctttgcagctgaatcctggcacgtgcaattattaatggtatggctactagtatacctcttgcataaaactatatttgacagcaattcacctacaaagaaacaacacctcagccaaaacaggcacacatggtggtgacattcaccccattatcaatcacttttgtggcactatttatggatgtataaagcaagtatttcttttcttttcttttcttttcttttttttttttttgagacagagtttcgctcttgttgcccaggctggagtgcaatggaacgatcttggctcacggcaacctccacctcccgagttcaagcgattatcctgcctcagcctcccaagtagctggaattacaggcatgcatcaccatgcccggctaattttttgtatttttaatagagacgggcttgctccatgttagtcaggctgatctcgaactcccgatgtcaggtgatccccccgcctcggcctcccaaagtgctgggattacaggcatgagccactgcacccggcctataaagcaaatattaaaagatctgaagggacagatagaaataccacaaccgtacgggacttcagtaccccattttcaacaatggacagatcacctagacagaaaaccagtaagaaaacagggtactcaacctgcactttagaccaaatagaccttacagacatatacagaacattgcatcagaatacgcattcttctgaagtgcacacagaaagttctccagcatagatggcatgttaggccacaaaacaaaccttaacgaatttaaggagactgaaatcatattcagtattttttctttttttttttttaatggagtctccctctgtcatccaggttagagtgcagtggcatgatctcagctcactacaacctccaccgcctgggttcaagcgattctcgtgcctcagcctcccgagtagctgggaatacaggtgcatgccaccacacccagctaatttttttgtatttttagtagagacggagttttgccatgttggccaggctggtctcgaactcctgacctcaggtgatctgcccgccttggcctcccaaagtgctgggatcacaggcatgagccaccgcgcctggcctcaagtatcatttctgaccatagtggtatgaaactagaaatcaataacaggaagaatcttggaaaattcacaagtttatggaaataaaacaacatactcctaaataactactgggtcaaagaaaaaaagtcagaagagagatttagaaatatcttgggagaaacaaaaattgaaacacaacacaccaaaacttatgggatgcagcaaaagcagttgtaagaggaaggtttatggcaataaatgcctatgttaaaagacaaaaaactctcaaataaaaaaacctaatgtcaggcagggcgcggtggctcatgcctgtaatcccagcgctttgggaggccgaggtgggtggatcacgaggtcaggagatcaagaccttcctggccaacatggtgaaaccccatctctattaaaaatacaaaaattagctgggtgtggtggcacgtgcctgtaatcccagctactagggaggctgaggcaggagaatcacttgaacctgggagttggaggttgcagtgagccgagatcacgccactgcactccagcctggtgacagagtgagactccgtctcaaaaaacaaaacaaaacacaaaacctaatgttgtacctgaaggaacaaagaacaaactaaaccccaaattagcaaaggaaggaaaaaacaaaggtcagagcagaaacaaataaaggagagactagaaaaacaatagaaaagatcaacaaaactaagggttgggttttctgaagactaacaaaattgacaaatctttacctagataagataaaaagagaaaactcaaaatcagaaatgaaagagcagtcatcataactgatgccatttaagacacaaagaaacataaaaaactatgaacaagtacatagcaataaattggataacctggaacaaactcataaattcctggacacatacaacctactaagactgaatcatgaagaaacagaaaatccgaacaaaacaataacaagtaaggagattgaatcagtaatataaactctcccacaaagaaaagcccaggacctgatcacttaactgatgaattccatcaccgaaaaaaagagaaaacttcgctatggtttaaatattagccccctccaaaactcatgttgaaatttaatctccaatgtggcagtattgagtggtgaggcctataaaagatgattgggtcatgaggaaccttgccttcatgaatgggttaatacatctgtggattaattaactaatggattaaccagttatcacaggagtagaactggtggctttctaagaagaggaagagagacctgagctagcaccctcagccccctcgccatgtgatgccccatgcagccccaggacctctgcagaatccccaacagcaagaaggctctcaccagacgcagccccttgagcttggacatctcagcccctataaatattaatataagaaataaattccttttctttacaaattacccagtttcacatattctgttataagtaacagaaaacagactaatgcaaactctgccagaaagctgaagaaatgcaaacactttcaaactcattttacaaggccagcagtaccctgatatgaggtctttcttaatgaaatagtaagtatttaaggttttgcaggctgcaaggtcttgtttcaaccatccaaacctacccctgcattgtgggtggaagcagccatggatgtacgtgaacagatggaggtggccatgttccactcaaactacgtatggaactgaagtaggacatcttcatataatgttcatgtaaatacagctcttagctcacaggatgtagaaaacacaagagggcacgataggctcatggactgttacgttttagtgcaagctgcattcttttggacttggaattgttaacaaaaatcacagaatcactaactgcacaattttccatgggtattcttcaccatggactcagaaacaaaaggtatggtgtggatgaaatctcccaaaagaactgcaggccatttctggtcagtcaataaccagggtgtggaggggtgaggaggagactgcacacacccacacaaacacaagcctctgcatcacacggcagaacgggaagcataggaggaccgaccctcactctgttcctgcccaggctgagacaggcccagctacgctagaaattcctggcatgtgtggaaggaaacgcgcattctgcaaagcaggcggatttcgccaaatgtcagcgatttcacccccgcagtgatgatgatgaacttctgttaacatcgacatcagcaatttcaaattaaaagagggcttatctctcagggcacaatttctaagcgtttcaaaaatggtttacatggcaccagaagagggcaagccattagcaaatcacttctgagaagtttcaacatgttcccatgaattccactaacaagagctgtccagaaagccgaaagttgcttagcaaaaggatgcattttagaaagctctaggtggtccccactaggacccatatgttttaaataatctcatcatttctttcaatttcatttaaaaaattgaagtgaacaacaactaaaatggaataaatggccaaggatggcacttttcaagtccagcaactccaagagacttctgacaatgcagcaggcagcaggtctgggtgtgccctagaacctgcactttccacaggtgctgctgctgggcccaggctcacagctcaggaatgctgcttagaacagcttgctacgtgatcctgggcaatgatgatccatcaatatcaggctcactgtgtcaaaatcaccacaccaagcctgaaaagcataggttgttttaattaacaagaattatatttatttaaaagtccgtctgtctatctctctctctctctctctctctctctctctctctctcttagtttgcaccaaaacacaatttgggtgaaggatccataatctaaaataatacttgaaaagatcaggtcatcacggacgatttggtggtcctaatgggtgtacctgtccatttggggggaaaatatgatcaagttagatgtgaggaaagagacaacactagagagaagcaaataacatctgtgtgccccgatggaagttttctgcacatcaagtggtcatcatatgccttacagctgtaaacaccatccacaagccagcctacctagtgcctttgcaggaaagatatactgagagtctaatataactcaaagggaagcttctttcaaactaaattccataatacaatggatttctgtgcagttttttagtgtaaaagagtccggaagaaaaaaaaaaaaaaaacttctatcttgaaccgtcaacacttcctagatactttgatggtcctaagaatgctttgtcaaacacacaaaatagggagctgcccattaatgaacagtgaccccagcccactggctacatcctttcccaaaggattcctccctgactcaaggtgtgactggaataagagcttttctctaatagtaagtttctggcaggagggttaagcttcacacacttacccctcagtgagtttgctttcagtccaacccctttcaacaacaatcacatttgaggagcagtacaaagcagttgagaaaactgggaattaagaggaaagatcccaggaggtgggaggaggaagcatggaaggagcccgatgcagccaggaggaggagtgcccaccagctatgcacctgggctgctggcatccaccaaccctgctggggctgacagacagacagtcccggccactctgtgaagatgtacaggccatgtctgcactgcaatggctccacgtggaaaggacaacacgtttactgcaatggcatcatgccatcatctagtccatcaactgattaccataactcaagatggcatggaaagtctgacacagtccatctgaaaagggcatacatagctcttttgaaaaggagggctttccatgaaaaataaaatttaataaaaatgaaacgatttgctctcataatcgtggtcaatttggggtcaacagtttcaaatgtccagctacacattcagggaccacaatcctataaattctaaagccaaacttggggaggtgtgataactctgtttccttctttaagagcaagtaggaaaacctaaagacaaacccataaggagcacatcgcaccagctcaaagcggaaatgtgctcagatgcagcattggtctccatctcaactccaaaggctgaagcccagccagacccccaaatgtgagagggggcgcactcaccctgcagtgaatgacgaccacatgctggaggttgctgttcagccaggactcctgcgccttgcatatggtacacatcttatccaggggcggtgcgtggagctctggccagcccacatccatgatctgcaacaagaaaggggagcttcctcggtttccatttcctaaaaccttctgaggccatctcacaatgacttctttcatcatcagtacatttcatttgggagtaaagaacatgctgggtgaccctttcctaaaactcagtgagcatgaggatcaacttccttcactgggaagaaaaaataaagcattatactgcccatgtgatgcctcttcttccaggggctcatctgctcttctgcagctggggtgacaattctagaaaggtctttgagttgctgatggtgcaggttgtgtggacggggctgcagtccagtgagatcacaaacaggagtcctaggcccaagctgctgccaaaatctccccactcgggttaaaatcccagtttggagagtgcagccagccatctcccacaccgtgcggacaacacctcagagacaatctcctggaaaggcagcacttaaggaggaagcaccttcaaaactctaattaagtttggtgcttggacaaagaaaatcaccaccatgtgctaaagacacagtgactcggtgcagaactgcagctctgagcgtcctgaggcacacacaagtccacagtggcccacagtggccacacgggggtgttgcttttcctttgatttccttttgtcagtaggacgaggacaaggagctctatcttatgatgaaagtcgtagaaatagtgtaagactgttggaaatttcagaaagttgccaggaagtaggaaaagtcactacccctgccaccactcaaagataaccactgcaatgttttcatgaatcccttagtctcttttctgtatacatttagcataattgagatactattatacataaattctatactctactattgttaactagtattaaaataggcaacttatcatgtttctgctttgttactctaatggctgcaaaatatttcaacatatagaatatacatacatatatgtaccacaacttatgttgactcagtcttaaaattatcccaaactttgctgttgaaaatgatcatgaagggtgaggggcaaggggaatgagagcattaggacaaatacttaatgcatgaggggcctaaaacctagatgacaggttgataggtgcagcaaatcaccatggcatatgtgtatctatgtaacaaacctgcacgttctgcacctgtatcccagaacttaaagtaaaatttgaaaaaattttaaaaattttttaaaaaatgaaaattatcatgaaaggagtggattagtatgaccataaagagatactagcagaagagagccccatgctgatggaaatgttttgtctcttgtttgtggtggcttaacaaatctatacacatgatgcagtttagatttattctatacatatatttgttatagatttgttccatgcatatatatatgcagtatatatgaaagatcccaggaggcgggaggaggaagcatcatgtgtatagatttgttctatacatatatattagtatttatcatctatacacacgatgccgagaaacacacatgtacgcaaaaccagggaaatgtgagtgaggtccgtggactataccaatgccaacttcctgacctagatatttcactattagtgttgtaagattctcccactggaaagactgggtgagaagtacaggagatctctgtattattttcacaacttcctacgaatctctaactatttcaaactgaaaaaaaagtaattaaaataattgatatgaacaattcctaatactccttatcaagtcacattccacaaagactagtagcaaattatttttgcacaaaataagcattgtttacattttacaaaatgcagaatataaagggatgaactctgtacctttgggttaagcttcgtaaggtcatatctcttttctgaaaggtttaatacctataaaagagaggaaaaattgccttgcataaaatagattttaatattttaaaaattaatactttaatttttatttaattttaattaatactaattttttaaaaaaatatctaaaatcttcacactcacaaatcagggggaaaaaaagcttttagacaaatccttgacatcagagatgaaagcagaaaacacattgcatttttacatgatgtttcccttccaggtaccgaggatcagaaaagattgaaaaatacagacttgtgtggtcacagaataaaaaacaaataaaataaataagataaggatggcatacagaacccttacacataaagtctatattctacttcttcaactagtattaaaccaggcgatttactgtgttactatttttttttaattctcatggctacaaaatatcccaacatataggatacacacacacacacacacacacacacacacacacacacacgtataaaatatataatataaaatatatatacacatatatataaaataaatatcacggtcttgctcctgacaacacaaactgacccgatagagaggtggtacatggtggggaaggctgtccctcctctatggcctggtggccccaggcctggaaagggctgagttcatgcccggccaaaagccatggcctaagttcactgaaaaatcacagccatttgtggaaccttgctaaatactcaagtagttcaaaatgaaaataataataataataataataataataataatgttccagcagcaaggagccttaaaaattaactaaacgtccctctcacttcagagtcagagatgtgaggaaagtggagggtgggggcttgtcctggtcacccagcaagccctgtttatgacaagggggggcgctgctttgtgacccacagttcatttctaaccctgcacaagaaaaagatccctgccatagccattttgcagggagagctctggccctgacaaggccccacagacaggtgctggccagggctccaggccctctgcatggtctctttggggaagggggactggggaagaggggaaggatggccagagaggagactcaggatgcgctgaccagcctgggagtggcttccaaaggaaggagccatggtcctgcagagcacaccgcctcagtgatgaaggaggaagccctgaggaggagagggcccctggtgagaggcaccaccatcaaatggggcttggccaccacttcctgtccactgccaggtcacagacaagacgggcttcaagaccagaaagaggcaggagcctgagtgaatcaaggatcggggaggggtcaggacccaggtagcacctgggccagggctgctctggcatcagacggaggccacatcctactctgccacttgggtccacctctcccagccactggtgccccagtcattggagcagaccagcaaggaagacaatgaacaccttgtaggtttgcagggcagattagctttaccacagataaggaggcctccttactagagataacaaggcaggtagagagagggtgccagggagctgtcattcaatcccattagtgactgttgacagcagaaggaagtcagcctccacctgggctaccaaccatgggaacagaaaacaaggggccaatcagagggtgagagatggtgagaggctgttctgtattattcctcagatgtggctccaccatcaactcgacaagtgtgttttgaaaatcaagctgtctccttgtctccagggcagcccctggtttcttgggtgcccacctaatttgtcttcctaatttctggctcaggaggagagtcacaagtttgtctcttgatacgagggatgcagcatgggagcgcaagggtggctggctggggacatgtcccaaggcactggggagccagcctcactgatgagtgcaggacaaggcaacagccatccctgcggtcagcagtcgtgtgtccctgaaagctacctacagagacacataagtctcctccccaggcgtggcagcagagagacagaggacgaaggcgccacggacagctgtgtgagcccaggcccttgagcttctccctcatgtgtaaaccagtgttctgtgagtgcccatccctacacagtgcctgctgcagagcctgcccaaaggctcccagagccgcccaccgctcaccaggtagttgtccccgtgcttggacttgagcatgcgcgtgacctcctgtaggttgtgcaggtaggactcctcagagcagccggcagggaaggacacagcgatgatgcgctccgtgatgtaagtgaggtccagcccatggccctcctccatggtgggactcaggatgacgggcctgcgagagagcagtgggcagatcagaaacagggtaaggaggcagcagacattcatcctctaggaaaaaggtgaagacgacggacactcatcccctgggtgttcacatcagcacctgggcggccagctacgggaatttacagtgtgtgcagcctctgtgctgtgttcccataacagcgggcagtgtggggaggggcacaagattgaattttcctagcagggcatgacggggtaccgcaagctgcggtcagggaacgcacagagagaaagcaactcagagcagtgacgcatgggctcaaatgcaaaagcacgaaggcgggaaggactctttgtggttacactgggagcaggaacagggttccaggcgggactcctggagtgggagcctcaaccctgctctgaggtgtcaaggtcggcacgagggggcaccgggagggggccaggaggaagcggagatggtgtgagcagaagccaaacatcagcaagcagctcctcgtgtccgtatgcggcatcctgggggaggtgcggccaaggatgaggctggtgaggtggccagctatggtcgtggaggaccctgcaggcccaagaaggaggcaggacctcacgtggagaggggaccagctggggcataatcaaagcggcctttcatctactgagtagcaactcagcagactcctatcagaaggctaagagctccatggggccccgctgggaccccacccagctagccacaggccaggtggatgcagggtagaatgtggggctggccacccaaccaggtgcccaggtggccagggcaggcccccaagtgtgagatgaagactgtggaggagggaagagggaagagggcagaaatggtcatgtcatggccagcaggctgaggacttgggcaggactggcagtgtggagtcaggcacccaatgtgactggagacaagggcctcccacagaccacagattctccaccagccctgtgggccccagggaggcctgagcccctcccaggagtgctcctaacattatggctgagggtggtatccaggaggaggtggaaaaggttccagggagaggggatggggttgaacccaatcggtgcccccatgaggtaaagccagaggcatgggtgcacgggacgtgtccttaagtccctccaaagtgctgccaccagctttggggttttcatttttactactcctatgtgtttctctctttcttttaattttggaaaaattcaaaaccatataaaatggttttgcaaacctccatgtacccacatcacctaacttcaaaattaccaacacacagctaacctctgtccatcaatatctccagcaatctcctccaccactttgattgctttaaagcaatcccagatactatgtaatttcatttataaatcttgcagaatttatttctaaaagataagggcactttttgattaaaatgtctacaatgccattatcacacctcaaaaagaaataataacatcaaacatccaataccatacatttatttttatttttatttatttttattttttcgagacagagtctcgctctgtcgccaggctggaatgcagtggcgcaatctcggcttactgcagtctctgcctcctgggttaaagggattctcctgcctcagcctcccgaatagctgggattacaggcatgcgctatcacacccagctaattttgtatttttagtagagatggggtttcactgtgttggccaggatggtctcgatttcctgaccttgtggtctccccacctcagcctcccaaagtgctgggattacaagtgtgagccactgtgcccggcccatacatttattttttaaggttgatttgttcaaatcagcatccaaacaattcccaaggattttgttttctctaccttatttatcagacatggatttcattccaattcaaatgtattgaacactgttagaacagaaataaagcgcttcctacggtcatgaggatccacagtgagtgcctctccagaagatgctggctcagggcccccctcatctgctctaaaggggctcttgccagcacaccctggagtctcccccaaaagtgacacttgcacaatcaggcctcagcagtgcaattatttattcaaagacaatcacaggtgtttctaccacctgggcttctgaccctgacacagcatttagaaacggacagaaaacctggcctgtatcacctttgattggcaatgtttacaaccaaagcagaaattatgatttctacagaagaaaatgatgccatgcccaagtttcctctgtagagagctgacctacagccagagacacaggaatgcatgacccacacagacactcaccgcagaggtttatcacggcagagagaactggacagcgtggaactccctggagcctgcaaataacaaaacaagggtcattttgaagtttcctttcctgccagtctacatgacacagacaccactgagagggaacaatgacagccgttccacagtttaatcataaacagcaagtcaatcgtaactacaagcccaccttatcacctcagaagggtctacaccatgttgtgtgattcagctcaccagaggacgcagtgccactaaccagcatcaggacgggctttcacaggagccagtgaggccaccctccagtcagggcaaggtaggcatcgcttggcctgcaaacagtgccctgccctccaacacaggaggtgccagatgacaccagcgctatgactatcatggctgctattatttacttgaaagaaccaattaatgagtgactttcaggaattctcagtcatacctactcttttttaaagagcctattcaacagggagaaaagactcgggttataattactttatagttatataactcttccttgtgtgtaagggttgttatatactatggtgacagagatctactatttcaggaaaaatgcccagcaactgtgtgagtaagaaggctcttcaatatttcagaagtgaggaaattgggactcaaagagggaagcgatcttgtcagatggcagaggtgaatggggaaacccagacacccactacagggctccctcaaagtctctttctgccccaagccaggtaatgctgcacacaggagcccagagacccccgagttggggggacacagagcctccggcactcctcctgctccccgatcaaagcaggcccacagacaccaccatcagaggcatcaacacccccgatcacacctgggatcccactcaggcaggtgcagctcacctggactccttaggcaagaaatgaacagaaaacaaattctatgtatatttcggagaccaacaatacagatgttttcctgaaatcataccaatgcaaagcctagcgccaattccaaaaccacagagatcatcgtctcagcctcccaagacaggggcaggatctaggggcgtgctcttcagttctacaccaaggtgccggtgagctcagccctgggtccacctcctcattgtttttcccgggaaagccccttggccactccacttctttgtctcctgccttttgaagtgagaatagtaacagacagggccagtctcatggagctgtccagggattcactgaggtaattctgtcaatggcttggaatccagcctggcaccgcatggccactgcccgtgctgggcagacctggtcaagtgaagtcccgtggtctccagaccccgcccacccctgacatctgagctgcaccccctgctcatcccctatgcccacaaagctgcaggaggctccaaacatgttcctctgatcttctcaaagccctaacccaaagcctttcacagctcagactagacagctacaaaacagaagactactcttttgcctagtagagcagcaaaaataaaaatcttgaaaacattttttaaagttttgatgaaatataaacagatgcaagatttcagaggacaacttgtcagtgtgtataaaaagtatttagaatacggccgggcacagtggctcacacctgtaatcccagcactttgagaggccgaggcgggcagatcacttgaagccaggagttcaagaccaccctggccaacatggtgaaaccacgtctctactaaaaatacaaaaattagcctgcgtggtggcgcacacctgtaatcctagctactcgggaggctgaggcacaagaatcacttgaacctgggaggaggaggttgcagtgagccaagatcgtgccactgcactccagcctgggcaacagagcaagactctgtcccaaacaaataaacaacaaaaaaaaagtatttagaatacaatcccagagtaaactgaatgcactaaaatgaagtctccgaaaaggtaaggaaatgatacatcaaaaacccgtttaggttaattcatacaatctgtacatgtaacactcaaattcaagcagctcagatgcaatcctaatagagccaatctcattatggggaaactcagcttaaccagggtcccatttaattcaaaaaagtattcaataagccaacatctcaggggagaacagcaaggagtttgatcgaccatggtcctgggtcttacatgaacccaccaggatctgactatatgtgtcccacatcttcaccagaccacgcatccaaaatacagtgactcccattgcaatgccatgctggagtacactggcccagttcctacaagtgggctgtcgcttcagaccctatgtcacgcttatcatttgaccgtgaaagactggcacgcaacttaacatataaacagcattatataactcatggggcaaaactatttaactctcacatgacacatcattccaagatgacaaccacacaaatacgtgactgctcactgccggcaccaacgtgatggggtaggagtgtcaccgtccctcaggcggggccctgacggcaggagggaaggagggaagggtcccagaaggcatgaggactctgctgtccctgacggaacccagggcccatttcctcagctgcagagtgagaagggcaggtcagacagacccacgggatcttctcaatccaatagtctctgaatccaattcagcattataggcctcgatacagtaactccaatgttcaaaccccgaaaccatacaaattgcaaccactgccaaaaaaacaaacaaaaaaaaccttttaaaccaatagttatataatttctaaggtcaaggccaatggaggaaactgtaatctgtgctatcaccacagggaggccccagcacctgagctggtgaaaagtcagaaagtgttgaattgcacaaagttgcttacatgaagtgttcggaaatgcagggttcctgtaaagtgtcccagcattgcccagagacaccccttccttaacctctgtattgggaagaggggcaggaaggaggaattcagcccgtcccccaacatacccaattttctatgtaagtctacatccacttaaaatcgaggcgagaaacccagcacagctcagggccaccctccaaaaacacagacagcttgacacccactcaaatccccagccccagacccgcatctgtccacctcatgcctccagatgtgcaaacacaggtctggccacctccaaggcatgtggtgctcagcagcttccatagcacaaccctgaagagcattgcacggagcccagcagaaaccccagtaagcagacatcaccacccctatgttacatgttacaggttggtaacatagggatggtgatgaggaaatgaggatttggtgggcggacgtgttggaatcccacagttaagctgcagtagcaccttctgacaccaaaactctgttctccttccatctcctggctttcaggtggtccacaccctctcctgcacaggctgcccctgaatcacatgaacatcagtgaggataaaagactcttgcttgggggagctgttctagccccgtgccaaaaagggcagagaaactatggcccttccatcacttccaagtcagcgtctgagatctcatgtgactaaaatccccctgaatcattcaggggttaaatctggaaccaagtagaggacatgcctatgacaggtccccctgacacactggggtagaaccccctcagctgctttgacttggactaaaatgagaaccaggccccatactgaactggaactgccgccaagagtttctgaaatactgtgcttgtcaagaggagactcagggatacaatgtcactgtaagtctttatttgaaagtaaacaatacacctacacttgggttgcacaaatctaaaccctgtgtgtgcaccataatgcatttcatgactgaaggatgactgagaaactaacttgctataggttatattaaacctggctcctgagaaacccgaaatcctaacctcatataaggtttaaaaaactctctctacttgtaggcaccagtcctgcaaatctgtgttgcaaactcactctctaggtgtttttttcttttgttttgttttgttttgagatagagtcttgctgttgcacaggctggagtgcagtggcacgatctcagctcactgcaagctccacctcccaggttcatgccattctcctgcctcagcctcccaagtagctgggactacaggtgcctgctaccatgcccagctaatttttttgtatttttaatagaggcaaggttccactctctaggtgttttgaaaagagagctgcctgctcacgtcctcagaagccttcccaagctgtggtttccttgtggaccctatcgccaatgtcaatcaaatccaagcccttagtgattagagtttccatgagatagaaacacaagttgcttcttttgttctcttgttttccagggtgaaaaaacccagacagcaaagcctcccacccagcctctgcccagcccatgcctccctcacctgtgtccctgttggcatgctcttatcacagccttcaacacccaaataagagaaagagaaaagggaggcccaggtagaatctgtggttaaggttaaacctgcaaaaggtaagcctgcaaagaccgccctgttccaggctgcctttttttttttttttttttttttttgagtctcactgtcgcccaggctggagtgcagtggcatgatcacggctgactgcagcctctcagtgacttctcgggctcagatcatcctcccacctcatcctctcaagtagctgggactacatgcatgtaccaccaaatacggctaatttttgttttttttttgtagagatgggggtctcgccatgttgtccaggctgctctgacgctcaagcaatccactggcctcggtctcccagagtgctgggatcacaggcatgagcttccgtgcccggccagactgctctttagaagcattttccttctacaggtcctggagctcatcctggccacgtgacaaactggccccatgggctcaatgaggtcaatgaggtcactaaactccctttctcttccggtaaaatgacagctgtggatcaaacacttggaggtcatcccagtcctggactccctgagtcagtgagtgaaaagtgaggagaggcattcctcagataaaaaattagatgcactgcctggagggtcattctggttccacatatgtttgtttgtttgtttgtttgtttgtttgtttgtttgtttttgagatggagtcttgctctgttgcccaggacagagcacttcctagtgtgtcacagcagtgggcgagagcagactaagcggcaggaaggcaaaaacacctcttttgggagaaagtagcctagccttatggcaaagcacacaggctccacatcaggcagtctgggtccaagttaagggtccaccgcttggcacctgcagcctcaggaaaggtcctccactcgcctaggcctcatctccctcctctttccaggactgtgcgctcatgtcccgacctcaccttggagttagcaatccacgcatggcacactagggcaaacctgcttttcacagtggccctatggcacatggtcctgcagtgaccctacagttctcagtcccgctgtgccctcctgcagggcgccatcctgcagtgcgctatcctagcacaccctaggcttcaccctaaagaccctaccctaaagcctcatcccatcccacagcgccccaccccaccacgcgccatttgccaagaccagcggacaactctagaacatgtgatgatgctcgctctagtatctctatgagaaccatgctttccactgtgaactgcggcttcttgctcaggaggacagccctgatcagaaggaagacctgagcttcaaagagtctttctgcacatctgggagcagaacaagggaagagccaagcacatccacctaaagaaggcagagaagacagcaggaggctgggggccctggcagaaggaggggaggctgtggactgctgggactgaaagggccactggagattccccaaggccactgccaaagcacatttccagagcagccatccctggagctgctcccttggctgtcacatcaacaccatggccaccacccgggcaggagtaagcacactcaccagaaagccagcagcctcctctgcactcacccatgtggggcatgcagagggggagcacagggaggagggaagagtgaaagacacaggccccattccctctgcaacaaaacttccttgaagtccacgacgtcccagggagacatgggatcctccccaggtggggtgggatcccagctggtttgatgttcctctccacagctgaggatctgggagcccccacctgacaggaaggttaatttcgagacaagcttgtaatcaatgagagcccaactctggtgggaattcgatttttttttttttttttttttgagacagagtctcactctgccacccaggctggaatggagtggcacgatctcggctcactgcaacctctgcctcctgggttcaagcgattgtcctgcttcagcctcccgagtagctaggattataagcacccaccaacacacctggctaatttttgtatttttagtagagacagggcttcaccatgttggccaggctgctctcgaactcctgacctcaggcaatccacccacctcggcttccaatgctgggattgcaggcgtaagccaccgctcccagccagaatttggttcttttttaacctatgtccttcgactgcttgtttgaacaaatcaacagtttccaaaacctcacagtatagtaatgaaatctgaaatcagacagacctgggtgtgagtcccacaccacctgccagctgcagaatcttgggccagggcactcatgagcctcagtgaccccatctgtggagcgggacaatgatgtctcccttgtgagactgttcacagaataaagacaaaaatgtccaatgcctgcctgagactaacaagccagccttgctcactgcagattgtccctgagccttgcactgtatgttgccgatacatccagttaaactgtacagaatctctactgcccagggaagtcactgctcgacgttcagcactgtgcgcctggcacgggtgcgtatcctgcaggtggaaggcagtgtgaagagtagagtcagctgcagcaaaccaagcctatgtcgtgcaattaatgctagtgcggcatttcaaatggagcatccttcactgacgtcccattgccatggggtgaaaggcaggtgctcagcctggtcctcagagccctgggtgagccagcccctgcctcctcatgtgcctccctcactccctgtccctaccttacctgctgtgcttcctcctgccccaggttctttgcacataccacacagtttagaatgctcctcattcatgtatcccagctttacctggttaactcctgtgatttctcaagcacttggctcagatggcaacttccagcaaagcataatctgatctccctacccgacctgagtcatatgttcctttctactttggtctcctttttgttttgtttttgtttgtttgtttgagacagggtctcactctgttgcccaggctggagtgcagtggggtgatcttggctcactgcaacctccatctgccgggttcaagtgattctcctgcctcagcctccagtagttgggattacaggcgcccgccaccacacccggctaatttttgtatttttagtagagatggggtttcaccatgttggccaggctggtcttgaactcctgacctcaggtgatatgcccgcctcggcctcccaaagtgttaggattacaggcgtgagccaccacgcccagccctggtctactttactgtgccgaccacaactgcaagaaaacaactaactgtgaattctcgtctgagctctacagccccctcccatgcggatccagcagaggcactggcagtctagctcccagaggtatctctagcctctggggccgcactctgcacacaatagccacccagcacagcagtctgtagaatgaagaaaggaagaaacgaaccactaatcccaaagtggctgtggagtcatctggccatctgaagaggcatgaggatgctgttattagatttcaataacagacagctagttagctttagttttgggttaacaaaaataaatgtacccattgactttaacaggcttatctaaaagaagaataggatgaaaagcagtgacatctgctccttcccaaggtcataacatggaataactggggcctatttaggaagacagtgcccacagaatagcaatgtggttaagcatcagcttgacagctcggtaaaagctaacagtgtgacttggatacacatgactataaactgtggatttttctcacccactgagctgacctcagtaccctgtgcctactcaagtactgaaaacggtaatacacattttttaagtgttttctcacataattccccaagactaccctttaagaagcagtccccttagcatctctgcctccctaagacccaagaccctggagcagaggtgaccatccctcttcccaggggggctctgaccactggcagaaagcaggtctccactatctgccaggcctctagctacagcccaggctggccaaagaagcagtaactagcactggccctcactcctgcttacccaggggccaatatgggtgcagggcagtgccaggataggttaaacatggcaccccgttccctgcctctccttgtcctcactggcttttggtgaagaggaaagaaaagaagcccttggcagggcatggtggctcacacctgtaatcccagcactttgggaggccaaggcaggggatcacaaggtcaggagttcaagaccagcctggccaacgtgatgaaaccccgtctctactaaaaatacaaaaattagccaggtgtggtggcaggtgcctgtaaacccagctacttgggtgactgaggcaggaggattgtttgaacccaggaggtggaggttgcagtgagccaagatcatgtcattgcactccagcctgagacgctgtctaaaaaataagaaaaagcagcccttttatggacgtcatgttaggaatcccagcaaggcctaagcctgcaaagagaatatcagctcccctgggtgtccccagggcctgtgcgctgctcctagcagcctgaccagccctgaaaactagcagtgtaaacagctctgtaaaaagaaacaaaaggccaggcacagtggctcacgtctgtaatcccagcattttgggaggtggaggcaaatggatcacttgaggccaggagttcgagaccaacctggccaacatggcgaaatcctgtctctactaaaaatacaaaaaattagccgggcgtggtggtatgtggctgtagtcccaggtactccagaggctaaggcaggaaaatcgctcaaacccaggaggtggagattgcagtgagccgagatggtgccactgcactccagcctgggcaacagagcgagactccatctccaataaataaataaatcaaaagaaacaaaagccacggataaatccacaaggaagcaggactatgaacagcccggtgacgagagacacagatcacagctgccgggccatgtgtgaggtgaggacaattaaacaggttgggctgagacacctctgcacattctgtttttgtttcaccaagcaaatggagaagaaataaatgtaaaatctttttcaaaggcaacaacctgaacaacattcagctggcaaatttcaaggcatttatttgttcatccttcattgattcctccaccacccagcacatacgacttgggggttcagcacacactctttgtaatactaatgcctgggtaggcagccagctctactgctcgagtaagccgtctgatcttgggaatttacttgccctctgtgtgactcagttttctcatctggaaaagggagacagaaacagcattcttggaaggattaaataaggaaacataaacatagggcttagaacagtgcctggccagtaataagtgccaaagaaatattagctacttattccatcatcttatttctgtgtcaggcctctgtgaggccctggaaatgcactttatccacaagttattaggatcccccttagatcacaaaaccagctgtgaccacaatgcccatttaacagtaggagaaacaatgctcagagagggtaagtgattttcccaaagccacacagttaataagacatttttttcccttccagaacaagaataccaggaaccaattaattgtcaggattgcccaacttgattttctgcttaatgcttttaaacataagcagcaatcgttaagaactgccagagaaagtacaccccatggagggtgggaaactaaaataaagtcatcttgtcattttaccttcatgttcaactatgagaaacaacagactaagattgtatctctatttatttgtaacgaaatagtcacaggatcctgcctccctggccaggagctcaggctggtttggaaccatatggaaggaggcagctcaggaagactggcagcagggagaggtaagcaacactcagggaggacacagagatgtcagcatttccaaagaagtcggaagctcccctttgctcttctcacaaataagtttcccaagaaggggcagatggggcggatggttcttaggacacaaggtcccaccgaacatctgcagcattgaagtgaaaggggaaaaatgacttggaaatgccccttcactgcaaagcagccagtaccggaggccacagaggagggtggccagggacagacaaagtgcccagtgccagcccagccgagaggcggcacgtggggagttgggaacttactgtgctgggcctgggcagggaccaccggccagggctgcttttcccttccagaaacagctcctcctacgtttcgctccttcccctgctttagtcaagcacacccctcttcgtgttaatgtctcggcagctctgggcataaaggaggcagctggaatagcccaccaggtgggagagcctggtgagtgtgggagtccccagaaccacagccaggagcagctggcaggtgtgcccggccccacggtgagcacgcaggcatggagctcacaggacaatgtccgcccggggctgagggccagcctgccgagggccagcctgccaagggcctgagggacaggaacaagaacagcgctctccgggagagccttctgaccaggaagctgagtggctgtgccttcctggggactagccactagggagaaccgcctctcaaaagttcccccaggaaaaacaaaacctacttcgagctgctgggagggcaggttactcacctctgtatcccaggtaacagatgcctgatgcccactggccttcctccctccctctttccttcctctcccccaaccccattctctcctttaccacttccttccttagttcatttttgctccacttcattccaaatagaatttgagatgactcatcgaatgaattcaacataactaaataaaatttttaaaataaaaaccaaaccaataaacaagcacaaaaacagggttaaagacaagagtggccaggccagagagaaggaaaggtatgcagcgaaacctcagttatgggaatgaggcaccagacggttctgagttacaaaacgggagatggaggccggatacacggcagatcttggtgacatagagtcccggacctgcccgaggcgggtttatttcctcacttagcactcagagctaagaggaagggtggccagcccgggccacatcgtgtcctcagctgttagactcacccaggcagctgtttaaactgatctcactgatctcatgactacatggtcagtcacgtccctttaactgacagggagatttgtgtgtgcttttttgtaacatcttacatgcacttacattcttttatttttatcacttatttcataacgaaaacatttcttcacatagaaaagtggaccaagggaggggaggtggggagggcctcattgggcccccagcataaccctatcagtgggcagggtgttctgggggcgcccattccactggaaaccacgtggtgtctccttccaggctgaacacaaacagggggccccagtttataactagccaggggtgcactgctcagaccaggctcagctccacaaggcagcctgcgcttcctgccacctgcccaccatttggcaggggcagacacagcagtgacggcagggggtcaaaataggaccacctgtccctttactggccacagtcatcagacccggagacactaaacaggactttaactcctccgagcattggtttccacctctgtgaaactagctgacaacaccaccagcctcccaggatctctgtggggactaagaagatgcctcaaggcaccaagcccaagccagcagcactcatcatcagccctgggggagagaggagggttgcatgtgttgtttccagtccaactcccgcattttacaatggaggaaaggccatggggaggggctgctctgggggggcaacagctgggcagggtgtggcaccctgaggacaggccagtttattccttacttcatggtgacagaaaacaggccgagccctagagagccagctctctcaaagtacccccaatgggagtgtcctcaactgcaggcagcggccagccaggcagagccaggcagggggctcccatccataggcgagcaagttagcaagggcggcctgggagggaagtgccttctctagaaggtgacaacattgttaatgagcccgtgttaatgtcagtcatctccggagtctgaaagtgccctgcagcaggtgggaggggttatgtatgctgagtccactctggagtatgccctgcagagctgcgttctgtcctgttagatgtcccacccaaactcacacagatccccctgcagagagcctggaaaccagcccctcagggcacagcacaggcatcccaaggacagccccaccaaacccccagcatacagatacctggtcctgtccacatgggatgtcgggggtgctgacgggggcaagacccacagatgctgaccaccatgggccacagagataggtctctggccctgcagccagctggttccatacaatagctcaatgtttgcaaggctgagggaagggcctaattcacccaccccagcctggccaactctgatgggcaaaggggctgcccagagaatgctgagaggatcaccccaactcagaccaggaccatacctgcctccacacccagaagggcacagcagggcttttgctttagaatgaagagctaatgaattgcactgacactgacagagcagccttaacctggagtttatcccacaataatcagattcatatggataaccctggaaacaacaagcagagagggctctgagcagccctgcttccctttcatatccacaaatgcaaacaagtatttgcaggagggctagcccatttcaggcactgcagggagaatgcaggtgtgacagaggggaaagaccaggatggactgaaaactgaatggatgagaatcctgtcctggaggtgctggataagtacacatttaagaccccataaaggagagagaaggcagtgccagaggtggcggcgatgggcacctgggagaagaagagctcgtctccagctctagaaaccacggccactttgcagatccatcagggcagctcttgggataggccaggatggctagaaagcatctgatacaaagtgggcgcctgtggcagaggtggggcaggaggagcaaattccttcagaggacagagtctgggcagagaaatggaggcacactgcgtgtggtgggtggggcagccaggagtgacacacgccatgctcacaggatgcatgagaaagaggctcaagcccgggctcaaggagcccaaatgccagatgatgaatccatgacgatgaaaggtgtcagaagtttctgcataggggagtgacacaatctcaattgtttttaacaaggtttagtggtagtagcagcagcaagattaatataaggggaacactgggcagtggacgacataggtggaaatgtcaggcccaagagcagacagctgctgacctggacctcatctgttagtggcatcaggagtggctccagcaggctccaggagcccagggtgcacttcccagacatcaggtcggaggttgaaatcagcaatggggggagtatttataccaaagaaatcagcaaacactgccgaccgagcttttacctggaaaacctctattaaacattcaccagcaaccccgtgatattcgtcctctagaagcctcagattccccacctggggaatgggggtggaaatggcacataatgcagagttctaggaagatcaagtaaggtaagcatgcaaagtgcttaatactgtgcctggaacaccacacatgctcaacacgtgccagcttttactagtatattacattattactattggggcaatcaacggaggccaggagggcatccattcaggatgtgaggagaaggaagacaaggccaacagacccaggtcccctgaagctgaggaggtaaatgatgctgagacagcaacagggaacgctcaaggaccagcacgtataggtgcaggcccggcaagcacacacacaacacagcccacgagacattcgctgccccacacctgctgctcacctcagccaaccccctccacatctggagctccaacagtgagaaccagctgggtaacaacaggtccccattccttaaggacgctttcagctcttcctccttgagtgtttctcagcccttttgaaggttatgagtattagtgaatgacattaacgagactgtcttccaaggactcccattgtgtaggacaattcagtatcatagtaactttctccctaccttacccctttcttttaagaaaatgataatctctctttataaatgtcttttaaaatattcagtgtgggctcaattcttcccatatcattatccctggaggtgtgctggtaaaggggaggggaggggaggggaggggaggaggggaggggaggggaggggaagagaggggaggggaagggaggggaggggaggggaggggagaggcaaccacctcgatgtatcctctgtccattcctgtggcgtaaatactgccaccatggttcattctaagctagctgggtaattccactgaagatggagtggggatgtgtgagtgatctcactcaattcctcactaaaatgttctctttttataggtgtggaaatgatgcccttgatatctaattgacctgatcagtgctctaggccagggcctacagctcctccccacttccacacacgtcatggataggcaacctatctcagagacaggcccttctcactccaaatagcttcaacagcctccaagaggccactcctcctaatcactctccctttcatcttcccactttctccactaaattaacttcgttaccacttctgaaacccaagctatcaaaaacccatcaccaccatggtttcctgccactcaagcacctagaatgctccctatttctatagagctccaagtcagtcccctccaaccactacacactatggtgccctccatccatctaccaccactcatcctttctgcagaggcagagcgtattacagttgaaggaccatgggaaaggacttggaggcagggagcctgactcaaatcctagctctgccctacagacaggttactctgggtagtcagtgagccctgtcgcctcagtgtcctcatctgtaaaaacagggacaatgacagggacccagcactgtcctcaggtgcaccctgaacttgctcctagcagctcacaagcagaagcttgagcctatcaggagactctgggaagaggacatagtctgaggcaccaaaaaaaggaagtatatctgctcaggtcaatcctaaaacctattgagacagtacgtctcatgccaaaataatgtcaatatgccacatacatgacgtttacactacacagaaacatgggtgatcttactcaatttcttacaggtgaggaaataatgtccttggtatctaactgacccgttcaaggtcatctggttagtcagctgaggccacgtctgcccaggatgagtgctctaggccagggcccacgggctcctcccaactcccacacacacacgccatgggacagtcacctggggctctgccaaagggcagcttcactagctgagcacagggcatccatttcccttttaaacatggggacagatgtgtcctctaacctctgaggcttccatctggaagtgcctcatgagtcagtggctcacatttagaacagctgtgcctcctggatgccccaaccttttttctccctcatttctatcccagagagattagatgtcctgtacaaattggatctgaaaatgataataaaataaaatgtaatataaaacaagatgaaataaaatcagtctgcgctgggatgagctgtgaaaaacggggctgctcaagccacctcctgtgagcacaagccaaccacagacgaagccttctgcatgaggaacaagcagtccccccatcccttcccgcaggtgcaggcttgcagctcgggagtcagaccccaggcatgtaggtcccaggccatctgaggagcctgtgtagacccctgtggctgaagagcagggcctcactgcccttgagaggctagctctgagaaccagctttttaaataacaagtaccacctactttcattcttatgataaaagttacttggttatagaaaattcagaaagtagacatatacaaaaagaagcagacagaatcagcctctctctccctcccataccccaagataaccaactttagccagataggatggacccctaaataagtacgggcgactttcttccgcccatacttatttaaaagccaaatggtgctttatgtccatatcactatattttcttctgcactgcaatttttaacagtggcatagtacccaattatccagatggaacataatccctctttaacagcatgttttttggtctcaaatttcccactcttatgaatgatgctatgagaaacattctatagtttaaaatgttaacatccttagtggctgcctcgggataaacacccagagatgccatgtgctttggggtccacatcactaggacttcctctagaaagtgctgtgacttccaggaccacatgcatcatcccagagaagaggaaacatacaaaacatgaaacccattccatctttttctatttaagcatattttatcccctttccaaaaaagaaactatcttgtcaaaggtaaagagacttgaagtgtctggatagttatgaaaccagtgtcccagagaacacagcagaggagaaaacggcacctccaaacctctctgcaagcaccttcatcccctcccaggtcagtctcaggccccaagtggactatgccactggagtgtcctagaatgtaaattcccccacaagagaaccacggcaggcctccatatccccacacagggcccagtgtctggtgcatcagaggtccccaggacataaatatttataaactgattgattaatgaaggaggggcagggcagtggaagagaggactcatctgttccataatcaagaccataacttcaagtttatgatttattacccaccatatctggcaaaggtagcaccgtcctcctccccactggagactgacaaaatgcctggtaccatctgttaatggatgaaatgcattcccacaaacatccatatgttgaagtcctagtgcccaggacctcagagggtgacagtttggaaacaggatctttaaagaagtgattaagttaaaatgacaccattagggtggccctaatccagtatgagtggtgtctttataaaaagaggagattatcctggctaacacggtgaaacctcgtctctactaaaaatacaaaaaattagccatgcatggtggcgggctcctgtagtcccagctactcgggaggctgaggcaggagaatggcgtgaacctgagaggcggagcttgcagtgagccgagatcgcaccactgcactccagcccgggcgacagagcaagactctgtcccaaaaaaaaaaaaaaaaaaaaaaaaagaagaggagattaggacacagacacacatagaggggcagccatgtgaggacacagggagaaaacggccacctacaagccaatgagaaagccctcaggagaatccaaccctgcagacaccctcatctcagccttccagcctccaggactgagggtgataaccgcccattgctgcagctgccccgcacggtggtgctttgtcttggcagcctaagctgactaagacgacatctgaaagctctgagatgcctggtgggtgtttgggaaatgctgctgccaggagcaaccttcagctcccaggatgggcaggtggcctggagatgctcacctgccgccctgcgctcccctcacttcaccctctcctggcaggaagccaggctgactgtgaacagcagcaataaagcaaggagtggcataaggtgtggggccggaatggcccctagccacacgtggaaacgttgcctcctcctcctgaatgtgttaaataaaagggagaggcagtggggaaaacaatccagtaagtcaagctggttaatgtaactaggaagattgggcaatttgatgggcatgccaaaatattgaaggaggaggaacagcaggagcatcaagacacaagatatccaactactttcagctcttcctccacctagtaacttccaataaagctgaaggaggatgtgctctaaaccagagaggttttatgtgcatcatataccttaacattacagatctatagatcccgccatgagaaaataagtttattgagcaattaacttcaaaatttattttccagctgttagaatgtgtccagtctcactgacaatgctggagttgaaaaaaaacgggaaagagcatattcccgcctttgggaagcttacagtgagatgaggggacacaggcaggtgtaaacataagacagtgagccccgcattaagtgttgtatgtcaagaaatgagtacattggaagctgaaccaggctgagcaaagccacattcatgtgtgagtcttttctgcttactggttagaatgaaactgcatcttgccctccaaggaccacataaatgaggtcactccaaaaccacctctacaggcttcccaccaaccatggatctgctgtctccctgttcgttccatgagacaatatggaatgcatggcctgagccagctggctgggctccacaatggagcactagagaattggctgtccccgctcccactgaggggctcagtcagccaagactctagcagtgcagaagtaggaactagatgaagaccgaaggggcccagggccttcctcaccacccctgtccaggaacatcattgttactactgaggagccgggcactgcatgcccactgcatgcctgaagccagcaggctgggctctgcagtcccgcactgtgtttcttctgtcaattcaaaagctgaccaaatgaccactgcgtctgctcccaaccctgcaaatgccagttgtaccagttattgtaattgcagagcttaataaaatactgcagaaatcaatgaaatgtgagcaaaaaaggatttgttactgctgcaaacactgaagtttttgagagccttgcgtgaggcagtcagtaaaactcatcaaatttctgtagggcagctggggcagagtccagaggatttctatgctccaattattcctaagtatctttaagctttcttacactctgaggaaccccaaatgggaaatttcaatgactcattgtagatgtacactatgtaaaaacaggacagggaaccccagaccctggagagaactcaaagacagggtgggatggtacgtcaaagacaggtggctacttttaccggttttcagacacaatggaatcctaaatgaaaggttcaggattccgcaagttaactgatacttcagttcaataatcacttataaattctgatccctttaaatgacagattctgcctggatgtgaagccaaatgcatagtaagtgacatgcaagcagcaatgaccctcctcgttgcccctgtattaataccagtaacgatcattgtcacagcaagttattccacatccactctattcctgacataatgcaacatgatttgcttgtattctctctccatccttgtagcagcctgctgagcaaggaacccttatcatccccactttcaaacaggcataagccactgcgcctggccgaggttatgtgttgatcagttcgtgaaaacactgtgactagagctcgcaggaccctaaccctttatttctcctagagacagaagctcagtgttggctaaatcagtgtttgcagcaactttatcgaacatgactaccaccaataatgagaatctactgtaattgattaggtattgactagggttccatagtaagacagccccattgtcaggctgtcacttcatctagttcaaacccaggaccaggcttgcccacctgaggccatttgcagcaaggggagtgctaggacacaggccaggtctgtcttagctttcactccaccacgagggaccatcgacttttctacctccctagaactccacagccaagactagttagccctctgccctgattcctccccgctgtgcctctcttctccctgcctctccggtttgtaagcaaattgcctatcataggttcacagaaggcagccagaaagtgggctgggatctgttctctcagatagtaaagctcagggaaagaatcattaagtgaaaacctgacaatgaggctgtcctacaatggaccctaatcaatgcctaatcaattacagttgattttcgttattggcagtagttgtgttctataaagttgctgcaaacactgatttgaccaacactgagcttccgtctctaggagaaatacagggttagggtcctgcgagctctagtcacagcattttcaccaaccgcttcaaggcataaccttggccgggtgcagtggctcacacctgtaatctcagcactttgagaggcctaggcaggtggatcacctgaggtcaggagttcgagaccagcctggccaatgtggtgaaaccccatctctactaaaaatgtacaaattgtcgggagtggttgtgcatgcctgtaatcccagttactcaggaggctggggcatgagaatcacttgaacccaggaggcagaggttgcagtgaaccgagatcatgccacagcactccggcctgggtgacaaagagagaccctaatttaataaatactgtggattcattaacatgaaactctcagccattggtgctgtaactcacacctgaaggaaggactgtctaacacatgcgctttctccaccaggcacaggacagtcatcttgtgcttagggacactggacatcacatcagcactacacttgcattttaaacagcataatcaacaacagaagcacaaaaatgggggaaatgtggcactaaatagactgtggaaaggatgcctgtctgcagtatgagttgaaacaaggaagagctttgctttgttcagtgtcagacgggaacatgcaggtgggcaacccgaattttgagtctttttgttcatgtcttcaaatgaccacaaaattgtccttggtattgattttggtgttacaaataaattgtatccaggaggctaatttgcaaatatggaatccacaagtaatgaaaatcaactataatttaatcttcaaatttgtagatttaaaattgctagaaacttgccagtttctaattctaatgcccccacttaatacacctgttactctaacattattaaaagggccgtaatcacagcctagtccacccgtaatttttatctacctgactctacttcttcatccctaggatgcctcatgctgctacagaaagcaaagccttagaggaatccttcctcctgacaaggaagctccagggtggcaagttcaggctgcagatgccttcttctaaagacgtgcacttcttttccagatttatgttccctacctgaggacctctattgatttggcaatgccttgccttgagaagcttacagcattttctaggcaaacacactgaggactctggcatcagaatattttctggagcacgtacgacagaagccaatagtcatctgcccgggatggaaagaagaaaggcatcagagaatgtgagtttctcaggtggaaggaaatcataaacgtcaggtcacccaaaccccagaggccgccgagttctcagtaaccctacgccccgagcaccctcaacacccctaggattgctcaaggtggccccgggtggcagccccaccccagcaagtcatctcctagaacaggctgaacagacttcagtttgcatcagaaccaccaggagggcatattaggagagagacttagggaccctatcccagaatttctgattcaacaggtctgagtgggcacaaagagtttgtatttctaagttcccaggtttatgctgatgctgctggtcttagatgacactctgagatccactgacctaaaatatttgtgcatcagtgtggtttatactaacgaccttgtcaccacatgcaatgcgggcttcattactgcatcctctgccatcatttgcactcagtctcccaatcaccctaagaaggaacactgcaacataacttccagccactacttaaatggcaccaatgatggggagctcaggacctcatacaagtccaagtccatgtttaactcccctaatattccaaagtgcttcactctcttgaatcacaatctgtgctcactggatgcctgcgccttggccctatttccttccatgcacaaaacctatcaaggctgatctccctggtgagtgagttgtatgattttcccaggggaaaaaaagtaaaaatgtacctggctagtgtgaaacaaccctttattcagaatgatttctttaaaggctttatgaagcaagtgttactattttacaaagcagcctgtgaactctgtgccatgtgttgacaaactcagtgggttttcagcgaaacatttcatcaaataagacacattgtagcactgctgaggggctatcacccagatgtcaacggctcaatgccacacaggagacttgtgggaaaagtcttaagccattaggtcatggaagataactgcaagagggggaaaggacgctggcttgggaaacactggtgtgtcatatgataaaaacagtgaccagccagcctgagctctgtgcctaaacacatcatctgcgccctgcacaatgcccctgtgaagtagagacacgcggatcagaagccccaggtcccaccactttgtttccagtcaccaacttgtccccaaatcaactgcatccatacaccgacaccccctacccaactgtgccatttaaagctaaccctagatatcacatcacttcatccataaatatctcagtacatatctttaaaagtcaagccgggcacaatggctcacgtctgtaatcccagcactttgggaggccgaggtgggaggatcacctgaggtcaggagttcgagacaagcctgaccaacatggagaaaccccatctctactaaaaatacaaaattagccgggcgtggtggtggatgcctgtaatcccagctattcaggaggctgaggcaggagaattgcttgaacacaagaggcggaggttgctgtgagccgagatcacaccattgcactccagcctgggcaacaagagcgaaactccgtctaaaaataaataaataaataaataaataaataatttaaaaaaataaaagtcaagaacattttaatacatagaacaaactgccagaattgtgaagaataatttcttaaaatatctaattcatgttcaaatttctctgccatacgtgttttggggttgtttggatttatttttacagtctaagttacagtctgaataaagtcttacgatgtttattcaatatgtcacttcagttcctttcttttttttttctttgatacggagcctctgtcgcccaggctggagtgcagtggtacaatctcggctcactgcaatctctgcctcctgggttcaagccattctcctgcctcagcctcccaagtagctgggattacagacgtgcaccaccaagaccagctaatttttgtatttttatagagatggggtttcaccatgttggccaggctggtctcctgacctcagatgatccgcctgccttggcctcccaaagtgctgggattacaggcgtgagccacagcacccgacccagttcctttttcttcctcctctttttgcaatgtatttgaaaaagactggggttgtttccacacagtagaattccctctgccctggatttcgctgagccctgcagtatggcttcacagatgtcctggcccctggacttcctgtcagttgcagatggatctgaggctgggtctgattctggtttgattctggtgaggacttggctagggtgaggactcagctgtgtacttcctgcaaggaggcttacaaccctatgacccatggtctaactccccttttgtgatagtgcaggttacagaggaccagagcctagagccagacagtcatttattaggagtttggaaagggcactatgttaaccctatcacattttcaaggtttattagctggaattcttctttcaatacaactttccctcttcctttatttggaaactccaaagaacagttcccaaaggttaaatgctcgattgcttctctttatttaccaaatcagaatgagttggttccctacatcccccaaaggtaactagggagtgctgtggtgatgacggtggtaatggtggtgatgacggtggtggtgatggtgtaagtagtacttttgaaagtctgttgcatatgttagataattacatctgtgtccaaagtacaaagctaacagctattacaacctggatgcaagcacagcctgccccggtgaagtccctcatcttccatgaccccaggttctcttcaaattccataatttctggaaagacaggccatggggctaccccagggcctgagggccagagaggacgggatggggagtgctagtggtcatcacgctgggaaacgaagtgttagttaagtagagaaaaacttcccactaaagtagaaaatactcatccaattaaacatgtttctccttattctttctctacgattgagtctccaaatatgacaaggtttccggcagggacttttttctttttaattttttaacaaaaattgtttcctgatactctcgggaaagtgcacattttaaagaaacctgttataaatgcaccaggagaatgagacaattatcacagcagctatgaggaccaggagcccatgaagtttcagattttgaagccaacagttgtcctgatgctggcagactgacacccagacttgggtccccagcaacacacagtatgagtgaagtttctgcccaaaaagctcaagatgccttcagtgacctgaggaaaccgccatggtacctgcttctctaaaataggactattgagccacaggagaccacagattcatagccaagcaacccccatatttgaagataagaaaacagaaggttagaaaacaaggccatgtataacaggaggggcctgagcctagaccctggctcctggaccaagccagctccctcccacagcacgctggctgtcccccaagtggatgtaggttggagatgttgttgtgtgtggttttctacatgagtatcccttttgcaggtaaaatacactcaggtaatataaataatgcacaaacgaatgcctcctctgacctggaatctgtaacgtctccttgtcacatgccaacttctctccaactgcagacatttaaaaaaaaaaatcagcactttgagagcctgaggcaggcagatcacttgagatcaggagttcaagaccagcctggacaacacagtgaaaccccatctctactaaaaatacaaaaattaggccgggcacagtggctcacacttgtaatcccagcactttaggaggcaggcagaattacctgaggtcaggagttcgagaccagcctggccaacatgatgaaaccccgtctctagtaaaaatacaaaaatcatccaggcgtggtggcacacgcatataatcgcagctactcgggaggctgaggcatgagaatcacttgaacccgggaggcagaggttgcagtgaaccaagattacatcactgcactccagcctgagcaacagggcaagaatctgtctcaaaaataaataaataaataaataaaatcagtatttaatgttccccttcagtagttactgctatttcccgaaccaatcacatatggccactgcgtttaagggcctctccatatttaaaatgcgtgactactgctgaaagaaatcagagaaaacacaagcaaatggaaaaacatcccatgcttatgaattagaagaatcaatatcattaaaatggccatactacccaaagcaatttacagattcaatgctattcctatcaaactactgacatcattcttcacagaatcagaaaaaaaactattgtaaaattcatatggaaccaaaaaagagccaaaatagccaaagcaatcctaagcaaaaagaacaaagccaaaggcatcacattattcaacttcaaactatactacaaggctaatgtaaccaaaacagtacggtactggcacagaaacagacacatattccaactgaacagaacagaaaacacaaataaagctgcacacttacaaccatctaatcttcaacaaggtcaacaaaaacaagcaatggggaaaggacaccttattcaataaatagtgctgggataacttgctagccatatgcagaagaatggaactagacccttacctttcaccgtatataaaaactaacccaaggtagattacagatttaaatgtaagacctcaaactataaaaatcctgaagaaaacctaagaaatacccttatcgacatcagccttggcaaagaatttatggccaagtacccaaaaataatttcaacaaaaacaaaaattgacaagtgggagctaattaaactaaagaacttctgcttaacaaaagaaactatcaacagagtaaacagacatcctacagaatgggagaaaatattcacaaactatgcatccaacaaaggctgaatatctcacaccagtcagaatggctattattaaaaagtcaaaaaacatcagacgtcggctaggctgcagagaaaaggaatgcttgtacactgctagtggaaaagtaaatgagttcagccactgtggaaagcagtgtggagatttctcaaagaacttaaaacagaactaccattcaacccagcaactcacttatgggtacatacccaaagaaatatagatcattataccaaaaagacacatgcactcatatgttcatcaccgtgctattcacaatagcaaagacatagaattatcctaagtgccattaagggtggactggataaagaaaatgtggtataggctgggcacggtggctcacgcctgtaatcccagcactctgaaaggccagggcgggcggatcacctgaggtcaggagttcgagaccagcctgaccaacatggtgaaacactgtccctgataaaaatataaaaattagccaggcgtaatggcaggtgcgtgtaatccaagttactcaggaggctaaggcaggagaatcgcttgagcccaggaggcagaggttgcagtgagccaagattgttccactgcactccagcctgggcaacagaatgaaactctgtctcaaaaaaaaaaaaaaaaaaaaaaaattgtggtacatgtacaccatggaatactacaaacccataaacaagaacgaaatcatgtcctttgcagcaacatagatggatgtggatgccataaccctagacaaattaacacaggaacagaaaacaaaacaccacatgttctcacatgggaactgagcacactgagcacacgtgaacataaacatgggaacagtaaacactgggaactgcccaagtgaggagagtgggagagggacgtgaattgaaaaaccacctattgggtactatgctccttacctgggtccaacacacctgggtaacaatcatacacatgtacactctatatctaaaataaaagctgaagtttttaaactttaaaaacaactttaaaaatcttaaaataaataagtaaaatatgtgaccactctagaatctgtgccataaaagaaaagaaatcccactcaacctgatttttcttgtctgctgcagacgtccagtcatcagacttggcagcattcattcattcgaaacactgcttacaggtgagtccagggaccacacgacaatacttcagccaaaggtgcctttggtgcgtccagccctgacctggcccacctgtcactttaggaagagatccccagcgcagagaaatgcagcaaccctgaaccacagacgcaggtaatggtcagggctgatgggaatccagtgtctgtgagccacacacctgcagcccaggcctcctagccggagtgggtttttaatcattagccaaggctttgtgctcccgggtggatgtaagctgacaccagggttaatatgttccctgctgttgaccgttcacaattccctccacctgcagaggtgggacaatagcttcaggaacagtatccaacccaccactttcaaattccagctacaaagggagagcgcctgcttgtgtgaggctcacattgacgggtgtgttttgttttttgtttttttttaatgtgttgaaggtttttcgtctttctcagcaggtcagtgaactgagacctgtgggctcctgactgtggatgaggagtctgcctgaagggaaggccaaggctgctgggaagcctcctcactggggcgcagttcccagaaaccctttggaaatagccaaaggcctgtatgttattttaggcgtgagaggagacggtgaaatcaaaggaaaagtgtggatcaaagttcagcctgtggggagaaggggtgagggtgggggtgccacaaccacaggcatcagtcccagaagactgtgcccacagggtcatgatggcctcactaggcaattgtgcagatgctaaggggagcagctggaaacagaggccggggccaaggggcagggaccatcctggtaaccatctcaccgtctcgtctctgggaactgggctgagctctgaagggcagccgtcctgggtcccactcacccatggagtcattcaggatggaatggaagggggtcttcctttccaaccttggctcccactgacttagtgcctgactcctgcaggcagctccagggcacccgcgggccctgccagcctttcctggaagagccctggggtgacagaagcctcacaatcccgcccagttcgaatgacagttcatcaccagaagctcctcttttaaacacgttccactaacatcttctgctgtttatctgcccattctcaaagtctgctccatctgagcagaatgcggcagtttggagaaggggcctcagccaggcttgcccaggagccacctccccctcgggtgtccactgggtaccagctcctcgcggcccatgtcttcacccagatgaggctggagaggtgtgagccaaaaaggatttccagaaatgcctgaggaacaactaatcaatatgaaagaagtgaagggatgcaccccattgtattaatttcctaaggctgctgtaaagcactacaaagtggttggcttcaaacaaggcatgtgttctctcacagacccaggggctggaggtctgaaaccaaggcggcaggctgcgctccttctgagagccccagggaggatctgtccctgcctcttccaccttctcaggctgccacaattggtgaggttccttggcttgcagacacgtggctccagcctctgcctctgtcatcacctggctttctccctgtgtctgcatcctctcctcttcttacaagaacccagtcatggaaatcaggcccaatctaatccagcatgacctcatctctgtcatcattccaaataaggtcacattcaggggtttcaggtggacatgaatttcgggggaacacaactcaaccccctgtacctcccctacagatggttctctgggatccgtgagaaggagggaggccccactgcatgttccaggtcgaatgttctcatagcacgtcgtttccttacctgcaaggctaggtgtcagtgtcactgggaaaggagcccattggcttgccctccttcactggtactcactgtgtgtgcccatcaagagaaaggcacgtgcacagggatatagggagaaactttcaaaggggtgaaatgcacagaaaactgagagcagtccaggactgtggccctaaacttgctccctggcagctccctacacacaggccttatggttgattcgcttaagccactctctagggactagaggcgtctagaccagaaggcgcaggtgagccatgggaacaggaagtcccagcccacatctcagcacatcttcagcctgtcctactccctcccacagagtaaatcccggacactcctgctggtctgcacttgctccaaagcaacagagaaccagcctgcactacatccacaccctcccagggctgaggccatgggcaatgatgaggcaggaccctgagccgttgttgttcaggacgcagcagctgggagatgggggtgagggtcatccccaacaacgaagcaccctccagaggggcgctgggtgagaaacagacggacttacagtgctggccccaccccttcctcaccttctgctgagcgacctcacgcgcatccagccctcccaatctgagtgtgatcgcccacgcagccctcctcccacccgactgctcagcatccacacccatcgtcctccaccgtgccctgccaatgcccgaatgctgtatgcacaggctaactaaacaccactctgtgatgactgagtgtcaaggtaagatctggggaatgcagtatcggtttgtacttttatttttgggtctcacctgacttttgccaaagccacagatgttgagtttggctcttctgaccaaatggaacacctggatgctgatctaacaggatccttgaaactcttctctctgcttcctggagatcagagagattaaggagcaagaacatttgcgtatatccattgacctaatagaactcaatttcactgtgactctggtcaaatatgtttgcatgaagactcctgatgagacacacagaatctggaaggggcagcggtgaatccagaaaccatgagcacgcacacatacacgtgtaggtgatcttcagccgagactctgctgtggtgtatagacccgtgtctgtgtttctgaagtttactgaggggtggaaacaatctataagcaggaaataaccactgtccagtcaaatacctggacttatgggccgtgaggacaagaaatgcatacccagagacttgtgggaagccttctgtgacaacatgcatgcagaaaccactgcaggctggggccggcagaacagacccacataggtcacctggatccactgtcccagatcactggatgctcagctcactaagccccacacccagtaatttacaggtggaaagtgtgggtgttttgttggaaatttgcttaatttttcagtaaaataaaatggagaccattaaagtgatttcatttatctgaagctcctcatcatccatttggtcagcattctttctgaaagaatcaaatagcttcatgagactccatcacggtcactggggcagaggcagggatggcagcacgtgacctgcaagacttcctgacagtcacatctgtcctgtccttgtgttggttggtcttgttgctctggtcacttcctctgtctggctttctgagttcaagtaaaacatactgagcaagtctcaacacacacacacacacacacacacacacaacacacataaaaaaacctcacacacaacacctcacacaacacacaaaacagcacacaaaaaacacctcacacacaacacacacaaaacacctcacaaacaatacacatcacatacacaaaacacttcacacacaacacacacacataaacacacacagcacacacacctcacataacccacacaacacacacaaaacacctcacaacacacacaaaacacttcacacacaacacaacacatacacaaaataagcaacacatacacaaaacacaacacaaacaacacacactacacatacaacacacactgcaacacacacacaacacctcacacaatacacacaacacagacatgtacacacacacaacacaggcatgtacacacacaacacacttcagcacaacacacacagcacaacacacacacctcacaacacacacaagacacacctcacacacaaaacacctcacacacaacacttcacacacaacacacaccacaacacacacaaaaaacacctcacacacacaaaacacctcacacataatacacacaacacacacagcacagacatgtacacacacaacacacctcagcacaacacacaacacacaaagcacaacacacacacctcacacacaacacacaaagcacaacacacacacctcacacacaacacacacgacagacacacctcacacacaaaacacctcacacacaacacttcacacacaacacacacaccgcaacacacacaaaaaaaaacacctcacacacacaggtaacacctcacacaatacaacacatgcaacacacacaaaacactacacacactgcaacgcactcaaagcacctcacacgcaacacacaacacacacacctcacacaacagacaacagacaactcacacacaaaaacacacctcacgtacaacacacacactgcatcacacaacacacaaacacaacatacacacacaaaacacctcacacacaccacagaccacagacacacgcatcttgcacacagagctgtgcaaaggtggagtgtgagctccagcctcaggctgaaatgtgagccctgcagtcaccttggagggaactagcccactggcctcgggtgaggtgaaccaagagaagcaccgccctgatgactcagccactattcttacccaacccctcttccagggccacagaccacagtggccaaggccaagcaagaacaatcacagcgtgagtgcaggcagctggtgcgggctcgggacctgcccggagctggatcaggcactgccctgaaccctcccacaccagaggccgccaccagaaggcggagacaccggcctccttcaaggacagtggcccctctgtaaacaggcggcacttccccggggggggggccaggccctccctggactcaggctggctgtgggctgcccaggaggccgggcggggaagtgggtcccatacatggcctcggggtgtcctagtgaaggctgccctgcacctgagggcatcaagatttgctggtatgaatcaatcgcttgcagagtgtatgaaggtaaacacaggatggaaaaaaacaaggacactctgcccttgaacttcaatcaaaagctgtggggccaccattcggaccactgttaggccgcagcatcatgaaaagatcctgcaaacctgcaactaccaaggacagactcgcatgcgcccttgttctgaccgtggtgcctccaagtctgcaaatgcgggatcacaggaatcatctactgtgtctgtcatcggtgccctcaccctcaggaagcaggggacacgctctggaactcatcagactggttctctccatcaggagaaccagatcaacaatgaatggcacacagcaaaggctgtgggcaccagaagaaccgcactgccaactcaccttcacaggacaaccaaccaggctcttccccacacatcacgtgtcttccctgtgtcacactagcactgaggatctaagcatgttatttcattcgatcctggcagtgaccccaagaagagctggtggcgtcctcattttacagaagaggaaagtggagcccagaaaagtgaaagaactccattcagggccacacagctcaccagtgtcataccccggatgggactcaacccaactctagtccatgctcacacctaccactacattctgtgcctgtgtgcgcatgtgagcactgcgtgtacacatacacgtagacttacagagcagctggaccacaggctgtgactcccctgtaaggagcccggccacctctcccagccttagggacagtagttacctgaacaatggtgaagcattctctctatgacccagaagaccacagcccatagaacggtaatgtaagcagaaagacaccaattgtccctttatagttctaaaagccagaggtcccaatgaggctatgctgcaatagcttgcctctgacatccctccaaaatcatcattctgctcgactcatggagacgtggtgcatgcccctgatgccttagtctacaccctccataatttcccacgtcgcacattttctctgctgattcttgtttcttcccaccttccagaaaggcacatgccaatcattgtggtttccttttcacactggctcccaggaagctccaaccctgtgtccatgtaacatatgccaagttgacattcacaaagggaggtttgcctcccagctcctttctcaacaatactatgtgccgattttgagtccatgaattaatctaacctcacatcccacttttgtaagctgctgcagtaaacagaagattctgctaccaggaatatgaaaacgaacatcacaggtaaatagccacgggttcaatgcgccacaatcacggaaaaggttccttctccattgtgtcttaaatgccccggggagccacaaaggcaccctatgcctgcagacaaagaaccctcacacagtatgtcattaagatgacagacacccttacagtcctgtcctgggatgtcggtaagtatggctggcaaggctcatcactgccttctttctgccctaccagggaattaggcccaggggtttcaaaacaatcatgccctcagccagcacaactccaggaattttgacagacccggcagctcacctcgataaaacatgctgggatgaagctattctagaacctctccaaaggggtcatgcccctcaggttagctgcagagcagaggagggcctgggggtgggtacaagtgccaggtaaactccaggtgtgggaggggccgccagcacaggacagagcagaagagcagccaggtctaagggcaggtcacagaggggcctgcaggggcactgacaccccagagagcagaagccccttagtgtctgggtgatgtgggagtttcttcagttttctgagctccagcaggtgagggagggcagggcatctgagacagaataggtactcaatgaatggtaacaaagagaaaaacaaaaacagctatcaggtgacctggccaggtgccacagggcacagtgacaacccaggtgacatcggggatgtcagtattatctgaaagcaattccatgcccatccaaaatgccaaggatcacagtgccagaagactcagcccagacaggatcaggaaagaaaaaaaagattctgtgctttctgccctgagaagccacacggtgcaggcggaaaccctcctgcccaagctccgctaaatgggggggtctgcttctacaaggccacccagcagggaggcagaagagtgctcaggctgggctgggctgccacgtccatccttccatttactcctccatgccaggaggaagacagcactgccctgtttaggggagaaagctccatgcaaaataaagatgtgagggaactgggtgtcttggcatcaaaggccctctcatgaccccacaccaccacacggggagagcagcccagaaaggcaggcatttgccaaggccacccctgactgcacgcccacgggctgatctctgccccagttccagcccacagccaggattcccacacttgagctgatcagccttgccagagggtttgttaaagcaccgatcgcagggccccagcaattcagtacgtctgggctggggcctgagaatgtgcatttctataggtccccaggcaatgctgaggctgtaggtccagggaccacacctgggggccagctggtcaaggcaagttgaaaaggccacagagagcttagtacagagtggactcatgcatgttcatctcagggaaatacacacacacacacacacacacacattcacatacacataaactgacatacataataaacacacacatccatatgttcacacacaggtaacaattacattatccacatatatataccctcagatatataacaactacattaaaaacctacacacattaataattacatacaagatacatatattcacatgtgtaacatttatatacataatatatgcatacaaaccttcatataaacaattacataacatatatacactcacatataaagactgcatacctaatatacatatatattcacatacataactctcatatgtatggcacatgtatgtattcatgtgttgacacatgtataacatacatattcatttgtgtgcgtataacaattacatgtataacatgcatgtatgtgttcatgtaccaataaaattacatgcataacatgcatgtctatccatatacatgtaacaactacatgcataacatacatgtatgtatttgtacgcacaacaattacacacataatacacacacacacacacagagcagcagcaaggggagtgggcaggagccaggctgggctagaagagcgagatctcttagcaaccacacctgtgaaaaggttaacagggaggccgtgtcctgacgcagggggagggctgtgctccaggagactgaagactcctctctgggaccctgggctccagagggaacaatgacaacatctaagcagccaggatgggccctttgggctctggcctgtctgacagccctgcaaccggcatctttagagccagcacacagctttagccctctggtgcctctgatgtccagggctcaccaacaaatctgatggcaagggactgtctgcgaggtgggagagcctcagctgccaccaggaaaacaggcttcagccagggcctcgggacaggcacacagctctggggccacctgggcctcagcccctggctcccggggcctatgacaagcctgaggaaatcagtcacaaaccgcagcctgtcaaaaccaactacaaacacaggctcccaagtccccccacgccccctactcccccacccccccgtcggcggtgagtgccacaggaggaatggagtgagactggaccacaggcctggggacacagctgaggccagcagggacagccaggcaggcgcccgccccggacggcctcagctcttgatgctgcaacatgtttctcatagtttgtcaatattttaggtttctgggtgagattttatttttaacgttcctatgacctcaaatgcatactttgctcttccagaaccaaagagaccacaccacatgccagcattaaaaggagcataataagggcaccccgcctgtggccaggcttctgtgacaggcctgaccctgtagtccctcttctctcatccgcagctaggttagagagcacctctatggccattgcataaaggagaaaaccgaggctcaggtgggcagggggcgagggcagggcctggccactcaagtgatgaggttagagagccacccccacgcccactgggtaaaggaggaaaccaaggctcagatgggcagggggcaagggcaaggcccagccactggagccaggatctgatcttgacttcatcaaagcagggaagctgccacacgggcgccgctggccgagcctggggaaggatgtcctactgcaccacaagacagagccagttagccagttccatgtctggaggccaccaggctcacaatccagaaaggctgccaaatctccggcagaacaccccagattctgtgtatggcgaagctagggggagccaagagcagaaagccctgccctacttgagaagtacagggaacaacacacctgacagatgcccaggaggaaccacagggtgcacctgtttccctgccccaccggggaggcccagacctgcacacacttccccagcagcaagaggcagcttcccatttgcctcccagggagtcgcttctgacttgcagtgagagaagagggtcctgtatcctactgtcttggcacagtgagcctttcaattatcctgcaagctgctaataagccctcagaaacaaagcttcactcactcagctccaaaggatggaggcaaagaaaacaccaggaggtaccatgaccttccaaggagctgcatttgaaaagcagacagcaatttaaatttgcctaatcacaagccaaagagaaagtgctattgtgtttaccttcaatctgatttgaacacacacacacacacccagtatttgtcagagctggatgtcagtctacaaaccactgcactacactgtccacagccacctggcgacccaggcaccctcactgtccaggtttttatcactaagacaacagacttgtgctgtcttcactttatagccaaggaaactcggcccagggagattcgccccgaaggtaactattactgatagaaaggcagctcccgcaaaggcgcagcggatcctcttctctaaaaaaccatgcaaatggccagtgcagcatggtcaaaggacctcagatagagccttgtgaatgcaagctacaggtcaaagggagggcatggatcctagaggaagccaaaagatccccaaagagggagcagcttcaagaaaggacttagtcctttcttggatggaacaagggagccaaagaaatgcaaagggcttacctgttccagtcggacttgcacaccgcagggaatcaccacctttcaaagagagaagaaacagataagcaaatggattctccaggaaaaaattagcataataatcaagccaggctcccaaagactgaatgaaactgtctctaacctcactctggctacaaagctgtagcagatcaagactgacaagatttagagttaagagagtccagggttttgttcacttttggaaagtccctgtcatttttgctaatgtcatggaaaccatggggcctccccttccagaaaaatgcaaatcactcatagatacaaaatttagcccccactttcacaaagaactggtagacctcaaggatggaaacctctgagtcggtccgtgcttggggagcttgggagcggggcccagagaaggaggtggaaggctctgcctggtggtcttcaagaccccactcctcccatcctcacccaggggcatgcattctctacacaaggggccatcttttctagaactatttctacaagtagaactgaagagtctgaatgtggcaatgtcaacctggttattccattccgcacaagagacggggagaggagactttgactccaccatagtctctgaagaccgagagctccctgggaaagataaagaaagtaacggaggcaaggtggctcaaacacagtcaggagaggcagttagtaacaggcacagggagccaccagtcctgcagggcaaagaccccaccttgggcaggatctccaccacttactagccacaggaccttggcctttaatctctctgggcctcagtttccacatctgaaaactgcaggtaacaatagtgccttccgggcagggtcatggtgagaattaagagatggcgcgtgaggagctcagaagagtggcacagggcaggggctaagggagccaggcaggcattgcgctgctctggggggccgctcaggagccaggcgccagcaaacaggattcagttcctggtgagtgacctcactccttagctttctcctggcactgccccctccagatccctggcacctgccttctcaaagagttttctgaaaatgtgcaaccgaaggagaatcgtagagaatctcagagatctgactaattgtacttgtggtttggagtgggcggcggcgtaatcttggcttttaccaggataactatttatagcctcttgcttatcttacgcagtccagtcctcagggagtatgtgacacatggccgttcctgtgtctgggacacatcattactccaccatggctctgactcagacggatgtctggggcaggggtcctctctcagggcccctttaaagtttgatgaatggatgagagaataagtaaacaaataaatgtaaagcaaaacaaaacaaaaacagctttggaaacagaaggagtcacagacaaaaccttacaggatggcggaaacagccggacaaggagaccccatggttaacagagcggtgtgacttatctcccctcaagcatggtatctactcagtgcacacatgcatcttgttgcctcactccacatgtgacatgcaggcaagaaatgtgcgaagaatcagggcccctgcctttcaaactcactatcagcattcctgcaatggcatgtcaagcatgatgaaaaaaaaaatgagctatgaaggcaggaaaacacaaagaggaaacttaaatgcatattactaagtgaaagaagccactctgaaaaggccacatactgtatgatttcaactctgtgacattctggaaaaggcaaaactatgggacagtgaaaaggtcagtgaaagccagggattaggagggagagaggaacaggcagagcacagagactctttagggccatgaagctattctgcttgacactataaggatggacgcacgtcattctgcatttgtctaaacccacagaatgtacaacaccaggagagaatcctaatgtaaaccgagggctctggttactaagactgtatcaatattggctaatcaagtgtaacaaatgtaccacaggaatggaaaatgtttatatatgaagaggaagaagagtgtgtccaattttttttttttttttgagacggagtctcactctgtcacccaggctagagtgcagtggcacgatcttggctcactgcaagctccgcctcccgggttcacgccattctcctgcctcagcctctcgagtagctgggactacaggcgcccgccaccacgcctggctaattttttgtatttttagtagagatggggtttcactgtgtgagccaggatagtctcgatctcctgacctcatgatccacccacctcggcctcccaaagtactgggattacaggcgtgagccaccatacctggcctgagtgtctgatttttgtataaatctaaaactctcttaaaaatacagtctataatacattttttaaattcactctctggaagcacacgtttgttgagacaatgaaaagaaaagccttgtgcaatgtcagaaacttgagttttaaagacggcagccacttaaggatttggtccagaagccaggtctgtgtgttcccacatccctctgtggccagatggggtgcaataacggcccaccacctggcctggccccagggtgtcctacagaaaaggagaggtgagctctgtaagccgggactgcccgagtcccatctcaccccagaccatccacggcttatatggctaaccggctcgcgcgataagttggcacgcccaatcttgtcgaactccatccatcacttgtgctgcacattttcactgacagccttctcctgccaggacttcacttggaaatgaagcagactggtccctaaccccacagagcttacggctcacgtaatagaaactgcataaaatgaatcgtttttaagaaagtgagctggggaacagtagggggcgagcagcccccaggttctgcagagcaaatggcaggcagccttgccctgagcctccacattcgcatcctactgaacttgctcctctcttccaagagaaccagtcacaggccctactgtctgtttgcacatgtgctgttacaaaatgcagacaaaaatgtctcaggaaagaccttttgtgggagtggatttgcaaataaaaatgcacatggagcaccaaccagagaaaaagggacattctagaagcaaagagtcacctgttgataaagagaaaactcatcatttctataagtacaaacatctcatttagcaaaaaccatgaccaagtgaacacagagggcacttgttctttcaatgtggctaaaaccagattccaggacaggaagtccctgaaaagagactgtatttccgtcacacttttcctcccttatactaaggcaggtaagctgaccacagacagaaccacaggatgaggcggccgggctggggatgctcataccggcctgctcagcaccaaggaacctatggggactgtgcgacggtgctatcagctgcatttgctggacagtcaagtgtcacttgctgttcttcagccttagcagaggcagaagcacagtgcttccgtgcacagagctgcatccctgctggagcgcacacagctctccactgatctacaggctgccctgcctcccatgcatcaggagggtatctcctgtggatggagccaggtaagggagtaaggcacacctgcttgctctcctcacctcaaactccagctctgatcacacattccccagcactgtggggttctttcactgttttcactggacagagggaagcaccgtgggtcggggccaactccaggtgggcttggccttcctcggcacaaagaagctaacacttctttagcacttatgttcttaacatgccagtctgacttattcagagagagcagccacccaacgctgcagggctgggagggtcccggtgcactgcatcccctgagaccgtcctgcagacgccaaccagaagcctctgagctgcgcctggccccatcagtgcacagccagcatggctgggatgtgtgcggtggcatggccaggagtctagatgggcacccgctggccttgtgctttgcctgctctgtaacatgatgctgagtgagctgcaggggcgtgaaaggatgagacaagaaccaggcagcgttccctgtgtcaaggcacactcctggggaggcccacggctcatccaatgtgtggactcgaatcagctggataaacacgaaacagtgccctgtctgtaggtctttctctgtagccctcacaataaggccagcgagcccccactctgtgtatgagaagctgcgtctcagagagggccagcgccagccacgggaactctcccagagatgactccagctggtgccccagctccaggctcctctcctgataggagctgcaccctctctcataatgagcagctccctcagggattagggtgacaagaggtgacaacagtgagacaaggaagggggcagagcagctcccgttagcagctacagaaggctggagagaaggcagtgggtcatgggctgtgggccaaaagccatgggctgtggcatccccgggatccgtccctcccatggtggaggcgagggcccctctgagaagcctgtttgggagcctctttattgccttctttcagctatcctgggatcctaatctactgttcccaaggaaaccacaaacaaacactgctgtgcctgccccacacctggctacgtgggtgcctgggtacactggcatcaataaccttgtccccaagccagcaggtccacaggacagaggggcagagggacaagtgcttgccaccaagtcatgactgtgtccttgggaatgtgagtgtgtgggtgagcgtatgtgtgtgtggatgagtgtgagtgtgggtgtgtgaatgtgggtgagtgtgggtgtgtgagtgtgggtgtgtggaggtgagtgtgtgtgggggtgagtgcaggtgtgtgagtgtgggtgtgtgggtgagtgtgtgtgtgtgagtgactacatgtggtggtgtctgtgtttgactaggtatattttactgtggatatctgcaaatatattcttttgtgtgaatgtgtgtaagtttgagagtgttgtgagtttgcatatgagtgggtgagtcagtagttatgtgcatgggagtgtaaaagtgtagggggtgtgagcgtgtgtgcttgtgagaatgtatgaacgtgcatgtgtgaaactgagttttgtaagtgtgtctgtgtgtgtttctatgtatgcctatgcctcatgtgtgtgtattgatgtgagagcgtgtctgtgtgtgtctccgtgtgtgagtgtatacctgtatgtgtctctgtgtgtttgtgtgtgtgcacacacaacaaagcttagccctgcagttccatcccccaaggtgaatgaaagcacttcagctaacaagtacattctgccttagaaagtgctttcatccaaggtgcactggcccggccaccattacccccagtgctaacagacacagggcctcgggtgcagatcttcctcagtaaggagtgagatcaactcttcaaacctgaaccaatccctctctgcttacttctgggagatccaagtcctgggagaaataaaggacaactcagttctcctcgtgcttgaccgacattgttttccttttgatgaacacaataaaactccaaactcagcttttattgttgtttcttattaaatttcactttgtaaacagccatatagaaagtgacatttttccatcagtttctctaaagccgtgtgggtatagctgatgcactacatattctgtataaacatgcatattctgtataaagagaataaatgtaaatttcaattctatcttttccaaatcatcaaaaattccagtcatggtgggtcacgtgaatcagcttcctagaacctcacagaaacatgaagtaaggactgaagagaggccgggcgcagtagctcaaacctataatcccagcactttgggaggcccagatgggcggatcacctgaggtcaggagctcgagaccaacctggtcaacatggcaaaaccccgtctctactaaaaatacaaaacttagcagggcgtggcggcacgtgcctgtaatcccagctactcaggaggctgagacaggagaattgcttgaacctgggaggttgcagtgagctgggatcgtgccactgcactccagcctgggcgacagagcaagactccgtctcaaaagaaaaaaaaaaaagaactgaagcgagcaccctcaagtgtcaagcatgcttttacacacccggcagctacagggaaagcctggaggcttggctcctctaatcgtttcttcctgcttgttctccaggtcattctgcccacaggtgaagtctctactctactctggtatcaagcaggcctgggcaaaccttgttcatgtcaggattctggaggggagaatcagctcaacaataccaacccacagcaatgaaacgggcgttccacaaatgcacacacaccacacaacaccgaatgcaaatccgtgggacagcattcaggtgcaaaacaagtagaaactgagtagagacaaacgggccagccactgaccttgccaaaccttgcagacaagggagaaagcaattcactgagttaagccaagtacagagacatcaccttatgcacaagttctatcatacataaaattactttaatcataatagttttaactctaagataagttgcaaagactcagaaatgaagtttacttttattttatctttacaaaaacaattctttttaaagaaacttcgtgatggcgccaagatggcagtactttctttcctaagtcataaaaacagtcagaggtaacctacctctgaggccctgaactagccagggaaaaacagatacggacgccaaatatttgctgaccaccaggaccttacgatataattgggggttgggactcttctataatctctacacggagtagcagcctggttgcaaggagggtggagcttttacgaagggccacttctattataccacagctttgacttcttacattgtatgttactgatcaataaactagcaagatctttaattcacccattagttaagattgaaaaaggatgcattgttcatgtgtttatattaccattattatcatttattacaagggcagggtaaggagaataatcacagaaggaaagtcccctcattcccagtgctgacactgacccaagtgtttatctgcttaaataagcaacagtcttagctcgggtaaggggcggctgttgtaacaacataccacagaatgggcagctgacaccacagccgtttatcctcccatagtcctggaggctaggaggctgagatgaagatgtgggcagggtggttcctcctgaggcctctctcccgggcctgcagatggccaccttctccccgtgtcctcacgtggccattccttgtgtgtgtctgtgtcccagtctttctaaggacaccagtcatactggattaggcccatcctaatgaccctatttcaacctaattacctctttaaagaccttatctccaaatcctgccatactctggggtcctggggatttggacttcaacatttgaatttggggaaacaaaatgcaaccccccagcactaacaatcaaaggtctgacaggacgggtggagacgtcaggtcgacacagaacgttctgggcacaccaacaagagctgggtcccccaggtgaggccgggggctcctgacatgccgaaggtggccttactcatcattcaaggctgcttttccaatggtgcctggggacagggggctaggtagagggttgaagagaggcccagggtcagattttcaacacaagcctgcaaacaacagcagatctatacaaagaatggcagtacaaaatgaggacattcgagactttattaactttctctgcttccttcaagagctcaccctaactttgcttctgtgtctcctttgtcaggcttgaccctggaatccctaattaggttcacattcctcaggaagctctgttatcccactaagcgtcaaagcccaatttagcctgctctaatccccatgagaaaacacccgcccggcagacgcaattaaaccttctcagcctgcgggctgagaaccgggacaggagcggaagagaaagagaaggaaaattcccagaatcaggtcattatatttttccttacagttaacaagcagctagtgaagatcatgtctgtggcacagtaaaatgaaaaaagaaaggctcaagctttcccagtccttggtcttggcttggtctcggctcttctcacctctaggggcctcagtttcccctttcaatccaactctatggaatctaataatttttagacaaaagagtagtgcccctatcccagatgggcttagctgaacctactggaaccttctttttcattctttacttaggctgtgtagctgtttaacattggctacctttacccagttgaggcccatggcccacaaggcagggccaggccttcgctggcctcaggcaaacaagttaccactggtagggaatataatagatttaaagcaaaagcatagtatcctgtatccattatgtcaccattatttgtctcagatcagaaatcaaatgtgaacctattgttggaacaatgtccaggggattctcgaagtggctgaaaagcactttcaggatcacttgcatgctgtatacacaagtcccagcaaagggcacagcacaggatcgctcgggggcccaaacgccttcctgcagtgagtctgtcttacaagaccagggctgagcagggaggccaagcatctcatggtgcagccgaggcccgcagaggcagaatcagggtctacagacccctgaaggccaacacttaccacagtcctacgccttatcttttcaaaaagagaaagaggacatctggtgattgataaaatgctaatggcttgcaaaaaaagcaagaagaaaaactcataaatcataaatccaacctaattgcagaaagattaaaaggtagtattgagttgatgaaccgtctttttattagagcattataatgccaaggaccaagatttaactgcatccacattactggatccatttccacaaggaaaatccaggtcccaactcatgcattcctcaccagctacatctgatcagcctataattctcaccggccacctataattaataataaagtaataaagtactgacactgacatttgtgagtaatttacattttaattcatcagaagagactgatgattacctctacaataacatccctgcatgctattgcctgaataagtttagtaggttgtgttttcaaagacggtggcatcacacagggtcttctgtaaaggaactctgccattcccccatcaagaggtagagtctgtccctgttcctcttgagtctgggctcgtcctgggtttgccctgtggcctgctgtgagtggtggaatatggcagaactccgaagcctggccttagacagctgcagttgccgccttcgcctggagcatcccattcttgggcccagcccccataatgaagggaagcctgaacagccgcatggagacacctacaagggggcaccgaggtgcccagtgccaatcgttggaaatgggcatgagggcgtttgtgaccttctggccacccagtccccctgtcagcaccacatgaagcaagcactgcccagccagctcacgaatccatcacagcttgttggtttcagccactgagtgtacaggggatttgttaggcaacaacagagaacagaaatagtgtgcccagcaatgcgcacagccccagcatgcccagacgagtgtgttgggcaccagaatgccatccttcagtgctctgtgtcgggaagtagaggaaaggggctcaaaatcagcacttgaaaaagccaacagcagcaatgaggccatgagctgtcacagatgaggagatttcagccgccgatggtgggggcaagaggccgacagagcgcggctgtggcttcagcacgaggcgggcagacatgacccaggacactagccagtgggcagagaggcagaggggcagcctctcgtccatctacgctgcgattcaccaaaaaatgcatcaggctgaacatgcacggtatgtggtgttcttgaatgtaagcttcggttttaaacaaatatgtattttaaaccatatatatactgtttcaagccccagagtgactggacagaaccgaaaaagctctgtctttgcatccagagactgaaattagggcaagccctctgcttctcccagctggctctgatgaatttacggagactgtcctctgtgaactcaattttcctcctcatctgtgacatagggataatacgacctcgcggggtggatgtgaacctcaagctcataggaaagtcttgacagtgggactatatcaaatatacactgtcagattggagtgagggtgaaaggggaccccacggcctttcaaagacagcagcatagttaccgaaggccatctcagtcggccatacagactttgcctctctcctgaaacacgaactccatatttttcagactaggcatttcctggacaattttctgatgatgaggctgcagcaatgagactgattcatgataatacttaaccaggggcaaaacagacatgtccctcgccccgtcctgttcacctgaaggaaggcagggaggaaccactgcccaagaccataggcctgagtgggacggtgaaacccgagagtcatgtcctacagagatggccccgggtgtatgttgatgtgtgcatggccccatcaatcacagccagttcctgagagcgatcctacaggctcctggaaggacgggtccagatgccatgcctgacaccatgaacattctaaaacactcaactggtagtctaagcaaatgaaggaacgctttttgattttgctttgatttattcatgtttaacatacaagttaaaatacctgactctgaagaagctgtaggggcctactgagtggggaccttaactattggcaccagaaatggctccctttccaactgtgtgccagtgactcctaatcccactcacgaatgacagggagtcatcatctcatgtccaccctacactggctttctgtcatggctctggccaccccacagtgggggcagcccctcaccacagctctctgtttggccagcagcaggaaggctgggtttggagcccatgtgcctggtgcgcaggccttcatggaggacacagccgcatatcggcaggctgccctgcctgccgcacggtagactccagggcctggcactgtcagctccccacacctgatctcttcttatcctctttcctcacctgcagccaacatagtccaggctcaactcccttgcctaaccctacctcccacctgtgagcctcagcccaggctgctccctctgcctggaaaaccacctgcccacctcctactgggcaggtgcctgtgcctcaaggcccagtggcaaggccccttcttcaggagacacacaaataagatgtgcttttatttctgcttcaagagaagagcacagaaatgttatgaccctctgctcctgtgattttgtaatatcctcttcttattttaaaggaaaaggtccaaggaggcagtaacactaaaacaaagcacagttttccgaggcttttaaaatgaggggtgggccccacatccaccagggagcaggcaagcaggtgtttgtattttcaaccacgccagcctcatgctgagaaaggcggggttccggacatggagctctggagcaggaggagctcccactgcctgtgagagccaaggcccgttcatcaggacggcactgagctcacagggagcagagcctcgggcgatgacatcagctaatgccacccccagctcctgcttcttgggggtctgtggcatctgaggtttccatatgaaatcaatagcaggctcttcatatcaagccctggcttccactgacctgttgctaatgacaaggcagaggaagtggtcacccctagggaggggatgcccagatctcgaataaaaccaccctccagagtgaagcgcagagctctgacagtcaatgttcagtggtcatccgtaaagaaaaggaatagcacaaataagtgagctggtcacttcgccagactttgggtcagttgtctcaacctctcattcattcattcattgcagaatggcatatcaaatatcacacttcggggcactcggagatgagaaagaattagcagttgccttcgaaattcagtttaaaatggaagaaaaggtataaacatacaacagttattcagggaagaaaatggtaaattccacaaaggtaggcaccagagaaattttccctgaaatacattttggcaagagtgtttaacaatcacatgatgaacagtttgggttttaccaactgtcctttgctctaaagaaggctgacaagaggccgggcgcggtggctcacacctgtaatcccagcactttgggaggccaaggcgggtggatcacgaggtcaggagatcgagaccatcctggctaacacgctgaaaccctgtctctactaaaaatacaaaaaaaaaaaaaaaaatagccgggcatggtggcgggcgcctgtagtcccagctacttgggaggctgaggcaggagaatggcatgaacccaggaggcggagcttgcaatgagccgagatcgcgccactgcactccagcctgggcaacagagcgagactccgtctcaaaaaaaaaaaaaagctgacaagaaaagaaaacatgagaaaccctaagagctcacaacttatcaaatcttttaaaattaagcattgagctgcaaatggccaactggccaactctaatgtccacataagcatatttcatgaaacccaaactagttcctgctggtctgaagctaaactgccacccctgttcacaaaatcttgataatggcattccatttaactctaatgtccacataaacatattccatgaaacctaaactggttcctgcaggtctaaagctaaacttccacccctgttcacaaaatcctgccagtggcattcctctctgcccagtgtctcaaattcaaaacctaaggattactcacaagccgtgcctctgacccaccgggtgggtatgccaatcctaacaggtctacctttaaaatgcccacaagtctacttcctactgaccccacccattgttcaaggttgggccactccagctcttgctgggcagtgctaagctttctaaccaacctcctgaggttcaatcgactcccctccaaatgctttttagaagtaaagaaacctctgaaaaagcgaaaggttttagataaagattctgaaagcagaatttctcacatcacagtattgcaaccattcagccattctatccactccacctcccctgaaagacacagttgtgagtttgttattctaaagaccttctgaacagggggcagtttccagtgataagggagggttaacagctcagatccttgcacaccgctttattaagaacagaaaggaagcctgcgggcttcggaaagttccagggtaatttggagttgagggtgcacagacacacacacagtgcgcagaaaggcaggagttgaaatgcctagaaacacacaaaaatgaactccgccagctgctcccgggaggcggagagagggcgccccgcgagctatttctgtgcttgacagaaaatgggagtaggcacttcctgaatccctgcctaaaattaactgctttacaaaaggggggaaggggaaacccatggtgaaacaagttttattttacaattcaaaatctggaggtggggatttgaatgcttcgttatgggttttggccccgctgataaaaatgtggctgaaaaaaagaagaaatgggggcttcactaggaaacctacccttcagaagtagccccacaaaaataaagccagcggtttgattagaaacgttcttctccccggcgcctgtagtcccagctactcgggaggctgaggcaggagaatagcgtgaacccgggaggcggagcttgcagtgagccgagattgcgccactgcaccccagcctgggcgacagagccagactccgtctcaaaaaaaaaaaaaaaaaaaaagaaacgttcttctccccatggaacgtgaagccatgtctcaatgagaggcatgaaggcgcatgcacagcaacactggtgcagtcgccagagagcacaggcttcagtgccgcacatcaactaagtgcctgtcctgtggtctagggggctgagactcatggacacacacgctgacaacatgagagggcagcgtctggggcaggggctgcacgagacagagtggggtatctggaagtatggtgggcacagggccacgacccccgccctgaggacgaggcctgcagaggtctctcctagcctgacagggatggttatgtcccaacaggggcgggcttccaacacctctcccagcctgaactcaggctctggaagacctgagtctgaacgggccatagagaggtctcaggaacaagatcccactgggaacctacactcagagccagaatgcagtctcccagccagagccagggcccaggactgccagaaagtcccggagataagcttctgcagagatgacattgctagatgccagggtgggtggcatccatgtggaagaatgactgtagtagaaattttaaaaagatgcactgcatatggtgtctaaacattgaaagagaacaggccgttctgcagctccccaactgcagcacaccttcctcctccatctcggcagagggaaggggtaaggacagaccactcaggagagcagtggacgaaaccacacacattatgacaagtggatttctaacctggacagagccagaggcagggtcagagaggaagagctgtgatccagaaggagcacacggtgccacagggctggggagaggccccgatgccacccagcccagaagcccagaggtgaagaggccctggattgaggagaggagaggaccccagtgagcctggaggaggggtgacaggataatgggaggaagcatacattatagactctgagcagttcaaaaactgaatggtggtctgaaaaaaggggtagtaagataagcacgtcaaaaaaggacatcactgaacaggatgtgagctcacacaggggaatacagagtttggggtcttctagaaaggggccaagggctcctgcagatggcagccagagtcagcagaaagagcacctggggccacatgtgtggaaggagggacgtttcccctgtgaccagagctgatgggcaggaggtgctggagccaaatggcattttcaggagtgtttcaagctgattaatgtcaggctggtagcttggaagcaggcggggggaggtgaggtattttcaccaggggaatcagcagaggctgccaatcagcccgctgcacccccagcagggtataaaccctcatctgcacaccaccggccagaacgtgtttcaagagaagcgggagtaaaagcgatggtggccaacgcaaacagagtctgagtgggagagtccacgcacacgcagtacagaacgccaggcacaggtgagagaggcggagggctggggatgcatctgtacctgctcgtcaggggcttgtgggaaatcacatcagaagtccaagaccaagcaggcagggacacctgcagcacccagctctgccctaggcccagataccctggctgcagcgatgtgggccaggactacggaagtcctctgtggggtgagccaaggcagggtgagcctgtgcaaatgcaggaggctggggggagtagaaagaagggcagccagtcaggggaaaggtcacagagctggccagaaccaaggcagcatcgagcaagaggcacttggattccagtgtcagaaaatattaagcccacggctctgccattagccatatggaaccactttcaggtgggcctcaggctaagtctgaggcactaattaagcccactaaatggaatttgtttgcttaaaagagcagaccccattctcagaagaaaatttagaaaatatatatactttcttgtcatttaacagttaataaataaaatgcatagtgatttatgctagcggtaggcaacatttcatgaaataaatctactagcgtcagtaccacaactgcagaaagagtagtttccagcaactgacactgtagacatctacagtgattcctaatacaatgatgcagattaaggtattaaaaggggaaaagagcactcctgcagaagccaccaggccctgtgcttggggagctgttgaattcagttctccgcagtcctcttagtaggggttaattcctgttttatagaggaagaaactgaagcccaaggtcacatgggtaagacaaagcagagtcaggatccagacccaggtctgttattcattcttctcttttatgagtcctcaaagtttcagaagctgcttctgagagctacacatgcaaatttccattttgtacttctgttctcccaaagaggccaggcaagagaaaataagtattcgcctagtacagagtttcacgtatggaacacacacacacacacacacacacacacacacacagagcaggaaatgttcaccgcgtgctcttttcttttgtttttgtttacactggagcgacgtgtgcccatggatgcctggccttgctgctctgtcccctgcccctcgagctatatggggctccctccaggaccgggctccccaccctggtctatctgacccagtcagggcagtcactcaaacattcattactgtcaccatgaaagtggcatctgttttgaattcaggggcctcatcttctctgggtgtcccactctgtcatcagagcctggctgcatgaggtcagctggccccttctctcctccgtgacacccctggtaaacagacacccaacaacatcccgcagggtggaggtggggagtgaaccttaaccaacagcacgcttgtccaaattatttctcaagtaatggaggttctgcagggagagcttctttctcaggttagaactggtcaaaagacacagaggtggggttcagaagaagatttccagggcacctcgaaagccctagtttaatcaataaaacacacttgcaggcacggggtgcccttgccaacagcctcctaccctcccatgtaaccacagtgccatggaaagttaccctcatttcacagatgccgagagtcaaggcagacaggcctggcctgagccacgtgcaggatgcagggacccacattctccctccggctgcaccttctagcctcctgcccaggacacagatacagatgctggctgcagagctgctaattaggttactggccacgtagttaaaatgatgtggcaaataggtgcagattcattccaggtatgtgttgtttcatctgttacaacacaatgtggaatgaaaactgatgattcagagaaaacacaggatacattttaaaattatattatttatttaaaacaaatatcttgtttcaaaagatcataattctcttttggcctctttttggggcagggctaggacttcctacacaaatatagcttacacttatgccgcactaaaaaacaaacctgccatcacagggcgagaacttcactcataaccagacagccaacatggtcccgtcagcccggccaaaggtcaccaccagtttcaaagacctgtttcctctggtgtaaagtggcgaactcagtgacttcccagcctgtggaatgccagcagggtcaccataaagccccgcagatgccgagacggtgcaaggagcagagccccacagggcaaggccccgagctgctggcagctggtgtcgcccagctgacgcacttcctcagttgacagtggcttggtcctgctggccaccttcgagtccaagaaaggcctagaagtccacaatgaatgcctctgattgaggctcagattactagggatttagaaaccttaattcttttgtacaaagtataattgtgctgacatgaaaagccaaatgtggcttgctgactttgagagtgagcctagagcccacatggtggccttggctgatgggattcacacagtggggccacttcccagactctgggagtcaggagtaatagttcccagtagaaaaagagacacaggtataaacatgcctctagtaaggtgttaatgtgtaaagtgactttctaattaaaatgagtcaaaaatgattggtgaggacagcctaccagaaaagggatcttacaggaaaaggaataaaagtgtcctcaaaaagagcagaatttaaggatgcttcatggttcttctgacagtagtgacaactagcaaaaaagaaagacatggaagccaccaatcagtacccaccttgagtaggtgaatggagggtaaactgtggcacatccagatgacagagtgttattcagctgaaaagaaatgagctatcaagccaagaaatgacagggaagaaatttaaatgcatattatcaagtgaaggaagcccatctgaaaaggctacacatgtatgattccaaccctatggcattctggaaaaggcaacactatgaagacagtgaaaaggtcagcggctgccggggtgcaggagagagaagcgcggcacagaggatttctagggcagcgaaactactccatacggtactgtcatggtggatgtcacttatcatgcacctgtccaaacccatggaatgtacaacacccagagtgagccctaacgtagactgtggactcatcaatactggctcatcaattctaacaaatgtgctgttctggtgcggcgatgctgacggcaggagagtgtgtgtctctgtgcgtgaatatgcatgcgtgtgtacatgtaagcacgtgtgtgtgagccctcggttctttcccctcgattttgcggcaaatctgaaactgctctaaaaataacatcttctaattttaaaaaccattttaaaagctgtcaaacattaaaacacacacacacacgcacacacacacacacttggcaaacataggtggagacctgcaatcatctggcagaatcagactctcatttcgtcctgtggggctgcagacagaagctccctgtggacagcacgctgcatctgggtccagctctgtgcacggccgagagctaccctcaggaaatgtctgctgaactggctggcttaaaaattaactgcctccgcccttagagcaagaagtggggagggaggagaagggatgcccgtgtaaacatttactgagacggcagagagaggcagagcccgtgctggccgcgtgagctggggcaggaccatcgcaggctttagcaagagatgcaactgctcggtcccagccctgtcacctgtaagagggagcagaacaagcctcctcagacagaagtgtgacgagtaaatgacagagcatatctaaagcactcggcagggtcctgcagatccctcaacagcgctgactgagtggcattccttctgcacaggctggacatggagagatgtatctcatgacatccctaaaaatcctatgctcaaatgaagaagctgagttcagagggagtaaccatcttcctgaagctattgtaaagggtacaaataggggcaggaaagagatgaactcacaaacaacaaaagagcttttacacgcagggccagggattttccttttggttatgaaaaacgtattggtcctggctgggctcaatggctcacactagaatcccagcactctgggaggccaaggtgggtggatcacttgaggttaggagtttgagaccagcctggccaatatggtgaaaccccgtctctactaaaaataaaaattaaaaaaaaatagccaggcgtgttggcacacgcctataaccccagctacttgggaggctgaggcagaagaatcccttgaacccaagaggtggacgttgctgtgaaagatcgcaccactgcattccagcccgggtgacggagggaagaaagacaaacagaaagagagaaagagagaaagggagaaagggagaagaggagaaagggaggaagagaggaagggaggaaggaaagaaagggaggaagagaggaaggaaggaagggagggagggagggagggagggagggagggagaaaggaagagagaaagaaagaatttattaggccttgttactagcaaattcagatcattcattcctagtgaagaccatatgaagaaaggccactacttacaccttttggggaggtcaaagctgacaccccaaccttaaaagctgtggcaatgagcttcaccagattccatcctccaccaacagcccagggagcaccaaccctgctgaaggtggggacgagagtctgcagcctccgtggcctgtgtgctggcaggaaagacaggcccctgccctgagcagagcggagctggctggtgggatgctggagagtggaggctctggggccctagacagggtaaggtctggacatggaagatgagacaggctcaaagaatgcagtaaccgagagctcagggtcagcaaagcagcagctcccacagcctccctccttgtgcacgggtgagaaggtccaaaacagaaacgcacagctgcgacagccgaggcccctgcagggttgcaaagagctatgggaattggggagagatactgcccctgctcactgtctcgtgggaggactgggagtctcggacaagatgccacggatgtatgagcagagccttcatggggaagaagaggcctgagccatgcgggagtcagagaattctcaggcatcatttcatgagagagaaatagagatgcagcccaagaggagtgagccccaagccaagcgggagagacgctcaactcgtgttttagagaagttggccctggagctggagttcacaagaggcatagtaggttctgtaggcatacgagcaaggtgggctaaagtcacccacacaaacctcagctccatttctgatacatgaagatggcaaagcaccaaaaagaacacatggaacagcaaaaatcagaactttgaaatgcaacgcccatgaattctgggcccagaagctaggtgacaataggtaagttgtttcacctccctggggtctcgaggtttttcatcagacaatggggagagggggctggagaggtcaatccctgggacccagcaggcccgtatcccactgcacggcagctgcggctcttagcatgcagagaaaaggagtgatctgaagatgaaagttaactgccagacagaagttaatggttgaaacttatcagttaggccactgagcgtctgttgacgcccaggatgaatgtctagggacagtttctgaagaagccataaactctaggtcccgtgttttccatggcagaggaccaagtctttgccctgggcctgtctggtggaagtgaaaaagctcctgcatcagccgcagccaggacatggggatccctgatgggagagcccagcaaaggcccccagggcagcaggcgatgagggcagcagggggttccgctgacttccccaggacctcctgtagtctcagcttaaaaagagcagcaagcctatcacaaagttctctctccctcaagcagccagctggagagcggggaaaggctcctggcttggcaagtgcccagacgtagcaccgggacagtggaagaagatgctgaggccacctgcaggagccaagaggctggacagagcctgggacctctctcctcttgctgcactctccttctacagactcagcaaggaggcaacaccagcactcctgtattttatatccaagaagggtgcaaaccgaggcacatgcagagagagaaacagcaagctggaccttcgcagccaggctgcaaaggctgaggatgagccagggggtctgagagcattggagcccaggtggtaggaggttctgtgtttttcctggattaaagggggagctgcgcatcgggaccctgtgcagggcatctccccaacattactcctgcgcatgttcccctcactaactcctgcgtatggtccctacgtggggtcttaagtttacaaaaaaattatctgcaggtccatttcacctctgatgattcaagatgatactcaataccctacacaaagtgcaactctaaggagcaaatgtgtctgcaagtgggcagaggcggaagaggcatctcaccatgatgccaggctgcaggtttcaaggataggattcccatgcctccatctgcttgcctaagctccccttcatttccttcaggggggcaccacctgccaccctttcctcccccttctcccctccccaacatctgctttcctacaactgcttcatttctcctacttcttttttcactcttgccagtaagtcaagtgacagccaggaaaaaagcaagtcatgatgcccacacagctcatgtggctcacatgaataagcactgcattccaggaagcaaaacagttgaaatcccaaactttcaagtgattgtacatacattatgtgacttccctgaaacttaagtattaacataaccaacagctaagagaaagttatttttctgtttattacagaaacctattattcactttttttatgcaggaagaaagtgaggctcagggcctatctaagtccatgtgggctgctataacaaaatattgggaggcttataaacaacagaaatatacttcccaaggttctagggttgggaagtacaagatcaaggcaccagcagattcagtgtctggtgtgggcccttttcagggttcatagagggtgccttcttgccatgtatgctcatggcagaagaggtaagggatctctctggggtcccttttataaaggcactaatctcatttatagacactccaccctcgcgacctaatcatctccccaaaggcctccatttccagctaccatcaccttgggggtcaggtttcaacacaggaatctgggggagacacaaacatcaagaccatagcaagggggactagaaaggcttcaggagacaaaaagccccactgggatccaagtccaggtctctgcctccatccatccactgagctgcatggcctggcctgagaggacatactgtccaatggctcaagaagagagtgatagcagtcttttggcgcttctcaaaatgtcccaacgatggctctgcctccctgcctgaggcaggtccccagctgctgtctcggtccccatttctgcaggatggtttctccacattgtcagtgccacagaaggggctctgagggcctggatgggaggagcctgtgacaatgtcactgacagcagcagatcaacagcaccaccacacaccagccacatgctccagggcatgtgtggagcctgtagacacaggcgcaagtgctcccacacagaggggaacaccatcgagggggtttaacacagcacacgctaccacccagtcttgggtctgatgccagaccaaagcctatgagctgaaccaaggcttcatacttgcctgagcaatctgagtgcagcgtctaaggagcccactgggcaatatatgtaaacacagtaatgaaggactcaaaagccgagtgcaataatgtgggagaagccacagccatattcagttcctggaagaccgagcggctcccttagccacataccctgcaggagcagctggggagttatggccctcatatccccaacaacgacggcattatatttttggaatgagaaggtgctttgttattgccaggggctttctcccctgtggttcaaagctgtattataaaaaaaatgaacacggatatatttccccacactgtgatctgataggaataagagcttatccatccctcagcaaactgccaattgctgccgttagaaattccatattcagtgatagttaaggattttggaatacactttgaaccaaagaattcaatcccttaagcagccggcgacaggcttcatttaagaaatggaaggaacaacagcaggctcatctctgcggctgtggctcagaggtggctgggcccacaacagagtcaggacaagcagcccaccccctcctcctactccgcagccgacccaaggtgcaagcaatgcggacaaaggcaccatacaacaggggtgagggacaacacatcccagtcctcctaggggagggggaagctctccaagtctgaaatgctcccccaaaggtacaatcttcccactcaccactgcattcagaagcactgctcccacaccactgaaggtgcacagcaccccaggaaaggagcctatctgtggacaaaaaacctcaaataaaccacggtcagaaatcagctacgcctaggagtgtgtgaacaagaaatgcccactcctctggaaaaggggaagccctctccagagcagggtggaaagcaagaggagaagcgctccacacagcccccaggaggcccgagaagtgcaccccacatgacatctgaaggaggcagccagcaaggaggtgtggccaggtcacaggggctgctggtctggggttcaggaagggggcagcaaggccctgtgccatcctctctgctcctgcacgtgctcggcattctccataatgaagactttaaaaagtctcttgggagaaaagaaatagagctatactagtctagttcttccaactttgtgtgtgtgtgtgtgtgtgtgtatttctgtgcacacatatgcatgtatgcgtgtgagcacaaatgtgtttgtgtgcatgtgtatttatgtgcatgcatgtgtatttatgtgcatgcacatgtgtgtatttactcatgtgtgtgtttgtgtatgcctgagatcgggagggtcggggaaaccagccgccctagtcctcacatggaaaacagacccacatgcagtgagttcatggtaacatgaagtcagcttccagcatagccttccactcggagccgaaggcagggctggaaatgatcaaaacagctgacccatgaggtctgtaacagtagcaaaatcccaagactctaaaactcctcttccctggacctacagccatggggacaacctgtcagggcacctacagagcccccataggcagggccaaacagtagatggggcaaaacactgctgacaccccgactgcagacccaaatcatacttggggattccgtaagtacagccaccatccccaggagatctgaaggtgcgagcaccaagacaacgtagaaaaccatgtgcttcttccttggggtgtctgtcacttcccacacggcacttccaggccacctcacttccccactcaccaaaaccctaagcccaacaggacatagccaggcctcctttggtcatagaggccatcgggcaattgaacctctctagagactcacaaacctcagtgaacatcactaaaccttactccagggttcccaggtttccgtggcagctgaaaaccccaatccgtctatgcacaactatctccaaaatgaggcagaaaagtctccaggccaggggaatgccctggacctccctgctcctgccctctctccaccgagaggcagtatgacaaggcagtgagaaaccagggaccatgtgccactgagaaggagctgttgatgtggccaggggacaactattgaattcttatctgaaatcaaattcttaagaattattttccataatcaaaaccgtggatttcaaagctctttggtttatccttgagatgaaaagtatacaccgtaccccagccctggctttcctaaagagttttctttccgtggctgcagtccaaagaggcccccccacacatatcattcaatgaaggccaagtcagctataaaaagtcccatgggaaagcaacggaatgcttaccttggcttcacatttcttgtggcaggaatacttgcaggctgggaaaaaaaaaaagagaaagaatgtgtgtcaagcagtctctctagcaagaattcttacatcttcaaaccctctcaatccttcagagtctctggcttgaagatcccataggtggcctctctctggcacgagagagatttttacatatgacacacggcagtgtggacagaaggcagtgaggacatggtgtgcaagagcagagttacaactgttgtctgttagcaacagctcaggtggctcaggtaggaatgtcttgggagcacggtcatgagcagattggtttttcaaggggtcatgagcagattggtttttcaaggggtatgtacgtccagccgaactggatccctaaagaagaatagtgaatttcagcagcagaatgcattcgtgtgtgcccagaaattatagctgatccctgaaaaaagaagagaaactggaagatgccccttaagaatcagaatttaaagtgtccatgaaagaccggatgggagcctttaaatttgtgagaaagtcgtgcatctggatttcggaagtgcttccacttccggccaacctgagaactgactgtcagaataaattcatgtctaaattcctataggagaatccttccagaggggccattgtgtgaacggagcgagtcctgtgtcccttcggaggccctaacaatgcaatgcagagctggaaccaatgcggatttcacaggcccttctgcccagaggctgcagctgtgatcatgaggcataaacctccccacgagcaccacgggcatgctgcaggcaggccttgcaggacagggagagagaaatgaagcaacaacacctaataatcccaacacagcctcctgtgccagctccaagggaacgtcgggtacatgccctcccttcccccacgtttgccagcccacagggacagctgtgggaggagggaaagagacctgggttggggaacagtgaccaaagcctcctatccaggctctgcccctcaagctgggtctctgcttcctcccacggagctatcatgggtcaaatggaatccttcaagggaccctgctttgaaactagaaagcaatgtccacatgcagaagtgtgtgggacctgaagaccaaggcctcagaagtcagggagaggggccccacatcccagctctgcgtgtcaacaccccgtgaatttaatcaatgtctcactccccctcctgcactctgttttctatgatgtgtcaaagtcaaaaaggtttgtgtagggttgaatgaggatgaaacagataaggtcacttgcccactgcctggcaattattagaactccagtagttacagctaggttgttatctttgtatgatctatatttttgaattgctgaattgtcattctataccttgaggtttgtaagattattcacaaagacatgtatttatcctacaccttctgatgggcaaaacacacaaaggtgatcagtgattttcaaatcaagagagacttgccattgggaaacaaggggcttccacacaagattaaaagtccagacagaaaccatccccagcagaggccagcacaaaggactgagataaggagaagggcggtgggcaggcctctggcctctggctgagtgagagtcaggcaaagaattctgcccacacacgtctagcagcatgtcacaggaccacgacatcatgcagcggttagccttccagatggcctgggtgacctcgtctcttggcccccatgctggtgtatagccccctcccacagtgaatcagctgggctgtgtgacagtgcaacctggcagaggagatggtgtgtgacttttgtggctaaaagacatcgtgacttctgtcctggtctccaggatcactcattctgaggacagccagatgccatgttgtgaggacactcaagcagccctgtggagaggcccccatggagaggaactgaggcttcccacaaacagctggccccagcttcccagccacagaagtgtgccacctcggaagctggtctccaaccccaaccaagccttcagatggtgcagcctctccagagaccctgagccagaactgcccagtcacctgtgtcccaaattcctgatcactgacacagtgggagataacagatgcttactgctatgttaaggtactaactttggggatcatttgtcatgcaacacgccaactcaacacaaaaaaatggccctggtcagtgcaagggtggcagtggtatgatacattcatggtgggtggcctactcggccaccagacagccatcggcactgtagggcaaaatcattaaattcaattatcatagtgaaatcatataaactgcccatgagccaagactacaatcctgagaggcagggccattgtttctggtatgtagacaagtgaccctcaaagttttacaaatgtttggactaggacttcacactcgattgtcagcagcatggataatcctcagagtagcaagtccaccgtcaatctatccgtggcccagctctggtcagcaccgcaccaggcagtgtacaagatactttcccgtatgttactgcacttgctcctcgtaagcacctctcggggaggaactgtaagggtgactcagccaagggggcagccatggtccatgaaggtgggactccagcccgtctgtgcatcaaattcagtgtttgcatccagccatactctccctgcctttctgacatattacaaaatatgaatcaaacagtgcccaggcccagcttcctatcctgccgcccacaggagacagccccctgcctgccctacccctgcctgccctaaccctgcccataccaacctcacctcctcattcacgccatcctgcacccacctcctgggcccggctcagctgcctccgttcctgagttgacacccttctgtgccactgaaccatcatggcaggtcatcatggcttgtcatatcatgatgatctccctgtgtccatctctcccgatgggctgcaagctcctcaagggacagcgtctctgttgtgcatgaccagggtctcacaatagcagcactaacacgagtaacaggcagctaatacactcagcacctaaaagtttgaactgcatgcgtattgccaaatttccaccacaccctggaaagaagctacctatcttcgcctgttttactaatgtgagactggggtttgtggatgagactgaggattcacgtgctggacaactgtgtcccaatcttgacctgttccaggtctgctttcagaagcccatagccagcaggcccacaagctatggagacctcattacctgatcaccacttagggattcggggctgtgaaggtgctggccagaagggaggctgcaaaacagaagaagaacttcgcaccaaaatccatctctgaagcacacaggcccagaagacaaaacgtatgtgttcactttgaccctcagccaggcagacccgcctcctttttggaatagcagttgtgtgagctggcagctaaactagccaccttctcaggggatgtcatttttatttgaaagaactcctagcagacaaaatgcagttattcagactcgagtgcttgtcattttctcaaaaatgaagtgagtctgtcatcataaaccaatgtcaaaatttgagatttcaagtgaaaattagaattttaaaagactagtacccaggccaggtgcggtggctcacgcctgtaatctcaacactttgggaggctgaggcgggcagatcacttgaggtcaggagtttgagactagcctggccaacatagtgaaaccccatctctactaaaaatacaagaaattagctgggcatgatgatgcatgtctgtaatcccagctacttgggaggctgaggcacaagaatctcctgaacccaggaggcagaggttgcagtgagccgagatcgtgccctgggtgacagagtaagactgtctttaaaaaaaaaaaaaaaaaaaagacttgtacccatcaccagggcctaacaactcctaggacatttctgttaaaatcaacaatattattaacaaatgtggggattttcctgagattgtataacaaatatgtcaacatttagaagttctgcgaaattgtcagtggaccaataatttccaaatgtccagtgcgtggtgttccacaccgggtaaaagatgcacttggtgtgcaagacaggccagtggattttaataaaacagcgtaggaaaaactctactgacacaatttcagattccacagtgaaactgaactttaagcaactgtcacttgagttctggtgtagaatcaaaatgaaatagctacaatggccggaaaagcctattaaaatgcctccttttccaagtagatatgtttatggggctagattgtctttgacgcttcaaaccaaacattgcagaagactgcatgcaagggtaaccagcctcttgattaaggctgcataacagaatcacaaaaaaaaatgcacctcctctcattttgttgttttgaaacatagttattttttattaagcttatgttcattttaacatgtaattggttcattaccattgcttttaactgacttaaatattttaaatactcatcagtttcccatttctaatagggtaaatcgtgatgaatacaaaccacactgacaagagccctttagggtcttctaggaccctagcagtgggtgcccgagacccgcagcgcgagggcaaccccgttcattctccttgcctgaggctctcagaatggggtaaggacccaactttgaccaacagaaaggtaagtgaattctcccaggggcttctggcgaaggccttcccactcctgtaaacgaagcaagggaaaatgcctcagcttctggaacctccccctctgagcacggagctggacccacaagaagaacctggagaacttgggttgcagaaccggggcccaggcacactgcccggagcctgccggccgctgcacctccccctgcagaagacacatgccctgctggctgggagaggctccttccatgcagccccgttattggctgccacggtgccttccacgaagctccatgtactttagacgccttgttccacctgttcccatggggaccagggagaaagtcacattctcactccgttgcacgaacagcaaactgcagcacagagcggaagctgcctgccctgggcgacagagcaggttaagcagtgacaccagctgccagcccagctctagatgggcagagcccacctcccagagctggactggaacacccagtgagctggtgtgcaaaggctcttctgtgcctggtgcaagaactggggctccacatgcatgagcccactaaagcaaacatctaccatgagctacacaccaggaccaggagcaggtgtccagggacctcaggagtctgaactcacatgctcactccagcccctctccaaggatccgtgccagtcatgtcccctctggcacacatttccccttctgtaattaggagtagaacagggtgatagccaagattcctctctgccatgaaaagaatagtttacctaagcaataaaaagataaaattacatatatatacaaacaaaatattaggtagctattgaaaaattatgatctcaaactatttcacatgtgagagttcttacaaaaggcaaggctaacagatatacagcactctgtgttgtatgaaataaactttgtgaccgacagacatgcgcggtggcctcatctataggagagaaaatgacactggagagagacctcacaactcagacagaaaggaggagccagacaacaaaactgggaaaactggttactccatgaaaaacatcatcataataataacagaaataccatgaatttcagatgcatcaatcatagaactgattcggaattggaaaagctgaaatgaattattagaataaaatatcagagaacatctttgtgactttggaaaagggcagacattctacaacaaggaacaagagtatgaactaaatgaaaagatgagtagatctgaacaaaccaaacattacaacttttgcgtgacaaacaggccacaaacaaacttagacaagcaactgactggaatgtttgcaatgtacaaagtggaaagataagaaactgaccttttctgaggacaaatgtcattagaaattggcaaaagttctgcctaatatcacagataagatttagtattcataatatagtgaagtctcagaaatttaaaaaaatgatttttaaatttattaattttcaaaatgttatttatttttttctttttagagatgaggtctcactgtcacccaggctggagtgcagtggcatgatcatagctcactgcagcctcaaatttacaggctgaagcaatcctcctgcctcagcctctagggtagctgggaccattggcgcgtgccactgtgcaggccaatttttaaattttttgtagaaatggggtcttgttttgttgcccaggctggtcttgaactcccggtttcgatcgattctcccgcctcggcgtcccaaaatgctgggattacaagcataagccacctcaccacgccctaaaataatctaatttttaaataagcaatgaacaaaggatttgaaaggctactttgctaagtaaacagaaatgctgcaggcagcttttttgtatctttttagatgttcaacctcatgtaatcaccagatgaatgaaaaacataataaaaaggagacatcacttttcatccatcaacttgcaaaaactgaaaagctgaaaaatctcaagtgagagggtcagtgacattccatgcaagtaggctccaccaaaagcgttttcctgtgaggagcctgaaccttctccagcccagcttaccctccggcgtctgagctggtgtgtggcaggccccttctcgtggctttgcctgaacactcggctccacagctgacagtctgcaaaccacacatcagttcccttgtcagacgaggtttccagactcatgtttaagaatcctggctcccgctgcagcagttacagcccagagctgtctggcttgcaaacgcccaacatttttatatgttgtcttggaactgctattcttcacaacgtctccacgagccttgggaatccaggccactgtcttacagggttgtcagaatcttttatacaacactcgaaacatattgaccaagttataaacaagcctgtgagtcaccctctgcttctcctagcatcaactgtcaagtttgccagcctctctgtgtcccagtaacaggctccacaaggcaggaggggactgattaacccacagcgggggaccgccagacaaggcctgcccaatgcccacattcactgctcaaccccatgaccccattgttgccttgttagttttaaataactaccatgttctcctgaagtcctaatactgcacctggcccaaagcaaaaaacacacacctaccgacctgcccgtctatctccaaacctttatctgtaatcacttagtgtattgctgactccgatggactcaaagacaggacacaaaactctcatctttctctcctagcaggtgcttaataatgttgggttaactgcgtggaacaacccattaccaaatctttcttacaaaactcccttcatcccactttccctctggtctcctttctcagctttctccttgcttcttttctcctttctccttgcttcctttctcaactctcatctcctttaggccttccctacagctgtctctcttgttgcagcacttctttattctgtgccatcctgtctcattccatgatagtctcgctgattccactattagatcccagaaaaccatctctcaaatggggagcatttatgcgtggtctgaccctggatcctccctggatctaccttcttccagggaccaagtcccacaaaacttgtaacttttggggccgaatctactcaattccagaatgccgagactcacccataacagcaccttcctctgtcctctgtgaaatacaaccattttgggatatcaatggcaactggaccatgttaggccacccaagggaactcagtgacatgtagtgagaacgggttgcctcagagtcctaactgatggtatgagcacaccagcaaggttttgaggagtgtaagaaaaaccacaactggacacttaaccccattgctcaatgtcatttctatcttttctttcccttacttaaagttccaagagtagagataacagggcccttacatgttaacataacagtttttaaaagatgaaatgttttctttctacttaaccacatatgaaatttgcatttaactaggaggttaaaatgtgaaagtcagggacctgaaagtccaagaatgagccagaaaaggaacggtagaaatactggcctgcatcacagaatatgcccctaacccttctccatctatcatcaccatcagtatcatcacgatcagcatcatcatcacaatcgttaccattgccattgttactatcaccatcaactacactatcactatcaccatcaccagtcacagcactatcattgctgtcatcaacatcatcatcaccatcattgtcaccattcatcaacatcgtcaccatcaccatcatcatgtcaacataatcaccagtgccatggtcaccatcaaccacaccatcaccatcatcatctccatcaattacaccatcaccactcaccatcaccatcatgatcatcttgaccatcaccatcttcaccaacatcataccatcatcatcaccatccccatcaacaccatcatcactaatataccatcatcatcaatcacgccaccacccaccatcaccatcatcgttaccatcatcaccatcaattacaacatcattatcggcataccattgccaccctcatcaccatcactaacaatatcattatcaccatcgtcattactgacaccattgaacactttctggagctcctcagtgttctttgtgtttcatgtgtatttaccctgctattcctcacaatgactctaagcagaaagaggcagagcaggaatgctggcaggctgtctccaccatccacctcacctccaccacgctctgctgcttccccagaaataagccaaagaaagaacacctctaccaaaacgtcacatcactgtgatgcatgatgacttacataatctatgtaaagggaataccttgttgtttccaggtagcatgtacacaaagggatcaaaatgcaaatgtatatgacatatgtgaattattagtagagaacactatgaaattgtctatttggggagtggtctctatatagtctattgagaaagagaaaatcctagagattaactactctaatgtacaaattgtaaagatcacggcactgaggaacagaaatagggtgcaactgtccagggccacagcttcctgtggagcagcccatccctgactctgccaggctcccatctacacttgcagtgactgccaggaccccatctcaactcagtgagcagagtcctcacatcctgcctctgtcccatctaaacttgcagtgactgccaggaccccatctcaactcagtgagcagcatcctcccatcctgcctctgccttgtctacacctgcagtgactatcaggaccccatctcaactcaatgagctgcagcatccccacatcctgcctctaccccgttctacacccacagtgactgtgcccggctcccagctccaactcagtaagcagcaccccctaccctgctaatgccccatctacacatgcggcagcacgtaaggagatgggccaggtccgtcctcctcctactacgctgacaagagcaatggctaaaatgatttcctgtgaagatacacaaacacacacaaataaaaatctagctcttgtgggtcaggagcagtggctcacggctataatcccagcactttgggaggccgaggtgggtggatcatctgaggtcaggagttcgagaccagcctggccaacatggtgaaaccccaactctactaaaactacaaaaattagccaggcgtggtggtgggcgcctgtaatcccagctactcgggaagctgaggcaggagaatcacttgaacccaggaggcggaggttgcagtgagccaagaccacagcactgcactccagcctgggcaacaagagcaaaactccgtctcaaaaacaaacaaacaaaaatctagctcatgtgttgtatcccaattcagcctggtgtacttacacaggctctttttccttcacagtgtcatggggtgtgccaattctatggtcctactggaggctggccaatgttgactgaagacaagaacgcccaaccttgcaatagaaaccctgctgtgctgttttcctggatggtctccacaagccccgcttcaaatcacactcatcttaccagggctaccagccacagcgtcctgcagccccacgcttgacaaaagaaacctagaggaaaggtgtcattaccaatctttacccccgaaagccacccacagggcaagcctcagataagtctcgtcgggaaagggaaggggaagagctcacccgcagggaccttcaccacctccaacaaaccagatgtttgtaaagatacaaagctaaccacaagttaatactcaccaaactaaatacttctaccttttattccctccttaattccaccagtattcattaatacccacagctgaaacattttgtaagcctataaatatgtcctggacacctacaacagggcagaaactgatctggacctggatactattgggaacacaaaaaacattcatgaatgtacactgcagtgcaagaggaaaggaaaatcaacaggaaccgtggattcaatcaggatgacctgaggtacaggaaagtaactccaggaaggtgcagcgggagcctaaaggcggagggagggttccacagtcatttctgtatcgggggtcaagaaaagtctgaagagacaagaagaaaaatagcagcaaatgggtgagaaggtgacagggagctgggtcacacagcctgagggaggccaccacccaaaaggcactataaaattaattgttgagggcatcaaccaatcaataatcaatcaatcaagaatcagtcaacaataatcaatcaatcaagaatcagtcaaccaagatagtcactctcacaaactccagtatttgcacaggcctttgtggcaggttgactggggttgcagagagcccaaggctcttggctgcacccagcctgcctcccacagcaccatttcctcagccaggtgcctcccaaaagggaagttaaaccctccagaccaccctctgttgaacacaaactcaggaatggggataaggctcaagatgctcccattcgagacagagcagccctctctgtgcgcccgtgtggcacaggtaggattggatgtcgccgcaaggtccctccgccgatgtcatagggcggccatctccatgctcttatctatttgctgttctcactctcctcacagatcctcacctccccacgccagatctgcccaagaacactgcaacacacttcaagacaacagcccctaaaactcttgaagttttcatccccagatattcagttttactctttctctctttctttccacgtaatgattttcttttctcgaaaaataatcactggggccaggcacagaggccgacgcctgaattcccagcactttgggaggcaaagttggcaggcttatttgaggttatgagttggaaaacagcctgggcaacagtaagacccccatctctacaagaaagaatataaataaataagtaaataaataaataaatcattatccccctcaagggattcttatcgtatgggcatggttcacgtgctcagacatgaatctgatcctcacacaaccccttgatgagtatcagttattgtcctcatgtggcagaccgggaaactgaagcacagagaggcagtggagctaaggtctgaactcacatcagcctggctctggagatcacaggtttaacctttgagcctctcagaaatcaatcgaggtggacttaatcttcacaaataggacactgaatcagctgcggcactgactaatgttgatgaagcactcaagagctgacagagtccttttacgtcccttgactcacatgttcctccaaacagcctgtgagtagggccagccaggcctcactgcccacttcacagtccagagaatcaagcccagagtcagtgagacccactgaggccccgcctgctgcttcgtctcagggcgccagctcccatccctaacattacttacataatctatgtataggacgaaccttgttgtctctttaccttgttgttaacctgccccccatttaagatatccccccccaacacaaggcacgggtgcaaaggagaatgtctctgcatctccatcagatattcaaagggatcatattatacaatattgcagaatgaaaggaaagaaagaagatggtaccaatccctcaaaaacatcttaagtctaactcaggaaaccctcttagtaattgtctccttcaaatacacatttggaaggaaacaagtcccccacctcactcagtgtgtgagcagaccccagcggtggggccactcatcaccatgtaaaccaggagcaccctcccaagaaccccagtcccccacacacatgggtgtgactgtccaggacttctttgtccctcactagcccagcagcccggtggcagatgtccacctgtgtgtgggtggccagcacctaacacagtaggcacctcctagacccatgctagccacagtgagctggctggaggggcgagggtgataggggatcctgcctgtccatgctcaccctaggttaggggccgtctggctgagtcatgcagaggccaggcttcgactccatcctctggaacagagctcctcacatttctttttttttttttttttttttttttgagacggagtctcgctctgttgcccaggctggagtgcagtggcacaatctcggctcactgcaagctccgcctcccgggttcatgtcattctcctgcctcagtctcccgagtagctgggactacaggcgcccgccaccacacctgctaattttttgtgttttttttagtagagacggggtttcaccatgttatccaggatggtctcgatctcctgacctcgtgatccgcctgcctcagcctcccaaagtgctgggattacaggcttcagccaccatgcccggccgctcctcacatttcttaacacttcaggcctgccagtgtcccagggttgctgatacccacgtgggctccgtgaagcacagcactgcctcttccctggcttcgaggatgtggaatcagaagttgccacttggccttgcccccctgccacacctaggcagaccttgaacacccagagagtagcattacatccatctgaataaaccaacagaaaacaaccccacaacttaacataaaattccagatcacagttactgcaaaacaaatacttggatttatgagcttggctacactactcagtgagttttaaaaatcaaaatccaccagcacaatcaactaacacaacccagacgtccctggcatgcagaaacctcaaatcctgacaacccagaccgttgagaaacatctgggaggggtccaggccttcttcccagccacagagttagaaaacaggaaggatttcagacaaaatccacgagtaaagtccgtgtggaggcggctgagaaaggctttgtattgcaacagaggagcagaatttagaggcagggaagtgctgcttcccatcggataaccaccaccgaccagaaattattcagatgaaatttggcctgggtgcctccttcccctttgggagcttctgggagattctgtcgtgttgccacctctctggatggggcaagtctgatgggagggctgagctcagttccccggtagaagtcaaccccagggtggggctgggcttgccctcagggttgggggactcaccacctccaattgttctggaaagaactttggaaataacatctggagccatttcacatggatttgccagagaagagcggatcaatgagccaggtgtttatctgcacaaattcatctggattgtcatgcaacttacattccctgtgcacctactgggctctaggccctttgctgagactcaggatacccaagaaacagcagtgcatcgcatcatagtaggggcagtcggcccaggggagcagatagattcataaacaaatgatcagaacacagcagttcctccatcgtcctgacaatgcccacactccctgccccacccacctcccagaattgcctgtccctcctctgtgctcccaaggaggctgcaaatacctctgataaagcactcctcacacgggatcctgttcctgctcactactccagcccactagactccgagcccttcgaagccttggtcaccgtgggcatcgcaatgcaccagctgccgcacctgctcagtaaaagtgtgctggtgagggttcaccctgcaagacaagacagcactccactttgggacggaggtgtctgccctgtgcacaggcatctggtgaacaacacagagccagcccctcatgcctcctgggctccagctgagggcagagaatcactgccccagtgaacatccggatggctggctagtcactggccatggatagttctggagggaaaagggcagatgctaggggacacagcggcagggcagggaggcaccttcctgaggacctggtgcttgagctgaaacctaaaggatgagggtcagcaggcagagcagcacagtccagcaagaggtcaaaaatgagccctgtgcagccggcctctcaaagcacctgggggagtcaggagagaccaaataaggcaggcacagcctcaaagggccaccatgaggatgcaggcacaggttcttcccgctggatggtttacagtttcccagagccgttctctgagtacaaacaggagaggagcggagaggcaaacaggagactggatctcaagggcatcccagcctgggcagacaaagggccagacccagggaagctgggttaggaaggaggaatgggaggtctgcacggcgatggagaccggggcccagcctccaggaagaaggccagcaagggtggagcagcaggcagggctgggggccaaagcctggccaggggctctcccattcagtggatctgggtcccaggtatcagcagggatgggatgcccgccccccaaaagtggggacaccatatcccccgccttctcacaggcaagcaggatcatagatttgttgcttgcattaagttagaaaactaaagcctctgtgcatcagcagcctttgcaggcctagggctctcgacgggtgacattccctggtgtgtctccctaaggcatttcagatctgcccacctctgagccgcaagcctctgcactggtagtccatcccacccacacccccaggccagcctcacagcctccacgtaacttccgaccccccagtactcctgctctgatgatgggggcttatctcagccgcctcagcctacaccatgacacctcctgtccacagggacccttggcctcaacagaccatggcacctcaggcttgggagcatccctgaacacctcctggtctctagcacacacattaacttaacataactgaaaaagctaatgaaaacaatcatgtctaaaagacttctgaaacatggaatcctgtatgttttttataaagagtttctaggccgggcacggtggctcacgcctgtaatcccagcactttgagaggccaaagcaggcggatcatgaggtcaggagatcgagaccatcctggctaacatggtgaaaccccgtttctactaaaaatacaaaaaattagccgggtgtggtggcgggcgcctgtagtcccagctactcgggaggctgaggcgggagaatggcgtgaacctgggaggcagagcttgctgtgagctgagatcgcgccaatgcactccagcctgggtgacagagcgagactccatctcaaaaaaaaaaagagtttctattgtttattaacataattcctagagctatgtgcataaaaacatgatgtctcctccagtttgggctactgtttaaaaattaccctaaactaggtggcttataaacagttgcttatttctcacagctctggaggctgcaagtccaaggtcaaggcaccacagatgtggtgtctggggaagacccacttcctggttcatagatggtgcctccttactgcatcctcacatagccaaaggtgtgagggagctttctagggtccctttcataagggccctaatcccacccatgaggctccactcacaaaacatatcacctccccaaggccccatctcctaatgccaccatcccatggagggttagaatgtcaacataagaattttggggagacacaaacattctgaccataacacagggcacacgtgaggcagttccaaaaaactatgccacagaaagaagaagacagacacttctccaacagaagtcctcaagatctcagtgcacatatgcccaagggcacaacactcaccacatgctaaagtcaacagcgccagaaaccagaggtgggcccgtcccttgagtcagaatgcctctgcctccaacggtgcccatggctgctgtttcctcccaatgcctccaccaagtgccttgagtgggggtccctcctcggggatggagcctgcaagtgctccctgaagggcggtggccctccttcctccagaaggcaaaggttttccttcatctgggccagttcctggttccttctcctgataatggacctcctgccatgaactcaacaggacatgcagcttcccaagcctaccacatcctcagcttctgccagttctctctgcaaaaagcagctgtgtgcttgccaccacccaccacaaagaaaggacccagggaccatggggacagaccctactgaagcccaccaggccagagggctcaaggcagaagagcttcaccatatgggactgctaagaggagagcaaggagtgagggaggaattcagacacagacacacaagaacacacatgcatgcactgcaggcacccaggctggaaaggtgaacgcaactcaccacaccacccccaggattcacagccagcaagctcagggcaactctttggggagaagctgaaccagcgccctctgagaggcggcacatccagggtgcagtgcagcactgcctgccagcacgaagcagccgtcccctggggaggcggtggtcccgtcctgcctcactggcctggcagaccaggccctttcacgtacacccctccccgagtcccagctctgcaccactggatctgcattttcatgcccattttagggttgagaaaatgggcttcataaaagcctactgtccaaaactgcccagggtgtgagtggcacagccagaacttgaccccacatcctgatctctttctactgcctctagacaagacatcccatcctagctgaggcgcccagagccacgaacagggacacagcaggagcaggtgcctgtgtgtccataatgcctgcatcctggctgcccctggaaaggaaccagcttaaaaaaggcaatgggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagatcgcgccactgcagtccgcagtccggcctgggcgacagagcgagactccgtctcaagaaaaaaaaaaaaaaaaaaaaaaaaaggcaatgggagcagccatgcatccctgcggtggaaagtaagctgtaggggaggaggaggtaaagaagaaagggataaaccaggcgtgagaagaggggtgaagtcacctaacatcatagctgtccatgagtgattttcttcaagggatgaaaaaaggtacatggctgttttttcccttgttacctccactgaccaaaaatctatttcaccagtgagaaaaaccagtgctacactgggttccctggagtagaggagcattagccaaacaggacaggagataatgctgcacgaggacagagctggcagccccgctgcttgtccatgttgggtacgtgtggggtcctccaggccaaagtgggccttgaatcctcggaggtgacgctctaggtgtctcgctgcctcccaccgaagcagaactccagagagttccaagaggaggcgggaaagcatcattaccaacagaaaccagtagatgggccacggggccaccacactgggctttgttctcgtgagtgcctggatgttgccagaagcgtgtgaaatttaaaccattatctggagacagcatgccttactgcatcttccttaacaaccaggtgacacacagcaagataagcctgttgaacatcttgtccagatagggcactatttattccctctcttctctttcaagaacaaaagctgctcctgtgtgcatgcacattttctctgtttctatctccctcaagataagataatggacgtcatagagcagctgaactctacaaagtggtctgaacaggagggatgctctcacatgttccctcacaatgtggaatatctgtgcgctcaagcaaatgcattcactcagacgcatgcacgcatgcacacacatgcaatcacaggtgtgtgcactgcttgtcctcatatgcatgaactcaatcatgcatgcatgcactgcacacatagccatgcatatgtgcacccacacactcaggcacatacacaccactctggcaggcctcctcacccctccgtaatatttcacacgccacatatttaaaataccacaaaacagagttcatttggaaccagaggatcaatctggggtccttccctggcccttctgagtgtgtgcaactgcaggacagaggaagagacacaagtcccaacccagggaaggcaccaagacaatgatcctccagataaagaaagaagacaggctccccgccgtccaagacgtgcttgcgcgtttcacagctggaggccgtgctttctccaagctcttctctttcgttggttccatttactctgaaaatagtcaatactacttaaatggcaggaacagaatactgaagtattaaaaaggatgtctgagatgactcttcagtaaactcagttctcttttatacaaagaaggaaaaattactcctcaagcagtataaccaacctagtgcagcccaagccactgtggtaagttgtgcaaaaggcctctgtgtctaaggagctcccccactggattacagctcaaggatgtgtggtgcagaggctaaccaaacacacatgcggcatcagccatgtggagctacccacagtgggttcccttcagagcaatcctaacaccagcaacaaacctaagtaccacaacgctggctgtgcactttaagcctgacttctgcccttggaacagcccttaccctaagtcctagacccagagtgaggagactttgcccctgtcaggggcagggccaggacccagctctgtctgacctccacctttgctcctaaatcagacctgtccccacatagcatctgacaggcagaagtcagttcatggggaaccttcggctgtgcaactttgcctgggacgtcatcacagggtaaggaagccgagaacaagcccaggtgtccctgctgatgccatgctgctcatgacagctctcccagtatcgcccaatggctccgctggcacaggaccagggctctcggatcaacaccaggccctgacagctctgattcccaggttctctgtgctgctggtttcatggttccaattcaaccacgactttccttttccttcttttcacacttgggagtcaaagttagagaccaaaattttaaaatatgagcatttctggccgggcgtggtggctcacgcctgtaatcccagcactttgggaggccgaggcaggcggatcacaagttcaggagatggagaccatcctggctaacatggtgaaaccccatctctattaaaaatacaaaaaaaaaaattagccgggcatggtggcgggcgcctgtagtcccagctgctggggaggctgaggcaggagaatggcgtgaacctgggaggcagagcttgcagtgagccgagatcgcgccactgcactgcagcctgggtgacagagcaagactctatctcaaaaataaattaataaataaataaaataaaatatgagcatttctatgagaatgacattcaaagatggggagactccttgggcttctatttttgccatgttcctggaaaggcacaaagcccctactggaccctgtagggtatgtgggacacagaggggctgctgtatttgcccacagacattttagagcaagcttgatggaggacgcctgtccgagagcatcagtgcaatttctcatcaccttacacctgcaggccccaaacacaaagggccaccacatttggctgacatggccctcctgaactggacaagctatgcaggggaatggccagtgacaggccacagcattcacagatgaccaagatatcacctagtgcagtgccgtttgcaagtatgggcttaaaacaatggctcaaacctgtaatcccagcactttgggaggctaaggcaggagaatcacttgaggccaagagtttaagagcagcctggacaacataatgagactgtctctaaaaaagtaagaaaattagctaggcatgtggcgcatgcctatagtccagctactggagtggctgaggtgggaggatggcttgggccaggaggtcaaggctgcagtgagccctgatcatcccactgcactcctacctggatgacagagcgagaccctgtctccaaaaaaaaaaaaaaaagttttgaatcacaggatgtcctatcagttggctcagagtacactacagcccgtgttctctgccttggatgcagatctagatgaattacacaggtggctccctggtctctggcttctacttagcgaccagggtggccggtacccaccactcatccaacacattcttcagcactgacttctccaaggggccgaatcagaggaggggcaccccagtcttctcacccacactcaggcctttgaactgtaaaagaatcccaagagccccttagaggcccctggtcacatcctcaacccattaaggtttgactgcgtgcatcgttccatcacaggcaccctactctaaagtggccatcagggaccatctgctgggggtctgcagggaaggaggcactgagggggaggtcctaacagcacagaagcccacaggctgagactctgcacattttctagaggaaatccccaaccccgcagatgaaatgatgccaaagagcagcccccgcactctccaaggacctggtcctcctagtgactccctctgtgtggtgtaccccactggtccgccaagcagcccctgccccccaccactcccacattcattacagtcacacctctcttactagatttattaatgtgcagtcacaaaagaattggcaagttccattcattacttgacgtctaaatatctggtacccaagctggtggcttagtttagtgacaggatctgaaaggggccataccaaaatgaacccgaaatctaaagatagaaacatttcattcgcaaacttgagtaacagatctgaaagtcaaactaaacaacctgagttactgacacttcagagcagacctgagaataaatgattaatttacaaattgctgcctcctctcccatcgggaaactctgctctttctgtaaaaatgtcctcatgagcacttatctatgtaaatacggttggcccctgctaagtaagggggtagggggttgggggacatataaactaagaaggggaattccatgatttaactttcggaaactcctgaaaaaaagttttcgttttgtttcttgtttgttttgctctggattaatcagtgagagaatcataaacacagacttacctcggcatgaaataccttgaccgtcaataatttgtttgcaaactccacacactttggattttttaaaggccttgttcttaaaagcgtgcagactcgaggttaattcttccggctgaaaaagtaaaggaagaaattgtcaacgtttcatctcatagtttgtttctttttccttttcatttaagggaaataataaatctagtggaattgtaaagagcaaaaacaggaattttaccaagcaaacagagaacaagaaaccatcttggtgatgctaaaattcccaagacgacccacggataccatgttagcattcccaattccagagtcctagacggacgttcactctcacccaactcatcaatcaccacatggggtgcctagaaacattacatcaaccaacatcattatgtgaaaatgcactcccttccagacttcagccgtagagccacctacttctgtgacaaagtaatccacatacacttctagactctcaaccctttttcttctggaaaaagtaattagctaaacagcataattatgttatgaggaagtcaactggctttcctggttcaaaggtgttccagaatcaccattaagctcttgagcctctctgagctctcctgcagaagaagagacagtccagcctgtgatacacatgtggttcttcctcaaacacaattacaagcattagcacttggaaaaactaaccactcagctacctattcatgtttgtagagccaaggctctcagctatatgataaccttataagaattcaatttgcttttagagtcaagcactaatcatgtctatttgctgatatgtgaccgtgtattctatcagtacttaatatccatatggattcagtgaggccattactcacccactggaataattaaatttatttgaaaagatgaaatggtatttagaatgtggaataaatggtacaactactttagaaaatggtttgacaatttcttataaacttaaacatacacctaacctatgactcagcaattccattcttatttacactaaagagaaataaaagcctatgtccacaagagaaagaaaggtcataacagctttatataacccaaatgtccatcataataactattctatatgctagaaagttaagtagagatctgaaaaacataaaaagatccaaatcaaacattcattgaggaaaatgtaagaatacagtgcaagatacactggatgcgattactggcagattagatcctgcagaagcacaggtgaatgaacttgaagacatcacagtacgaacctcccaacgcaaagcacacagagatgagacaacctaaataaacaaataaacaagcatcagtaagctgtgggagaactttaaccaacataacatatgtgtaatggagactgacggagaagggcagggaaggggggatatttgaaaaaataatggctgaaactttttcaaaccaggaggaaaactataaacccacagatccaagaaactcaagaaatttcttggccaggctcggtggctcacacctgtaatccgagcactttgggaggcagaggcgggtggatcacctgaggtcaggagttccagaccagcctggccaacacggtgaaaccccgtgtctactaaaaatacaaaaaattagccgggcatggtggtggtgcctgtaatcccagctactcgggaggctaaggcaggaaatcgcttgaacccaggaggtggaggttgcagtgagccgagatcgcgccattgcactccagcctgggcaacaagagtgaaactccatctcaaaaaaaaaaaaaaaatatatatatatatatatatttctagcacaagaaatgtgacaggaactaccccaaggcatacaataatcaaattgcttaaacccagtaacaaagagaaagatcttaaaaacaaccacggggccaaaagacacattacatgcagggaaccaaccaataggataacaggtttctcattgttttaaaaaatataagtgagaagacagcagtataataggaaatactgaaagatggacacaaagaagggaacagacaccagggcctacttgagggtggagggtggaaggagggtgaagattgaaaaactacctatcgagtactacgcttattacctggaggaggaaataatctgtacaccaaacccccacaacacacaatttacctatataataaacctgcacatgtaccctgaatctaaaagttaaaaaaataaacaaaatagaataaaacaaaatactgaaagaaaacttgtcaatctagaatcctgtacccaataaaaatagctcttcaaaataaaagtgaaccaaaaacttcttaaaatatgcaaaaaaagatatacaattaaagcccaaaaaaaatcatcaccagctgacacctatgacatattaaagacagtgcttgggcaaaaaggacatggcagatggaattatggctttacaccaacagatgaagagcaccagaaatgctaattacacaggtaaatttatgagtttttcttattatttaaagctcaccaaaagataattaactgtttaaacaatagtgtaatgtgacatgtgacatatgtaaaagtaaattttctgaaaaaatagcacaaagttcaggaaagaagaaaaggaaatatactattgatgacagcggttgctaccatcacgctggctgcagcagggaggtgaggctggggctgcactctccatggagccggtgggagctccaccccttctgagttggggtgggaactccctgggtgccactgcagctgcccaaactgcagctgtagatccaagcctccctgcgctcttgagtggggccaggagcaggcaggatctgccccccggggtgcagctgcagccaccatccacggctgcagacctgggcctcccactccaccacacaggcgggagctggggaaaagcaggagctccctgagtgcaggcagctgcagccaccctcccaggcacagcacccaggcatctctgcggcctgcaccctcgggcgcatgggaagcccccccccgcccaccatccctgctggctcaggagtgtctattctggctgcctggcctgtctcctctcccggccccccacctctcatctcagagcgggattggggacaagtaccagggccttgaatggcagcggtaggcaaagtcctgggcagaagggggtgggtcctcagtaaggccccaccttcaggccagggagggcctgtaggctggggacgggctgccagtcccacagactggagtggggactcatggtgcctcttccagccagcccatggccgcccatggaccaatcagcaggcacttcctcccctccaagggcttttccatgttcagccagagcaagagagaggacagagagaatggagagaccacaagagaccagctgcacagaggagctaccctctctgccgagagcttcagagacctgcagagatgttgggacttccagctgcagagaggaactaccctctccagggcctcctctctgctgagagcagcagaggtcgggatgacctgcctacagagaggacactgtgggtctcctctgagctgtttaacacttaataaagcttatcttcatcttcttcacccttccccgtctgcctatctcattcttcctggacacaggacaagaactcaggcaaaggtgccactggccacagaggtttccagccagaaattggacaccccaaagatcccataagactattataaggctctcatagtattcatgaagtggatataatatcacttgaaggtagcctgtgatgttacagaggtatagtataaaccctagagcaaccactaaaatcatgaattataggtaataagcaaacaagagagataaaatgaaataataaaaattattcaattaatctaaatggcaaaaggaagtaaaacaaaggcagaacaaacaataggtaggagaaatagaaaacaagtagcagtatgacagattcaaaccttgccatattaataatcatatttatgtaaatagtctaagtatctcaattataagtcaacaaaagttgtcagattttatatatatatatatatatatttttttttttttttttttttttttttgagacagagtctcgctctgtcgcccacactggagtacagtggcgcaatcttggctcactgcaacttctgcctcccaagttcaagcaattctctgcctcagcctcccaagtagctgggattacaggcacccgccaccatgcctggctaatttttgtatttttagtagagacagggtttcaccatgttggtcaggctggtctcgaactcctgacctcgtgatccatccgccttggcctcccaaagcgctgggattacaggtgtgagccaccgcacctggcctttttttttttttaaaagacaaaggctagaaaaaagaggtaccttgctgatgttaatcaaagggaagttggagtggctatatcagacaaagtaggctacagatcaaagaacattaccaaggatatagaaagtcctctcataataataaaaggattgattcatcaagaacacctaacagtcctaaacatttaatcactgatatggcttgactgtgtccccgcccaaatctcatcttgaattcccatgtgttgtgagagggacccagtgggaggtaactgaatcatggcggcaggtctttcctgtgctgttctcatgataatgaataattatcatgagatctgatggttttataagggggagttcctctgcacaagctctctctctttgcctgctgccatgtgagatgtgcctttcacctttcgaaatgattgtgaggcctccccagcacgtggaactgtgagtccattaaatcctttttcctgtataaattgcccagtcttgggtatgtcttcatcagcagcatgaaaatggactaatacaatcacctaataaagaacttcatggccaagcgcggtggctcatgcctgtaatcccagcattttgggacgccgaggcgggttgatcacctgagctcaggagttcaagaccagcctggccaacatggtgaaaccccgtctctactaaaaatataaaaattagctgggcgtggtggcgggcacccgtaatcccagctactcaggaggctgagggaggagaatcccttgaacccaggagtcagaggctgcagtaggccgagatcatggcacggcactccagcctgggttgacagagtgagactccatctcaaaaaaaagaaaaaataaataaagtaggggaaagagtcctgaaccaagcagaagccttcacataagttctgatacctacactacaagctctgtggcccaggacaagtcacaacctctcttaaatagaaaagatatcctccccctcctgtctcttaacagctattgtaaatgaccaaacgctgtatcatctgtcagttcataggaatcactggggcagtttttaaaacagctgacccaggctccaccccagaccaattaaatcagattacctggaggttgaatcagaacactggaatgttgtcaaaccccccaccccagctccatcccgtgattctaatttgcggccaagacagaaccaccactgtatataaccgactatactgtaagtatctatatacatttaaggtactgttattatgtagttgttcctatgtcggtatctggttttttcaaagagattgcatcctttctgataacacaggttgtgtgttcagtgctctgcaaaagaaggataatgatgctgctaattatgcagttggtaacactagctaagtgcttctgtgtcattaccgtaatcaccactagtctacaaaccgtgatggtgagatgcaaaaccgagatgcagcaccacacagccaatggatgaggcatatgagactcaggcctcatatgcctcaagccccagtctcacgctcagacaagagtagcattcaaacacctaacaaacacatctctctattgcaatgcagcagctggtacgtacttttcactcgtattgcagttatttgtttatatgccttctctcctgtgctatattgcaatttcctagatgcaggacaccaggctctttcccctttgtcctcttagggccctgcccagcgcctggcagacagtggaccatggaccctcaattaatatttgttgaccaaatgaattagccacagtctgtgggccaaggaaagatactgtgacctttcattcctcacaaatacctttattccaaccagggagaaagaggcactgttttcctgcagctttcttgcccactggtccacagctagaaaacttaaagagggaaacagcataagcactgttgcgagggctcagccatttgaattgctggatctctgaggagttcatttaggatagtgtaataacatctgctcacgcttcatctgtacataacatctctattgtgaaatgagaccagacgggattagactgcccttgttttcacctgatactgtgctttcatttctcccaaagggggagaggaggcagcaatgctgaagcatttagcaggctcagttcaggaatctaaattgcacttaattgttaggaacaaaatgttggaagggtagagagcaggctgctggttccacaaggactccctgagggggacacagtaattagtgctggtcttgattgtgaggtctcttttgagaaagaaaaatctctgcaaaattgaacagggaggtgctccacatgaatgctccactctgccgaaatgcaaaaccgcagggatctctcggataggttctcccggctaaaggtcgccctggcaaaatggttacacacgcaaaagtgcaaagctgcatcagcacaatcccagctatgttttcctttcaggaaatattcagctccaccatagtaagaggatttaggtaggcattcaggcacctgggaaaccttcagaggcattctggagaggcagacactgatcaaaaacacattcccagcccaactttactctgatgttaaacagccaggaacacttccgggcctcggggatatttcccagcccacagggggccggtatctggggcaagagggacaccctccacatccaacacatattgttcccacacttccaggcagcagcgtttgaccactaaactttaaaagggaacgcagtacacctcaagttaaccagctgaaattttgacagtttttcaccccacagaaccttacaaaagcttcagaaaaacaaatgcaataacttagggaaagggaggctgaacctagcggggagccaaccagcaccgctctgtttaattcagcaataacttagggaaagggaggctgaacctagcggggagccaaccagcaccgctctgtttaattcaaacaccgtgaaaggccgtcctgtggaccacagagcaccgctggaacccatgcggtccccagggaacctgtaaggattcctacatcccagcgcatcccccacttcattgcagagctaaaatgccctttacctttgcaagaaacacgcgagggatagcaggtctgcgcaatggccagtatcccaattccattgcagggaaatgaacccaagaagccttttcaagaggcagttgagttagaaagagctaagcctgaaccctcttccacgcttaccagaagacgcccccactaggcaaagctccactggccctctcgctccttgtcctgcgcgtgcacacacaagggtacacacgcacccacgaggactcaggcacggaccagcgtacacatgcctgcacacacagacgcgcgctcacaagcacacacgcgtggacgtgcagacggggtgcacacacactgacatacgcgcactgacaagggcacacgcatacacatgagcacaagcgggtacacaccagcacagcgtccacgggcaccagtgcacacccggcgcagcccacgtgcgtgcagccctgaaggcgcccgtgcctcgcgcccctggccatgcacaccagctccgggccgcactcacctggcgccggcgccggcgcgaccgggttccgcgcgcgaaccctcccggtggcccaggggtcagggcgcgcagcctcatggctgcccctgccgcccgcggggagccgggctcggccgggcgagggtggccgctgacccctccccagcggctatctggggggaggatgcctcccgagtcccctgcggacacaagtcccaggaaatggccaacacgggaggggccaagggctctccgtggccgccggcccaggtcccagccgcgcgccgcagcctccacggccactcctgcccgtcagaagtcagacgccgggaacaaaagccaggcgcgagcgcacggtcccgcacggcgtccctccatctgacacgaattagccctccctcccccgcccgccccaaccgcagctccgagcgagcgcggaggcacaggctgagccgccaaacactgggaaagtgggtgaggaaacgccttccaggcggggggagcaggatcttgcagccgccatctgattggaattaccgacgcgccgcgcttggcgcagggttcagctttactaggatttcaaacctctccgagaacgctggcgaggtgcttaaaagaatcaaaaccgggcaagctctggctttcggaatttctaaatcttgaatattatccagtcaactctgcatctgtaatgagcagtaatctacactaccctgataatctacactagcaaacagggcatttggagtggaaagcaggtaaacaccgaggcagaaaggctttttttctaatttgcttcttctactaaaaaactaggagcctggccttgcagagagggacacgcctaaccaggtaaggatttcaagcaaatatcaaagcacaggaccgcccggggccttgcacacctgggggctgggctgcacctccctatctcccagcctatccctccctcaccgcaccccccccaccccccgccatcctgctcctggcaaatcaggacaattcacagcacatctgaagtcccgtcttcctttatgggtctgcgattttagaaggaaattagaaacccgaagttcaggaggtgaagatgacagggtgatgggagaagatggacaagccaggatcctgaagaaagggtcacttagaaacgccaggaggagaggcgggcaagatccacaggcagatccctcctttcaatgcctgtcggacttcaccagccttcccggggcagtggatcttggctgtctgcaagaagctttgtggcaagtctaaaactaaaagaacatgttcaagatgaagccactgcctgtggtctacggtgggcagcggaagagacccctgcctcagagcaggatagggggccttctagtctcaggccagctaaccctgtactcctaccactggccttcactccaggcccagcctaggagcagtgtcccagagctcagcctttatggctccaacactctaacttcagatctacagctccacttgcaactccacatgccttggatgtggggagcagtctgggtgggctaagtcgtggcctttatggctgacatatgtgcaaattccagccatcaattcaactggctgacgttaacctctcaagttctggcactaaatatccatctttctgtttctgcagtagaagagcaaagctgctcttcaacttttaactacaaaggaaaaaacctcctcctagaacacaccattctgggttccaattcctcactaaatcatcacctggcagacaagcaggcattctcatttccccctgtccttcaaatgacaccattattcacctttttctatattcattccttcattcatttttctgtatacattcatcatttttttcctatagcatatccaaactttagtcttttcaaacatttttccctgagaacacatctgtatcgtattcattccagattgcttcacatctgacacaataccaggtacatagcagtgcctacaaacagctaagaacaggatatgctgctgtcatggtttacccagggcaaacacgcccagaggtcagctggatctaccaccgcccttaccatggtgcccacaggaaccggccaaagaaatctgaattcagcaatgaacagatagcccccagcaggataaaactcctccaacctgagtaccaggattcatactctctggggtccacccaggaacaacggccaggagcacaggccagcccactgcctatgcaagccagagtggaaggcaaatggttgaaggtggctttttattgcagggataccctgaatctgctcttacttatttaaaagagtagccattcagaaaactcccacacttcgttactagtaacaaatatcgtgcgtgtgataaacctccccagtgaggacaacaaactgatttttcactggcaagaaacagtgctcaatcctaaggcgaatccgcattcatcagcaggccgcctctccagcccctctccctgcccccgactctgacctcctcctgccaggcttgcaatctaggctcttacactccagggtccttctgctctgcgcccttgggctcacttggggcttctcccaaggcagtttcccattctcctttctggctgaaaaccgctgtcctgggctcagttgaagatccgccccccatctgacctcccagactggttaatcatcctccatggctgagccactcaaggatggttggggccctgaccctctagtgtggtcataagtcttgtacctccaataggaagtcctaaccttgtctgggattttccacacacagcaccaagcaggagcaataaacactggtgcaggaatgaaaacattctcctttgctgtatttccaccacatcaacaccggtgttcactgcctgtctcagaccacacccttctgagtcctcccagaagtaagctgtagctgagggtctggggatgcgaagggactcagaagccagggcacagactcctccaggcacagaccctcacctcaaaacttgggtggcagactggcctcactccatcttaaagccacagtgagctctgtgctgctgcccagcttccaattttcttcgtgctttgccacaatcctctgtgctttttactcgccaggttgtctcaccctagcttctgactgcacttggttcccaggaacaaaacaaggttcttcccaggaacaaaacgaggttcttcccaggaacaaaatgaggttcttcccaggaacaaaacaaggttcttcccaggaacaaaatgaggttcttcccaggaacaaaatgaggttcttcccagggaggatgaattccagacggctaaggcagacatcagcaaaccagccatcaggaagagaggctacatctcaacctgggttggaaacccagctggaactagggacatgagcccctccatgagtcagactttaacaccaagtacaaggttccctgggggagagctgaggggccactcgtgcccgttttgtcactggaaactggaggctgctcctatgagtccattccctcacacgatcatgcattcacccacagatacgtgagcaacgtgtgtgctcgatgtcagaggaaatacagcggctggctcaccccgcccctcccagagggacgatctacacgcagtgttaggagggggcacggagtccacagatcatgggaagaactccatgaatggcctgtgacttgaagcagaagcagacactttccagacaggaaaagaggtgaggagaggcaagggtggtaaagcgccgtatttttggtgaactggccaaaggctgggtggctaatgcacagctgtgttgggacactgagggtagacagggctcaagaagcaagtacagggtggtgagcaggattgcacaaagcagtcacaaggaaggaggccccagtaccgagctgggctggactccaacgtcacagggggctctaactggcaaaaaggaaaaagcatcacaggtgtatgttcatcctggaggacccctggcagtcctgggaggacactcgggagaaagcaggagtggacatggaaactctaggtaagagaacctcagcctcgggcaacagccctagaaacacagataaatgtacaggggagaggacggccatagcagtggagaggtgacgggagattggtcatgcacaggatgattgagcataaggatctgtgagaagaaaaatgggaggcaccttcgggaggagcttgctagtctagaatgggggacattatagtaagccctgtgttgggagacaggaatcagatattggtgtgactcagagtttccaatctagagacgtagatacatctagaaatcaaagtagatgtgaatgtgtgtatacgaaccagtgcacacacacacatgcacacacacacagagatactcccagatctgtccttggagggtgcggaggctccaataccaacagtcaccccccaatgagcctgaaatctcttctttttggccagaaagtaagacagtgctcacagaacaatgggttttttaacaaaaagacacaggggccagcctgaagaggctcccaccaggcaaactgtaaacaacttggagatcaaaatagtgataatattggattatgacccattgaatacaatacaaatccaagactctttgagtccctactgatagaagcaaatgaccgaggccgggcgcagtgactcacgcctgtaatcccagcactttgtgaggctgaggcgagcggatcacaaggtcaggagatggagaccatcctggctaacacggtgaaaccctgtctctactaaaaatacaaaaaaattagctgggcatggtggcaggcacctgtagtcccagctacccgggaggctgaggcagaagaatggcatgatcctgagagacggagcttgcagtgagccgaaattgtgccactgcactccagtgtgggcaacagagcgagactccatctcaaaaaaaaaaaagcaaatgaccacagagacagtctcagagaggcaatgggagtcctgggagcaggttattaggaagcgtaaaggtctcagcttccatgcgtcgtgggatgggagactcgggagttatgtgcagtggagagacagaatctaataggctgtcactggttgatctttagagagaatacatagtctctaaatactttcctttatttactataaaagggaaaagagtaagtcaacaacagagaaagcttcagtctccacctaatcaaggggtcaaggtgaccatgaccttggatgggacaagccatggtcagcgccacctgtgattcagagatgagaatatgcattaccactgggtgtttctgcagagaggcatcatctaaaccaaatcctcaccacaccttggccagacaacccaagtgaggggtggagagtccaaatccttagtccctctgacgtgtgctcacagagccactgtcctggcaggatccagccctgattcccgattcctagcctcagtgctctgaaattggggccaccagatactctgggcagatgactcctagctctcctctacccactacatgcccgtcgacacgaaatctgacatggccagtcccactgctccatggcttgagggtgtccgagtgtgagggagtttctatgtgccacctaaagcacatttaaaagcactttacggccgagcacggtggctcaacctgtaatcccaacactttgggaggctgaggagggcagatcacgaggtcaggagttcaaaacgagtctggccaacatagtgaaaacccgtctctactaaagatacaaaaaattagccaggtgtggtggtgggcgcctgtaatcccagctacttgggaggctgaggcaggagaatcatgtgaatccaggaggcagaggttgcagtgagccgagatcacgccattgcactccaaccacggggaacagtgcaagactgtcaaaaaaaaaaaaaaaaggcactttgcctctgatattgaaaaagactgccttcagtttaaggaatttctgacatcagcaagttgttgccagctctcatctgcagaaattgagcctggccctctctccttgtccaaaggtgggaacactggtcactgggcagcaggaggcccagacactgtctctaggggcaggtcttgtacctgggccctgtccaaacacagactttgggaaaatcctcccttttgtctctttccctgtgcagccagcttgtgctccatccgaaatccagaagggacagtgtaacagtgtgcctcccagggcactcaccctctgggacattcaggaagtgttcaggcacacttgcatctcacctatccagcaaacatcttcacacctgttccccagggccatgctggagggggaagaccagcagaggactttcggtacgtcaagtcccaggggctcaggatatgtgcatggggcacctgaaagactggagaggtggggagctgacttccagtccctgcggtgagggggctttcgcccaggctcttagtgacccagcgacatcctaggagacaaggagtccaactcccagagtggtattaatgatcaaagatgccatttgtgaagtgcctgaccctcaagatggtccaaagctggagttacccactcgggtggaagcaggacttgaaagcagtactgctttgtcctttacacaacactgtttctcatgaaaatcacagacactcagtagataacgtgatgaatgagagtccactggccacagaggagagtgtatttattccaccaggttaaccaaaacgtctccattggctacaaagttcccgggcacgcagcctgtccccacccatgggagtcccctggggtgtgcaggctgtcaatgaaatgtcattctgcgactgccacacttcagggcttcttctgacaaacagatggtgacttctgacatcctttgcatggtgtttttgcccgccctggggaaaccagcatttgtttccctctgctctgactcgtcacagagttccttccccctgactttgagaagtaaataaaaaatgctttccttacaaaattcccctccagtgggtgcttcttccctcttctctgctcaaaacagagctgtttcattacagactgtgcacaggagagcaaaagaaagtgttaaattaaggtggctctccccagccccctccagctaagtccctggtaggatctcgcccccttccctcccttcagaggagcaggaagagtcagaggctggtgccaagaggagcatcttccttccttcacctatccatgggtcgggggtgggggtgcccagcccaaaagataaacaagggcccacctgtctccacctctcacaagcacggagcacacctttctcatggtaaaacggacccccacagctacgggctctctgtgtgcctccaaaatccatatgttgaaatcctcacccacgaggtgacgatattaggaggtgaggcctttgggaggtgcttaggtcatgaggggagactctgcatgaatggggttaatgcctttaagaaagggaccccacaagacccttcacccattctgccatgggaggacacagatagaaggtgccttggatgaaccaggagccagccctcaccagacaatctgccagagccttgatcttggacttccagcctccaactgtgatagcttccagaactgcctgaggtcgcagagctaaataaccacaagcccaagtccccaggtccagcttacagacctactgctaccaatgggtgtcccaggacccaggcacggatcagtaggcatcccagcacttccaacaagccagtttcctcctgtcaaatgagctgccccacctattctaaccgaaaatgagaacataggaaactgtctagttaataggtgccctgtgctgaggacatcatgatttacttttccactccttgccaagcatttcttcaccatcaagttgactccaagcagaagaaccctgcagagttagttgtacgaaaagcctggagatccacgatgttaggacttactctgccactttgagcacctcgaacactaaaaacggagagaggtatgttcacttcctccaggggggtaaagaaaaaggacacagttgttggtgttgtgcctggccttttaaactcttccgtgataatacattgagatgcgtaagagggcatttttttttttttttttttgagacggagtctcgctctgtcgcctggagtgcagtgtggcacaatctcggctcactgcaacgtccacctcccaggttcaagcgattctcctgcctcagcctcccaagtagctgagactacaggcatgcaccaccatgcccagctaatttttgtatttttagtagagacagggtttcaccatattggccagactggtctcttctagaacactgaggaagagctagatggtagtgcatgccactggtcacgaaaggggagggctttctacactcccctcccatagaaatctctgttactgtttgatgtggacaaggcgcccaaggctctaggaagtttaacaacctgctcagcttcaaaacctgcaccagatccttaaacagggtgctgacagcaagaggacccagcctggtctcccctcccttggggggctcccatgggaaggctggggcagtgggaggcgggtcacccacagatagccatctcagttaccactgtcctttcggaaacctctctaatcgacccccgtcctttcacacctccccagtttcttcctgaccgaaaatgccccaacattgcctgacttagatcagaaaatgaccactggaccacatctggaactgtgggtaatgaagccctaggggatcccacctgggggcagcctgagcagttctcagccaacactgctcctcaaatcccctgcaggagctggttaaaaacataccgacatcacacaaactccacccctaccacttacaccacagtcaggggactccacagtcttgggggaaccctaggcagtgatatttcttcacagtcttcccaggagctctgatttgtagttgggttaagaagcacagagagccatgagatctggggatagaggcaggtgccctgctctcctgtagcctggagcctcccccaggaggcctggactgaggtggtccagagagctgcggcggaccccgaccccactcctctactcactgcctgcgggtttattattaattattctgggccacagtttcttcatctgctaaagcggatgatcaaattgcaaccgacctcaaaagcttctaatgaggcgctgaggctcagaccttaaccatcttacctgagccacttgtctcacgtggcgtccacgtccggcaccccctggcctcacacacagtcaccgcacagcagcactgctgttccggagctggactgagctcccaggacctgccgtcaccgcaggagagctccttccttacagtcttcctgcgtcccagccctgtgcacatccactgaataagagcctgaggaaaacccctccccaggtggcccaggacggtgaggtgctgaggctgggagcctgtggcaatttctacacatctgttttcagcttcctaaaaggttcgatgtattgctcttataatttttttaaatatcactaaagtatacttacagcatagtactcacaatcctcttatcctccttatttaaaaaaaaaagtttttaaatgttattcaagcaaagaaaaaggcagttcaagtcccacctcaccactgaagcttctcatcccatgtctgcagtgacagccatcactgtccacccaggctagcagggaacagacatgggcttgcggcataccccactcatactataaactacgcgtgtgccaagaccacggtctctcagtgtgtgcgctcagcacccgcctggtaagacacggctgtgctcaacaggcgctgcggatggaatgactaaaatgacaaagacagacgccaggttttaaggtcacccccttgactaccacacccctcagtcacgccctgggctgggcctttggaacaccctgagctgtggcctcctatctgctgccctttgagtttctgattagatggtttacaattatactggcagggttcatctgtccattcattcattcccgagtttatagcctaggagggagcagagagaagataaagccaaggaggcagtggaccctccagggtgaggagggagggaggcagtgtgtgtcgggctccagtgtagactgggccttgaccaaaacaggtaagcagaggctcaggagcaaagggtgggagtggggcggagggcaaagcgaagaattgtgttgacttcaactggactaagaattaagagagataaggggcctgtgtcggggagtggaaggcaagtgtgggtgggacgtgaaggagtaaccagcactcagtggagccctggggacattagatttggaggcatgcttctgctgaaattgctgaaattgctgaaattgcagggggcagcggcacacactggacacgaagacacttttatcaatggggttccgggagctgctcctcccagacctctaggtgtccactgttagtcaccagcacaaggtactggggacaatcctatagttccatcagatggccaggtccacattgtgcatcttccctgcatgaggtagggaagatgaaggtctgagggacagcaagccaaggtcacagacttccaggagccctcagcatggccccacgtctacgccgccatccacccctccacagtcctttctcatcagtgcatagctgctctgtgcagcaacacgcacaggagctaaagcctcccaacaaacctcagcccagaagaaaatggagaccactgcagttcaccagctcatgtgcatcgctgccaggtgccaaacccagatgcacatgcacagcgggctccagcattgtccccagccaccctggctctcattctccaactcctgacggagtctcactctgtcgcccaggctggagtgcagtggcgcgatctcagttcactgcaacctctgcctcccaggtgcagacgtttctcctgtgtcagtctcccaagtagctcggactacaggcatgcaccatcacacccggctaattttgtatttttagtagtgttgaggtttcaccatgttggtcaggctggcctcgaactcctgacctcaggtgatccaccctccttggcctcccaaagtgctgggattataggggtgagtcaccacccaccccgtccctccagctcctaaccttcacgtttttcttgcctgtgccaactttcccagtggcatacagcctgctgtaacacatcccatctttgaaaacacaaccctccttgaatgcctacccagccttcccatacctggcctgtctctctgctgttccccttataggaagccttcctcaaaggctgactatagtcactgccccttaccccaaggttcatgggctccagaatccatgttcaacccatctcactgcaactttccataagtcaccacctagccatagcctgtcagacccagtaagggacacctgtccctcattttattccaatcccagccgcatttgaacacaccatctcctgatgcattttcttccctggtcgctgtgaccccgtgccctacctcactggtcctgcctttgcctcctttggagggttttatccccttgggtacttctaagtttcagggtgcctgggctccgacctgcaggtcctccctgtgaatgcacccccaggccggctgtcacccttcccaccacctgtctgccggctgatggtcctgaccactccaagcttcttctcccctgacctgctgagtcctgagcaccacctgctcccaccttcactgggccatccccgaagcaccgctcacttcaaccctccaaataagaactcccagttttctccccaacatgtcctccctgctgctcggtctgcacaaatagcaccacttccccacacagtcaagtctcaaccttggggctccttctctttctcttacagcacacagccaatctgtcagcaagccctgcaaaataaagccccaaaaaggcccagttccccggtctccactcccaccatcctggtccacccaccactgaactgaccatctctgtgcatccacaggccaaccaaatggagcttcttaagacaggaatcaggacatgacaatgtagcacaaaaccctctccagcttttagaatctacacccttaaaaaataaataaatgaaagttcttttggccaggcgcggtggttcacacctgtaatcccagcactttgggaggccaaagtgggcaggtcacgaggtcaggagattgagaccatcctggccaacatggtgaaaccctgtctctactaaaaataccaaaaaaacttagccatgtgtggtggcgggtgcctgtaatcccagctactcgggaggctgaggcaggagaatcacttgaacccaggaggcggaggttgcagtgagctgagatcacgccactgcactccagcccggcaacagagggaaactccatctcaaaaaaaaaagttctcttcatgagcccacagaccaatgtgatctagcccctgcctgtctctggcctgctctccaacctcctcagccaggtgctgcctcaggacattgg

SEQ ID NO: 371 - DNA, 404091 bp, Homo sapiens
ttaaatattgatgagctatgtcaagtccattgaggactgaggcttgaccactgactttagcaatatggatgtcaccagcgcccagttgttttggtggaatggggaggacaacgcatccttggagtgggtttaagagagaaacaggaggggaattggaactagagtgcacttagacaacatttaaaagtatactgcgaaggagaataaagaaatgagttggtggctgataaaggaagcagggccaataaaacaatttaagatagtactttttatgccaattggaatgatccaggggaaaggaggacaaaacccatgatgtaggaaagagaggggcagattgcaggatgaccctgaagggaccagaaaggagaactgtgcacaagtggatggccagctttgatgggaacggtggatggttcactatggtaacagaaggaaaggcggcaggggcagatgctggtgggtggagaatgggatggagtctgagttcttttttgattgctacaattttctcagagaagttggaagctaggtcaccaaatggaagtgaggagttggggaagacgtactgaaagtctgaggaagaggagcagccatgaaagagaaacaaagaaaatgggagaatgaatggattggggacatgcagtagaattgccaggcatcattgaagacccacttaaaaaaggtgtatctggatgtgtgcatgcaattttaagtgaggtcagtcgtcacagttgtcatgttttgtttttgtatttttttttttttttgagacagagtttcgctctttttgcccaggctggaatgcagtgccgtgatctcagctcactgcaaactctgcctcctgggttcaagtgattctcctgtctcagcctcccgagtagctcggattacagggatgtgccaccacgcccggctaattttgtatttttagttgagacgaggtttctccatgttggtcaggctggtctccaactcccgacctcagatgatccacccgcctcggcctcccaaagtgctgggattacaggtgtgagccaccgcgcccgggcccttgtttttttttccttattccccccagcaattttcaggtgcaggagagggagagggtgggattgtgattgggtttcgcctggtgagcctgagtccacgggataagcaatagcatgattctaactgaaatggagtttgcacagatgcttaatgattgtctgttgaatgaataaatgatttaaggaaaagctgaaactttataaaaaagaaaaaacatgtgcatgggaataataagtgccatctcaatgtctgagaaattgcagaatgagtcagacgatgagggtcttcgtgctggctgctgttctgtgtgccctgtcagcctctgcctattcctctgtcctccttccgtggcctgtctacacgtttctattcatgaggaccttggagaattagattgtgtctgcctctatgggccttgttgagcctctctgtttctgtgaatgtcttcataatgtttgaataataatttactgagaaggtttatttttttcttacatatattttaaatattttaaatcatatacaccagtttttaaaaattctgatttataaacatacatgtaacctatttttacaaaatatagaaaaatgtagatagatttataatgaaaaagtttacctacaatatcatcattcaaagtcaaccatgttaaaaattaaatatattctcttccagtattggctattatttacataaatgtaatcaaaattacatatgcactgtatcctttatgctcttagtattagtctattataaatttctcacaaacattctttttactggatacataaaatcccatcttccacttctatagtaacttcggtgttaataatttaaggtaggccaggcacggtggctcacgcctgtaatctcagcacttttggaggccaaggtgggtagatcacctgaggtcaggaattcaagaccagcctggccaacatggtgaaacctcatctctaataaaaatacaaaaagttagccaggcatggtggcaagtacctcaggaggctgaggcaggagaattgcttgaacttgggaggtagaggttgcagtaagctgagatcgcgccactgaactccagcctgggaaacaacagcaaaacttcctctcaaaacaaagcaaaacaataatttaaggtaattctgtcattccgagtggtttagagaagggaagcaaactttccactctcttcttctttccctatctcctgtgcccacagtgaatgctccactttagcactatctgcagtcttccccatctgtgttcccatgtacttctgcctctttttcttcctcttcccatgtctctttgactcctggctcctttctctcatttgtctcctattcatttaccataatgtaagttctgtgagggcatccttataccctaatgtctgtcttacagtaggtactaaaatttgcatgtaaggacaatgatatgtcaacctggaatatcccatttaactggactgtggtttattgaaagttaacttctaatgaaatggccagggttagtttcctgccggggactgtggaactccatctacccagggaaactcatttttatctacattcttgcatccatagtcttacagagagcaaactcttcagtcataaatcttctacttagaaacctgaccagtagatgcagtattggtaaattttcaatgaggccataagaatgcatttacaaaaagtacaaagttaaggttgcttgtgatgattttagctaatcagcacaattttagcaggaagcagatacatctgtcctttccctcaaacttcatatagctataaaatattcaatttcctgaaggagttactcaacacacaaacttggagattaatttagaggccagatccccacaagcatttgtctagccttagactgaacaacttctgttgccgggagcttgccatgtctagtgggaatgggtctgttctgtagttgttggatggaaaaattgttagcagagtcttttttatgttaagatgaaaagtgcctcccacagagtcaacaaaaaggttctggtgtgtggaattttttaaggatgctaaagtatgaataattggaaactttagtaatttgaggcttctgtgatttctctaattctttgtagtcaatccatttatccgatcccctttaatgctaacattatttacttgattttagttctgtgaagctttggctcttataaatgacacatctaaccaagggaatggttaagccttagagcaacttgtggaaagttttcattcctcaaaacaggaatgaataacaatggcctcgatatgactaacattattaatgtatttatatgggtacataattactagcaatatctagagcattatgaaaatgatttgcatagccacttcttaaaatttagggcagggaggccgaggcgggcggatcacaaggtcaggagatcaagaccatcctggctaacacggtgaaaccccatctctactaaaaatacaaaaagttagccaggcatggtggcacgtgcctgtagtcccagctacttgggaggctgaggcaggagaatcacttgaacccggggggcggaggttgcagtgagccaagatcatgccactgcactccagcctgggcaacagagcaagactccgtctcaaaaaaagaaaaaaaaaatctctatcctatatctctcaagccttgaaaataatatattggcttcttcatgatttaatccagggcttcctcatgaaacttattgctcaatgccactggaatgcaaatattccaactgaccatgctgctcagttccttgcaatagaattgaataaaaacttggattaaaaggtcaactttaaaatatgcctaataaattcactgactaaaagctatcccaacaactttctgcatcatttctcttcatctcattattcatgtaggcttccctgaattttaaggaatgcaaataaaagagcagaatgtgtggagcactggggcctaggacattcttttcatgaatatggaactaaaggtagagtgaaaggtatttcttaaataaattacgttgatatggtggagagagtattgatggatgcttatgtattttctatagcacaaaaaagtaaaactcatatattattctaagaatcccttattttatgtccttcatatatttggtcccatagctataatattgggagcctcattacttcaaaatgattatttttaaaatttcctaacctatgatactaaaattattggggttattcagcaagttgtcgtgggacaaagcatgggaatttctataagggagaggtgagcagaatgtcataatattacataaaaagctttctcatgcattctacaaatagttgctgagtaaccacgtgttaataaaaaaagtgatataaaggtaacacttttggaaggaatgagatcatgtccttttcagggacctggatggagctggaagccatcatcctcagcaaactaacataggaatagaaaaccaaacactgcatgttctctctcataagtgggagttaacagtgagaacacatggacacagggaggggaacatcacacaccagggcctgctgggggttggtgggcaatgggagggagaccattagggcaattacctaatgcatacagggcttaaagcctagatgacaggttgatgggtgcagcaaaccaccatggcacatgtatacctatgtaacaaacctgcacgttctgcacgtgtatcccaaaacttaaaaaaaaaagaataactataaaataagaattctaactcaaaaacaaacaaaaaagaattattatgaaataaagaagaattctaactcaaaaacaaaacaaaagataactttttcgggaggctgaggcaggcagatcgcttgaacttaggagttcaggaccagcctgggcaacatggagagaccccatctctacaaaaaaaaaaaaaaaaaaaattagccaggcatggaggctcatgcctgtagtcccagctacttgggagactgaggcatgagaatcatttgaacccaggagatggatgttgcagtgagctgagatcgcaccaccgcactccagcctgggtgacagtgagaccactgtataaaaaaaaaaaaaaagagcccataatcccagcactttgggaggctgaggcaggcggatcacctgaggtcagcagttcgagatcagcctggccaacatggtgaaaccctgtctctactaaggatacaaaaattagctgggtgtgctgccaggtgcctgtaatcccagctactcgggaggctgaggcaggagaatctcttgaaccctggaggtggaggctgcagtgagctgagatcgcaccactgcactgcagcctgggggacaagagcatctgagactttgtctcaaaaaaaaaaaaaaaaaaaagaaagaaaagaaaaagagaaagaaaaaaaacattagctgggcatggtgccaggtgcctgtaatcccagctactcggaaggctgaggcaggagaatcgcttgaatctgggaggcacaggttgcgttgagccgagatcccgccactgcactccagcctgggcaacaagagtgagactctgtctcaaaacaaaacaaaacaaaacaaaaaagcactgaatccaaatcacaaataatgagatttagcatagggaattcagttgcagacagcatagcgtttattttttatggttttagactcctcaggctaatttcatatgcatgttaaaggtttaatttgtagaataagtaaatttaaacacaagtaaaatattagaattgaatgccaaggtctcatagtatttgaaaatcacatgtactcttgtctggaatccacctcaactcttgacagccatggtcatgtcttgaacttccaaatcgagaaaccactccagctacaagatttctaactgaaaattttctcttaaccttttacttcttctatttttcctgttaaatgaggtcaattaaacatgctcttcacttgctgggcgtggtggcacatggctgtaatcctagttacttgggagactgaggcaagagcatcccttgagtccaggagtttgaatccaattggggcaacacaggaagaacccgtatattaaaaaaataaaaaaataaatgtcttcatatttactttgactttgactcttttagcttacactaatattctaagcctatgatgattacttgtctcatggctttcatgttcccatgaacatgctagccattttgagcaactgaaaattgcttggccttttgattttcctttgttactagctgaatgttttgccctggccttggccttggaacatcactttcttcttcagatatgtgaacaaggacggatacaaccagatctaaccagactaggtttaggatatgtatctttcagattgaggaacccactcaagggcaacattaacatacagaggcttcttgacttatgatgtggttacatcccaataaacccatcataagttgaaaatatcataaggcaaaaatgcgcttagtacagctaacctaccaaacatcatagcttagcctagcctaccttgaacatgctcagaacacttacattatcctacagttgggcaaaatcatctaaccccaaacctatcataataaagttattttaaagaattttacatcaaaagtcaaaattcgaagtaaggtttctactgaattctagcttttacactactgtaaagttggaaaatcctaagtcacaccattgtgagtcagggactgtctgtatctactttaaatcttggttagttagggaacaaggaaagaaaagaacaatagttgtcagggactagagaagcggtacagtatgttccctcagcacggatacaagcagggacttcggttactgcactagtggtgctgcacaaatattactgctcacttgctacagacaaggccctactctaggaataggacatacagcagatgacagtcaaggacctcaaggggttcatattctagtagaaggttcatactgtttaatggttaacaaaattatgccattcagataaaactgctcaattcttgcataattttattctcatcatttcccatgtttattgttcaaaaatacaatgggctattaaatattcactattctttaggttttaaaaatataagggttatggtatgatttgccatcctacatttatcagttcctttgactattagttaaaaacacttttctacctctggactctgtatacatctcagatttcttggttctcgggcaccagctatgggtccattgtgagaaatttcctacttttcaactgtgagcgctctcggggccttgcttacatttttcaagttatctgcagggatggaattagtttttatttgttgtgtacaaagtccttgctttcggtggtagaatgaaatacttagagaacagtccatggatctatttacttcccatgacctgtgaagaggagtgatgttgccaggacctctttcctgggttgtacccagagctgttttctgcacgctctgagcctccagggatgccatcccaatggaggctaattgatcaaggctgcctggagaattgttttgagatagattctgaggcttaggctggggatcatcagaaaagaaaattatgattgataagtgaaatctgctgtgggcaaggaagggtaaacttgtactttacatgccaggaattttcgaatctgtatgtgactcccaagaaaggcttgaccttgtagcttcgattttaatctccgcaggtataaggataattcattttatgttgaatagactgctctaaagacaatttaaataatctaatacccctgcccatttcctaagagagttgtgttgactgttttattcccaaataggatcaaattcaacctgctgtcattggtagatcattcttcttaacacacatgtaagaataaaaactattattagtttggtgataaaggcagtgaaacaaacaccgagaataggagtagaaaaatgttctgtgtgaccttggttaaattatgaggcaaataagttgaaatatctccagatacattctcgctcaaatatgccagttttcaataatttattgaaatcatataaattctgaaacagatttttaaaatactttaataatgggatatcttaattatttgatgggaagtattttttaaaattacactcctattgtcctaaatttatgaaaaaaaatgaatgttcaatgcagaacacttgcataaatacacacactttttaaaaaaggtacctttatgcattttgctctgcccttaggcactctttttccaatctagaatatatttctggatgtttttcaattgacaataaaattactggagtacacgcatgttttattgtgtttgtgtgtgtctatggactggatcacaaggtataccagatgtatttctagtgggccatggtaaatatagtctgaaagtcaccattctgaccatacccctctcaaaatcacagagccttggagaagagaagaacagtttcttgctgcgtactgacttggcacataccatcagtcgcaatcaggccagatctatgtgctgctttattttcacagttcaagtaaagctgtggaaaaagtctgagcagcagtagtaggcaaggtctgtgccacacacggaagcagaacgcaaaatgcattccacacacatagaagtgtgacacaaaagtttgagcatttacctgtatgaatgccccagtctgtgtccaccgcttctttgctctgagtgatgctcacccatgcccccctagtcccaattccttgaaccacacatataacttattacatgtcatggtcatgtgtgactccaaccaggttgcaatagctgcagtgattttcagattttccctgctttctaaagagaagtgagatcatagcatgttttcactaatcagtgatttaggtagacagatgacatttgggggtgacaataactagatttataaatgctacaaatccgacccatagaaataagaaagtgactggagtcagaaggtcaaggagcacctgtcactttcccagcagggcccaacctgcagtctcttttatggctacaagctggaggtcaggatctgaactgaacaggagtaagagaagagggacttcccaggggggctcagatagttcactgggtgtacctgagatctcactatctgcagacttgtattgttataaaaataagtgaatacttaactgccacggtgggatagcacataaagagaaaaacatacttaggtagttttaaggaatgggaaggggtgaaatatagtcatcccctgatatctgcaaggactggttccaggacaacttctccaacccccaacctgcagataccaaaatctgtggatggtatacttaagtccctgatataaaatgatgtggtatttgcatataacctatgtacatcctcccgtatatgttacatcatctttagattacttaaaatccccaatacaatataaatgctaagtaaacagttgttgtactgtatcgtttaggaaataatgacaagaaaaatgtctgtctgtgttcagtacagatgcaaccattcttttctttacaaatattttcaatccatgattgattgactgaatgtatggatgtggaacccactgatacagagggctgactgtaataaaaccagcacctagcgctgtatgaaaggttagcactccccttgacaagaatggaagaggccctcgggcctgacaacacacatatggttaaaactagcacctaactcctcagtagcctggcaggaactgggaatggtggcctatgttttaagagaaccccttctgtgggcccccaatggctacagcctgatactcaggtgatggtgtgagataagcctcagtgcttttttttatcccctgtcccccaatatttactaagcttcaggaaactatattcttttttgataagtatccatttattaacactggtaacattttcagggcacacagaacatgcattctttggtagcaaaattttaaaatcacagatatatttcttttatatattatgaatatatttctagtaaggaatatataactagtcttcagaaactgaagatggaaacatagctaagcctcaacttccggtcaagcagaaagtaatgaaaagtgccgaaaatgccacagtcacatgggccactgctccttaaatgccacaatcacgcgggccactgctcctttcattctctacagacaacctgagtctcacactgtcatagcaccaagaagaaaacagttactttcacttttcttatagcaacatagggatttgtgtacataaaacatgttggacaggttctccttcaatcatggtttgtatgtcaacagttggtttcataaaacagagaaaggtggaaagaagatagaagatggtctctttacaaaagaaaggtgaatacatttcgatgcaccaggttgtttaggctaagtcagtaactgtgtgtattatcagccctatgactgctaagtgtcaatatttagaatttcagtgtgggaaagaacctcagacaccatcagtccaaccgcttccattttacagctaaggaaaagggtccggaaacttaggtgaatatcagactgggatgagaacgcaggctttggagttaggctccttagtatatgaagttcatgtatccccatagacaaactcattttctggtaatatgaatacacttctggatgaaccaacagtttttcagtctaaggtatgtcagaaacgaattcaatttttatgcttaagtttcctctgcacagctttctccatttaggttgtgatgatgatgcagactgttaccccctctagacttttgcattcttacttttgaatttgggggttaatgtgtgagtagggctccacgaatcatcatttatctttcacatcatttctctttccacctattgctaactacctatttttaaatttaacaattaggtcaatgattcttgatttatttaagacaataccaaagacagtaataaggtcagagtgacctggtgcacttctaacaccccaatctgaaaggaattttttttcagtataagataatatatatcatatacagaaaactaatactaaaaggtactcagaggtagcccttgttgttagacatttaaggatgttctagactccaagaggaacctcaacagttttctctgattcaaattaaaaacaattttctaggataaatggaatgattaataatgtaagaagaataatcagtactgaattgtatagtggaatgattcccattaggttccaaccgaatataatagagcttatttgctttcttagcatgtatctttcccactactataaaattgagatctgtcatttataatgttacctgtattatctaaacactaacatctttaaacccagtgggcttcccctagagaggtttagattcttgcaaacccaggtgaatcgttcttgttgagcaatgaactgttgagaaatgagataaggcagaggcacacttatggatgccagtcaacaggttagcttttgatggccatggtccagaggagtgggtggtcagtttccacagtcacaacaccagacccgtcgtaggtattggaagtactgaccaatgttccaaaagcaagcacatcatttgctgtaagaaaataagggaaaaaaattagtaactattttttttcttcctccagtgtagattaactttgtcacttaccaaaaagcaagtacacactttgataaaaatatatataaatgtgggataggtgaaatatatgatgtatggctttaaaatgggtaagttctataacttgctgtaaacattcttcctggaattggttattgaccattttgggttatatatcattctcaatattaaattttattagaatcttttctttttctttactaattataaaaccaaaacctgtatttgtaatgtgctacttacttccttccctgggtacaattttagtttctcttgataattcagaattaaaatttaatatgttattacactctacagaatgtagttttagcttcaagtagaaatgatatgagacagatagaaaattacctaaaaaaatgcatgtgattttggttactgttttctcataaagtaagaaaagccaaagtgaatacagcttacattctgtaaaattaatagaaactcaaaggtcaaagccgactttcaaatgtgtaatcttgagcaagtcacttaagctcagccataaagtgaaggcaagagatgataagataatcctttaaactacttatcaaagtaaaaggcttatgaattaagattagaattcatatatttatacatttcataaatatatagctataaatatattttttattttctaacaagttaatgcctaagcacagattggtaacgtcaacctctctttgctgatacaggagcaattcacttcatcaacatgactctaaactcacagctgtcctataagcatcccttggtaaccaatattattttctttaccaaaattcagagagaaaaatgaacaaatgttatggagcccaaactatcagagtcagaagaggccccttttccttcaaacaacacctatgaagttatacacactgctttgggggaaatcaatcaattacaatgctcacttcccactagagggagcctcctatctttctgaggaaatcttgaaaaggcaatttaaaaattcaggaacagtactgcaagataatctattgtcagtattaccagttcacacagcttatttattaaaactcaaattatttttcatagttctttatgtttttactagtgcaaacacaaaagtaaaactacacagtaatacagagtgaatctcatgtgaatattgccctgatacgaacttcaatataggaagctcttaactcttgagtcatttgggacttgggacttctgtgagatgatgtttctgaacactggtgatatacacaaaaatatgtatcgatctagacactgttacatagttggtagatcagggtggtgatctttgagggattcacagcaaagtcaattgaaatctctacctctcctgaatagtggtcttgcctggaacctgggtgcttaccaagtagcttactgagacctatcccaggcctacggtttcaaggttttcccaatagccaagagggaggcaatcagggagcacttcacaccacttcattgcgaaggcaatttagagtgcttcagcaggcctgccaactttaaagtggaaactccctcgtgaagacccatgcatgcacaaccgacttggatttgacacacacattatatgattcgagaaaatggattaaaatcctagtttttacttaggcccaaagaacaggagtacaaaattgtgcttcaagtttatagctgcatataaattcctttctgatttttgaagccagactatggatttcagaatttcaggggtaaatacctggattatacatactgggtttggaagacactgttgtagcctaattaattttcaaatgggaaaataatcaaagtggtttatttgggcataagaagatgaaatttttttttggaaggaaatatttctttgagttaagcaaggccactgttagccatacttgtaaattatgtttttattttattttataatatttaaagttccaacaagaccagttatatagttacaattaattaaagataacaattggttttgattatctctaactttatggaaagtacaataaaaatgatagaaaactaagatgaataagttgagagacaaagtcatgaattttaatttactatgtcattacaattattttggaatatattttcttcaagtcacagaatcatatttttggacaaaaccttagaaaaataaaaaaattttaaggaaaatatttggaattatgatgaacttcctctaccccaaatatctgaaggccaatcatgacataagtacatgaaactagtaaagagacagctgtgtacagatagtagaaaaacaaattacctcttcgtttctaccctagaggatttgtccaacactttagctggctgaattatagaaaatctgacttggatttttccccccattgtttgcagagtagactacagccaaccgtagttgctcaaagacaaccagtcatcagatcaagacccgtttttaacaaaaggcaaaaataaaagttacagatctatgtgcaagcttataagcaacgatattttgtgtgataaacacattaacatagattttacaattttcatccattatctcaggctgttttatttcccaaaggtaaggacgagaattagcactccgtgttctattgttttcagtgatgtcctcccagcttttctctaaagctggaaaaacaggggactacaaagcaagagctggcaaatcggtggaaaccaattattcaactcttttcagttagtggggccatttgtccctggtttcttgcccatctttcctccacaagctacattagtgaactgtggctccttggttggagctggaagcatgaaggagtactctgcaaggccttggatgcttttggcactgaaaagcaacagtgggaggcattcattctctgtgtacctgcatgacttttctgatcaggtgcttttatagaaaaggcatctctctatcaaagagcatgactccatcatgatgaagttaataagttagatctaggttcaaaccctggctctaccattcaccagctttacaaactcagttatttaaactctttggccttgtgtcatcaacagtaaatatgtagaaagtatctacttcacagggaagttgtatggattatgtggccaatcttacatatgatacatattcaagtaatttccatcttctttgctttctcctgttatcctgctgataaaacagatcaggtttttcttttaaaattaacaaaaagagagatgtcatgagctgaacaattagcaaaggcctgaattcaagtgattagtttatagccagctgagaagtagaatgaggtacactcgtaacttttccaggctagcttttgtgaaatacttaacatcatttcaggtgattccttggcctgcatgtatgtatgcatttatttaatagatattaaagcctcattctgtgccaggcactagggtttaaggatgagtatctctgccctcactaaaatgaggactcacattttagtaaaagggaaagatatacaatcaaacccagcagacaggagagaagcatgaggtgggccaaggagggcagaggtgccttcctggcagccaagatgggttgtgtattcaagagggaggtgaagcctttgacagtggggggctactggcatccctagaggcctgcccgctggcctggcttcccaagaatctgtagatcgacgctggttcttttgtaaaaataaatacattatttaaaaaggcaatggaaacatttctaaaatcaataaatcctgagggcaaaatggaggtgctatttgagatgggcataatccttattcattcaagacgtgatctgagtccttacagtacaccagccactcaaggcatagccaggttttatcttccatttagagatgaggaaaatgaagctcagagaggctaaaatcacaggctatgatgataataaaagttgtcagacactaacaagttagtaagggaggttaaggcgatgctttgaagagctctaaagaagagaactgttgctggtctgttctcctgaagtacagagctgtcttttggcagcctgatggagacttaaggagatgcattagtgagagcctaaaaatcactctaagacttaatgaatactttacatctcatatagacaaatgcttaatgaacccattatgatgaatcttaaggctccctaccattctggaacattaggttaagttcggagagttaagttagacatattagacatcactaactatttaaaacataatgggaccactgtctacactcaccatttactctctgaggattcttagcctatgtggagaaatggcaacacattaagaaaatatgactcagatttcattaccaggaaaagaaaactatactgtctgtaacatcagttcactattataggtctttacaattttaatttttgacaaatatattttttaaaaaaaggtcttttatgtacacacatgaggcaaaagattatattttaaaaattgccaatttatactgtaaaatatgaattctgggaagggttattagtgaatttgtttcttataaaatggcatttatacttatggttgctcttgaaaattttcaaaaataaaatcaatatgttgtgttttcactttcttgaagtaaaaaactcaaagtagtcctaatgtaaagctgtggagtacatgtcttttgtgtacttatatttctattagaatcttagaaaatacaagtttgagaccatctataaaataaatatatttatttatctcagcactgccaaataaaaataagtgatcacaaatctaaattttctaatagccaccttaaaaaagtaaaaataggaaaaatgttaatatcttttttatttagcccaatatatccaaaatcattttaacataatcaatatataaaatttggggtcttttacattcctttttcatactaagtctctgaaatccatttacagcatgtcttaacttggacaaggctcattttaagtattcagtggccatacgtagctagtggttactatatagattgaacagtgcagttctaggttgttgaagcaggaactatatttatgattcaattatctgcttttttcagaagaacattattttttggtttgattatatagatagtaattttcatttcatatgtagctatgcggtcacagagtccgaggttataaagagaacattaaattcaaagtgtgcatatacaatcattttgagtgatttgaacttacgatgtgagtggatcaacaaacacttaaatacttaacatgtgttcagcagcaagacagactcagtcctctgcccttcaacttgaaggctgagaactatctagcaggaactgtagaaaggacaaccaaaaatccaaaatccaagcaaacctaatgtgaaattaccaagagaatatatactacattctataaggtatagaataaataaatgcctgcttggacatgtggcaaataatcttccttttttttgaaggggggagggagttatttatttttattttattttatttattcatttatttccataggtttttggggaacaggtggtgtttggttacatgagtaagttctttagtagtgatctgtgagattttggtgtacccaacacccaaacagtgtacactgtacccaatttgaagtcttttatccctcactcacctcccaccctttcccccaagaccctcaagtccccaaagtccactgtatcattcttatgcatttgtatcctcatagtgtggctcccacttataagtgagaacatatgatgttcggttttccatttctgagttacttcacttagaataatgatctccaattccactattgggtatctactcagaggaaaagaagtcattatacaaaaaagatacttacaatcttctaattgtacctgcaaataatcttctaatttttcttctaataattgcaaataatcttctaattgtactcttttctcccaattattaccttctcttcccactcctctaacacttgtgaaagaataactggaggaccctaattgcctataatgaaatgttcaaaacaaacacattccctcttcccggcccaaacatcctggcatggcacttaaggccctttgttatctggctacttcctacctgcttgccagccactctctgctacttgctgttccttgaatagatcaggaatttcctgcttctacgaaaatttttgacgtgttccctccgagaacaaattgacttttctctgcatattttatccttcaagtctaaactcaatgtcacttgctaccctgtaccgctctttgattctccaactgctacaggacaaattaaaaattctcttttctatttacaaaggacttgattgcttccctggaacacactttgtatttaaagctgactgtttagatgcctcgtctcaagcaggcaaagtacagagtgagcttgaaacatcttgctccagaaagcaagagggtgctcaaaaacagatgtagacctgtgaaaaggacacaacgactggaactaatttggggcattagaaaagaatcctgagagagagaggcattataatatattgaataatgaattgccaaaagcaggtggagagaagaaaacctattatttacagaagaatgccaactactaaaggaaggaatggcagaattagagaattagaaaggcaccatttgcagccaccagtgtaataactagtttaggcaagaaccatcaatggatggatgcttaaactactggataaaatgtggagaagaaggatagcacccagttccaaagcagtactccacgtattgcttttaacttcaaaggaaaaaaaggtagcagagtgatctcatgagtccgatcttagctaaatgatcaaccttagcatcaccaataaaaggccatactgatatcatgtgcctcctgctatgatgctagggatgaatacaatatcacccattaatacttttggccaaaaatgcctgacctgaattgaatcatggggaaaccgtagacaaatgcagaatgggggcagatgacaggttagtgggcctgaactcttaaaagctgtcagtgtcatgaaagaccaaaaaagtgaagggacttttctagattaaaacagactaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaacagactaaacagatatgacaactaaatacaatgcatgtttttttagtagactccagattttagaaagttataaagagcactactgggacacttggggagtaagcatatggactgtacactattattccatcaatgttacattttgggggtagatattagcactgtagttatgcaagagaatgacctcgttcctaggagatacaagctgaggaatttcaggtgtttattattatcatgccttcaacttattttcaaatagttcagaatgtaatgcacatacactcatactcacatattatattgtttggagatttgtccctgcccaaatctcatgttgaattgtaatctctgatgctggaggaagggcctggtgggaggtgtttgggttatgagggtggatccctcgtggcttggtgctgtctttgagatagtgagttctctcaagatctggtcatttaaaagtgcatggcaccttccccacaatctctctcttgctcctgatttccctgtggtgagtgcctgcttctgccttgccttctgccatgggtaaaagcttcccgaggccttcccagaagcagatgctgacatgatgcttcctgtaccgcctgcagaaccataagcccaattcaacctcttttctttgtaaattacccagcctcagcaatgcaagaatggcctagtacacatacaaagaaataaatgcaaatgtagaaaaaaaatgttagcacttggtgaatctcagtgaaaggtatacagattttgctgtactgtcccttcagtttttttgtaggtttgaagttattcaacattaaaattccacaatacaatttggggaaaaaatttgggaagaaaggctagcaacttaggaagggaagtgtttccctcttggttcacctttggtttccctgaaagctgaagtaatgccattgcaaagcattaagaaatgtttattgatttaacgtgcatcaaaataaatccaagttgaaaaaaagtgtgccaaatttaggaagaaattatctagtctatgatatatctgcattgcagcttcttggaaaagtatagagagagatgctgagcacacagactgtgtgtggtgaggccccttcctttgtcaactcattgaagctcaccaaggacagcctttacttccactcattgatgcaggaggccctggaaattaacttgcagtgtctaccagaacttcttagtgcttgtgaaaatggtaagagcaagacttattgttatgcatgtctctgataacaagccatcagctgtgctttctttttgagccttatctctcaaaaccctgatctactaagactcttcccaaggtgaacactcatcacctccctctcctgacaactaatccttccttgaactcaaatgtccaaggaagggctattataattctatttgaaactggctgcatttatcttcttctctctcagaagtcacatttcccttgcccttggatgaggactggaatgcattagaaggcttctgatgttcaattattcttccttctccacattttctgtgttatgactcggcctgttgatcgaaaaacaattaggccaggaaaatgctgctgcttggaggaatcaaaactaattatgccagttagaaaatgtttacaaagatcatcagtttcaaacatttagccctttctaaaataaacaaaatcgttatttttatttgttaaagagaattccctaatgtattatgtcatcagcatgttctactcataaaaggccccatgttccagttaaagagccaatcagagctgctttaagaaaaaagaaaagcttactgggcttataaaataagaaccacagtccaaatccacaaaatgtgacctttttgcattaattattagtggtaaagtgaatgaactgtgtagaactctgtgaaaattttcagtgtggaaaatcagtatcagatttaaacgtttgttcaaagagaaaggctgtccacaggctgttctgaactgatttattttgctctgttgccttcaaatcctgtgtcttggtgttgcctcctgtggacactggcctgccccaaaaccatcccacaggggtgagaattatgacctgcagatgccaaagatgactgagtcgcagccatcctaatctcttgctgcccggctgtagagcaaggcaagtcattttgtactgctgggcctcagtgccatccctgaaaacagagagttgatcttttcactgtaatattttatgacttttgttaaaagtccctcaggtgacctcagcatccatttgtaaaatgccaataatacttgtccccagttacctctaatactgctatcgtgaagatgaatgagttaatgtctgtgaagagctttgacttctccagaaaagtgttgaaaatgtgttgtattattatcatcatttcatctgcactgaggaagctttaaagtggcatttgcttctatccttcaaatgtcaacagagattattacaggtacatcaaacaaacagaaatgtcatagaaaagtgaaaaaagagaggaacatgtgcagtagcatggtatgattacttaacatcaatctcaaacctgcaggtggtatttatacaaataagctaaagagacataatccaggcccttttagaatttaccagtcaagagggtctctgtgaatctgctgtgattctgggggctgccggatttgcaaatcgttcactgctcaattgaactcttttaaatttaattcggctgaagtttttcttttatcagatggtgtcagaagtgggatccaaaatggagcttctagcatcccccagcagtgctgagtgaatatgcaaggtacctgcaggacccacttgtgtccactcatctcttagagctgctggggatcatgggtaagctccttcttggatttcggagctccgctgatctctcacagccactggggatcatgggtaagctccctcttggatttccgagctccactgatctctcacagccactggggatcatggttaagctccctcttggatttcccagctccacagatttgtgttttgagctctctgagtttctttgagcaaatttctgatccaaactgggtttggagttgtgacagaaactggactgggtacaggaatggatttgatctgggaattaactggcttggatccagttagaagcctcttacatctgactgggtcagaaaggaactggtagtaagcagtaatattgcaggagttataaaatttggcttttgaaaaatcagatttttgtgttatacccctttgtttcatttttcttacacttgggtaggaaaaaaaaatcactggctaagttaatcaagagaagctgagcgtaaggccaatattttaggtaaaaatgggatccttagtttctggaaaactgagttctttctggcttacacttcaggcctgggaggcagcgaagtcttacagaaacagcaaaatgttactaaagataacacagtggaatgttccgaatgaacaacaatgcatttgaagtacatttttaaaatgagggctctaagtaaagtcccttttgtctaagaatgggtttggcactacagcatgtcaactgctattctctttggaataatctgccttgcactctttgctgacaactgtgggtgacaggattaggcatgtacaggatcgtgggacatggggagctttttcctccctaaaaggggaaacttgagagatgatgggcctgctggaaaagatcccttcgctacctagaagcagccgcctgaacttttttttcagtgtcgctgcaatgggtgggtctttctctggcctcccagatcatttcaccttccccaccctgcctcaggcaatgcttttctctttctcctttctctttcttatcttttctattactcagggcaaccatcttgcccagagaccacaggttgaaactcctggttggaggttggattaatgatgatggagcccaaccaggtgcaaatttgagccttgccagtttgatactgggtgctaatcagagcagctaatgtctatgtttttgtcacatgtattttactctggccagaacagaaaaagataattttcttttctgatgtggctttgccccagcgcgatggtgtggcaagctcagtcatggaggccgctcaggcaaagagaacccagaagcctggcatgccggcaaaagggtaagaatttcttaccagtcagacttctggcttctctctttctgtgcaaatggttgactgaatggtaaaaatcactgtttatctccatcttgttttatgtccttgggagcttgaccttgttaccacgtggcagtactttctcttggtctcctccttccagggaacaggaattttagggtttatgtcataattagctctaaaaattatcttgagtagttaaaagcctgtgtaagctcacaattaactattctagatgctttctgggaagaacagtgaagactgccctatgctgtagctcagttgctaaggctttgccctttcttactggtggtctggtttcgattccctgcttgtgaaataaaagccttttcatttaatttctgcatgaccttgtctagtctcttctccttcatgtactatcttaaattttcctttcgctgagcacctgggaggttacctttggtaaagttcaaaagccggaaatatcggagtgaaggttaggtactattagaagtcaattttccatttatttgtgcttgggaagatctagtcaaattaaccagatgactgaatccttgaatttacagaaagcccttgaagttctgaaagatttgccatgtaaatccctctaagattctggctcaatcttgatcaattcagccagaccaactggtccactcaggccacctcttgctggtgaaattcccgctcctctcacaaaggcatcttccctgctgcctgtgtccctacgcggtgccctgctttcctctttggctccactgcccactcgagattccctgttacagtgagtacctgccactctagctcctccagatctcctgccaccctcctgcaccagcccctccccgacccctgctttaccctacgagggccaccggcatgacttgacctctgctcctttaataatagatggttctttcttatatctcagcctgaaactgtgacagtcccgaaaatgaaatctcagtggtcatggtggcttttcattgtcttgtggaaaaatatttacaacacagaaataggggatgagtgtttaccatcaagcagaatccattcaatcatatggctgtttttagaatagaatttcatttagtgagagtctgaccgctgccttttggggaaaacatcatttgatttaagttcagatggtctaatattaacagatatgatttgttatagcaaaggtaatgaagcaatgtcttagactttgtccataaacctataaatatacaagcttgctcctaatatatttcatcatgacctattttcatttttaatttccccttgctgatatacaataacattatttcaatttaggaatagctgtcatcttcttatatgaatattctaacaagtctgaaaatattagccattcttagaaacaagctactttaattcacaattaatatattctctttctcgttctcgttataataatcaattttttaatactcataccatggactttttcctgatgacaggctgaacttctctttttttgatgaaccttctttgcattaactatctgcatgcaaagttgcatattatcccagcctcaaatttataaccttctacttagcattttactatatcattgtggagtgctgacatgtgtaacactatcttacacattaaatgttcaagtatttttttctaccaattagattataagctccttgtgggcagaaatatgacttggtctaacttcctttattatagaatgtctaatctgcaagaaaccttatctattatttagttcagtggtttaatacagataaaagtgaggctgctcctactttaaccaatttaaagtgctaggctcaaagttctcttcacttgactttacctcataaccaaaccaagttggccttagggaactggctaggtcttcagtgcttcagagaatgtatttaaagagccactgatataatatccaaacactttatttcaagacagggaaacgaattaaagataccttattgacctaggatgcccagcactgaaattcaagtctgttgacttgtagctcagtgtattctctcttataacaaaatcaaactatgggccagccacagtgcctcctgtctataatcctagcactttggaggctgaggtgggaggatcacttgaggccgggagtttgaggccagcctggcaacatagtgagaccccatctctatatatataaaaaaataataaattttaaaaacccaaagtcaaattacgggctttaacaaattggttggctcctcagaagtatttttggattagctaagcaaagttaaatgattaaaactacatactgaatatctgaattgcttgaacatgtggctatgttacctattttttcctaaagcttagtgattcatgtagattgactaaagtcacaggcttcaagccggtggcaaaatggattcagaagtttctcatccttgatttttgtgtaagctacagaccacaggacacaatgtacttaactgaaacactctgtactgcattttcttatttagaaaatgcaccaattccatttataaaccactatctatagaagtgtttcttttgttgtgtcagccattatttaattaagtagtattaacagtctagacaaggaggaatgaggaaatggtcacacaggcttagctgctaagacatggttcaatatttggcttttagtaaaaacattttgctgtatctgtagtaaacacattagataaaaattaaaggtgaaatttcagttaatccactttcactgctgatatggcaagattattagaagaaaggctaactacagagcctttatttatgatttaggaaaatagacctatattgttagagaagaaaaaaattcacttgttataaatggctgtatttgcaactgaaagaatatcaatatatcagacatcaattacaccaaagataagatgattacaaaccttctatgtagaaaaaacattcattttgaagtatttggagacagggatggagagtggcaattttgtttttgtactaaaaaaatcattcctcaaaagctgagttatgaagtttgtacaaactaagattatattatatcaaagctgcaggttaggaagtcatatttacttggtatgtatagacaaatttacaactctaatcaatttggtagaaagtctactaaaattgaactaattttttaaaaagcctgtcaaatcacaactagtatgtatgtgtagaaatggcctgagatagcttttctgtattcttaattaagaaataaacaatcccatatattccttgcaagtatctagcctggaaggcatgaaagaaccctggctcctccctgttcctttgatgccatcagtggtatctagttgttgggggtttcggggcaacctctgattcagacccttgtggcaccttgttgatgaccaggatcttacctactcattgtggtccaatcaatattgggtggaaccctcttgatggctaccattttgacctctcacctttcttcttaatccatgacactctttgcaaaaagcaatctaggaaagcagatatcctcccccttattcttcctaaaacatcagcgccatcggagaaatgtgatgaataattaccaatatgcctttttagtgttgtgcctgctgagtgttggtgaacctcttcctccagagatgatggacatagttgtgatgtctcactgttctatactttgcttggaggtaactacagactggcctctacttgggcacttgaggccatctgatgtgtctggagtaacagctgcctctgatcttaggcttggggcagcttcacttatgagtactggctgtgagcctctgaggcttcattctgttagtgctggggtatctcattttccactcattgatggagtggcagtgatgtgtgtctcctcttctctgagtcaaagaggcatctcctacaggacatgctgcaggcctgtggattggtgctgaggtgttgtaggtatttttgttctaagcattaacaggactgacactatctattttggcccttattccatagaggtcttttccttccaaagaaatccaaaggcatacacaacctatcccatatttcatttccctgttgagggatgaagaaatcatctcagcagattgtttctttccttctcatctaagagatatgtttatatgtgtacatggcaacagggatgaggaacctccagattcttggcatgatttcaggcatctggacacagccctgcctctggtatagggcctgctgtactttcttccttgtatcctcccaggcacttcactggagagtgactgatctcttcttgagtcaagatttaaatatacttcaacatactaatgacttttatttactagatttgccatttaagcagtctttatcttctgctgttgccctagtatttataatatctgaatcaaagaggaatagattcttgaaaaactgtgccacacactctagcctgggtgacagaatgagactccatctcaaacaaaacaaaacaaacaaaaaactgtgctacaaattcagactgcttttttaaacagtagtcttatatgggtcttttaatgtgcaatgcaagaatagtgctgtgttttagcatgagatgacgttgcttatataaatgattttatatctcacgaaaaaaatctataaaatcaaagtaaaaagttatctttactcttttaaaaaagaggctcatatattaaacatattgaaccttattagacagatatctaccaggcttagtgatgtaagctcatgactctcaaatgcaaaactttaaggcaccactgaattaatatactggcacattctgcaggcaaaagcattaaatttttaacagtacaattgactgtatgtggttcaaccttcaaacatgttgcttgtgaataattgcaaaagatacactctggtatgtgatatgtgttactcatttctaaaatgcaaagatagaaggatctactttctgttttgatttagccacaaatccagtgtacaaagaatttactcagcctggaaaatagttaagaggataataagaaaatagaaaagtaacagactaacttcaggcctaggttcctccagtatagctaatttatgacatttgaggcttaagagatgataataattaccatgagaaagaaaaatattacattttaaaatcctgtctcattttcaaagactacagaaaatttctacttggtgctttaattgccattttaggatgcttgaaatctctgtccctttctactccctggaaatgttttaacactttgtaaatacgatgaaaaaggccaagtttctataatctacaaagacattcaaatgctttattatgtacaagagtaattcttaagagtagggagttgtatatatagtttgaaaaaaaatcctaaaattataattgtgttactttctaagtacgaaatttattgtgaacattctgatattacgtgtgatcttacgtttagtaaaaaagaaaaaaaagattcatgggtttaataaaggtaagaaacattggaataagcaagcattcaataagaatgctaaaatgtgctaccccaatcattttggtactaattcattatggtaacagatttgccaagttccatagttcaagactttggcattataacaactaccagcagggctcctaggcagaattaagggttcagtgtgtgtgtgcaaaattagggccttggtgttattagtaaagaactgtattaaaaagaatgagggcaactgcaattctgttctaccaaataaaacattttgtttagagattaaaaaaacaaaaaacaatgaaggctatgttacagttatgcaaggggtgttctcaattagtagaaaacagtatgccaatttgagaaattccattaaaaacagagaattccataaaggtagcaccctagttattacattaaacaaaagtattaatattgagtattattgctacagtttgttcattactcagaatcatgtgagcccaggagagaccaggtttgctctgttctctattattcctgtatatttagcatactcaaagaaaatatcctaattatagattacaattactacatagcagacttactgtaaatatttattgaatgaataagtgtgtatccaaataaagatgtctgctctgcaaaccttcatccaggccctgggtctacatctcagataattcacccagacagccaagacataaaaaaacccaaactcctttggtatttattctccctaagctccctggtcaagggtctctaaatgacttcaaaggaggcccctttcctagaactcagcatttccttaactggtgattgctgattgaagcacaccactcccaggctttccagaattatttaatattgcttctagggcaccttatatgggtgtgttcagaagcactggggggaaaaggaacactgggttcaatggctagatccttgtttcccacttgttcccttttcataggtctccctgccctttgagatcatgagcaacttcagattacctctcacccttagaatacaatgcatccatggatggagctttggaaaatgctactgtgtttctgataaactaagtgcttgttaagctttcactttagcacaactttaatgtggaagtaatgactctttccagctgatatcaaggtatttcccacactttgggaaagatgcaaaaaccactttctatatggctcagtggttttattactgatggaagcatcccattaaattttcttatcaggctgtaaggaaaaaagaaattcattatgtgaagagagacaaggtaagggtttactatataatcaatcaatggtaatacacccttgtttctcttatcaggtaaattgcccctcaaatattttatagtaacgggaatttctccaatctcaacatagaatcctaaaaatatgcacactctgacataccattaatcctaacatttatcatcccttatggttaaacatttataaggttacattctccttaaactttcttaagcctgtaaacagctacaatgaacaacaggtaagtttattatggttttagacagctctgtggagtaattaatgaagcgtttaggtcgatgttttgcattactcaaactttccaattccaaatttgataaagaaattttcaacatgattgatgtaatggttacttctcaggtcaatgaaaatgaatgagcactgggttcaagtccaagcccaagcaagtcacttatttcttaagtctctatcttctagtccattggtctgagagatctggcctgaagttccactttcaagtatattggtccattctcacattgctataaagaactacctgagactgggtagtttataaagaaaagaggtttaattgactcaaagttctgcaggatatataggaaacatggctgggaggcctcaggaaatgtacaatcatggcagaagggcaaacgggaagcaagcacctttgtcacatggcagtaacagagagaacaaagggggaagtgctacacactttcaaacaaccagatcttgtgagaactctatgtggagaacactaagggggaagttcgcccccatgattcaatcacctcccaccaggcccctcccctgatacgtggggttacaaatttacaggagatttggatggggacacagagccaaaccatatcacatagcttgggtttaccttgaccaaggctcaaaacaaggtgatgcagtttcttaaatttttcctttactgcgcaggttaaaattacatgttaatttcttgaatggtattcccacaaattcccttacttccattccattactgattatttcctgagtctcatctgtctctcagattctatattcttttaactaaaggaacaagggtttctaaacagaaggtcatttcaagtttcaataataataataaaagtggtaggaaactttatctggacaattttatatgatcttgccaaatggacaatggcaagatcatataaaaaatagaattctgaccccaaaactgtagaaacgtgcccaggaaaccaatcccttatctacaacaactagcctgggaaatcagcccacgataagtcagacttgcagggattcagaacacagaaaaccaaacaataatttctgcaacaatttgccccaaatggccatgacttaactgaaagctgacaacttccctaatttttggctccactgctaactttagcaccaaccagagaaagccaaatatgctcctctaacctatcgcgtaggatgcttgcttccagtcagcctgcctgcagcttctttgggccaacagactccaattagggtacatcagaagccatccctttctccactacacagcattcccatttctttccctgcctttgaatctccgctgaaatgagttactctgcaagaaactgaataaatagccttgatttattctcttttggtttgtctttatttatcaccactgtgcgtataaaaaaggatacagagagtgcactcagcttcatctagatccacagttgggtcaatctttctgctttcctagttaattattaagttcttgctagctactatttaaaaacctacacactaaaacctcctacctttccaaatgcctaatgcctatctactttgagcatatgactttaccccatcttctcagggaaaacaagcccaataagaacttgctccacatcttctcagcattcacgccagtatctacagcctcatccagtcaattcctcccttcttgtggttgtaatagaaatgtagacatctcctctgtccagggttctggatctcacttcccttactgtctcacagctttgatctacagattatcatcactctctcctgttccttcaaacagttctcatcatcttatttatttctatgaacacttagatgtgttcaaggctgttccattttactctctctcccactccaagtccctttcagttatcaatctctctctcttccccacttcagagcccaaacactggaattacttatctacccttcaatttccattcatttcataacctgctgcagtgtaggttccacctctattactgcactaaaactactaagatcatcagtgacttcattttccctcagtgcaatgtgtattctcagtgcctacaactgtgactgatatggagtagagcctcacttctctggatttcctaattttaaaaatagttctgcattggcttatagctttacctgaattacgtcatctattacaacaacctgataaagtaggtattattaatgtgattcatatttggaaactggagctcacagaggttaaatctccccctgaaggacagacatctgttctgccacctaagattcatccttgcttcttccctctgaaataataatagtattagataggaaagtatcctgaaaaatccttagcagatttcctggtataagaaaaagagttcaatatatgttgagtattatcatttttctaccacctaaaccagtgcctggcacatgaaatatactccataaatactgactgattaaatgtgcccagagaggtcataacagtgatgcccaaataattatttttgctggtaactgtggcctagctggggctttaaagcaggtaggggcatttttcctagatctgaaggcctctagagggctttacctcgtcatactaactgtagggaagaataagaaaaaaatatttttacttcctctttctcaaaaatgttcactcatccatttctgaaaaggtaaaattatagacaatgttacttggtaatccctatcacctttttcagaaaaggatttgcctttatcttattatagcaaatattagtttgtaggtgtgaattgagagggagagcagttaagtcctttttcctattacgtacatgtataaatattgaaattcatgagatttaaatttgaaaatctgctgctttacaaaaatgaagtataattatagagttgaacagaacaaaaggggaagtaaaagcatagatgcactgatttactatcttgccttctctcccactggaatcaatttatgctggaaagaggagctaaagacagctggaggaacaataggttgttaacacaaattataaggaaaggaactccctttaatttttgggaactgagccaagggagaaaattgaagtgagatactgtatttatactacactataacagtactcatgtaattttctgagctcctcaaaaatctctactaaaataaaagcattagtatctatttctcattatgcctaaatattggtaaatgcataggaaaaaatccccagaaggtagctgccagtttgccaacatatcctattaaaaacttttttaccaactaggagacatctttccttagtgtaagaacagagatacaacaggatgcatggacactgcgttactttaatgatgttgcctttaagaaaagataattatgctggaatgcaagatgcaaaaagagactacataggaaacaaagagttcactaagtgcagactcagttgggtttctggcttgaaatgcaatacaagtaaaatatttggcaagaaacctgtaaactacataaaagaggcttaaaaatcaaatttggaagttaaagaaaaaaatcacccagataaactataaaatgcaggtaacatagatggatgtgatatatttctggttgtcacaatgaggtcatgaggatattctggcattctcatgaaggctagctcagagcactcccaaccaatgaggtcctctattaccaacaaagagcatgttaaaattccaaacaacagggttctacattttataacagatgaaatattgctattacatagtcagaactctgaggacgggctcaccattggaaaatagaaatggaagggtttccttagttcaagtgaatatgttaaaagatgggaaaaacaggaaagctaaagatctggaaggtcaaagtatcaaaatgtgccaaattcaataacaaaaaggggcttcaaagctatgctggaagcaaaggcgttgatttctgcctgaagaagatgctgtgacatcaactccaggacacttacttggcactcacattctccatcacagaaaatgatctcacgtgttgtacactggaagttgaactcaagatacgtgatatgatattaaagttctgtttactcggccaggcacggtggctcacatctgtaatcccagcactttgggaggctgaggcgggtggatcatgaggtcaggagttcaagaccatcctggccaagattatgaaaccccatctctactaaaaacacacaaaaaattagccgggcatggtggcaggtgcctgtaatcccagctactcgggaggctgaggcagagaattgcttgaacctgggaggcagaggttgcagtgagccaaggaggttgcagtgggccgagattgcaccactgcactccagcctgggtgacagagcaagactccatctcaaaaataaataaagttctgtttcctcaactcagattactgaaaataatttccagctattactctcgagtgatgatatgcctttcagagactattttgtatattaccaagaataacacggtgaagtatgggctaaatgattatacagacatatgaattttgagatatcaaatacctttcctaaagagtactcgttagtggctctttggaatggccttgaatggggcaagagtctgtccttagactacctcattcaactacctatcactgtctcggaagaacaccagtaaagttaatctgatcttcaatagaaaaacactggggagggtcgggggtagggagagcatcaagaaaaacagctaacgcatgctgggcttcctacctaggtgatgagttgataggtgcagcaaaccaccatggcacacatttacctatgtaacaagcctgcacatcctgtacatgtaccctggaacttaaaaaaaaaaaagtactaggagagagaaactaaacaaagaatcaagattcaagtattgtacactttaaaagaaataattttatggtttctgaattatgtcttaataaagctgttatatatttttaaaaagtaacaggagaatgtttaactggaaaatgtaaagcctcatatatttgagttaaaaaatgtactgagcagagaaagcttccctgttgataggctgaggcctgcagtagactgtgggctcaggagcaggtgacagtctgctggagtcttggcttcctcagcagcagcctccccctagaccctcagtacctgacatcatgtctgccacaaaggaatgcatagtaaatacctgctgaataattatgctccttaaaaacaaaacaacaaagaaaagccaagaacacaaacttaaacgttatgaaattaaaaataggagtttcttctctaagaaatctaacatatatagagaaaaaagactggactaaacaccaaaatactagcagtagttgtctttgggtcagaagattttgggcaaattatgatcatttaatttcatatttctgtctattttcctgtgtgttccaattttgtaggatagagaaaagtatatcctctgttacccctcatccctaccccaagtctgtttgaatgacaatgagtatgctgaaacattgagctgcttgaaaactatttttatatatgttactttgaattatttatatttgtatgtcttttctttccacttgaactgtagatactcagattgcagcagtgatatgttattatccttgtatatagtctgatgctaaggatggcagcaaattcaaccaccttctcttgcaaacgttattacaactgaaccgggaaaaagactagaattttatccacatggctgctctaatgtcatcctaatatgatataatttctctaagaaaaggcacttgactcaaactaaaacaaaagttaacactgtgactcaaagtttaggctagatgacaattctgaagatctttttatttcttggtggtgaagaaaaaaaaacactcagatattaccttttttttcagcgcatgggatcggcagtaatttatctgacattatcccaatactcctgatggaggactgtcatttcaagttctacttcgcaggaggattttatcgccctctcaatcaatgttaggagtcattagagcaataacagagaagaaaaatcaaggccacctatttaggcagggtgcttgccacaaggtagtgaaacacaaaccctaagatctttatgtctgtacaaacgtacaagggagttggccatttagctcccatagttgtggggagcactaggccagactgcctggatggggcaattccctggggcctcagaaattagtattggtaacagcttatatttctaccacttctcatgaaagaaacccagaaattagcaactacccttgaataccctgtagaagtttgcaggcttgtctagaaaggcattaaaaataatcacaaaataacacaaatccacaaccaagcaatcaaccctattcactttccaagccccatttcatctctctaatttttccattatttaagaccgcagccagaaaaacttcagtgggagaaggagaggtgaatccaatgcaacatgaaccaaatctctatcatcttcgtgtcaccaacagaaatgttttagctaaacaaatttgatcgtttgtgatatgtgcacaaattgatttagattatcttgacaagtccagttagtccatccaaccaaatcaactcagaaaaaggaatctaaggagtcaaaatagataattcaaatcaggttgcatgcacaggcacagccacaatgcatcttagcccaaatgacctgaatctcattactaataattcttaattattcagtactgaaaatacaaaatgtttagtcagaacatggtttgggatttaaaaacagagaaaaataagtgaataccaatttttggtatgtggagctgagctacagaaagctataacaaattaatttgaataattatcaataaatttaagaaagtaaatgtgccctaaaattctttcagataatttgtttatccaaatagtttaaatgacctattgtttatcctgctatacaaatcctttttctttagataatataagatttaatgaataaacacacattacaagttagtgacatttacataaagaatcattaatcataccaccttcaaatatatttgcataaatattagcagttaccaagtcctttatcatgtacggcctccatgacttagtctagatgagaataccaccttttgcaattatgggtaatacattctttttcaatctacttttgaatttgaggattggaaccaaagtttatcgtaagcaacggtgacttactcaagtttgtctatacatctgactgtcacatatgtaatcttcccaattttttttcttgcctctggctattctagtctttccctaaaacctactaaaagttactcattttaaagcaattgctatttactgtgtactactaactgctttctgtgaaaaatgtgtattcttggatgttgaaatacagggagaagagatgctccaccaatagctttgtaaacttttcccattaaagtagtattccacaacatgcattcaaatgtcaccacgaatactgatgatcctgtaaagtggcactgtctttcaagagacaagattgatgaggatagaaagaaccagataaagaagtctttgaattctagactattaagcagtagagagtcactgcataacatttttataaggagtggttggattaaacaatattttgggaatattcaacaaatatgatacagcatactagtaggaattgaaataaaatgctttttgcatcgagcattcaataggctgttgccctactaagatgataactactaatcctttgctagtgaaaacccagactttaaattttttttttgaaagcatttaactatttatgttggttgatgaagtcaactgctcaagtgagactgataccttggaaatgtctagctggtgttaatggttcagtttgggagctcttggttgggaaagcactgagctcagctcttgtgactaagatagcttgattcactcatgtctccaacaaatattttcaaatatctacagctatatgtgaaagctgacaaatttaagaaaagaataaaagtaatgtggtttccacaagttgatcactttttgagtataaaaattagggaatggagtgtagagggtaaaagctagaatatccattccttcggttgagatttctgatgcattattattgaagtttattgaagacctagagtttcaagaatttcacttaaataagaatatcaatttaactatattatccttctttcgtggaggctttcttaggtacaacgttaggtccaatttctcaggagttctctttgtgagcagcgtgtactcctctgtctcttgatgtggggccggccatatgactgatttgggtatatgaccaaagaggatagattgccaggtcagaagccaggcctttggggactttgtatgtttctgcttgctgtcttaagtgtttgccactgccttgagaagaagttagctccaagtccaaacagagacttaaagagcatggccagtcagacacccaaacatctattttaagaggcagagcaatgacgcaccaggtgctgtgtacagaagttcagctttagatgaaccaaatcttacctgcactgccctgcagtcaagtaaatgactgttatggaccacagagctttgaggaagtatgaaacacagtatctttgtagcaacagctaatggatacagtggcaaaacagggattagaactgaggcttggaggctcttatttgaatgtagattttatctatcacttttttttcctgttgcactaggcatgacaccgtcatatgtagaacttaatctgttctatttttgtgccctttccattgcctttttcagtaaccttttaactaccttgcctttccattttttgttttgttttgtttttcttctttgtttttttgagacagagttttggcctgttgcccaggctacagtccagtggcacagtctcggctcactgctgggctcaagtgatcctcccacctcagcctccggggtagctgggactataggtgtgcaccaccacacccagctaatttttgtagagatggagttttgccatgttgtccaggctggtcttgaactcctgagctcaagtgatccaactgtcttggcctcccaaagtgctgggattacaggcgtgagccactgtgcctggcctgttttgttaatatgtatgtatttccctgtgctttggaaccaatttttccactttactgacattttgttttctttccttggaaacttaagtctttcaaataatggccagtttctctaacatttctttccaccttaagatccttacagactttgaaaagaaaaaaaaaatacactcataataatcattcttattatcttattatcatttttaccttagtttaatcttatccaaactaggtcgtgacaatttagggaatacttccgaagacttgctctggtattttattttttaaagagaagtccatatattggaatgcatgaacaagaaatgcaaagttagaaacatatcccatgaagcactgtgaacactctgacagctgcaatttatcaacataaattactgtgcttagctgcaaagcttttgtcacagggagacagggcacttcctaaatggcttgctgccctctttaataataatcttagtttttacaatccagacaacctagggcaagagacagcctgatgcacatagaaacagaaaaattcaggtttttatgtacatcaccgggagcactgacatgctactctattcatttttagattagagtcttttcccccttctgtctacatgtggcaatagatgacttagaaaagaaaatgtgggcaggagagccaggataggaagcttagcagtaaacaagtcagcctgtctgctgtctcactttccttttaatcaaggaaaaggcctaacagaattcactgtcatcgtcttagtggtggcttctaacagcactggatagggagaatccttttatttccagcatcacatgaacaaattgatttttaaattcatgcatctaacatgtgttcctaaagccattaccatttagtaaacagcataactaaatgtctttaaactactttagacattttaagcactaatttttctcattttaaaaaagtttcaatctgtgtgttagagatattcgagatatgctactacataaagttttgtacctattcatgaaaatctaattttggggggatgtggttgaattctgtatctcaatattggacttttctaatacggtggatgagctgaaacctgttccctggtccccttaactccaaagcctctgctcactctactgtacatgctgcctttacagaaagcccctgtccgtaagctccattttaagaaaaggagttttaagactgctatccataatgccaaatttctaagctgctttcttctagtattggaaaaacagaaacgtctagtttagccattataatcaggaatcaataacatgcatatctgctaatttccctgcctttatggtctgtgctcctatccaaaaagggttgtaaaggcaagaacaaagttacctatagtctctctctctttttgagtactttcaaattcatcatttgtcaacagatgtactgcagtccctagcttcagtacaacaggacaccagtaaagtcacctgtggtacacagaataagagctgcccaaagatgtctaccttctaatccctggaacccgtgaatatatatgttacatggcacatggggaattaaggttgcagatgaaattaagtttcctaatcagctgaccttaaaatagggagagtatcctggactatccaggtgggcccaatgtaatcagaagggtccttaaaagtcaaagagggaggcagaagaggaagtgagagtgatgtaatatgacaaatacttggcccaacattgctggcttccaagatagaggagaagaaccaaaagccaagaaatgtgggtggcctagaggctggaaaacgctgggaaacagattgtcccctagagcctccagaaaggatcaaaggtctgctgacatcttgttttagcccagcaagacccatttcagacttctgaactacagaactgtaggaggagaaatttgtgttgttttaagccactaagtttgtggtaatttgttgtagcagccacaggaaacgaatacatcatttatttttaagacaggttaccaggaaggctatctacattacagataactgggagacaatttgacaaatatttgacaaattatcagaaatgtttttgttgtttaatggcaaaagtaaaagaataatatgcttttgttttcttttaatttatttttccttgctgaattgtgtcctttaatttataactacaattgctttggctgttatttggcactccaaatggatcagaagtaaattgagactgataaataatttttgtaattaaatacaatattatagcaaagaagaatttaaaatataaacagcatcttacttcaataaaaatgtgttataaaagaatagaaaatcacaagtaactaaataaaaaaataaataaatttgactttatcacaagtaaaaacttctgtgcatcaaaggacaatatcaaatatgtgaaaagacagtccacattaaaaaattttgaaatcatatgtctgataaaggtctagtatctagaacatacaaagaactcttggaagccaacaatacaaaaggcaaataacctacttttaaaaagggcaaagaatatgggtaggtatttttccaaaaaacctcaaaacaattgaccaataagcacgtgaaaagacgctcaacatcattaatcattagggaagtgcaaatcaaaaccactatgagatactaattcacactcattatgatggctatttaaaaaaaaggaaaatggtgaggatgtagagaaaatggaactataatacataactagtgggaatgtaaaatgacacagcccctgtggagaacaatttggcaattccttgaaaagttaaatatagaatttccatatgaccccgcaattccactcctaggtatacacctaagagcactgaaaacatgctcatgcaaaaacctgtacacaaatgttcctagcagaattattcgtaatagccaaagagtgaaaacaccaccaatgtccataaattgatacatgaatagacaaagtgtagtatgtctatacaatggaatattatacagccagaaaaaggaatgcataggtgaaccttgaaaattttatgctaagtggcaacagccagacacaaaaggccacatattccatttgtatgatatgttcagaatagtcaaatccatagagacagaaaaattatttcattgacacataaatgagggatatgaaatctattcacaataggaactcatggtaggtatcatttatatagctgagaaagctctcaggcaatcacacacaggaaaatgtgtcaaaaatatctgcagaaaatgttatgtgaatgtcttcatacatccattatatccttattcctccctctgttccaaatttgagctttactgaatagagtgtgagcacctgcaggcaggggctaaatcttatttatctttgcattctcagtgctgaacataataggcacacaataaatttgttctataatgggatgaagagatcaaagcaaagagtaatggccctcagtaatggctcctgacaataagaaagcccttgtagttaggaaatattcttaaatccctcaaatgcttatttaagatacagagagtgaagtattaccttatgtaggaatgttcagtgaccaaaatgggaaaattacaaatatctgttgctttaaattctttaatttttggcaaattgaatattatgcactttttgtatttttattataaataatttgtttcagtactatgacttatttcagtataaatgaaataagttgaggagggttatttaaaatggtaaacatttaaccatctaatggttaattaaaatgaggaattcaagtttgaacataaccattaaagtctttttttttttttttttttttgacagagtctcgctctgtcaccaggctggagtgcagtggtgcgatcttggctcactgcaacctctgcctcccaggttcaagtgattctcctgcctcagcctcctgagtagcttggatgacaggcaggtaccaccatgcctggccaagttttgtatttttagtagagacgggatttcagcatgttggtcaggctggtctcgaactcctgacctcgtgatctacctgcctcggcctcccaaagtgctgggattacaggcatgagccactgcgcctggccccattaaagtcttttaattcaatgaagggttcactcagccttatttgaaaacatatttgcttacagataattctattgtaatattttaatcctccaatatgtgcttataaggaaattacaaaataacaatacatcattttaattttatctttactaaaagtaatgtagagattaaggccttctgcttctctgtcaaaaaataaaaaagatcaaacaataccggctgtgataagcatacaacttgtgattatattgtgctaataggtccaaggatctatggagataaaatctgattaatatatttatcatctttttatgtttgttttataaaagaggattcatgtttctatttcataaagagacatttaacttcttcatcgggtcattctaaagttacctttaaaacctaagaagcaccttctacctcttaaccaaagaaaagtcaaatatacgcagaatacagagggatacagaaccagctaagtgtcgcaaagtcacaagccttctttcccccaggaaaataaagatcagaatgctatgctagagtacatgttcaggtttttgaaagggatgtaaggatatgcaggtaatgagcaaggcctcatttcttttctgcatatatattagcatggattttagcctatttatataaaaaagtcagaaatataaagcagaggagtttttactggaactatgatgactccatgtttcgtatttgattttctctgctgttcacatatgttttcttgattccttgagaattgtctttttaaaaaatttgtgagtgtatcatttacatgaactaaatgaccaacactacttgccctgcctaataaggagtaatctctgattcactcaggatacgtggaggccttaaagtttgggagtccttaattgcgtttatggctatatcttgctatttggcacctgagtgtgtttatcacactgtcttacgtatggtaggtgcttaaccaatcatgactagttttagatatgtttacttggtgtcccaaatagattctaagtaccttgagtgcagacattatgtattacatgtttttagagtatttcacaacctttagcttggtgctgagcacatgggaggtgccagttagccaaggtagtgtagacccttcttttcattcttgttatgagaagagtatagatgatattgggactccttaactccttacccatttaccaagacacatacacatgcgcacgtgtgcgtgtgcacacacaatctgtatttgatgaagcagatgcagattaatggagacacatttgatcacagggagttttatttttactctctgtgtcatcagcagtttttgcatattacctctagaaaatgttcagaaaagttgtactggtaaatagaattccaattctttgtgatggaaaaagtacttgagcaatagcgagcctatggagacagctaaatcagcagctggcagggccctctctccattctcccctctacggatcagcagtccttggtattcagaaagtagattgtaagcaaatatttttttctagtgaggccggaagatttactgtgtagtattttacagaaaatataaagtctttgataaaatgtaaaagtcagttgttgagataaaatatgactacaatgaagaccactataaatttgagtagatttttcaaagtagcattataattaagacctaatttctctctcctagcagtgtagaaggtggagaggaaagagtattatgtgacaggtaaggaaacggaggcagataaagtctacatgatttactattgattgggagccagaagccagaactcaggattcctggctaaatcaatcaaaaaattattaatgacttctactacttataagatattatactaaaactttctttttgagataactgtagaagagttaaaaagacaatatataaagatgtggtaagttaaattacaacagaagcattatagatttccaaagtaaatgatacctataccaaagggggaaaaaagaacagaaaaaagacacctcaggagattgttttgggctgtggtgttttgtagatagtaatttcccactctaagttttttctccttccatattgaacactgggactggaagataaaaccatattgattttctgtccttcaccatcttgcccaaacttctgttttttaatctttcttttagatattggaggaaaacgtttgttgtttctcatctagagttaatcccttttcttacgttccatggctcctcattgcccatttattctatgcccttactcctcagagtgcaatctgtgagccagcagcagcagcatccctggggagcttgttagaaaggcaggatctcagtcctcaccacagctctagagaggagaatctgcattttaacaagacacattccagtgggagacctgctgatctcggccattctttcaaaaatcagcccctccatttctagcaccattagtctctctttttccctcactatctccttttcccttcttgaacaatccaggggtctttattaagaaacaaaccaagaaacatccctccctactccccatctccaatgactgatatccctttcagctttcagagcacctcacttctgtttctgtggttaccacgttcctggaatgaattttatgcccctgctctctttatttttaattcagtcagtttcttcttaaaacttggaaactttcactctgaagcagtttgaacacataggccacatgaactcacacacgtgcacgtagaggcacacacatgggtgcacccacatgcacacacacacgtgcacgtagaggcacacacatgggtgcacccacatgcacacacacacgtgcacgtggaggcacacacatgggtgcacccacatgcacacacacacgtgcacgtggaggcacacacatgggtgcacccacatgcacacacacacgtgcacgtggaggcacacacatgggtgcacccacatgcacacacacacgtgcacgtggaggcacacacatgggtgcacccacatgcacacacacacgtgcacgtggaggcacacacatgggtgcacccacatgcacacacacacgtgcacgtggaggcacacacatgggtgcacccacatgcacacacacagatgcagatgattaactctgatgaggttagatcaacttttaaaatgaccatagttcctatactgatgggaacattaattatctgagccacatttggttcctgatgattttggtgtgcccactcctatcatgaatctattcaggatcatctacttgtctgtgatcctgcttaggtggctggactgacctacaccaggccaaatttactgaatgcccctgcggtacaactgtcccaatcttgaaagggaaatcttgtatctctgcataaatatcccagcagtatacacagatgcaggttcacgaaagtgaaacaaaatgagaccttgtacttaaggcctatctaagttaggttttcttcctgaatccttctgctgggtaaatcctagacgacagaggtccatctgtagtcttgtgttagacgtgaagaaaaggaggaggttgccaatagattccccaccatcaagtgtcataggaaaaagcttataccaatgaggaaccaaaaaataaaaacaatcttcttcttaattccaatgactttctgaagtcatttcatacaacaaggttggaaggttgagatgttttaaaatttactgggtaccatcacccactcaccttctacgggttttgagcaatctgctcactagtgattggatgttgtgttattcatcaggcctggctcttatgaagaaaaatgaagagcataaaagaaaagaaccaccacagtgaaaatggggctgtgctgaaaggttaatgtgctcttcagcctaggacttcagacagaacacggagcggccacacaatctgtttatctgatgcatgcagacagtactgtcatgcttcacctttggaaatgggccattacttctggtgacagattatgaattgtggaatatggctggcacgtggccagacaatggagagttcataaatcagactcaaaatggaaatacctgagtaaaattcttgagttatttgaggggttggaaaaggatatgtaatgagagaattcgttaaacccatgtgcgtggatgtgtaggtgggcacgctgtgtatgtgtatgtgtgtatggggcaggtgttgatttttaaaagtcctttgttaaggttctacaaagaagtattttttgttttgttattttctggttggctgaagaattttgcttcagcatggaatagagtggtagttggggatcagggtaaaggatggttgggataaagattttggtttttaacaggaaattggtttgagccttccaaaaaaaagagagaatcaatcaactctgaacaaaaggagtaaatagttggtctacagggattaatgtttctttattttacaaataatctgaaaaacaggcccatagatctggaaaacagccacaactgcgtagataatactacacaaattggtaaacggatgagagtaaattaaaatacaggtttataagcatgtgaaaatagccagaaaaatatcaactaaaataaagtgttgatgcataaatgcccttgaggaaaaataacctaaactccttgtaagaagacgggctctaaagttttgttttgtgatgaaggaatgaaacctaaaagtgatttttaaaactactatctgaaaatatgctccaatgtgtccccaaagaccagcacaggtaggtaatcctctagaaaggtactagtaacacacaaaaggtaggattccaatattggcaactcatgctaggttgattaagtgcttatgaccaaggagttgagagtggttgtttagttttcctcgtactcaacctcagacaacagccatcaggctgagggtaattcttcatcaggataggaccacaagagcttgttctttcttgagaagaaaaacaaggataggtaaatatatagatcattactataatgtcaccagcaaatttttaagtagttctatttgaaaaaaaaatcactatttaggcatttaaaaaatgtaatatataataccatgtacaaaaagtagagaaaacttttataagaataaaagctataatcaagacttttagtaccatctctaattatatacttagtaccacctctaatattatactttgtaccatctctaataatatatactctgtttatctaaaggctacctcatggatttttagagttctgataaatgtatcaattattttcagctacgaagtactatcctttttttttttttttttctgtttattacgaatatcaacgacttaagttctctggccaaattagtttctccagtgtggaactaacttctatagaaaccctctagtctttttgtacagttgtgacattgactaacatttttacatcagtggccagactaatcctcaggcctggagtcccacattttaggccaccagcaaactccctgtcaggtgctgcctttgcttgttgctggcaggagagtccagtgcaaccggtaggaaaagatccttcattagcaggtgctaaaatgacgggaagccccttacagagataacacatcctacctttctactttctttttctgcttaaaatgtgccttcaatcttccttttaaatggatttcctcagtttagagatgtgtaatacgaaggcatgcatcttacctatgtggcttctgatccctctgggcacctgtgtctggatacagacctgtgcccacctgcatcccaacccctgacgaggcacatctctgctggtgggggcctgtgtcaaccctgaacagctccccaaggaagctgcttttctgggtgtctgtctagccagctaacctatcatgttcatttttctggcccttagttaaaaatgctctattaggcagggcacagtaagtcacacctgtaatcccagaactttaggagacaggcaggtggatcacttgaaaccaggagttcgagaccagcctggccaacatggcaaaaccctgtctctactaaaaatacaaaaaattaggcgtggtggcacctgcctgtaatcccagctacttggaagacagaggcaccagaattgcttgaactcaggaagtggaggtttcagtgagccaagatcacaccaccgtactccagcctgggtagcagagtgaaactctgtctcaaacaaaacaaaacaaaacaaaacaaaaaaaaacaaaaaaacaaaactgctttattatccaagtgttaaaaaaaggtataggctttctttgtcaagatactttctcgaagtcaaagtcttttatcagtcttctactgtttttcagtagggtcccggtttattcctctgtcaggagcaatatacattccagtatcacacacaccaaaactttaaatacgttggtcaattttaggttatatacattatctatgtgaagtgaataatgtgcattttttctatgtttcattgcacctggtacaagtttaaagcataataatacatttccaggccgggcgtggtggctcatgcctgtaatcccagcactttgggaggccgaggtgggccgatcacgaggtcaggagattgagaccatcctggctaacacggtgaaacccagtctctacttaaaaaaaaaaaaaaaaaaaaaaaaattagccgggcgcgatgatgggcgcctgtagtcccagctacctgggaggctgaggctggagaatggcgtgaacccgggagacggagcttgcagtgagccgggattgcgccactgcactccagcctgggcgacagagcgagactacgtctcgaaaataataataataatacatttcgggctactttgtatttattctgttgaaagagaatgttaacagtctgtcttgccctgatttttcattctgatattatttcactatttccttctaacatgtctccaaaagaaattactgccagacatgtgtcttagagaaatagtgattcaataattatcagtaaattgccagataatctttaaactagccaggagtattacaagcaatatttatgctaaaaatcaatttccctacctcagaagaataattgtattttaaggtttctgatggaaaccagtctttgaacatccaagcattagacccagttccttaccctctgcataaggcatcctgttaggggctctaaagaaaatcctcaagaggtatgaaatttatatagaaggtgacacaagcttaacttcatagtaagtttaactgcattcaataagtaattcaatataaatatataaagaatggtaggagttagcatgctttccaaatgaattatagaaagaataattgctacaaaatttactacactggcactgtatagaaaagttggatgtagaaagagagataaaagttgcctttcaaataaatgggtagcctttgattaagaagtaaggaggaaagcattttgagtacaaaagctccatttgttaattcctctaaatcttcaacaaacagagtacaaagacagagaaaatgctcttcaattactttttttgatgtgagctaatacagcattaataacaaagcctgtaaaacctggttatttaagataactttaataaatacgaagtaactggtgataaatttgacaaaagatgtgcaggagctataaactaagaattataaaacatcgctgaaagaaattaagtcccagggaaatggaacaatattgtgttcatgggccagaagattcaatattgtgaaaaagatcaaaactagaggatttacactatctgatgtcaagacttattataaagctacagtaaccaagacgccgtggtattaggatatgaatagtcatacaacaatggcacagaaagtctagaaatacacatacacatatatgaacaattttaacaaaaatttcaaggcaattcggtaggcaagggaaaaaatttcaacaaatgctgttgcaactataatatatccacatgcaaaaacatggacttcaaaccttaactcatcatttataaaaataaattcaagatgtatcatggatctacatgtaagagcaaaaactataacatttccagaagaaacataagaaaaaaagggctggccacagtggctcaagcctgtaatctcagcactttgagaggctgaggcaagaggattgcttgagtccagaagtttgagaccagcttgggcaacacagtgagaacccatctcttaaaaaaaaaaaaaaaaaaaagtaaaaatacataaaaaaggaatatacaagatgatgttttagagaccttgtgttagacaaagatttctgaaataacacacaaaaagcatgaattatgaaagaagaaagtcagcaaattaaatttgatcaaaattgaaaccttttgctctttaaaggaaactattaagaaaatgaaaaggtagcctgggaaaaatatttgcaaaacatattttaaaaggcacttgtatccagagtatataaagaactcttacaactcatcaacaatccaataaaaatgggcaaaatatttgaaccatggtttttcaactatgctatcagagacactggggatggataattttttcattgtggggaggctgtcctgtgaactgcaggttgtttagcagcctcccaacatccacccagagatgccagtaggatctgaagtagtgacatcaaaaaatgccttgagatatttgccaaaggtcccatgggaagcaaaattgcctcagatgagaactactgatttggataacatgttaatcagagaggaggtacagatgacaaacctacagaacctatgataatcaactagaaactatggaaaacaacacagtttgataaagttatttaatatgcaaatattagcaagatgaaaatgcaatactgtttttatgcctgtactgtgccgtttaaattactagagctttgtagtaaatgttttcaaatcagtaattgtgatgcctctagctttgttctttttgctcaacattattttggttattcagggtcttttgtggttccatatgaattttaggaatgttttttctatttctgtgggaaaaaaaagtcattgcatttcgatagggactgcattgtttctgtagattgctttgggtgggatggaccttttagcaatattaattcttccaatacgttaacatgaatatctttccatttatttgtgttgtatccaatttctttaatcagtgtcttatatttttcagtgtatagatctttcctccttggttaaatttgttcctaaatattttattatttttttgtagctattgtaaatgggattgtttccttgatttctttttcaaacactttgttattagggtgcagaaatgctactgattttcatatgttgattttgtatcctgcaactttactgaattcatttattttaacagttttttggaggagtttttatgttttctatttataaaaaacataaaacattaaattgtctatacagatgacatggtcttataatgagatcaatttaatttcagagacaatttaatttcttctcttctgatttggatgtcatttatttcattctcttgcctaactacactggctaggacttccagtactatgctgaacagaagtgttaagagtgggcaaccttgtattgttcctgatcttagaggaagcttttagcttttcaccactgagtatgatgttagttgtgggtttttcatatatggcctttattgtgttgaggtacatactttctatacctaatttgttgagagtttttataatgaaaggatgtcaaattttgtgaaataccttttctgcatctattgacaggattacatggtttttgtccttcattctgttaatgtggcatatcataattactgatttacttagcttgaattatctttgcatcccagggatagatcccacttgatcatggtgaataatccttttaatgtgctggtgaaatcagtttgctatgttttttcatggaggatttttgtatctatgctcattggtgatattggcctgtagttttcttttcttgaagtgtccttatctggctttggtatcaatgtattacatgtttcatttatttaagttaaataaaaggactagaaacaaaaacaagaaattgctaactctgaatgatagaaatataaatgagaactatattatttttctaaacttggcatttcaagaaattatcaaaagaattcaaagtttctagaaggtaaaataaataagcacgtgtttaccatgtcagaagacaaagtacaaattcatttacaatacatacagttcaataaatgatagaaaagaatttgttcaataaatgggaagatgaatgagcctactgaaaaatgagcaaagacaaagagtggtcaattgaaaaacacaaatttacaaagcctataacaattaagtaattatattaacaattaaattgcaaggaaattttctacactagattgaccaaaaaaactaagtttgaggatatatatatatcttcacctccaccccatgatccagctgtcctacatctggacattgggtcctcttgactatttatattaaatacaagtacaagtgcaaggattttgattgcaacactgtaataaaaaacctagataatccatatagaaatcatattggaactagttaaataagtcaccgtagctctatacaacataattctatgcacatattaaatgaattagttagatctcatttgtaagataagactgtatatttaaaagacagaaaatatgttcttaagtggaaaaagcaagtgtggaagattatgttcattattactttttggttaaaaatatacatatatagacataggaaaagttctaggaagaaaaatgtcaaatgttagaagtggtaacctatgtggttagattgtgataggacctccattttgtatgttttatgtgtctgtactgtttcattacctcaacaatgtaatttttatacaaattgataaatttttattttaaaatgtatttagttttcaagcagctctttatcaaagacatggttctataagtggcttgggatcctcagtagaatttctgaagattttatttaaagggagtgagaaagtaatagaatagtatgtgtttctttaggcaatgtgctgtataatattttattgtaatctagagactttgtggtaattactaaagttaaagcagtattaccttaagctgttgactcccctcctaagtaaaaataattttaaagaaacaaaataatctatgcttttccacatgaatacagtgtttgaaatatttatatatacataaagtaggtcatatttcaccctagttgtcatcaattcatctaattcttgacatgatatataatttttaatgacttgcaaaaaattctggaagaactctctccaaaatcatctaagcattaagatcaaaagttttagtgacactaaacagaggcaaaacttaagacaatacttcctccttttctatcataaaatagataagtttagctcacaaaaacacagtacaggcagcaatggagattttccatagcatcttttgatacatagtaccgctgcaaacttcaacaaattcctaagacattttaaaattagcaattcagttactagctccaaaataaatcattgtatttatgcaatggctgagacagtcttaggaacatggtaggaagtctctctgtgtctgagtgactcaacagtctgacagccaccccaagtaatccccttgaaggtccaaagtcagaatcatttctaagatttgtcatctctagtagagtagctaatgtgctctcttggtcccttttacttaagtgaattcaataaatgatgctggaagtacttcactaggtagagtctgttaatttactaagaaaggtgtttgacttcccatagaatgtacaaactgagtttgtactgaagatttctctaagaactgtcgtaatgcttggtatttaaagaataacaaccaaaaagaatacattcagctgagagaatggttcattttaggtggcttaatgaagaaataattggatacaatttgacatttacaatttgataatgataggtagactgtacttgtccctttaccaggagaacaactatagaacagcttaggttcatatgcagaagacaccttattttttttctgcctttttttatttttttgagatgcagtgtcactctgtcattgcccaggctggagtgcagtggtgccatctcggctcactgcaacctccacctcccgggttcaagtgattctcctgcctcagcctcctgagtagctgggattacaggtatgcaccaccatggccggctaatttttgtatttgtagtagagacgggatttcaccacgttggtcaggctggtctcgatctgacctcaggtgatccacccgcctcagcctcccaaagtgcagggattacaggcacgatccatcgtgcctggcctgttctgcatttttattattacataaacagtattctggaaaggctggaaaatttaaaaatcgcctctcatcttattatgttttcccactttctgcctttatgcacataagtgattattttacacagtttaatcacaacatatgcaattttatatgatttttgaattcattttcctaatgaaaaagtgtttctcaataagcaactttcttcttaaaaatgacacagccatttcaagagggaagggtagaaaaatattttaattgaatcagctacttatgaatatagtattttatattcctttttgtaatattttggaatctcagcaaagtcgtagatcttttcctaattctgctctcattaagttactctgaatcaaacccataagtctgagtctactccgtagtgcagtattcctgctgaaatacttagagattgaagtgcatttgttagacacttgcaaattatcattcgcttaatctgtaatgtaaatgttcgctctttttcatttctaattttacttgcttgtgatttctccttttttttgtttcttgatggctcactgtccagtagtgtctctttttaacaaatgttttttgactgcttaacaattttgtgatttacaatttctcctttgatcatctttgtgtctttcatttgacttccttatattcactgtattattccatttatgccttcttgacttaaaaactgatcctttttcttttaaaaatataagtattaaaagctacatatactgtatccggaggtgtgcggggattatttttcaattcttaaaatgtgcaaatatgccttttgatttaaaagttgcttaaaggtacattttttaattttgaggatatgttagttatgaatttgttaatgattatattttgtattttattgcattgggtcagactgtagaatgtatttatatttcagggctaaaacaatgtttttgtcacttagtagtccattttgtaaatttctaagcaagtttaaaaatggtttctgttatacaggttttaatcatatgcatatatatgttgtatttatgtatatttcacatatacatatatgtataaacatatatatgtatatatatatttatccatattatgtaatccttactaataattcacatctttcatatctttttgtttacttacttttcttcctttcacatcttttggttacttactttttttttttttttttttttgagacggagtcttgctctgtcacccaggctggagtgcagtggcactatcacggctcactgcaacctctgcctcccggattaatgccattctcctgcctcagcctcccgaacacgcctggctaatttttttgtatttttagtagagatggggtttcaccatgttagccaggatggtctcgatctcctgacctcgtaatctgcctgcttcggcctcccaaagtgctgggattacaggtgtgagctaccatgctcagccaaggttacttactttcttaatctgtcttgggcggggggttgacagaggttaattaaagcctataatcaccattgtgtttgtcagtttctttttttaaccttcctttaatttatgctatatgggtttttgtgcaatagaatttgggtatacatacttataccctcattatgacctttaatatttactacaaatttcttatttatagctctgttgacatagtttatcttgaatctagctttgtacaataaaaatcaacagcagctttgttcttgttagtacttctagtatatttaacctttctaaatctaagttagaacgtttctaattcttattctaattcttctaaattagaatcttctaattctaataagaacctgttcttatgtttggtttgaagaaatcacacaacatacattcttatacacgaaagtgtctgtccatcatctagattcaaacttcctggagagctccatatttattaatttttgaatcctttaaaattcccagggccacgcataaagattggatttaaaatatatttgttagctgacttgaaatgtcaaaaagagtgaatcatcagcaatagagctgaaaaataatcgacaatccagtggtgataaatttggggcaggaattttcctggcctccctggaagcacaaaacctcagttgctacatccttcaacaatgtgcacctgctatttctgtacttggcacagactaatcggacagacacacttctagtcaataagaaagaaagcacagtcccttttcagtcaccttgcctttactaccaatcaatccacaggcagttctactttggaacgagagtttaactgccctgcttgcttctccgagatcaatgtaatggctgagaacagcaataaaggaataattcaaacaagtttaaaattcaaagaaatacagacaattcacaggcctgagaaagaaccgcatccaatgtaagacgttctctctttcctcatttcacttaagcctcttgttatctctgcatccttgtaagttatgcttcacttactttaaaagttagtcttcccaaatatcctttgatagacatatttctgaattctttacaacaacttttgaaagaataaggctgcagtcactgcatttttcttcctatgctaggctcaagtagaaacttaaaaaacatttaaaaagcaactccaagggtcagttggtctatctgttctacccacagtaaaaagagttttgccttgagaaccccgaaaaacgtgagatgtggtggagaaatgtggataggtttgttttgtagaaaaaaggattatattttttaaaacagccatgtatgcttagaagataatctactaagtgttgtatttctggatacaaatggaaaaaaaaaacaatcacagctagataaaaaccaaacactcgactgataggaagctacgctgaatgaatgcttatcagattaccagaacaggtactctaagtatgaaaatgcatggtgtctggtatttgaaaaaattcaaaaaatctcaagagcgcctatggcttagggaaaggaatacctcttctcctctctccttcttttggtaaagaggaaaactaattttgaaaggtcatgttctttgagtattagtcagtatagttttcaatactataaggtattttttttcacaatatatcaaactaatgacattgttttctgaaatcgtatcagtcaagctttgtatactctggtatgaagtaatcatgataataagctgaagttaaaaacaaaaataaatgaaaaggatggtagttgggggaaatagaaatgtagcaaatagcaaaatatagaaatgtttagatttattattcactccactttttatttatttttatttattttttatttttttttcttttttcttttttttttccactccacttcttaaatggttgtaacagtaacaggtggaagatagaaaatgttctttatttctaaaaccttattagggttgtgaattttgctcttacagctttgaaagaaaaattggaaagaaattgagcaatatggttctctagtatgatatacatatatatttgacagaaactaaatacattcaaatccaggcaaatgagtatcttttctttgtaagtgtcaaaaaatataatttggtttccaattcatttatatacttcaggtttctgtattctttatcactcttcccaagttaaatttacaaactttgtgtcaggtcactcactgcagatgactgaacaggtgaggagcactctggtaccaagcacccttgtacatgtgttgaaaccgctgagcaagctacagtctcatttgtcaaagttttcacattctgacaaaactgacatttttattccagggatgagaaatctgcccctggtcttttcttcgtatttaaatttaaagggggtagaaagcaaataatctttttaaaaagtgtgaacacacatctgacaaacattcatgcctttgaataatggacgggtaattttaaatacccacttagattcttaggctctttaagtcaaatggcccaattgtttctttttcttcttctttcttgagacaaggtcttgctctgccactcagggtaagtgcagtggtgcaatcacagctcactacagcctcaacctctcaggctcaagggatccccctacctcagtctcctgagtagctgggactacaggcacgtgccacaacacccagttagttttttgattttgtaattttttttagagatgggatcttgctatgttgcccaggctggtctcgaactcctgaactcaagcaatcctcccaccttggcctcccaaagtgctgggattgcaggagtgagtcaccacacctggcctcccaatttcttatttatcttttgtttgtataaaacctactgaaaatgatgactctaattcaattcagtggggctctccctagcttccatggtttggagaacatcacttttctacttttgtgctacatacacatatacacaataactctgtatacatttttaattcacaatgctttctaaacaaacttcctctgtggtggtagatctcatatggaacagaatacaaaccccacagtttatagatttgggctgcagcaatactggctaaaaacagttgtctggtgctgagttgtatcttctctgaattccatcagaatttaagttacaggatggatttagaaataaatggctcaagtggcataatgaaagttgtgactggtgggaaaatgcacctaaaagaactgcaaattcaattcaaaaaatattcagaaatcttacacattttgtgtttttgacctaggtctttaggtcctgaggttttgaggttaaaaacagaaagaaacaccatctattctccatggcaaaaacggcttgtaatcccccaatatccatttttctcttcatccagaagaagagaaccactgatttttagccagatatatagttcctgagaatagagataatacttctcagcctcctttgaagctaggtaaatccgagaaagtttcggctaaaaagatatatgcagaatttgtgtagcaattaaaggaattttccttaaagagacagctgaagcttttgcttctttatatctacactgccccctggaatgttgatgggatggaactctagcttccatctctgaccatgagcatgaaggtcccacccaggaatgctccaggaacgctggagcagcaaggcagaagaagcatgtccctgacagctgtgtgaagtggaaccacgagatcatccctagactgacctgaatgggctttcacaggagaaagaaacccttcctgtgtttaaaccattgtgatcctgggcctttgttctttcaattggactgaatcctaatggatacgctctcaatgaaggcgcatattgaagaagtaattacatgtgtaatgaaaatagaagtaaagagtgttttagaggctaagcatattgtctatgcattgtctgtctccacacttactactaattaagtggtagaaatgacatttttagaattcattttctttggctcagtaatttcttttctgagcatttatcctaagaggacaaatcttaaacacagataaaacttcttgcatgatgatgtctattacagcgttatttataatagtaaaagcacgctcactgttcaaaggaaacaaacacaaatttacattgcattgaatattgtgtaggtaataaatatataaccatgaggactatatagcagcatatgatatgcttctaagtctgttttaaaacagcattaaaagctgtatatatagcataactatacacataggaagaatgagaatatataaaaactgctgttattagttatatttgaatgatataattactgatattaaattttaattttgaagatacatcatatttaattttttaacattctaaattttctttaatgagcatgtgccagctaacataaaaatcacgtcaaaacaaacttaaaaaaaatttccctggctctaggaaactatcaagataaaatgaaatagggacagtaataaggtcttgcaattacatttaaaatagtaacacaaggttagggtgtctgacttacagtatctcagaggcctgacctacagtatctcatatgaaagaaacacaagagttttagttgactgtaagctcagtatgagttgatagtggtgtgatgtgactattaaaaaagctattcttaagtgatatggaagaataaccgtaaggttcaaaaaaggatagtaacaacctattgatctatgtactcatcaatccagttttagagcaccattatcagttcttggcaacacattttaagagagactttgactactgccacatgtccacaggagagtgtgttgaaggtatctggagaaaatattatatgaagagtcattaaagaaattagggatatttaccttaaatacatgttcacaaccaaggcacgttaattgacttcaaacatgtggcgtgtgctagaaagatcagatttagactccatagtttgagggatagaatcagatccaatatgaagcaaattatgaggcttttatgagacatgaagaatttaagacatatattgtttaaaatcttatttttaattctgtcttctttctatgaccctttgggcacatatagtccatttcctccttgtctattaatgaatatttgaatttttactaaaatcaaaatcctattttgacaagaaggcattagttaatacttttatttatgaaacaatataaaccgaaccaaaccttgtaaatagtaagagtcttattcagctccaagattttgttgctgaatctgtatctatctgaaataccacccagtcaatacctttaaagtataaacttctttcaatatattatcttttttgaacttagcaacaaccctgcatcataaagattatttgatttttgtcctacatatttgtggtcggatttttcaccatggttttgacttctttctccattttggtattctatttcaattgacttaatgcaaattctgccaatctctttgtggaacaaaggaggccacgggagtgcaggggaaaagactctcatattagtaaatcaggaaatataggtttcttcaaggccatataactcaactatgaagcagatgtgactagaactgagagcctctgattccaggccgatttctgctctctcacggctgcccctccaaactcctatttctctccttctctagtctagggttatcactatgaactagcagataacacagtaaatagtgatatggacaggaggcaaggaaattctgggtagaagagggtgcttccccggcaaaggcccccacctcaagcctggaaacctggtggccctaagtgggaataggcattcctgttttcatgctcaaatgttgccttttccaagaccactctggcctgccacacccctatcctgtgctcatataaaccctaagctccacaagcagaggaacagaacagcagcagaaaggtacagcagagaaggagaaaagagaaggagcatttgaacatcaggaggtgtttggctggggacagtcagagaggagattggctgtgggatggccaagctccaggggaagatcatcttcccactccatcccctttccagctccccatccattctgctgagagccacctccatcactcagtaaaatccccacgttcactatccttcaagtccatatgacctgattcttcctggatgccagacaaggacccgggtaccaagagggcagggtgtaaaaggatgtcaccctaactctccactgagctggtttaacacttagccatccatggatagcaactgctaaaagagcactaattgtaacacacctccagatgctactgtggggccagagcccagaagcacttggcccagctcctgcaccggcccatctgcatgccccatgtcctgtaagggggtgcgggccaagcaaatgagccacgcccctgtcacaagtcctgtgagggggtcagggaacgctcccatttcataaatagatctccagtaacctcatttaatacatcaatttcttggcattcttaaattctaagtaatttttcatcatgtttatgtttgtcttaacaacctcacttcaactggaatctacaaggtatgactaaagttcaaaaagatgggccaactagataggactaagttttctggatgcagagaagaaaattaccacccccatatatatgttgttcatgtctgttcttcaggaagtcaaatgtagtcaataaacgtgaccaagatatgtctgcccttcccccgacacacacacaactttagaaggatgctgagacatcacgttatctaaagagcattagataatctatataagcagttgtaaaactttaggaaatgcagtactactgaagtatttgtttttttgtaatgtaggtcaaatgattcttcaacccagaggtgtaggctccctatccacccctaggctgcctagctttccagttcaggtacttttatttgagaaaccagccatatttgactgaattaccatgctgaaatcctagattcttttcctagccctctcactctaactagcaattctctgagacagaaagtaaaaagacttggggaaaggcacaggccagaaaagacagcctcaatgttccaaagacatgccatatcccccaaccctacccagccaccccgagaaaacaagctagagcctatagtttacattaattgctctctggttagaggttacttttctggtaggccagaggctgtttccaggagtacagaataaagccatcatcaatcattcatcagttacaattaccatttgcatccatttaatgacagcctgcagtagctaccacccatgaacagtccaaaatcagaaacacagaaacattgagagtgattataatataattgcctacaaattctctaacactatcaaagatatatgtctcgcccgttcatgtttcatttaatgagtaatacatgttctctcccccgcatatcacatgcctatagaggggtaaaggagggtagaatagcgcatggcaaccagaatatatgggccatcatatgccaaatttcttcagactagaaaaggcacaaatcctttggggtgctcattcctgggactgtggttttaagcatggtctctttttatgtatataaccacatgaagtgcataattatgcaaagctgccttatatttccattcatcttccactctgctcttgctcatgtatctccccaatcatcatcttcctattgctgttttttctttcttttttttttttcaaccgggctttatctcggcagtttttacatcaggttcttttcaaaattacacttagctttgacatttctacatgttcactttatccatgacaccttttgggtgtcatcacaaatactaaagctctaaagatggtcactgacaggaaactaaatgaccttccttttttcctgtattccgaaatgtctcctgcctcttttcataatcgtgcacacatgtgtgcatgtgtgtgtgtatgtgtgtgtggactcagaatcatacctcattggccagacatatactgaattggtttctgtttacttcttgttgtatcattcacatgcttatatactttctactctatacggcctagtttaaaggacttgaaccgtctaaacgtttgttttccaatctctaatttgaaaatgctaatagctattttatagggtttttatgatgagtaaataatgcctaagactgcacaaggcatttaaatctgcatttaataaaggtttcttcctcttcccctttctcacgtgctcaaataagtcaaagctttcttttatcattttttattttctagagacagggtctcattctgacgtgcagtggtgcaatcatagctcattgtatcctcaaactcgtgggctcaagctacaccggcacctcagtctctcgagtagctaggactacaggcacacatcaccacattcagctacattttttaaaacagatggggtcttgctatgttgcccaggttggtcttgaactcctggcctcacaaagtgttgggattataggcatgagccaccacatccagctaaaatggtaaacctttacctgaatatttatgtataacacaatttattttgaaaagatatatttaaataatataacacctaggtgatagcaacattattttgttgttaaaggatacaattctagcaagacttaaattgtattaattcactgtaataaggtacaaagacctaggaaaataagaatttctctagttaaatgatgcctatgtcacataggctggccttgctattggatgtataaatatagctaaaaaactttgtaagaaacttcatgttttgttacacttcatgcttgccattttaaaatcttaacacattaaattgaaggatggcatgggagggagaaaaggggagcaaaaaaaaaattaactgtcgagttacctcagatggatttaacataatttcttttgtttttatggtaaaagaatcagttgctgtttgcatcttagttgaaaataccctcaaggaacttgaaaactttggtcgagacaaagtactattttcggttcactatctcctcccctttctcagcccacactcagatctgttctttccctacaacgggtgctgaaacctctgtactcctcagtcctgttatatatgaagcagcataaaaattgccttcactggggtgtatgacaggcctatctttagcctgtaataatatgataattaggttccaggatattttaagtggaaggagaaggtgggttgctcagttgccaggatgctcattcctgcttccgcatgtagatctatattctccctcctgcctggaatgttcgttttccatctctctcacttgcctctttcactttttcgcctatttatcttagacaattgctaaggctcaactcaaaggccttcccagagcatgaccgtgatttctcctatacttatacttcttgctacctattttctgaaatacatacataactgtattttgctacatactgtcttcttcatctatgtagatcttatgtcttccaagtgactatgatgctcttcagatcaaacaggatgcatgagcactgtgcttgctaggcttacagggatgagtaatatttatattgatgtttcttagaacttgcaattttatttgacagggaaagatgatctctcatgccttcaatgttcagcaattggatgtttttagactgttgcaaaactaaataatgaacaagtaatgttaaagccaattaaaatggagctcaaatgcctatgtgtaagatctaacttgaatcaatttactgttgtgtattttagtttttttttttttttttttttttttttttttttttttttgagacagtcttcgctctgtcgcccagactggagtgaggtggtgcgatctcggctcactgcaagctccacctcccaggttcacgccactctcctgcctcagtctcctgagtagctgggactacaggcgcccgccaccatgctcggctaatttttttgtatttttagtagagatggggtttcaccgtgttagccaagatggtcttgatctcctgacctcatgatccgcccgtcttggctttccaaagtgctgggattacaggcatgagccaccgcacccagcctcaaattagtttttatgaacattatctttacagactttaaaatgctttgaccatgggtatgttataaaactagaagccatttaaagatattttatatagtaaaaatgggttaatacactcatcagcagttatgcatgattatctaaaggagtaatgggatttatggtacatcaattctataaatatatccaactgtttatacagcatttcttagaggtaacatgcaaaatgaaatatgcagaaaagaacttgaaaaaataccccttgttcacatattttgagatgcgacattagagttatttattcataagaatttcataatacattagtaagcatgccgcaggatattttggaaaagtaatgaaggcttaataatgcaaaatttttctccagccttcttttctaagaaacaaatgaggtgagactttcatttaaggctaagactttagctcttcctgttcataatctcatttatcacttcgtcctgtgcatttgtatatctgcttgttcttttatgaatctgctcccgctcctctgctagactctaagccctctagagacagatccaggatttgacccctttttgcaaggcctagtggcagagtgtccattgtaaagtacttgcacatgataagaggaataaaagcttgccagacagacaaggggaaaggaatgagaatgaatgtgaatgatgatctagttagcacctactgtctactcaagactgtgccactatgctaccttggcatttgatcaaacttattaatccgcacagctacgtttacccaaaatcttcatgcaacatttactgaaagcatcttcactccttggcagttttctccgcatgtccccagggaaactcataaacagatgaggacattaaatatacatgtggtactgtgagttctggattgtaatggtcggggtaggagtacaagggagaaaggctctttgaaaaagcgaggagctggccttagcgagagcatattggcaggtagaggagcagaaatatcagcaggaaggtgggaacaatttgggaggtgctggagtctgaaggcagtttgctgttgctggactgaaaagggcaaggcacaaaatagtgaggaatgagtatttaacaacagaccatgtcctaaaggacttgatgacctagtaaatgggcttgagcttcgtcttctgggtaggcaatgagcatccatcagctatttagggaggagagtaacaagatgttttggatagtttactctggcgtcactccctggttaaaacccttagatgattccctaatgctcttcgaataaaacacacacctcctgcgatggcctaccagttttccctcctgcctacctttttctctcatatccacaccaaattcagccactattccctgtcctaggtctctttactggtcttcagaagcgccaaggcctttgcattttacatttgttccccctctgcccagattccctttcctcagctcttcttgcggtgggttctttctcattctgtagatcttacctcttcaaagggatctttcacagaaacattattaatgggaccttcctccattattctatgtgttttgaatttgctaatttactctatagcacttatcatactgtctatcttgatagttacacttttgttatacttggtatattatcacttccctcccagaatgtcataggagcccttgaattcttgaatttgatttatcacaggcacgttagcacagtggtacctggtacatggacaccacttaaataaatgtctgtgtgtgtgtgtgtgtgtgtgtgtgtgtgtgtgtgtgtgaatatatgaatataatgaatatacttagaaggtgagttagaggaagacgcccagtggtagggtcagaatttgcatctaaggcttatctgactctaaatttcacctttatccactatccaaaatattcctctttgttttagagtaaatatatattccattcattcatattgtgaagcaaatgctatagatgatgactcagcctacagacactgttctcaagacaaaaccaaatataaaataagtaaaaatgcatttaacttgcctaagagatacttttgtgctatgaaagcatatatctatctatagaactattataacacaaagaatgttttaattcttacatggttaattagcaaatctggggaaagatacggtgtttccccatttatttctcagaaaagccttaagaaagacaatagagaaataacctccgtgcaaaaaaagctatttttataatatgtcaaagcacattaatatcctctacagcattttagcaccaaaattaacaagtggaatttcttaaataaaattaaagtctgtcttatacaaacttaggctggttttcttttgcttcctttttatattgcttcatatagtatttgtaccctaccttgggaaatatatgcaaaattctctaaaataaatttgatatactaaaatgatcttaatttactacatacgtctagatccttttattctatttttttaagtcaggtaatactctataccataagctaaataatatacagcaattaaaatattatgtatttcccttaagacaaagaaatatatccagtcagaaataacttcctatcaggaataatgggtgaggataatattaaaggtgtaacttccattttgaattcaattcaatttcaacccctttttaatgatataagttctcaaatattataatagcatgcttcaggatcatctgagattcttaataaacatgaacactggcaggccccaacctatgtgatgtggcgctcagatatatacattttaaaagtacttcaggaaattatggggggaaatgggggtgatgttttacattttctaaatttctggagctctaccaaaagaaaaaaaaagattcttgggaagatacctaaattttatagtacctatagtttatagcacttttccatccattatttcacgtaattttcagtacaacagtaatataggaagaagaggtataggtgtgcccattttaaaaatacaaaccaaaattcaactgactatctttccacatttgttctacttactagcaaagtacagttatatttattcagtcaaataacaaatatttgaagacctgcttttgtgccaggcattgttctaaatacttggaataaatcagtgaacaaaatagataaaaatctttccctcatggtgattatgttctggcagttggagacagatatgagcagtagagataataaatacataaataatgaaactaatattcattccaatacgatctattcaaggtaaccagaaagtcatcttacacagattatcaaacaaatttttgaaacaaatgggctatccagttcatcaatttaataggaaacacaacactcctttgccttaggagtctaggtaatagagccttaagtacagcaacagcattttgcaaatatgcaaccatttttctatgtagcaacaaagccttactgtatgtacacagctaattctaaacacatacacatcttatttcccttgtggctacattatctgaagtgcagaagagaaacagaatccacattatccaatctattctgtagatggcactgcaggtccaacagtgggcttggctcataagtcttgctatcactgtcgggctcagataagtgtcacattgaactgcaggaaaaccacattcattctaaaagcagaaatcactttgcaatggcaaccgtcttatacaattgcaggacacaactccaatttgtaatttatttgaaatttttcttataatgtattaggtcccacaaaggctgaactggtgaaatcattctgtttatcttgtagcatctattttagtttattgccaggaatagaataatgtctgttccctaaagtggaaaaatgtttcattgataaacctatacattataaatcattcctgtgggctctaggtctgactaaaccaaaggcatgctttttatggcatttgagtttcacttcctaccccaggaagttaagtaatattctgcagggaggcagattaatgtccgctgaaggtaaaggatgaagggataaagtcagaggtactgcaccacagttggactctaatgccaaggagggtgagcctctcatcttgagccagagcaagagctgctggaagtcagctgaagtatctaagaaagagaaaagtcaggctttgggtcctgaaacccagacttctattttatcttgtattgactgatggattgattaacctttctgcaggggtcactaatggcgaacgtaatgcaactatagaagaaggaacaaaacaattcaaactatgccataggaattggactagtatcttttcccatacacttgaattacacttattttttttttttctggcaaaaaacaagttctagcccagaaaacaagtcatggttgatcagacattcaatcgcatattcatcagactggcttttctttacaggtacatcctgaaacatatatagttgggacggcaattctaagcagtttattatcatggcaagtcgagtgtcaagttgaagtttctcaattaaaaaaaaaaaattctagccaggcacggtggctcatgcctgtaatcccagcactttgggaggccaaggtggatggaccacttgagatcaggagttccagacctgcctgggcaacatggtgaaatcccatctctaccaaaaatacaaaacaattagctaggcatagtggctcatgcttgtggtcccagctactcaggaggctgaggtgagaggatcgcttaagcctgggaggcagaggttgcagtgagttgagatggctccacgtcactccaagctgggtgacagactgagactccatctcagaaaaaaaaaaaaaaaatcttagatagctgagaaaacccagtcctcctacagtcctcaccctcttggctgtttctgctctgtgtgaaactgtgccatgcaggctgtactgagctcttgcagctgatgaacactgggtcgcccaggccaaggcaatagctactgccatggctactctctcttgccttttgtctgagtcagttactttaagagactgacaggagaagatgaggtgttctctttctctcccttccttagcgtgtgttgcttcaagcagtcactcatatttcccactcatatggccaactgaaccttagtgacttttaccaagagtgtggaataatacagagacagatgcttcagatccagacgcagtctgagggtgctagaatgatgagaaagccaggtggcaatctgggcacacagagaaagaaaggatgtaatacatcagtcctgacccacagttcctcagctcaccacaattattttatttttcaattatcgaggaattgaggtactgaaaggaatctgacaaagacccagggctcttagagtcctggggggcaacagcatggatcagaaaaccaacagactgtcaatgcaatgccattactcttctttttctatagctcaggtttcagtgcacggctgagtggtttgccttaaagaagtcacaaaatttactacaaggtcaatgcatcatttggcataataatttcagtaactctaatatcacacatgatgtattttaattgagaaaaaatcaaaatgacaactttttagtgaggccctgattcagcactcattgttctgtgcattcacagttggcggttaccaagggggggagctgtccaagaggattctgctctctgccctccagctaaaaacaatcctataggctactggtacaaattaacttagacctcaagcatatcaattattatttgtctcaattcgtgtcttttgtaggcaattatttgtcttcatgcttccaaggattctgttaatccacgttgtaacacaattctcagaaaaaagaaaacttacctacaggacataggaagttatgcagaaaataattacaaatgtaatctggatgtagaaagaaaaaaaaggaagcaggaagccaaaacataaattctaatctgtaatttaaaaaaggaatacccttaatatgacagcatagtgaacttagaactaaataatcatgatttttaaaagtcacgagacaccaaaattagattgggggaggaggaacttacggattttttgagggtggggtggggaatgttgtaccactaaacagctatttgttttctgcagtgaaaatcatgtgatggtatataatctattttgtttccaagaaaacaagtgaatagttaattactctagacagaaacataattgcatgcacatgcaatcacagaaaacagctcatctacttgccactccttggctaataataatttagtgatgggcatgtaagttattatggtctttatttatttatattttgctagggctgtggctcccttcctggacactagccattttgctctgtcacagtcataaggaaggggttacatatgacatgtcctctggctaaaagctgtagtgtgggttactaaagaaatattaagagctccatgtaaagaataggtttcttttaccactgcagttaattgacataaacaaatgtttcctttcaacagaacttgtccattttcagtcccatgttctatgctccagtgcttttccagactttgagacggtattgcctctcaaatcacaaacatgttataaggccaggggtcataaaacatatatacgatgaacgggaccacctagactgttgttcaagaatccatttgtgaattcttagggaattactgggttctgtggagtgatatgaagatattaaacgctcaggattactaagagatcctgttacacgaaaacagaatgatttcatttttgtggcccaccttactctgccagttgcacctatgtagctgcacaccttatgtaggccaatgcatgagcacagcagctcagctttcagagcagccctctcaaccttggctgcacaggaaacacctagggagcttttcaacaaacaaaacaaaacaaaaacccagcatctaggctacacctgagaccaattaccttgaccctcaacatgtggcaccaaggcagcagtactttctatagactcccaggtgatcccggtgcacagccagggttgagaatccagctctaactgcatttgcttcagcaattcgtgaggaggtatcaaagaaggtaataagaaaaaacaaacaaacaaacaaaaaaaacccctggcccttgggcttattagaaagtcatcaggcaactaatgctctgcaaaattctcttcaagcatgtctgaaaagaagaatctctccatagcagacttgtgaattctgagatgctggtcaaagatcctaactctacagtaagtaggagtgtatgagtggtaagcacatgggctttggcagcagatggccagaggaaaaaataaatcccaactccattgcttataggctttgtgatcctgggcaacaaagctaatatttctaagcttctgtttccccacctgtaaaatagtacttgacactattagattacaggagacaaattcacagaaagcagttggaagagttgctgacacaaaaggaagcactcagtattcacttcatttttatgagctattattttttgcaggaaaaaatagtccataaataaagtgtgaaattcatgtacaatgttatgaacttatttcagtgattttaaaaatcttacgtgataaaacaccctatgtgatagcatttgtattatacttcagacggaacagttgcttatctatctttatgctttaagattctaagtaaagtttggtaagcaaagccttctgcagtttaagaaggagtttaaaatcctttggcttaacatcattaatttactcttattgcatagatttaaaacacatcattagaaatattttggggcaacggaattttctacatgaggcctctctgacaatgtgaattagatggatgcctgctataaatgcaggtaaagctacatggccaagtttttggctttcatgtggtttatgaggcagttttgtttggcactgcactgaggaaactctgctgacagtgatagtgatgctgataagactaaggcacagattttaactgaattaaaaccactgggaacatgataagccttgactagcacagcgctaaacgtggccttgaatgttcagaaactttacaaggctttaatatttaggggaaaagtttgatattcagttccagtggaaatatcctaattcagctgtccatcacactctcaatgaagatagaagtataatttattattgttattacattagctggtgactggaaacacattaccaatgtacaaattagagtctctaatcctaaggtaattatcagccaatttcagagttgttaacaggattaaaattatgaatacattagctgattcacccttgcaaatcaaattttgattagataatactacatgctaatatgtataacattcaaatgtcataaaaggctttttagtataaaaactttgataaaatttttcaataatgtatgcaaagccagggagagggaatgaatgattgatggtttttccttataagccttattaaaggtcctgatttggttggtctccaactgttttggctcagaattaggaattctagttttgatgacagctcgtgtgcactgattagaaaaacatctcacagagctattaataaggcaagttaatcactagaagcataacagtggatggaaaatatttcatactgaaagttcttgaagatcctgcttttcagtttattacaggatatatcttcttaaagaagcatcattgaacagttagtacctacataagtacatactaactcatttcacgtaggtgctctgtgaattctacctgtaagcataatccttctagcaacagtaacaggcagtgtaaaatgcagtcaggtgggtgagtagttggtgagtatgtaattgtgacatttttctaatgtctaaagaacttcatttgtggtacatctggactttaaaatacatcacttcaccttaaacaaaagatcgttgggtcatcaggtttggtcagaacaacagcacagaatatattacagaaatgaagtcttaccacatcccacaaggagaagagacgtttgcaattttgtttgttgggaacaaccaagtaattccacaaatcataaccctgaagacagaacatccttatactcccttccatgtaagcagacacagaaggtgaatttggaatttcaaaggtaaatgatacatattgaaaaagatgataatacatttaatgtagccaaaagttttaaaaattgtgctcaatagatttttctttttagaatgagtaagaaatgctttttttgagtgtttattcaggtaactgagataaggttctagtttactatatggtctgattttaaaaaggaacaaaaaatctatttactgtatctttctgtaatacaacttgtacctgattccagaggcatctttgttaaacgcaaaggtgagcatttccccacaccccggcttaaaatctttccccattacctaaagagtaaatccaaacatcgtgttacggtacgcagggtcctacatgagctgatcccgccaatacttctagcatgcctctcacctttccaccacctctacttgctatgccagtgatgtacatatcccttacccatcaggacatactctgcaaatgctgcaccacgttcccagaacgtgctcctgtttctttctacagtgctccaaaagatttctaagattatttaattgtgacatatcactgcatcccaaaagaaaaaaataatgaacttttggcatcaatggaaatattcaactatggggatatatgcatttatacataagttacacatatttaaatcctgtgtgagcaagcatgtgtttttccagacttaacaaacaacaacaaaacttatctgtcttgatcctattcatagacctaaggcaaaatagaaattactgtaataacaaactcatagaaatacatgagcataataacagactgcgaatagatttagtatttttccatgttcagaaaaccaagtcagtgtagctcatatccctacccttcttgttttatggttcttggcaattcttttgattatttctgttctcaggcagggctgccaaatccttttctcagctccatctactccacagttgaggtctcttcggttccagctcttgctctgctgccaagctccccttcactgccttggcatcaaagacgaaatgtggccaaggaaggaagctccctagccatcagcatgtgcagggcaaatcggaatttccttaaatccttctccttaaaaagatcaaagagagcatagctttgcatcttatagtccttttattgagagtttgtttctgcttctattatgtctgcctcctcccctggtcctttttctttatttcttcaattatgtaagcataaagttggtttttaagtatgcaaggacataaaataccaagatttttagtgtctgtgctggccagaatgaaaattaagagatctgatgagagctgaaataactgagttagtaattctgataaatatcctgaacatacactatggtctacaattgagtatattgattcttagaacttacattgctgtgccacacagtatccgagaggttggttaaatgttagcatgtattttaggcaaaaggtcagcaagtttctaacttttaagaagtttctgcaaaattatatcagcctccccaaaggccacccccactttttttttttaaatgatgtaatcagaactacttttcattctctcagggatccatctatcttctgataaacttcctatctacttttccaaatcaatgtgaccagtgtatactttgattagaatttcctgttttagaatccattactttaaaaacaatttataaaggcaaaagattgtgggatttgttctcctcaaaggtataaagcacaaagtgaggcattattaatacttctgaacacacgtaacaaaagaaatcattcagcaccatttcagcatattccccactcaggagattcatgcatatttaaatgaattaatttattttctgcaatttgctctttaagtgcttaagtgctcatttgctgttgcttatttcaagattctgtgcccttgttttctgagtcaccaacttatagcttgagtgctccaggtgtatttatgctcccaaagtattttaaattacccattaggaaatccaatttcctatttataagactcagaagtgattttccactgttacctttttcttaattaagaatataggcctaaattcacagctaagtttttggtacaatatttatttattggctctatgacagtcaatattatagaatgtcaccaatattagactctcagtcacttaagatgggctactcttggattctattgggattgacattttgggtatccataaaaatcatcaccgtaacaacatccactacttacactgtgtgccaagcactggacatgctctatctcatttagtcctttcaacattcctatgaagagttattattttctctatcattatttgttttacagatgagaaaatataacttagagaggtgaaacacaaggtcacatacctagcaagtagcagaaccaatatttaaagcccgctccgtcgtccttccaaactttataacgatccatttgtgtctaaggcatgtgattgtgttttggcaggtatagaaatgactgactgagacccaacttctgcttttaaagacactcaataatctcattcaataatttcagacagtgatgattgcaataaagaaaacaaaacagggtgatgtgctggagaagctttgttggtgggttggtcatgctaatgcagatctggttattagaaacaacctccttaaagaagtaacatctaagctaagactcaaaaaatacaatgtgggacatccactgaaagacaggaaaaatggtattccaggcagaaggaaaagcaggtacaaaggcctaaggcagaaactgaaaggtcactgagactagagttaagtgagtgaagggaaactggcacctaggctggggaagagagaacaaaccaggtcatgagatgcaggcaagagtgtggcttttatgctaaatgtgaaggaaagccattagagggtgccaaactggggagtgacgtaagtaagttttattttggcttcaaaaagattgctctggttgttttgcaaagaatgattagacaaagtgatcagtaaggaaggagaccactgcaggattccatggtagagatcacctagactaggatgggactaggagatggagaaaagggaagaatgagtttaaggatttgggtttgagctgttgggtagatggtggtttactgacatggggaaaaccgaacaggtgaggcaaaaatcaggttgtcgtttatggtcaccgggttagacaaggtttttaggcattcattcaacaaagatttactgaacaactcagtgctcttgagggcactagagataagttgttaacaaagcagatgaagtttctatgctctagttagcttacatcccaggaatcttggtacaaatggaataatcagagagggcaggaagggaactatgtatttgagaaacaatggcatttagatgtatttaaagccatgggtcatggtaagatcatttagggagaatttacagataaaaagaagaaaaggacccaggaccagaccaagcaaagggacattttttattgagaaatggcgtacgcaaaacatatttgatgacttctagtttaaaaacttgtcttttttttgaaaatactgactgacatggcaaagtgacctcccctctatcccctattgtatttttagattgcttagatacaagtacaagaaatttgttgatgcgctactctcattttcttcttccattcaatacccttttgcttttttttttttttaattttctttttctattttttttttcgagacagagtctcactctgtcgcccaggctggagtgcagtggctcgatctaggctcactgcaagctccgtctcccagattcacaccattctcctgcctcagcctcccgagtagctgggactacaggggcctgccaccatgcctggctaatttttggtatttttagtagagacggggtttcaccgtgttagccaggatggtctcgatctcccgacctcatgatccacctgcctcggcctccgaaagtgctgggattacaggtgtgaaccaccacgcccggccaatacgttcttgttttctttttaaagagatagagtctcactctgtcgtccaggctggtgtgcaggggcacgatcatggctcactgcagcctcgaactcctggactcaggcaaccctcccacttcagcctcccgagtagctggaactacaggtgcacaccaccatgcctaattttttgtatttttgcccaataccttctttattaaaaattcattcttttggccagggcactgactcatgcctgtaatcccaatactttgggagaccaaggcaggtggattgtttgaagctaggactttgagaccagcttgggccacatagcaagatcacatatctacaaaaaattatctgggcatagtggcacatgcctctagttccagttacttggggagctgaggtgggaggattgcttgagcctaggaggcagatgttgcagtgagccataatcgtgctaccacactccagcctgggtgagagagcgagaccttgtctcagagaaaaaaattaattcatcagaaaaattacacagaaaacccaactaactataaaacttgaaccatgaagctctaaataatttgtgactgccataacaattaatggtaaatctgtaacagcagctgaatccatgagtcaccttcagatgagggggaaagcacatacaatttccataacgctgattctaactccacaggtttcttttcagttcaaggaagtacactaaattgacagtgagaggcatgatttttaggagtaaattttaatctgctttaatgagtttttaaaaactcagtcaaaatcatgagtacttacacttagttacagagtacttggggcctaattgacaagtgattgagacatattgtggcacttgagaaccgctgcccaagggcaggcttgcccacagtcagggcctccagtccactctgcccactatttcctactacaattctgctagagggaaattcagaactgaaaaatactttatgttcaacatagtttagtccatgttgtggttcaaaatgtaacccactctccttgataagtattttaaactttctaaatcctacccttaacccagtgccttatccccgatgctgtggtctctgtcttggtaaagactcttgccacctatcagttctgtcatctctgagtgtcttcaccttcatacctaactcatcatctctcatttcgttgtctctactttcaaaggtggagctaaacacacttttctcgaagggctcccatccccagtctgaattccatcttccatcttgaggaataccacttccacacttcacccatcctttccccgtttcttccatctctccctggatctctggagtttcctggtccttttgatctttcaacataagtagactcctttcatcttggacataaaggccttcttgataatgaagccttcacatgtatatatcttctcatatcactgataaacttctttttaaaagtttaatttcctgccattgtgctttcagtatgtttttaatacctccttaatgaatagaaatctggcttctgttcctactatgctattactcctctgcatttttaagagtgaccaatgcatttctttagtaaaaatccaacaattttaatctcttttacataagatccaacttattaatccctctttcaatgatagcttaattcttggctaacttcttcctggcctgctcaccgttcactctttgccttttgttttttatataggatctgctatttttttttttttttttttactaatctgtaaatatgacagtttcccagggctaagtaacccctttagttacttcttctagttaacaatgacagagaaatgtgtaagatctgaatatttaaaagcagcaaccctgataagaaatcctattattaatcaatgccaattaagcatctaatattaaggatttactaactacgatgagcaaaacatgaagggcctataaactaaaagagtatacaacctagttatgtagataaaacatacaaaataactggaacaaacataaacccaccttttacatatgtgtaacaccattacgaatgcctgttggaaacagtagagtaaggtgaactaagatttttctgttttctttctttttgcaaagcaaatattacaagtttcatgaatgaggacacaataatgcaagaaccaatttcatttgcctttgtttttacaatgatgtctgctctcaaataagagttctgtacaattttcagcatctaaaaggagaatgaatctaaatgaaatgctttagaccttgactcacgctcagagcagtaaagaaatgagtcagaaaaaaacatcctagggagcagaggatgcatttaaaactccaaatcccccgaaaggcaataatttccaaaaattcctccactgccactccctaggtaagcccctgtctggacacacacagagacacacacacatacactcactcagactcaaaaaccctcttttgtaataggcacatttttggatcgtattactttaaaccatatcaacttctggcagggtttgcaagtatttttacccttaaaatggaacttatccttcattcttctaattgctttaaaagttataataaagaactcttgcttgaacattttttaccatagcacaattagttccgtgtcccattacagaactcgtgtgggtaaaatgcacttgctgattttaaaaaggtggttaattacataaaatatgcaaaggtactattctggatgactaggaggggacacagaagacaagcaccaaattcttgaggcaaatccattctagtcaagggaataagaaatatacacaaataatgatgctatttatatggaagagttacatggtatactttaggaattcaaaggaaagagaaattgcatttagttataaaagcttcatgaaggatgtgatctgaaatggcccttgtagatgagtaacatttgtgcagggggagacgttaaagggagaacacattctgagaataccagggggtgaggtcatgtattatggggaaaatggaatatgtgttggacctcaaatgcttttaataggctctcaggaggagaggataaaatagtacaattctattactgagaataaagaagaaagactaatgctagagatgaaaaagattttgagatagtttagttcaaagttactcattttaaagaaagagagctacatagtaaggataggggagaacagagcgcatatttatatcaccattgcagcagcaggggatgaggaggagaaggctgccagagctagctctgtcctcattcactttgtcctacaagcacaagccagacttctcctccctttggtactgcacccacctatagggaatgagcctcatttattaaatttatatggtagttggcatgtaccatggcagcaggaaatggcatctcttcactgttatctctagaaaatcagcatttggtgggatacaagttagtgaaaacaccacaagtttcaatttacatttttcttaattgtatgtcagatttcaattgtccacaatttgtttctctctcctggcagactttccacttgtacactgcacataactaatttcttaaaggttaagataaaaattagttatcatctgtagttgtttaagaaaagagagtctgaaagcattcttttttcctaagcacatgaagacacacacacacacacttttttcctaaacacgtttttccctttttcctaagcacattaagacacacacacacacacacacacacacacgaaaaaccggatttagagatagatagttgcgagggaaaacttgttaatttgaaattaaatgtgtccagaaaataggtgagtggcaaaggctgctgtgcttctccagaagtgaaaccttgcaattaagatgagaagacagcccaagtgtgacgctggcgctggagcggccgggggatctcaacacggctaatgaatcatcatcaaagtgatttattgactgcggccagagcttcaactctgtctcagtgtaaatgaggaataataataatttcccagtactcgcttggctgtgaacttctaaagagtgagaaccttcagcaggagatgataaactgtagtgatgccataggacgtcttcttccacaatgttcaaagccactgtcatacagtgaactacatctcataaaaccgacaagagacgggtatgcacaacgcgatgtcatcccaacacagcttccaagcaaaagtcccctgagtctcatcctattacagcttctcatggggaccgttcattgctgccacacaggaatgtaaggaggagagggatgcctccttagaatatcaagctcctgacatttaggatctggactcacgcgcttctctgtggcttcagcgaccatggttttcaaaccaaaagaaaccttggataccatctatcatcatatatacaatcagtcctctttgtatatatgaagaatccatgttacttgtagtaccatttaattcattagttacagagtcagactttgaaccctattgtcatcttccctcctcattatgaattgaagtaaacagatacatactttgtttctgctacattttaaggaacagtcaaggtataaattacatacagagaaggtaagttatatattatgcaataatctccagagatttttttttgtcaagatgtttaaagcactgatttgagtgggagctaacactgagtacacacggacacaaagaagggaaccagagacatcgggcctacttgagggcagagggtgggaggcgggtgggaggcgggtgggaggagggtgaggattgaaaaactgcctatcgggtaccatacttactacctggatgacaaaataatatgtatagcaaaccccccaacatgtaatttatctagagagcaaacctgccatgaaccctaaagctagaagtcaaaaaacaaaaaaaattaaaaaggcatggatttgttcttgtttttggctcttataatattctcaaagccagaggatctttaccctctcttgctagttcaatcctactcttttctctggaatggaaagaaaatactgtataattccctgacgcacccctttagcttgggaatttacctgctctccatgtaacctatgccttgattttccttgaagtatagctatatatgcatatagctatgcaaatacttcactactatttgggatacatgggtatatgtaaaaggtctctgatgcagatacttctattttggtctccataatgggcatttctccagtttgatctcccctccttttaatttaaacctagtgttctccaaatatttttagcttttttacagtttgatctccaaacaatctagaggacaaagtggtggctcactgctgaaaaagccctgcatgcagtgtaaacctcctgcagccttgtcttcctagctctattaacattgttctttttcaccctttaatctttagacactcaaaaacactgttttaaccatttattcccctttgtggatgctaaatatatcttttttcttccctcgaatccttaccacaaattcttggagaaccacgatgaatgctaacaatttataattaccctagaaatcagatatcacagtaagcctaagttacacttaaattacacactacaaatctactagcttgtgcacttgtggttcatggagtggaaaggaatctcttggatggtgcctgaaacctgattttaactgctaagatgtttgctatcttgtttgtctttgagccggcccaatttcagaaaaatttcattgtcatttagaaaaatgacttggaaataggctatttcactactaccacatccaacgattttaaaaatggttatgtaaataactaatgatgaatccattttatgtatatagaggactaggttagaaaatatgaacttagacaattcatctggcatcttgtgtctcatcttgttttctcatctataaaatggggatgataatacttcacatttaaaaaaggttgatattataccagaatgagaatgagtatagagatacaacaggtaggagatacatgaaagacttattcaagatttaaagtattgttatttggaaccagcagaaaattatatccagtgtgccattcccagagcaaaagtttattcacctgcacccttgattctttctctacaactcatgtaatcaccaaaagttattgctttcttgtctcagtgtattaactggatggttgaatgcacagagctcacatctgaatcagcacaaaactgaaacccagaggaggggaaatagaaagggagtcgggcttacactgaagtcattctcatcactcaacgtgcccacacaaatactgggaaatcaactcatttaaacaacttgggaggcaagcttgggttataataatgttcttgaatgcaggtcagtgaaaaattggcctgcacacaaattcccacttgtcatattctctacaaatgcacattgattgttttcatatttaaatgcccagaatcaaccacaacaaatgtgtcaggttgttgcgagttttttaaaaaacaaaacaggatgaactatggcatatggtaaattattgtgggttccttgtgctctcagcagaatcacaaaagggcaaggacttaagagaaatcatttgtgtctggttcaaatcctacaacatagaaaatggaactggagctgagttaatgaaatatattattaaatcccagtttgtagttggctgtgtgtcattagtcttatatgcctgaaaaatgtagtatttgcttacaagtagaatactatacagtcttcagaatgacataatctaaaaagtaatcttgtttttccgtgtatttttctctatagacaaataatatctcctgctaatcaaccccctccccacactttgccttcttcataaaagctaggtccgagagcttcccacgattgccagctggtgcaatcattcctcaatgctaatactcggaactcatcaaaggtggcagttttgtggtctataatccccaactgaccaaatctcatacgtaataaaaaacctaaacttgtattatatcagagtgtaggtatatgcgggtgtggaagggggaggagtaagagtgatagccatgtaagtagtccaccagcagtttaatggtgtatgtgtgctcagagaagtcattgataataaggacctttagagtcctgagactctgataacatgcggccagaaaggcaacaaaaacaggagggagaaagttttgactctttcttgttgcctttacagccacatgtttttagagtctcgggaattttatttccacatcagattgctgcctgttattggtataaagtatcagtctctcgtataagaacaacttaaaaaggctaaaaacagaaaagacatgcaaaaaggctgggaaacatatgtctaagaagagactggataaaacctgccacagagtgaagagtgagctctagcctaagtaaacctgctgacttccttcctggttctgaagcatcaaaatacacacgtggcaaaacttactacaattttggagaacagtaactacattgaatggaaaaggtagacctcattccctgttgagggcatcaaataaatcctacttgcaaaatttgttttgtttatgtcttgattcttaactgcaagttacctgaggcaagatgaatgacaacactaagtttttcaaatagaatacaattatataccgtttttatacatcgattcaattgtacagattcaatggcatataattgtattcaagaagtattattttagaaaatcactggattactatctgatatagtaggctgaataatggaccactaaaaagtcctcaattgtaatccccggaacctgccaatatgctacttacatggcaagaggaactttacagatgtgattaagtctgattaatctgattagtcttgggacgggattatccttggctatccaggtggtcctagtgtagtcacaagttccttaaaagaagaaggcagaagactcagagtcagaaaaaaaaaaaaaagtgacaccagaaagagaggtcagaaaaagagggagagagatttgaagctgctatgctgccagtcttgaggatggaggaaagggttaggagccaagaagtgtgggtggcctttagaagctggaaagggttagaaaaaacttccctcttgcagcttgcaggaggaatgaagctctgccaatgcttgtattttagtctcatgagactcatttttgactgtcctccaaactgtaaaatcatgactttgtgttgttttaggccactaagtttgtggtaatttgttacagcagcaatagggaactgataaatctgaaaacttacatcatgaaaattttaacaaatattgtcaatttttttcatctacctatcatcaaacaacacccattctaagtctgtctgttatctctctatctatttatctatcttcaaatatactgtcaaacataaaaaattttctacactgtaaaattccctctatgtcacgtaccccacattctgtatcttgcctgccaactctactttaattgggttgttcctgctgccttgctgacttccccagtttctctcttgaatacctcaacttgaagagcaaatctcagtattatcctgatactaaaaccagacaaagacatcacatgaagagaaagccacagaacaatacctgttaggaatatggatgcaaacatcctcaacaacatagtcagaaaccaaatccagcaacatataacagtaatgatacattatgaccaagtgggatttattccagggatgcaagtttgatttaatatctgaaattcaattaatgtaaaacatatcaatagaagttttaaaatcaaatgttcatttcaacagatgcagaaagatacaaaatccaacacactttcatgatataaccactcaacaactggaaatagcaaagaacccccttaatctaataaaggacatctatgaaaagcccacagttaacatcattcttaagaacagaaaactagatgctttcttcctaagatcaggaacataacaaagatgtacactctcaacacttttattcaatattgtacctgaggttctagcgaggacaatttggcaagaaaaaggaagaaaatgcatccagatttgaaaagaagtaaaagtacttctatttgcagaaatcatgatcttgtatatagaaactcctaagaaatctgctaaaaatccattagtcttaaggaataagttcagcaaggttgcaggatacaagataaattgcagaaatcaattgtatttctatacacttggaattaaacccaaaataaaatgaattccattcactacagcataaaaacaatactaaataatgtaacaaaagaagtatacaacttgtactatttaaaaagaacatgaaaagaaattaaatgagatctaaataaatgaaaagcattccatgttcatggattagaagacaacattgttaagatggttatactctccaaaatactctacagaatcaacacaatctctattagaatcctagctataacttacacaaaattacttaaatataaaaattaattcaacacagatccagaacctaaatgtaagcacaaaactgtacattcttaaaagaaaatgtaagttttcatgacattggatttgacaaccaattcttagatatgatgcaaaaagcataagtaacaagtgaaaaaaataagactttgtcaacagtagtttttctttttgctttaaagaacaccattaagaaagcaaaaagagcccacaaaatggaagaaaatattttcagatcatatatctgataagggacttgtatctggaatacataaagaactctaacaactcaatgattaaaagacaaatagctcaattaagaaatggctaaagaatctgcatgaaaggtatacaaatggccaagaagtacttgaaaatacattccacatcattattcatcagggaaatgcaaatcaaaaccacaatgagatatcacttcacacatgccagattggctagaatcaaaaagtgagataaaaataataagtgttggcaaggacatggcaaaattggaactctcatacactgttggcaggaatagaaaatggtgtagtccctttggaaaacagtctggaagttcttcagcaattaaagatacaataatgcccagaaactctactcctaggtatatacccctcaaaaatgaagacatgtctacacagaaatttgtacatgagtatctatagcagcattacttgcaataggcaaaaggtggaaacaattcaaatgcccattaattgacaaatagataaaatgtggtataaccatatggtggaatattatgcagccatgtaagtgaatgaaatactgacaaatttctacattgatgaaccttaaaatgttatgctaagtgaaagaagtcagtcacaaaaatccctatattacatgattcaattcatatgaaagactagaatatctagagataggaaatagagaagtagttgcttagggctagagcaaaaaggcatgggggggatgtgagggtgacagctaaaggatacatggtttctttttgaaaagatgaactttctaaatttgtctggtgatgactgtacacatattttaatacactaaatccaatttttttttttttttttttttgagacagagtcttgctctgtcgcccaggctggagtgcagtggcatgatctcggctcactgcaagctctgcctcccgggttcaggccattctcctgccccagcctcccgagtagctgggactacaggcgcccgccaccatgcccggctaattttttgtatttttagtagagacggggtttcactgggttagccagggtggtctcgatctcctgacctcgtgatctgcccgcctcggcctcccaaagtgctgggattacaggcgtgagccaccgcgcccggcctactaaatactattgactatacatgttcaatgagtgaattgtatgatatgtgaattatatctcaaaaaatgtttaaaaaaaacatatcatttcgttctagcttagtctactagaactagaatcaatgcttgcctcctagaagatcataccggtctgattcctcttgcttaccttggctcaaagtcatggccatgatcctttttagacaaagatagcatagcatagctctttgtgagacctcttcccagtacacaaatacggaagtgacataaccagccctttgtttccagggctacccctgacctctacttggaagttaaatggtattttgcaataacaaaatacacttttttaaaaagaccgcaacagcttgtgatccttaaaatatcatgagtgactgcaatttggtttgttaacaaatagtttttaaaaggtaaaataatggctcatacaaatataaaatgaacatgacagatattttatttaagtcattaattaatgagaaaacctgtaaataaaaaaaaaaactgcttcaaggagactctacaaaggacagacacatctacagataattgggaatgctgacatgagtttgctaatgaataggaaactggccaattctatagggtgagaatccactgcattttaacagaacaaaagctcatttgacttatacaaacagtaatcatttacattacaatcagccccttacaagttagcttctaactaaacagagttgtaaaataatcaaaaacaatgaagggcttaagtttcctatagaatcagataaccctgaaaggatcttttagagaccaggcctaacaatccatcagaagacattcaggaatctttctgtttcgtatttttcactgttcacttttattttaggttcaggggtacatggtcaggtttgttgtataggtaaactgcattttatgaaggtttggtatacagattattttatcacctgggtaataagcatggcccctgataggtattttttctgatcctctccctaatcccaccctcaagtgggccccagtgtctactgttccactctttgtgttcatgtattctcattgtttagctcccacttataagtgagaatacttcgtgcgttatttggttttctgttcctacattagtttgctttggataatgacctccagctccatccatgttaatgcaaaggacatgatctcattcttcttaatggctgcatagtgctccatggtttatatgtatcacattttcttttctttttttttaaaaaaaaaaaacaaacttttcttttaggtttaggggtacataatgaaggttatataaataaacacatgtcataggggtttcttttgcatattatttcattactcaagtactaagccaagtacacaatagttatcttttctgctcctctcccacttcccaccctcccccttcaagtagacatcagtgtctattgtttccttctttgtgttcataagttctcatcatttagctcccacttataagtgagaatatgtggtatttggttttcagtccctgtgttagtttgctaaggataatagtctccagctccatccatcatgttcccacaaaagacatgatcttgttcttttttatggctgcatagtattccatggtgtatatttatcacattttctttatccaatctactgttgatgggcatttaggttgattccatgtctttgctattgtgaatagtgctgcaatgaacatatgcatgtgtctttatgacagaaacatttatattattttgggtatttattcaaaaataagattactgggtcaaatagtaattctgttttaaattctctgaggaatttccacactgctttccacaatggctgaactaatttacacttcctcagcagagtataaagcattcccttttttctgtgaccctgccagcatcttttattttttgaccttttaataatagtcattccaactggtgtgagatggtatctcactgtggttttgatttgcatttctctaatgattagtggtgttcagcatttttttaatatgcttgttggccacatgtatatcttctctcgaaaagtgtcagttcatgtcctttgtctactttttaacaaggttgtttgttttttgcttggaatacagctaaccattcacaattgcttcaaagagaataaaatacctaggaatccaacttacaagggacgtgaaggacctcttcaaggagaactacaaaccactgctcaaggaaataaaagaggatacaaagaaatggaagaacattccatgctcatgggtaggaagaatcaatatcgtgaaaatggccatactgcccaaggtaatttatagatccaatgccatccccatcaagctacaaatgactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgcatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaattaatttgagatggattaaagacttaaacgttagacctaaaaccataaaaatcctagaagaaaacctaggcattaccactcaggacataggcatggacaaggacttcatgtctaaaacactaaaagcaatggcaacaaaagccaaaattgacaaatgggatctaattaaactaaagagcttctgcacagcaaaagaaactaccatcagagtgaacaggcaacctacacaatgggagaaaattttcccaaccttctaatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggctatcagagaaatgcaaatcaaaaccacaatgagataccatctcacaccagttagaatggtgatcattaaaaagtcaggagacaacgggtgctggagaggatgtggagaaataggaacacttttacactgttggtgggactgtaaactagttcaaccattgtggaagtcagtgtggcgattcctcagggatctagaactagaaataccatttgacccagccatcccattactgagtatatacccaaaggactataaatcatgctactataaagacacatgcacacgtatgtttattgcggcactattcacgatagcaaagacttggaaccaatccaaatgtccaacaatgatagactggattaagaaaatgtggcacatatacaccatggaatactatgcagccataaaaaatgatgagttcatgtcccttgtagggacatggatgaaattggaaatcatcattctcagtaaaccatctcaagaacaaaaaaccaaacaccgcatattctcactcacaggtgggaattgagcaatgagaacacatggacacaggaaggggaacatcacactctggggactgttgtggggtggggggagggatagctttaggagatatacctaatgctaaatgacgagttaatgggtgcagcacaccagcatggcacatgtatacatatgtaactaacctgcacattgtgcacatgtaccctaaaacttaaagtacaataataataaaataaaaaataaaaagatctctacaatgacaattgcaaaacattgctcaaagaaatcagagatgacagaaacaaatggaaaaagattgcatgctcataaataggaagaatcaatattgttaaaatggccatactgtcctaagcaatttagagattcaatgctattcctattggactaccaatgatattcttcacagaattagaaaacactattttaaagttcttatggaaccaaacaaatagcctgaatagccaaggcattcttaagcaaaatgaacaaagctggagacatcgcctgacttgaagctatgctacaagggtacagtaaccaaaacagcatggtactggtacaaaaacagacacatagaccaaaggaacagaacagagagcccagaagtaataccacacaccaataatcatctgatcttcagcaaagctgacaaaaacaagcaatggggaaaagactccctatttaataaatggtgctggggtagctggctagccatatgtagaagattgaaactggaccccttccttacactacatgcaaacatcaactcaagatggagtatagacttaaatgtaaaacctaaaactataaaaatcctggggataacctaagaaataccattctggacacagaatccagcaaagatttcatgacgaagacactaaaaggaattgcaaaaaaaccaaaaattgataaatgggacctaattaaactaaagagcttctgcagagcaaaagaaactgtcaagagagtaaataacctacagaaagggagaaaatatttgcaaactatgcatctgacaaaggtctaatatacagaggctataaggaacttaattttctattcgatttgatctatcaaatttcatcagttctaacatggatattttcctatatctgcaattataatcagtatattttttcttagtatacataaaataatacacatcttacaatcaatggcatcgtaaatgtgataaaatgcaatcatttcaccaactcgttaactcgagaaaagggtttgggggtggaagacctcagctagcatctattttaggaaggaccagaggggaaaagattgccaatgccaattttattgtcacctttgatctgtaatgcatcttttttttttctggaaaaatgttttaacatatttaattcaattcagagtaagttattgattatagaagacttacagtatgaaagacatcgtccttgactcagacaagaaatactgatgtcacagtttcagagtgtcttttttaagcactggtctgcaaaatcaataattaatataataacaaagacatctaaaaacacaaaacatctcacacattagtggcactagctcacaagaggttataacctaagtgggaatagctatagctatactatgacaactgcctacaatcactttgtgagttgcagtggagtgagaattaagagcatttctcactgaaaatgcattattagcaagtgtaattttacagatgcatgaactgttcccttgttaggctgacacttaaaaattttaatagaaaactcctgcagaaaaccatggtacctgtatatgcttattacagcttttttattttcatagagatgaaaaatcttttcaaactgttttctcataatttctctctttcaaaactctttcccctaggttaaaagagttgagtctcttttagtcaatgctgagaagttatttccttgtaatttacttctatatttctttgaaagaaacgtaaaagaaagaacaatgaatacataatttcaatctcaatatgagtgctatataaaggggcctgggcaaatggaaggcaactccatttaatattttccttaggcaaaagtgtagaaaagttaaaagttctgtccgtcagaatttcacttttcttgccattactttccattctgtgccattatcttctctttcatatcacctttgctttcccatgtagttaccttcctcctatcttctctttatcccaaatttacattctctttattccaaatttaaattttttaaacatcaacttattttatataagtccttcacttactaattggaaagaaagataaatagtattgaagacttgatttcaaattttgagtgcattaatccataattatgtaaatttaggacaattagagattttaattactatttccatatctgaaaaatacagacaatccaacctgtcacacagacctattgtaatatttaaaagactctttaaaaatgtgaaatatcatatgaacattaatattacaattctgattattgttcccatcctttgtgaaaagtcaaaaacttctggaaatacctcaaacccatacatagagtatactgccacttgactgtataggtattacatggaatatcaacctaaatacaccctgctaaattcaccaggattatctaggaaggaaacccaactttgagctattaacacccattaacacaaatttataaatcagattaagtagctatctcctggcaggagactgaaagactggagtagttttagtaaattattgaagagaatctttgttctgggaatatgtagagtatggaacatggctgagtagggagacaaggggaatggggaggatgaagctatcatgaggcagaagccagtgtgctgggttctgaaaaatatacaagaaggggcagaattctagggttaatgattaggatgagcagtggctccatttagaacttcaaaaatcagtgtaagactggaattcagatttcccaaaggtgaaaatatgagtgttggaatgtttacaataatgatttgtatgtttccatgagttaaagtttgaatagagtcacttcaaaatataattgtggcctctgaaaaaccttgccagagcctttgctgttaacttttccccttcagagggttccctgatgctactcttgtcctactcaagcaacctcaactaggagatgtggaagatttccattctggccatatggtagcccatatatcctgaaattctcctgataccagactcttagacataatacataacttattataaatgttctgtaactaacatgctaagctcacaagaaaataaactcttcagtggtataaaattgaaggagctggaaaacagggcacctgcacagagaatgttcgcttctttccttaactaagatgcctttcttttcagatacatgtcaatcaagagtcaacatgttgggcctcgataaagtagagttaggactgaggttctatataaattcactgctacgtctttaacagaagggtagacttgtgtcttagtctgtttgggttactctaataaaataccataaactagatagcttacaaacatcacaaatttattgctcacagttctggaggtggagaactgcaagatcaaggtaccacggatttggcatctggaactccagatccattgcctggtttatagatggtaccttcttactgagtggtggaagaggcaagtgtctctctcaggcctcttttataagggcattaatcccattcacgagggttcatgatctactcacctcccaatgtctcctcctcctgataatatcacattgatgattaagtttcaacatacaaattgggagtggaggcataaaccttcagaccatagcaactaggaaataactggtctgccagaaaaggttcggaacaaggaaacatctctctatcagcctgggctttcacagaggcaaaaactaaaaaagacacctcaattccttgtggttttaattaacactgaaagcgtcttcaggaaaatcttataccaaggtagctaagtattccaggattggttatacctcagggcactggcagaagcaccttaaaatctcatgtcaaagaacatgctcaacctaaccttctacatatttccacaggaaaaaaaaagacaaccacatatataaaacacaggataaagtgtctatcatgagtgagaataaaagaaatatttaaaaatagcagtattatcaaaaaggcaaaaaattaatagatgctggtgaggctgaagagaaaaggaacacatatactgctggtgggaatggaaattagttcagccatggtggagagcagtttagcgatttttcaaagaactcaaagcagaattaccatttgacccagcaatcccattattgggtatatatccaaagaaatagaaatcattctaccataaagaacatgtacatgtatgtccatcacagcactagccacaatagcaaagacaccgaatcaactgaaatcctcatcaacggtagactggataaataaaatgtggtacatatacaccatggaatatcacacagccataaaaagaacaagatcatgcgtttgcagcaacatagatggagctggtggccattatcctaagtgaactaacacaaaaacagaaaaccaaatactacatgttctcacttataagtggaagtgaaatgttgagttcacatagacacaaagaagggaacaacagatgccaatgtctagttgagggtgcagggtaaggactgaaaaattacctattggatactatgcttattacctgggtgctaaaataatctgtatataaaacccctgtgacatgcaatatacctatatagcaaacctgcacatgtacctctgaacctaaaagaaacattaaaagtaattggaaacagaaaatttgagactccttctcaaaaaataaaaaaaaggaaaatagcagaattaggtcaaaaaagagatgaagaaactagaatgctcaaataccatattgtattccaccaaatataagataccatgtattataataggccccaatttttaaatatctaaaaaaactcctatcaattaaattatgatttttaacaatctaatagattaaataattcatctcaatttctgatattttaaaaatctgcttacatatttaaaaaagtaaatatataattaaaatactggcaacaaacaagacgtgatcttaaattttttgagataaaaaagagtgaaaaataaaatctatgaaattcaaaacacaatcattaaatggcagattagaaacagccaaagacagaaacagtgaaaagaaagatgaaaacaaacaaacaaacaaacatagaatgcacaaagaataaacaaggaaaagggatgatgaggcctaatatgtttactaacagttcaaggagaaaagaatagaaaaaaatggaggggaagcaatcgaagaagataaacggctaagaattttcagaattgatgaactataccaattatcagaatgaataaaaagcaactagaacaaaagaaacgttacatgcaaacatattgttgtaaaactttagaatatcaaagcaaaacttaaggtctagaaaacgtgacagattataaacaaatcagaactaatttcattgattgtagattttttcaacagaaacaacagcaatccatatgaatatggctgaaagaaaactaaaataaattttttaagatatacatagataaaatgttcaagatgatgaatgaagcaaaggcattttttgacagaagagcagactcctagtcattctcttcttccctactgatggaacctcagttttatttggagtgacaatgtagttggattcaaaattgcacacgtagccttccttgaagctagggtggctatgtgatacaattctggccactgaggcaaaagatgagacacaggaagggtttctgagaatgccgggaatccctgatgtctctgattcccgttacagatccttcctgctcccttccctttcctctcttctgatgcctactgggcacaatacagctggagttgcaaaagacatcttagattttcaggcaaaggctgaggaaataatagaaaccttgccctgtaggtacttacctctgcactttgctacatgaggaaaccaacaaaaaggctttttttttaaagccaccatttcagtccattatagtaacttaattctatttgttacagactgcagaagaaaacttgattattaacagaaatacgattgtgtatagaaaaccaagtgagtgtacagtcacgttttcagatataattaatgttcatcaatatgttaacattaaaatagacaaaaatgaattatatgtctatatatcaccaacagaaaatgtaattttttaaagtataatttatactaggacacaaaatatagggtttatagaaataaaccttataaaaatgcataggatgtttatagagaaagttataaaattattgaaaggaatttaaaagttctaagtaaatagaaagctaaactaaatttgtggatgggaagactcaatttcatgtagaaatttccttccccaattttttgagtcttcccaaattaatctagacattaaatgtaattgcagcaaaaattataatagaattgtgtgagagaggcacttgtcaagttacttctaaaatttataaagaagagcaggccggtgtggtgactcatgcctgtaatcccagcactttgggaggccgaggtgggtgaatcacaaagtcaggagttggagacaagcctggccaacctggtgaaaccctgtctctactaagaatgcaaacaaaacaaaacaaaacaaaaattagctgggtgtggtggcagtcgtctgtaatcccagttactcaggaggccgaggcaggagaatcacttgaacccaggaggcggaggttgcagtgagccgaaattgcaccattgcactccagcccaggcgacagtgagacactccgtctcgaacaaacaaatgagcaaaatgccaggaatagagtgacaattttgaagaacaaggtctgaggactcaacttagcacatttcaatatttattataaagctatggtaatgaaggcagcgtggctccagcacaggaacaggtatgtaagccaatggaacaaaacagatccaagaaacatacccatacatatgaacacctgtgctacactgcaaatcactggagaaaggattaataaatgatgttagggcaattcattatctttaaaaaactagatccttacatcatatacaaaaatcaacttcaggtgaaagaaaagacctaaacacgaaacttaaatgagagtatctttatgaccatggggaatagaaagataacttacacgaaaatgactaaactgataaattttgactgcatttaactcaataaactctgttcatataaaaacaccataaacaaattgaaaagccaaagtacggccaggaaaaagaggcttcagaacttctaagaattaacatcccaatggaaaaataggcaaaagaaagtagcaattcacagaagaagaaaccagcatgaataataactacaaaaagatgcttatccttatcagcagagaccacaaaaacatatcatttacactcatcaggctgacaaaaatgattaagtttggtaatagcaagaattgttgacgatatggagcaggggaacttaatatgtattcctgggctgaatacacatgggtacaatcactgtgtagagcaatatggtgtatctcacaaaggtgaagatgtgattatctatgacacagctattttactgccaactgtatatatcctagagaaactcttgtacaagacacaagtcaaagaatattcatagcatattgctatgaaataaaagactgtaaacataggcagcttcagtaatatttgaaacgtttcactcctgggtgatcggtacctaggtatcagtcacacaattttttttttttaaacgttagaatggcatgtgaaatattgcgaactggtaacagataaatccaactacttttagaacttgtggcatcatgtacttagagtgggtggagataggtagagatcaagccacggggccgcacatgaggaccttgacaagtttcttcacaaaaacttgcttactcccattaacccaagaagtgagctgcccctgactaagtgtctgcatattctttctctttctgcaagcccaccttcaccctgtccctttgtagccatgactgacaaaataaccctgacctcagggctctttcacagacaacagcactgaggaaggcagggaccctctctgtgaatgaaatctacccacttttcttcaagtcaacatgatgtcacatttatttttattaacttttaatgaggcaatattacctatcagaagaccccatgaattagcgcttttacaacaggtaattgatgaaacactttgtatttcaactttattgctttgcatatgccatgaagttttttttttatttttatgaagtttagaaaaaataattacttcaaaagtcaaagtgatgtgtaactatataaataagtaatggcatattacatgcaggccggatcaaaagttatctcaggaaggttaagagccctgccctcatcatgctgaaggcccccttaccagagaaagccttacacagaattaggatgtgtgatacgatttgactccaggtccccacccaaattgcatgttgaattgtatgtaattcccaattgttggtggaggaacctggtgggaggtgacggaatcatgggagtgggcttcccccttgctgttctcgtggtagtgactgacttctcatgagatttgatggtttaaaagtctgtggcacgtcccccatcgctctcattctctcttgctgccatgtgaagaaggtgcctgcttccctttcacctcccaccatgactgtaagtttcctgaggcctcctggtcatgcttcctggtaagcctgcataactgtgagtcagttaaacctcttttcttcataaattacccagtctcaggtagttctttacagcaatgtgagcatggactaatacaatgtgcatactactgtgggaagtataggatcaaaggacattctaaagataacagaagaatcatgtctaacatatgactcttttttattactataagataaaggaagctggggcacctgctcctagtgccaacggtcctctttgctcagtgctcctttgtcttgctgccagccctgaaaagtgtgatcgctcctagatccagcaggaagttcatcactgtctagattgggtgcccttggaaataatgagaactagaaaaaataaaacagttgtttggggccagaatgttttcaaaaaagcttccaatgggagctcaggtcaatttcagctaaacagcttcaaagcctgtcacatatttctgtgcactggaggagatgtgttctcacagtcctttcaaattctgatgagctctctaaacatttgtttcaaaatatctctagtttttcctaattgtttctgcagtggctcatagaaaggtctttttacaggtctttttgtttcaaaatatttatttcttggaaaaaaatttattttcttgtgggaatctaagtgctttacttgttagaaaagaacgatacagttccatattttacttgtacagctttgccgtattggtcaattaggagatgatccctttgacattcaatcacaactctttgattaaattattactatccttagaaaggctagagttgattcatttcacaacgactgatggttccttttggaatcagcatttatctcatgaacaggacccccttactttttaatatttttaactcagatagttttagtactagtaggacctaatacagttcacaattactggaaaacattttaaaatttaataagagcagcaaatcttatgttaaagatttgactacgaaaataatttgctgcttctctagcaaagtaaagtaggtttttcaaatatacaaaatcgtgaagacggtggggcaaagagttctttggtatgacatcaaaaatatgatccataaaagaaaaaacatagacttaattaacatttgttaatttagttaattaaatttcagaaaatgaaaatatatgctaagggctaaaaaatttttgcaagtcacacacctgggtaaaggacttgtatctaaaatacataaaggactcttacaactcaatgtaaaaatagccaattaaaatatgggtaaaagagctgaatagacatttctccaatgaagatatatgaatgttccataagtacaagaaaagatgctcgacataattagtcatcagagaaatgcaaatcaaacccccataagatgccaccttcacatgctctaggataactataagccagaaaacagataataacaagtgttgagaatgtggggaaactggaacactcttacactgcacatagaaatgtaaaatggttcaggtacactggaaggtaatctggcagttcctcaataggttaaacatagagttatcatatgacccagcaattcctcctaggtatagaccacagagacattaaaaaaaaagaaagaaagcaagaaagaaagaaacagagaaaaaaagaaaaaaaaaaatcattcctttatgaaaaggttctacttactgaggttccacttgaggcctgtggttgtaacctgcatacaaggctgtccaacaggaataaggccacaccaatcaccctccattccagtgtctacatgcaacctgtgctttccctgaaggagacaagaaatgatcattaagaaggggaagagagaaggaatgttaatgtgcactgaagacctgggcaggatgcgtctacaaccctcacacggcttatcatacttaatcctcacaaaaaaatgtttgcaatatgtgctgaataatcctaggaaccttcacccgacttaatccttacaataattttacaaagtatctgatatcttattgttaattatgtttcaactatgagaaaattgaagcttgcagagattaacataggaccacacagataagggattcctacctacacctgccaattccagagaccaaactcacagcaataggactgtgggtttgaaacctatcctaaatgaaaggtaccacacaaagagaaacacacaaagacagctgcttctcagcagccattacaatgtattctgctttttttttttttttcttttttaagatggagtctcactctgttgccgaggctggagtgcaatgttgcaatcttggctcactgcaacctctgccgccagggttcaagcaattctcctgcctcctgagtagctaggactacaggcgggcaccaccacacccagctaattttatatttttagtagagatggggtttcaccacattggccaggctggtctcgaactcctgacctcaagtgatccacccacctcagcctcccaaagtgctgggattgcaggcatgagccacgacacctggccttgcgttttttgtttgtttgcttgtttgttttcctaaaaaagtttttattttcttttaggtaagagctgcctttattccttttgtatagaattcctccccgccccaagttgatttatattgaatagcttgccacacaaatttgagatttgtttcttcctaccattctccattatataaataattctctctgaagacagatatactaaacataatacaaatgaccatccctagatgccaaacatagcacacttttaaaacaagtgctcaaagaggtatcaaaaccttctttctaatagaaggagttgatgaggccaggtgcagtggctcacgcctgtaatctcagcattttggaaggctgaggcgggcagatcacctgaggtcaggagttcaagaccagcctggccaacatggtgaaaccctgtctctaaaaaaaaaaaaaaaattagctgggtatggtggtgggtgcctgtaatccaagctactcgggaggctgtggcagaagaattgcttgaacccgggaggcagaggttgcagtgagccgagattgtgccattgcactccagcctgggcgacagagcgatgctccatctcaaaaaaaaaaaaggagttgatgagacagatgttttagaaattcggatttccttagcattacattagcttcagcagataaggaacaggaattggtgacgacttatcatgtaggtggatcgccacccagtttcctgttgaagggcagtactcttagggttcccatcagaaaacacagcaatttcagaggggttataggtaacctgtagcattctggacattttgggggcagagagtggagggctcaagagagcaccagtggaacaaggaaaggaaggtacaccttgtccagatctctgtacttctgcatctgataacggtgtttctgacaatgagacctgttgttagagtgcgacttctccatcacttatcaaagaggaattcctgtgttcttgagctatcttattttcagtgtgttacagttagttcttgtctcttaattgatgattttctttcctctgtctgtggccggcttaatggtttggcagtgcctagctgaatacgttagcatgtttggtgctcctaggtgacttctgttaagaatggcgaaggaaagaaggaagtgtttttcaatttgtgatattaactccctaagagagtattcttcaacttgtatcgtataatgcaaaggaaacagcacatatacatgctaagttttattctcccagggagaggagggctgttataaaatccaatgatttaaatgacatagtagtaagcatgctatatattcattgccttcctcattattttaaagaatcagcaggccttaaaattttcagtctgggaataaactcgtttgtggacttgagaagtcacagataggccttagcccacaatcaattaaccatgttttctcttgttccaaaaaggtgcttagccatatgtgaatggtctttgtgtttataaaaatgcaaatacagtttttatggttaaatgagagcaatattttcctcctgtatcttcaagtctatatgacatcttttgaaaatgaacaactgtataaaggaatttttgttcattccccagatttcttaattcataatatgtgctagcctatatgtgacttgacacaggcaggcatacacgctgacattaaagaacttccctatggatttatgccattactggagactagaggcacatgaactcatcatttacttccatcttctcccatgaatcatttcacaggttcctgctctggcctcttttccgaactaagataactctttgaagtcaaagccagccctatatagtaaagaaagaacaaaaatcaatcacagtcaggttgcttttccaattgtggttattgcaacacatctaacaaccttaataatatgaaattgtaatttagggaaaggtaacacagatgttgcttggtatgtgtgctggaaagcatacctacgatcatgtgaaagacaaacagcgtaacagtattaatttccctagactgtcatgtcagggtagaacaaaatacacacaaatatgaaggggtgagaaatcgctgtccctttgttttgtattataactccactttccaaaggacaatgacataactgagagaaaagattaaagctgactctagattttgcctttgaaaaataccaaacattgacagggcatggtggctcatgtctgtaatcccagcaatttaggaggctgaggtggaaggatcacttgaacctaggagttggagacaagcccagacaacatagtgaaaccatgtctctacaaaaaaaaaaaaaaaaaaaaaagaaagaaaaatatcagagagatatctaaattctgtttacataccaacatccttaaatccaataactatgccaagttttgtgctaagatatttcagtgtggatatcgcaaaatatacagccaattaacaagatcattcagaaagcactgaacagaaaaagaacataaacacattagatttagtgtaaacaattcaaggagaagctgccaatgctagtttataaagtggccatgcattcatcaagttgttgttaatgctgaacctacactctgaggctaatggcagccacaattagtggcacacggttagaccctgtatgaatgaaatattgctgtagacggattaaacacaaggccagtctctggtagctcattttttgttagctggtccaggtactttaaaaatttatcaacaaacactgcaggaaattaaatagcctgcaggaaagaagagtaaaagaagtagacagaagtatctacattatatttagcaggaaaaaaggttacttctcctacacaacagagttttgtgctggtatattttcatactgtgactgctcacatagctgaaagtagtcacaagataaagggtctccccagtgaacttgtagttgtaaaacctcagagttggaagtcttatatattttctttgattctgttccacaaatgtggaattcaaaataaaagtgtattgggttcatttgaaatagcctgtatcaaattaatgttgcatgtatatatattaaattgaggggtgttccctttgaaaaagcattaatatgttatctacagatagcttttagaatttcaaatcatgttagaacattttctaaagtgctttccatagaacattactcccagggtcaaatacagattggaaaaatcgctttgtcaattcacctcttggaaaccacgatttttgccagcatgttagatgttctaggcaatcttgcagcaaaaacaagtaaacacaaaccctgtttacctgaataagtatttccaaaatttacttcaccacagaaccttcctctgctgctcaaatatcatctcgtaatttcccatggaagcttcatttcatgaaatcgacttaggaaaatgttgattgggaataatatttttcacacaacacccaaaactagcatattttggtttaatatttccatagtcagaacatttcaagaatatgttttgaacttaataacttccatttgatttttgttttagaagttagtcaataacctctggctgaaatcacatacgtgttctgacatgagctagctgtactattaaagggttaatgacaatactcaacagttatccaaaagaaaaccttaatgtagttaagttagtttgtttattcaaaagtcaaaaacatgtatgaaatgcctacatttagagatagtaaataactctaatgacaggctaatttccttatcaatcgcttcacattggatattacaaaataaaacatgacactgatgtctctgctttgttatcacctctgcatttatgccttttttacaatggatcatatcttatcttcatgccttccttttattccagtcagagaaaaacccaaccttggcctcttcaaaagatatagacatcttaaatgatgacttctagagacaatatttatcccagaagtaagcgttactgacagcagaaacaggacaggttgcattgaaagatatattttgagttagtgtgatctcagagttttcaaattactttagataaatgcttttcttaacatagcatctgatcaggatgcccatgctctcctgtctgcttctatactgtttctccatcctcaatccagagaaacatcaaagcaaaatgcaagctttacttttttaatgaaatctccctatgtgttctaaatagcaaagatgacttcctcctgaatgctacaattttaattatttatgctacaaaatgtagcactttggtactgtattgcatccctcaaatagtttcatgttgtatccctaaaaagaataaactttctttgaagaacaagaatctaattttttttctattggacttacagcacagtggaaggaacatatgtatcaaataaatacctgattgtttcattgtttaaagaaaacgtattgatgaaaaggtgtcaatatgctttgaaaaatcttctcgcagtatctgagtagatgagggaaggtccaggtgaactgaaaggactcaagagacagacccattattctttgataagatcaagcttgcccaacccgcggctcacaggctaaatgcagcccaggacagctttgaatgtcacccaacacaaattcgtaaagtttcttaaaacattgtgagatatttttgctatttttttaaagctcatcagctatgttagtgtcagtgtattttatgtgtggcccaagacaattattcttcttgcaatgtggcccagggaagccaaaaaattggacaccccgatctagataatgtttgcttaattggatacaagtaaactgtacaccaataatcatgaagaccctgtcactagtgcttgaaatacacttaaaatgtaattttatgtgtttctgtaaaatgcggactacaatattacctccctgagttattttcaggatgaaataacacgttgaacgtgccaagaatagcatttcaagcactcatattatatatgttgatttacttttctccatttatcagctcctccaggtttaatttgaacccacactttctttcctttctgctttttatttttttaaaaacctggccactttgctccagtaatttttaaagaaaaataagtgtgattagccctcataagactaacgtaaaatattagcagaaagaagggaaaagaaaaacattttaatgctatacctccatgaaacattaagataccttcctttttttttttttttttgagtcaacgtctcgatctgtcgcccacgctggagggcagtggtgcgatcttggctcactgtaacctccaccctcaccacgggttcaagcgattctcttgccccagcctcctgagtagctggggttacaggcgcccagcaccgcgcctggataatttttttatttttagtagagacggcgtttcaccatgttggtcaggctggtctcaaactcctgacctcgtgatctgcccacctcagcctctgaaagtgctgggattacaggcatgaacgacggtgcccagccgacattaagatatcttaaggagagtcatttctccaatttgtcatacagaagctctagtttttagtaaatgaatttttaaataagagcatacctcttttactttgttcatcattttaaaaaaagttctaagaactccttctgaagcctaatatctggtcactaaacccaatgtgaaattcttcaagttattttttggaattctcaacatgaatttagccaaatactgcgataactcaatgttatcttttttttagtgatagtaataatttaagtaatatttcattcagattctaaatatactaacgtatttcccacattttctataattgtaaaagagttgattggaatgctgttactgcaatacatatttcaactttcttcctgtattattaactgctccaactttgttactataaaagagctaccaaagagagtccccttcaatagacaatcagcttcccacaattactgtaagcactaacattcccttctacctgaaccccccatcttttgtcagatgagctattcatcaatccccatgcacttcgctttgatgttatctcagaagctacaagtcattaagactggcaggagaatggaggataagcggggagatggttcaaccgtagggagaactactggaatgatcctattcattatcaaactccaggcagcgtttctgctagctgagaatgtggtatggctgatgttcagcatgcttaactgaatgttgggtgtctcgtgatttttttcactcgtgttaataatgctcatgggatattgttagtgttcctgaagaaagtgtgcagggaaagacaacaaatttgcatttatttattttgaaaaccagcatgactatcaaactctgtaacctggaagaaataatgagaaagatctagttaaagaaaaaacggggcgaaaaatgagtatcttgtccaggcgtggtggctcatgcctgtaatcccagcactgtgggaggctgaggcgggcagatcacctgacatcaggagttcgcgaccagcctggccaacatggtgaaacgctgtctctattaaaaatacaaaaaaaaaaaaaaaaaattagccaggcttagtggcaggcgcctgtaatcccagctactcgggaggctgaggcaagagaattgcttgaacccgggaggcggaagttgcagtgagccgagatcgcgccattgccctccagcctggggaacaagggcgagacttcgtctcaaacaaaacaaaacaaaacaaaacaaaacaaaaaaaaaaccacacaaacaaaagaaaagaaaaatgagtatcttactttatttgggcaactagaataaaacaccacaaaatggtagcttataaacaacataaatttacttctcaaatttctggaccctgggaagcccaagatccatatgctggcagattcagtgtctggttagcacctgcttgctggtttacagatggcaccttctcagtctgtcctcacgtggggaaagtggcaaggagtctctctcaggcttccttgagaagcgtacccatcccattcaagggttccattctcacgacctaatcatctcctaaagaccccatttccaaacttggggtttaggatttcaatataggagttttgcacgggggaggggagacacaaacattcagaccatagcagtgaggaaacaatttttgagtatttgcttggtgcaaatattctgctgggcactataattctcgtaacaaccttgtgtggtagaattactgctaaaataaagattgtagactcagggcagtcatgaactcattcaggataactcaactagtaacagtaggtgtgatatctcaacccaagtatgctgtgattttaaagcccacttgtttttactatgtcatcatgtatttctaggctctaactttaaaaaccagtctggcccatttatctcattgcttgctttttccccattcttcctttttgttccctatattcactttccaagtgaagcttctgcatgaccttgcctaaagtttatcctaaataataaatactcatacagtacatgaatgaataagtcagtgaatgcctatcttctttgacctcatccatgtatcttcaatagaatgtcccattctctttatttactatgttatgtctccattcatttcgctgttctgtgttggtgactgaatatgcggaggatgcagataagtctgtgtgaaacacttattcatgttttcaaaacatgtctattgggttttccagaagttcacaaagaatggttaaagcaaaatcaataactgggctatgaacaagaaaactgagatacaatagtcatttttttaaaaaaaatccagtatcataaagcaagaacaaacaggacaattttgcttctcctctcccccaatcttagaaaatattaatgaaaagcaggtaggcttaatattcagatggtacaagtcccaacactcagttcagatgccaccgaatccactatccttctcagaatcctttgttgaacttgtaatctgggctacttgcataccttctgctctccacacacactatttcaagtctaattcccttaccagaagataaatgcctcaaggagagaagcagatcttattgattttttttttttttaattttgagatgggttctggctacgttgatcaggctggcctcaaacccctgggctcaagtgatcctcctgcctcagcctcctgaggagctgggagtattacgtacacagtaggagtacaataaatattatgaaaaggaaaacactaagcttagtagtttccatataacaactcttgaccttcttcatctgccatctaccaccttactaccccatttatttgttcccatttacattaagattcctagaaagcactgtctaaattcactgtctccagttcttctcctctattctgtctttgatatagttttcatatttgtccctgcccaaatctcgtgttgaattgtaatctccaacattggatgtggggcctggtgggaggtgactggatcatgagggtcgatttctcatgaatggtttagcaccatctccttgatgctattcttgtgagagtgagttcttgtgagatctagtcatttaaaagtgtgtggcaccgccccccactctcttgcttctgcttttgctgtgtaatgcacctgctcccccttcaccttctgccatgattggaagcttcctgaggcctccccagaaacagatgctgctatgcttcctgtatagcctgcagaacctagagccaattaaacctcttcttttataaattacccagtctcagggatttctttatagtggtgcaagaacgacctaatactgtcttagagtcataccaaataagcttttgcccccatcactcttccaaactggctttcactgagaaatccaatgacctccaagttgctaaattcaatggtcaactattagttttcatttgagttgacctatcagcagtgtttgcaatgggttatcattctctctttttgataaattatctttactttgcttccagaataccacactcttttgattttcctcttaacccatgtgtctttcactggctcctccccttcttttcaaactctcaatgatggagggtctaaactccttactctcagcaagatcctcctccctcatatgcccatattcacactctttgtgatctcaatcatctagatgttgtggaatcccaaatttggatctctagctcagacttctctcccaaactctgcttttgcatgtccaattgcctattttacatatcttgaccttttacctcaaacccaccccattcacagcttttgatctcagttgagagctactccatctttccaactgcttaggccaaaggatttcttcttttcccataccccacatctaacccataaagaaatcttattgaccctattctaaatagtttcagaattcctatcacttcctatcacatctcacagtctcattcattaccaccctgtgcactttgccataataaggtctcctcttgcctcactagagtctgttcccaaaccagcagttgaaaatgatccctttaaaaagtaaatcagacccacctacctccaggctgaccccttccctcaagagaaacactcccaggtttcagaaagcattccattttctttttctaactcttgagaagtctggggatactatagattctgtccatggagtctgaggaaatcactgtcattgttagtgaatccttcttttgaacttgcctgggttaatctaccctgcatgcagcgtgaccattaagagtactgtaagccaggcacggtggctcatgcctgtaatcccagcactttgggaggccaaggcgggtggatcacctgaggtcaggagttcgggaccagcctggtcaacatggcgaaacattgtctctactaaaaatacaaaaattagccaggcatggtggcgggtgcctgtaattccagctacttgggaggctgagacaggagaatcacttgaacccaggagacggaggttgcagtgagtcgagatcatgccactgcactccagcctgggtgacagagcaagactctgtctcagacggatggatggatagacagacagacagaaagacagacagacagacagacagacagacagagtattgtaggtgctagagaaagacttcatggatttcaatccctttctatcatgtctaagtttcattttctttaactacaaaaccagaataaaaacgttgctttgggaacttaatggcttgaaatgcaaagcccttagaatagtgcctgccaaagagtaaatgctccaaaaacatctgctatcattatgtttagaaaacaaacggattaaatcacaggtaacacaattaattacttttacttttagaaagtcagtgtacctgcctctcattttggggatcttgaatgttgggatacagttgtcttctgaaagcaacttgagaagtacttcataacctacaacctactgtgtttgggcaaaaatgtcagaataaacactcctttcaagttatgtagattacaatcttcattgttatagtggtcttattttgatacctcttctatatcagatactttgacatgagaaatgtaaaagcactgatactggggtgtgtgtgtgtgtgtgtgtgtgtgtgtgtgtgttggaagggaaatatatagatttttatcctttaaggtaaaattgtggtaatatttctgagaaaaatatgccttaatacaactaagctttccattttgatgctagaaagattattgtaatgagagtacaattaagcatactagatgtgacaagttgggttagaattaacaactgatattaagcggcctttacacttgtcacaaaccaagcgcacttcaggagaacatgatcaccctcaccctggacttgactcaactacccagtcttctcccctctcctgttcataaaggtctgtgtgtctgtgtttgtctaccactctcttccctatttctctgtggcaatcaagctccaaaacagcgcccagtgaaccttgcctcctggtatttgtgcccttgcattccctgcaccgaataagctaacctgtatgaccaacaggacactgcagaagtgcgggtgtattgtaacttctgaagctagatcattaaaaaaaaaatacagctgccctcttgcttgctattgaagattacttgctctgggggaagccaatccttatgtcatgaggacactcaagcagccctttagagaggtccgtattgagaggaatccaacctcacacccatcgctgccaccagctggtaccaacttgtcagccacatggaatctgatgcctgacaccaggacaaccaagctatacaagaccctaagcttggaacgtccagctaagaccaaattcctgacccacagagaagctttgaaagataataaatgtttactgttgtgttaagccaccaagttttcgggcaatttgttacacagcaatggataactaacacactctcaatctcttgctgtccctctccagatggctttgtctgcactattttatctttgtatgcccactgccttttttccttgtcattccttgtgctctttctgcttttttaggccaccataaaacagaaaaatcatttttggtgtttttttatgtgtttgttcaaaagagtttaagggtctcttaaaattgtaaaaaataagaagttttatttatttatttttgtttctaaaataaaagaaaatgaccaattttccctcctcttctctgggagttatctggactgttttttttcccctgcttatctttgttttctcctgggctatcagtctgagaaaggtaatagtgaagtcagagaataaaggttcctcaacagttatttaatgaagatggaaacataatcattaaaacagaacactttacgcttaacagcactgaaaatgctcaaacacactgtactgtatgtgattgctgacaaagcctccatctgaacaagaatgaaccacatgtcataatgaatttggcatactggggaaaaaagcattaaaaatattatacattaactatctccgttcctgtccaaaaaccacttatgctgtcttcattcaaataaatggtaaaatatgaccatactgttatactgaatttgattggaccttgtaaagttttcaaaattggatggtccaactccagacacatttcaaaaggaacatgcaaaaaactgttctctaccctgtattgtctacttttctagtatttttaatacaataaaatattttagttttacagttatcaatttttggtatcctagaaactccacaatgatgaaaaagaacaggtgctcacaacaaagcagaattaccaacatatttatggccttatcgtttgacagggaaggtcaaacctctcagagtttattcataaccctgcatcggctttcaattctttgaaaattgctccttgatacccgacttccctgaaatcacagagagtggcagccactctcttaaggtataaatcagattctaaataactgatagtgcttttttcctctagacatggacaagaaaagcactgcattttcattgctgaatgccagtacttagaaagaccagtgcaccaaggatgtttttagggcttaatttctaaagtcatctataagaaactgcctttgagattttttttttaaaaaaggtccggctcttgtgtgtccctggcattttaataacctctcttctttcgttctccaaattcaaatttaacgcaatcgcaaacttagtgactgtccatcactataagttctatgacgatgtagctgttccatacttaagaagatgtggataattttggctcactataataccagctgatgacacaacggcaagtgaaaatagtcacacagatgcataggcaactaacaatttagaaaaaaaagtaaaattaaggacaaatagagtaagacaggaaaaaatcttgtgtttttttctctatgagatatcagtaattgttgcagggccaattaagaagtaggtcatgggaactctttattgtaataattagtaacattatttaaaaatatttggcatttagcagctcagtcacggtagctggacatttcttctgaaatgtgcttatacacctggtgaacagtctgaaagccatacaatgtgaaaaacaggaatctttaatctgctgccatgttttcaactcacgagttatcaatacaccctttataaaaataatgaaatgctgctttttcatttagctgtttatctcaataaaattaatataatcatattaaggttcatccagatgtctgttttatcataaaatactggcatttgatttcagttgctatatttaagtttcaattcatacttggttggcatcaaacagcaccaagagaatcagcatcattgtagtgagaatcagcatagactctggcatttggctacctgggaacaagttctattctgctacttattggctgtgtgactttggacagttaaattaatctctctgtgtctcaattccttaattttcaaaattgaggtaatatttgtcatggccaataactgagatggttttaatatgagaacaagcacttgcatcaattcaaaaggcagcagttgtcacaacatgcgatatgaatgaaagttcattgtatagcactatacatgtgctgttgtaaggcacacatgatagagaactccaatgagtaggtatgaatggcactaaatccagtgaacgtccttggaagtctgtaaaggaacccatctcctgcagggtatcaaaagctgaggattaggtctaggacttcattataggtagcagagctcccttgaaggttgaattctcagcatattctttttcccaagtctgctacatcgaggtcagggaactaactgggaaggagtaggacccagaaaaacagaataggaaaatctgagttcaagaactcaaaaaactttgcagagaatgatggtttccagcttcatccatgtccctacaaaggacatgaactcatcattttttatggctgcatagtattccacggtgtaaatgtgccacattttcttaatccagtctatcattgttgaacattttggttggttccaagtctttgctattgtgaacagtgccgcaataaacatacgtgtgcatgtgtctttatagaagcatgatttataatcttttgggtatatacacaatgagaacacatggacacaggaaagggaatgtcacacaccggggactgttgtggggtggggggaggggggagggatagcattaggagatacacctaatgctaaatgatgagttaatgggtacagcacacaacatggcacatgtatacatatgtaacaaacctgcacattgtgcacatgtaccctaaaacttaaagtataataaaaataaataaatacataaaaaaaagctttgcattgcttgattcatctgaaatctacagatttcagaagtggctctttctttccagttaacagctagcactccccttctccttgagattatttagaacctctgccttataagggaacatgtcacccttccagatttacccctcttatcccctcctggccaccagttcaataacaaaggtgaaggtccaacataacccagccatgaaagggctggcactgctgagggaagaagggactacattccaatagagctaaggactggtccccaaagatgctggatcaaacagggtgaaacctaaggtaagataagggctagtttatggataatgaagcactttggcatgacagagaatgtaccaccctacagaggactctagtagacagtggtaataaaactccagttggctctggaaagttgggaagaagtgatggtttactgtaaatgaaatttaaatttctagaatttcaatggcaaatggcgaaggatggaagggatccaaaggctcagagaagtgagcacgctagagtagatatgccacccgaagccaaagtccatcagttaactctgttctatgagaagctggaggacaaaagtgagaaggaatgagctagtgaaagggataccagcatccaaaagaagtcctgtggaagctgtcctctatagactaaggctggtaagaaaagatgcaaatggtagaagatgctacacagaactgggctccaggagagcaactgagatgacaggatcctaccataacagaccagatgatggccactaactgtcaaaagcagggtaggctcaattatcagaactagtgacaagactagttacagccaggggcaccttaaccgcaaaaaactttggagatggttactaggacacaaagttccaggagacaagataaatggattgcaacagaaatattgcttcatttataggattaaaataaatcagttaataaattcatgaccttttgccccatttctggccataagccagttctcagaagtataaacaatggtatatatttcagtataaactgaaagagaggatgagttctcaggaggaaggactctgtccactcatttatataactgatgattccctagtccttccctaaagagatccacaagtgtttactgaggtgaccatgggaacctctggggtaaccactgggcaaaggaggacatccatacattgcatggagatgaaccatcactgctgaataagaacctgagttgatattaagacccagggacctgaagcatcattgtggcccactgtcaaagtgggggtagatggggtagggagagtaataaacggagtccgtgacctagtctggctcacagtgagcccactcagtccatgaactatctggtgcttgactatatggttagaatgaacatactcaatagttggcagaatttccacactggttccttggcctgtgggataaaagctactatagtgaggaaggccaggtagaagcatctgaaactgtcactcctctctctcctcctcattaagaagataatttaaagataacatggaatccaggagagaaagagatcagagtcactcttaaagagtgactccctcacatcctcatttaatgctttactctggtcagcaacaaaaatcagaaagatgtgagagaatgacgaagtactacaaactcaaccaagtagtagccccagttgtagttactctgccaaatgtggtatctgctagagaatattaatacagcttcgtggcaaaggaggctagggtacatcctagactccccagcagtggcccgtagtagccaatgcgaggtgcgatgcacactgcttctcagccttccatgtgcatgccttcatttctccttttttttttttttttaactgtgtgaaatagacatgaaccctggctaactctggaaactatgttgataataatagagcctaaaacactttaggtgcctaaatggctgtggggacaaaagtatcccactgagctgttcaacagcatagagttgtcatgtaaacacaagatattcttctttggaatttgaacgagcaaaaagggaggcattaaaaatatgcaaacagagaataggggattacaacaaagggttaacaggaaagagttgaaagctagtgtaagagtcacaaccactgactgatgaaaaactttgctttcattccatgcatttgacttgtaaccatgcaggtaatggtttcatgttgccatgaagtattaatatatttagtagctttgttctctccaatattattagtttattctaaaaagaggagtacatttttcctttttttttttgagatggagtctggctctgtcccccagggtggagtacagtggcacgatctcagctccctgcaacctccatgtcccgggttcaagtgattctcctgcctcagcctctagagtagctgggattacaggcgcccaccaccacacttggctaatttttgtatttttcatagagatggcggtttcaccatgttggccaggctggtcttgaactcctggccaggctggtctcgaactcctgaccttaggtgatccgcccgccttggcctccaaaagtgttaggattacaggcatgagcctccgcgtctggcctttttttcccaaagttaatgtcatattctataaaagggaatgtttggtatggaactgtaaaagtttgaatacaagtaaataaggatttagaaagatattcaaggattaggaatacagaaaacagaacatgattagtctcaatccttagagtagctcaaaatataactgagaaattaagaaataagtaagtaaagacagagactatgtgtcagtgttagaaacaagaagaaccctgaaataatgggcctccgttagtacaagagtgttgcgacaacaagctcagagctagccattacttcttgataaacaaacttacaaacctgttaccataaattataaattaatctatactggtcaggcgcagtggctcacgcctgtaatcccagaattttgggaggccaaggcaggcggatcacttgaggtcaggagttcaagaccagcctggccaacatggtgagccccgtctctactaaaagtacaaaaattagctaggcatggtggggagcatctgtaatcccagttactcggcaggctgaggcaggagaattgcttgaactggggagggggaggttgcagtgagccgagatggcaccactgcactccagcctgaaaaacaaaagtgaaactacatctcaaaaaataaataaataaaacaaacaataaattaacaaattaattaacctatactaatcctgtactctgtcattaaaaacaaacaaaaaaaaaacttttgttaaatcttactgagaaggtcaaaagatttttccataacataaaatggttggcttaaatttccaagaagtatttatttgtaagttttaggccagaatatggttgggtttgttttggtgtagaaatcttttttgtcacctaacaccataactgtttctcattgaaaatcaactttactcaatataagttaacttactgtgacatcactgacctaattttaaataattcaaaattttgaaaatgactgacactttcctccaagtaagaaacacaggtaaaggtatatttcctctgtattagtccattttcatgctgctgatgaagacatacccaagactggggaaaaaaagaggtttaattggacttacagttccacatggctggggaggcctcagaatcatggtaggaggcaaaaggcacttcttacatggcagtggcaagagaaaatgaggaagaagcaaaagtggaaacccgtgagaaactcatcagatctcgtgagatttattcattatcacgagaatagcactagaaagaccggtccccatgattcaattacccctcatgtgggaattctgggagacacaattcaagttgaggtttgggtggggacacagctcatcttccttttaaaatacactttcaagtaaaataattaacagataacttcacatctcaatgcagaatctcaaaacagtcaaattctaactttgatactaaaaagttaccttcattgagaaatacagtcctgctcctttacacattgctagagacactgaaatagtcatttacagacttgttgaattttattttttatattttaatcaaaatgtcttatttggtagttctaccccccagagtgaaatagactgaaactcatcaacaaattcattgagagaaagagataattaaatatgtcatccactgctcttcaattatttttgccaaattttgtgaagttaccctctgaatacggagattttagcagtccaggtacgatcattcctctgccgctttatataacccatattcttacaatgtgcaggttaaaacaaggccaatggcctcattgctgaattaagattttcatattgtacatgcctgaaaggaaaatgtgacctgaaatgggcagaataattctaggattccctggttataaacataccttgaaaggcatttgccatccagccacatcttgtctctaactattaatgtaaccttgggtagagaactagacttcgtggtgcctctgacttcaagtattttagccacatcagcaaaatcaaccctcatgtggaggaggataaaaaggggagtagacagaagactctcatcttcaagcattcccatcccactgggaggaatatccccagcatgagaatgagcacatcaattttcctaaaatctgatactatcatacatcggtttcctctcactcctatcacgctaattccttcttgaccatcagccctctgattataatttgacttctaatatggtatgtttttgggaggggaagcagtgaaaaaacataagataatatggacctcacattttcttgatactgttattttcttataaattaccaaagtattaatgagagatcaagctgcacactatttcaattactatcatagatatatttcttgttatgatgagtgaaattagttttatagtcttccatttttaaacaggtatgctgtatgaggaaggaggctttgtttttcacctttaattattctctaattttgccagacaagccaatagaaaaaaaacaaaaagcagaagatgggtcaaaacttgtatgcattgcttttacatgaaacacattactacaaattcacctctgtccatattacccaggttcagccttggtccccatcctaagaccagtctatacaggattgttaggtcactttccgaaaatctcaaggctgttgtgaaaacatagaccaaataaatgggtatagtgcctagtgtaggagaaagaataaccaataataccaaattgctgtttgtcttaaaagcaccgtaatttgaatgcttttacatcctagcatctccataaatgacatacattcacagtacagagtttgggcatactgtccaagtagaaattaaaatgtgaacccttacattctgactctaagttggacatcacagtggatataagaagttatcggaaaaatataattttgtggtcattttacattctcaatgaattttaaatactacttaaaaattagctgttcaattttttataacctttggacactggtggaacaggagctaggtttgcacatgcatccaatagagataaattaggattcattttgaaggagttgtcttatccaactttctttttgttaagaaaaaaaatctgacattacaaagtataaaaggaaagttttaaaaaccaggcagtttttcccctattaaatagtttctacttatattcgtcttctgaaagttacaggatgatgccttattagctttgagtattaataaatgacctcattcaatttaagcaagttataaaaaaaagtattctgaagggaaagagtgctgctacttcctcaaacgaggaaagttagtatccaaacgttatcataaataatgtacttttgcaagtaaaagaatgatatgtatgacatatatatatataatatatatacacttttaagataagtagccacacattttactactacttcctcaaatgaggaaagttagtatctaaatgttatcataaataatgtacttttgcaagtaaaagaatgatatgtatgatatatatatatatatacacttttaagataagtagccacacattttaactcatcacttttcagatactaatgaacaaaaacatataggttctcagtcccttctcccctagcctaaacttctacagtttctgctgcataagaagtctgcatggtatggcaaagggcagtgtcataagagcacaaaattaaggtaaatagaatgcttaatgacctcatagaaatctagttctcttgacccatttgaattgtactcttcacttgccctccacgattaaatgtgttaatgcttatgcatcgtgctcaatagttcatttggtacttcttactgaataggaaacttttagactaatccagttttaaaataaaggaaggtgtaaaagctaacaacattataaagttaggagtgatgtataaaaaatgtgaaagaattagggcaaaatagaatataaagctcctgtacctatgagcactcagcgtttcagcactgctaagatgagttgctaaaattgagatgtgtcaagatttaccatttcagagcttgagtctaggttatgacaaatcttctaagcacttaaaagttaaatgagtacggagtggataatgagattttttctttctctaaaatgtaaacctgatgaatgatgcctgaaagcaccaccagtcatttttatgagtcctcagcaaagcaatacaaggcatttttgttttgttgttgtttttttctttctctgtacctaaaaggaagattttctttattttagcttttctaggatggtcacatccccttttggagacaatgttacctctacaaacttaaatagctaagacaatatactttcttcctacataataaaaatcaaactataaatatagtttaggatataaattgtaaatatgtattaataattttatatcctaattaggattttaggattatttacaacaaccaaaagtacatacatgtgataatgaattggttacaatttataaaaagtcaaattgcagatatacaattgtgtataatatgaataattttttatatgaaaacggaaagtaaatcctgtaaaaaagaaatatagtgtgagaggaatctaaaattaattatctttgtgaaccttaaaaaaaagtatattactattaatgtttgattcaaatattttttctgttgttttcaagcccagttgtcaaagatcaacttctaacatcaaagacctgacaagaattgtatgaaagtgtcctatttctattgaaaaaaacctcatcaattaaagtattatttttattaacaataattctgaagtattttttaccatgtaaaaaaggatacgcacctacaggtctataaacattttcttctcaaggaagatggtcttgaaaatataatattcaatgcttgataacttaatcccatgaacatattataaatttgcatcaaaaatatctatttccatattcaatttaaatatgagagtcaccttgaactgtttcttagaatctaaatgtaaaatggagaaatatcaccatttacaaagggaacagtaaaatgttctatgaaatatatccagagaacccttgaaacaagctaagggggccagaggggaagaggacacatagggttggaattgcacatttctttgggaaccgtgactatatattgattaaatatttgggataaaaaatatgataaaaattatatatgtagcaaaataaaaaaatccactatgatgcaattcaaagtgccttctgcaatttcttttctttttcttttccttttttttttttttgttttttgagatggagtctcactctgttgcccagactagagtacagtggcgcgatttcggctcactgcaacctctgcctcctgggttcaagcaattctcctgcctcagcctcctgagtagctaggaatacaggtgcatgccaccatgcccagctaatttttgtatttattgtagagatggggtttcaccatgttggccaggctggtctcaaactcctgacctcagttgatctgcccccctcggcctcccaaagtgctggtattacaggcatgagccactgctcccagctccaatttattaagtagaaattttgtcaatagctttaaacaacaaagtccagtttaaaaaaaagaagaaaaccttcaagaaacaaaaaaacaattttaaaggttgatactaacaaaacctcatctttatgccagattcacatgtctgactacttgcttaagaattctacctgaaggttcaatgcatctctaacctaatacagccaaacagaaactcctgttccccactctagcctaccctatttctctctcatttttcagaatatttgtaaatcgtaccgtcatccaacaagccaaagattaaactgataaatctgttcaacaaagggcatcatgaacaaagctaacagaccgatgatggtgttagaaaaggtattctgtaatgttaaaaactgacatgatattcatatttaaaatatacaaggaacaactacaaatcagtttaaaaaatacatcatctacatataaatatgggtaaaatctagtacccacaggaagaggtgttcagactcattagtaattatagaaatttaaataaatacagtgagttaccacatgattcctatatacttatatccagaaattttgataatatgaaatgttggtggggaaatggggctaattctaaaacacaaattaaaaaaaaaaaaaaccatgttgctggcctgctaagaccattccagatagcaatctgacactagtcaaataaaacaaggacatgtcttatgttctaacaatttccttcctaggtatatatcccaaagaaatacacaggtccttaagggcatatatgtgagtctgtttattacattatttgtggtagtagagctgagttgggttgggacactaagattttgaagcaatgtgctatccatcagagagtggatgggcaaatgtactagttgtccatcacatagtgctattaaaaggaaaagaatcaatgcagacataacaacatagatagatcttaaaaatataatgctaagtaaaaaaagatcgtcagaaaagacatgaagacatgaatgaagcttaaatttacatcactaaacaaaacaagctattctaaaaagactacatactgtattatttcaattatataacattctggataaagaaaaactataagaagactaaaacgatcagtctccctggtgtatgggaaaagtggggagcaatgaatatgcaaagctcgagggatttttagggtcttgaaactatacttcatggtatttggtggctacatgatattataggattcttatttatcaaaacctatagggctttacacaacacagagtgaacgttattgtattcaaattttaaaaaatcatttagaaagttggaggatctccgcaaagaatgtagactgtgacaagaaaatctaattgtattacaaatatatggaacaacctcattgtatggggtaagaaaggtactgacctaactttggaaatgaatagaatccgtaaaagtaaaggcaaaaggacctgcacataactactgcactcgagctaataaagttgtttcctacaggggtacacgttaacaattcttatatctgcctacaagttcttcatctccatctgagaccaccgcagcctggatttcatggtccatatcattatcagcattttggtcaacgccatccaataagtctctagggagctccaaactttcccacattttcctgtcttctcctgagccctccaaactgttccaacctctgcctattacccagttctaaagttgcttccacattttcaggtatctttacagcagcgccccactcctgggaccaatttatcatgttagtccattctcatgctgctataaagaaccgtccgagactgggtaatttataaaggaaacaggtttagttgactcacagttccacatggccagttaggcctcagaaaacttacaatcatggtggaagtggaagcaaacatccttcacatggtggcaagaaggagaagtgccacgcaaaggagaaaaagccacttataaaactatcagatcttgtaaaaactcactcactattaggagaacagcattaactgcccccatgattcaattatatccacctggtcccaccctcgagacatgggattatttcaattcaaggtgagattgaatggtggggacacagagccaaaccatatcaccacctatatcagaacttcccccacagacattttttaactgttctgattacagctttagaattaattacacagatacagaggaaacagaaattattaagtgacatagtgccataaaatcagttcagattttggaaaactccatagaacaaatgacaatgttttttcaaaaaaaaagttaaaggagaaaaagaagaataagacaaagaaggagaagaagaaaaaatggagacagagagacttatagattaaaacggattttaaagaaatagccaattgcaacgtgtggatgttgtttggatccctattcaaataacaaactatggagaaaacataataaactatgttttcaaactatggagaaaacataacaaacaatggagaaaacataaacactacattttaccatattaagtaatgatttttaactttatttaggtgtaataatggcactgtagttacggtttttaaattatactttaagttataggatacatgtgcaggtttgctacataggtatacatgtgccatggtggtttggggcacccatcaacccgtcatctacattaggtatttctcctaatgctctcccactcctagcgccccaccccctgacaagccccagtgtgtgatgttcccctctctgtgtccatgtgttctcattgttcaactcccacttaggagtgagaacatgcggtgttttgttttctgttcttgtgttagtttgctgagaatgatggtttccagcgtcatccacgtccttgcaaaggacatgaactcatccttttttatggctgcatagtattccatggtgtatatgtgccacattttcttgatccagtctgtcattgatgagcatttgggttgtttccaagtctttgctattgtgaacagtgccgcaataaacatacatgtgcatgtgtctttatagtagaatggtttggtatgtataaaaatatctttaaaaagtcataaaaacaaaatatattttgcaaatcacatacaaacaaaaagataaaatgatatattacgatggtttcctatgtaatgtaaaggaaatctagagaacgacagaaaaaataatcagcaaatccaaaccaaacaatgaaacaaagtgatcagtgatgataacgtgccatgaaataaggagcatgattaatgcaactatttccactagaagcccaaagtaaagaaaccaaacaaaagcaaaacacaatagtaattttatatgcatggccctaaacattttaattttcatgaaattaatgtgaatcatttcagtcttacaaatgaagacactgagactgacagagttcctcaggattggcagtcagtataccaccacagtcaagcctcaaacttcccactcagagtcagaagccccagaacacctaaacttgtatgaagtaatttaaaatttccagccctaacaaaccaccggattgtgacgccatgttgcttcttcatacactcgcttatgaaatatctatgctctaattaaatatgatatacagtctcctagttccatttcagttatgaatgcttccctttctttgtgtctagttcctttctagaagagccctgttgcaataaacttgtttttcacttctatacttattttttaagagtttttaacatgaacagatgctgaattttgttaaatgctttttctacatctattgagatgttcatgtagcttcttttttggggtataaatgcacatttccaagtaaaaagcattgtagataaaaggaacagagaatgaaattttgagcatcgatttattaatgttgcacatcaaattttatgctaagttctagttagagttggtttcataaattgttttaaatgaagtgtatgttaaggataattttttaaaaattatacactatttagctttagaaataaaattctttaagacaacctggatgacatgcagcattaagtgttgctgctaataatcttaaagccacatttaacctattcaaagttctgtcatgaatgtagccacaatgaactagtgctttcaagggcagcaatctgtacatctaagatgtaagttcaatgaacacaacgtaagatctgcatactgagttgtatctatggccaattggtctaggctcttgtcattagaaactgcttcaatttgtttttctcagggagaggataatgtagcaattaagggcatgaaacagtgcctgtgtgaccagaatgctgggtatatgccatctctgtaccttgctagctgtaaataataccttgtgcttatgttttttcacctgagatattggaaaaataagaatagctactttacagaattgttgtgagcttgttatacaagttaacaaaaaacaaaaacaaacaagttaatatacataatcactcagcatggcgctggacacatggtgagactctgtcagcattagccatgatcactattttcattatgaatgaagagcctggctgctccccacgtttgataattgttattgataactaaatgtgaagctcctatctatgaatatcactaaaccctctccatgctaacttataggacaatgaggtacgtaagaatttgtctgaaatagctggttcccaaggggaagtccatggatagacaggctcagggcttctataaactcctcagataatatttaaaattttaagtgcgtttataaaggtacatttttatggagagaaggttgacagtttttatcacattctcaaatgggtttatgacccagaaaagttaagaatctctttaaactctaaaagataaaatccaaactctttccctggcacaggagctgatatctaattgcttctctgcccacctttttagccttatctaccaccatctccttttctctccgagacacaacaggttttcaccagttctcccaaataaactgtgcagtgtcttaactgcacacattttgctcatcttgtcccctctagtggtctcctgatcccttccctcttggtaacactgattcttctgcctattttgaggcaggctcaggaacgccctcctccaggaatccttcctacgccagtctgtggcatggcatgtgctgcttctctgggctcccataatattctctacatacttgcaatgctgtttttttaaaaaatctcattctatagcgttgttatatttagtgaagagacggttagctctttgagaataaattatccaccttcaatccagcaaagtgcctgatacaaataagtccttaataatattttgatcgaatgaatacattttaaaaattgttcaatgccttttattttcatatggctttctctgctcctggaaatactatatagtatgaaataagctcagaaaaaaatgttaagctttcaattactattaccaaaatttcaaagagtgcccacttcttaataggctagcatcactcaggagaaaatcaatcctcctccactgtcccttgagcaacattgttgtatgttaaacttgcctgataaaatgagaccaatgttctatactctgtgccttttaccttgaggactcctactagggataaaattggcttactgtcataagacaattggaaaggccaatgtctccacaatgaatcaattttgggggtcctctgtcatcatgcctttttccacagaggaagcaatcccgttcctcatcaacactatctcagctaaaacagaatattcttccttcttgataagaaaactgattacatctattcctttctttctatttagaaatttatctacatgcaatagcaggtggcaggtaactgggtgcagtggctcacacttgtaatcccagtgcgttgagaaatcaaggtgggaggattgcttgaggccaggagttcaagaccagcctggacaatctagcaaggccctacttgtaaacaaaatttttttttaattagccgggtgtgatggtacatgcctatggtcccagctaattgggagactgaggcaggaggatcgcttgaacccgggaggcggaggttgcagtgagccaagatcgcgccactgcactccagcctggcaacagagtgagactccatctcaaaaaaaaaaaaagtctgtatgtatgataattttcataattaaaaaattgattggggagaaaaaagccatatagattttttcaatgctgatatggatatgtccccactcaaatctcatcttgaattttagcttccataattcccatgtattgtgagagggacccagtgggaggtaaacaaatcatgggggcaggtttttcccatgctgttcttgtgatactgattaaatctcacaagatctgatggttttataaagggcagttcctctgcacactctctcttccctgccaccatgtcagatgtgcttttgctcctctttcaccttctgccatgattgtgaggcctccccagccaggcggaactgtgagtccattaaacctctttttctttataaattacccagtcttgggtacgtctttattagcagtgtgagaacagactaatacaaatgcttactcctaggtgaacctcatagtgcgcagaagatatgtaaaactggttatttttttcttaatccttttggagccttccatatgtatccaataacatttagagagtaactgtggattcttataaagaaaaggtatagaagcagcattcagaaaattcctagattgttgatggatttgccatggattcactatgttgtcctatgcataatttcttcatctcagaagtaggaaaaatgtacctagcctgcttacttaaaagggctgctgggagaagcaaatgagatgatgatgaaggtagttcataaattgtaaaagtgttaagtggaccaaagtgttcagtatataagtaaaaatgttattgttttttaatcttccatccttttggatacagaggatatttcataaatcatgcacggcggtcaagagatttagtatattaatattcagtatatcttcaatgtttagactatcagatctacttaatattttataagcagtttctcagtctgattcagaaaacaatatgaaattgggaatacctctcctcttctatgtttattcaaactaagtttctctttctgtgtgtgtctatcaccttaggttatatcctgctaacctgctttcagactctgaaactttttaaaaaaaaattccactggtatactattctgtatatatgtaagtcaagtatcataattcagataataacaaagttatgaagaattaattagagcttttaaaagacaaacacactagttttcaaaaaaaaaaaaaaaaaacaacaacaacaaaaaaaaccaaatccttctcaatagacctaagatctagaatccttactttcctttttcttagtaaaactgtgtggtgcgtgtgtgtacttatatattacatgtgttctatgtatatgtgtgtattgtgggggagggagacatcttacacaattccttgaaagagctttaaaatatctagggtaaatgtatggtctgaataaataccctccagccccacctgtcccagcttaactttctttgtaaaattttccacttttcttcacttttagttttgattactttcagaacaagtaagatgaaaattctcccacatttggaggaaaaaaccttaattggccgagaactagaacaacccagctggagctgtatggagctctttatatagaaactttcacttatgccaatcttcttcccagaggctcatttcatttccctgctggtaacactcaaatcacttcacagttcattgataactgcattggcaaccttttgttttcaatcaaaggaagatgctgcagcaatgctcaattgaactaagtatacatgacacagtgtaccagtgtccttgccacagaggactgtgggaggggggataaaggaaaagatgacatcctgcatccaatattccattactttacctagaattggattatgataaattatggtgacagagctcagacaaatgctgatgccatcttttctattgttgcacctgcacacaacactcttatggattgcatcaagtctccaaattgattctctgtcactcatggttgaaaatgaaaggccaatgtacaaataagtttttaaacaatttccatgaagattgaatttgatatttcctcccttactgctttgaaatcactgagggtcacaataggtttttgctgatgaacacctttctataaatcttccttggtgaaagacttctctaaggtcaaggaacctctatgctgtgtgggtgagaggcaggtatcagggtagtgtttcactcctttccccttgaaacatcatcatacctaggttgctttaaagcccaccaccaccaccaccaccaccaccaccattatctgcatgtatttgatgtatttgtccagcagtaacatgctaccaaccaccaaaagaaacaattactgtcccaagtaagcacccaaaatacaaggaaaaggcaagtgtcaaatgcgaaataagtggatcaagttatagcctctgactcttaaccagggatgtccaggcagcccacattttataagaggaggcaatactggatgcttctggtaatggaataatacatttagattatctaaaacttcctatttatttagacttggctagcattaaactgtgaaaattgttatttcatcttttatcaaaatacgcaattatttgttttttaaagttcagaaacaagaaaagttataactcaataaattttgttttaggtttagagtatttgaggcccaaaggagaaaaaaaaatttaaaaaaagtgtttggttgttcctaatgttcctcatgcacttgcctcccaattcatctgttgaaacctaatcaccaatgtgatagtattaagaggtagagccttagggaggcaatttagtaatgagggcagagccctcatgaatgggattagtacctttaaaaaagaggccctagagagcttagttgcccctttcgccatggaagaacacagtaagaaagagccaaccagccaaggggccctcaccagacactgaatctactggcgtcttgatcttggacttcccaatctccataactatgagagatgaatttgttgtttataaaaccaagtttatggtattttgttatagcagccggaatgaagacaaaagaagataaaaatgatccagatgaaggaggtttagagggtttatttggaaatgctccatagaagacaaaaattttgagtagggttttaaaagacaagaattacttaaaaatatttttgaaagtgtacagtgagttcaaaaaagcagagaaaagagtagttgtggaatgttcgaaccagttttccctagaccagaaaaggagtctaaaaggtttgacacagagttccaccatgccttagccccataccacagatgttcaagtagaagaggtgtcgaagggtttataagagatgtggagctggggtttgggccaggagattctttttctttttcttttttcttgaagaaagtattggttaaaagtagggtgaaaagtacttctccagtgtatgctggtataattagtgtccatgaatatctgcagcactttacaaacatgcagcatagtagctctcagtcatgctgcgcaagatacaaaggcaaaatcccaaatacgtgtgccatggttttgtttttaacttggaaaaatggtctcaccaaaacagttttataagccattattagttcccagtttagcacaaaaaaatcaacttctataagggaacaacaaaaaagggtaaacaataatacaaaagaaaacaaatgtatttcaactgcccttcccatttaatactcaactcatagtaatatagtttctacccatactgtgccataaaaacgtatcaaaatttcttcctggctttctaccttatcaaatttcttcctggctgccaaatccattgtatcctatttattcttgatatccaagctcatcactcttttgcctttttacatattgacaattttcaaggtatacctccaggccagaacatatatccttttaggcaattccatttggttccaaagatagatctttctctttatatcccagagtcaactgctgatcttcacattttgatctgctcttcccatttgctctatctcaaagaagaacagcacccagttccctaatgcaggatgcagttattataccgactcctccctctgcatttctacgatgaagacttctgagcacacatcccaacaaactccatcatttttccttcactctcatgtttacttaagtttactcaccatttgttccttggatttccaagagaattggttggcctctatttcttccataaacaatctatactcccaccaaattaaactttctaaaatgtcaatcaaatgccactcctttgattaaaaaaacccttaaaacctgacctttattctcaatatagagaccatcttcctggggattcaagcaagccctcatgctctagaccctgcttccctccagctgcacctccaatggctccccgtgatccagcaatttgctgttccccaaatgtgccaagttctcttgctttatattccttccacattaaatgtcactattcctttctttgcctgacttcttagcagtcttgagttcagatatcatctccatatcacatatggagtcttgatatcatttcttagaaactattcaagtctccaaaactgattctccatcactcatggctgaaaggaaaggccaatgttcacgtaagttttcaaacagtttccatgaagattgaattcggtatttcctcctatactgctttggaatcactgagggatcaccttaagtttttgctgatggatatcttcctataaatctttctcagtgaaaggcttctttaaggtcaaagagcctgcatgctgcatgggtgagtggcaggtattagggttggggaccaccggccctgtgtcccgtctgggtaagatgctttattcctgccatcccccttgctcccagtgttttctcatacatatttctgaattttaatatttattctgtctcttgtactaaactgtgagcagcagaataaaggcagtgccttttatttctgtactctgaatgcctaccacagtgtctaacacatcataggtatttactgaatgtttgtttttgaagtatcctactctgtgaatcaacaaaacagacaacaatagctacaaggtaaagacaagtgtgtagtttaacttcttaaatgaaaattagtttaattaaacatggataaaaccatagaggaaaattttctatggagatttaaagggaacactagggcacttaaaaaatgagaactgtatagctctggaattttattgtcttatttcatactaaaatacaaggttttcctgcttatatgtatgagattaacacatactacaacaggataggtttttgtgttatttttttaaatgtcatgtagaggaggaggaaacaacacaaaagaaaggggaaagagaagaaggagagaatgagtattgaaaattgttccctagaaagccgggcaacaattgaagagagggaaaagaagaggaggcttagcgaagatgtgtctgtgtgtattccatgtgaagaagaacctgctgcatggcatggcagagcaaacaagccaaagaaaggacagagctaggcaaggacacaatttgaaggtaaagagtatttcggccaggcgttgaaccctgagtggcaaaactttcccagggcaacaagctgaggtgggtgtaggccaggtaggaacaggtattcacaatgcgccttttggaaggcggagggaggttgggaaggtcagtgtaacagggcatttctggtatgaaatgcctagtggtcctttttcagactattactgcatcagatctttttcaatttcagtatcaatcacctaccaaagaaacactgcatataaccttgggcagatcacataaatgtctctgaaattgctcatctataaaacgatctctaaagctttacactattcacactatttaatagtttattatatttaataatacatatttaatagttctgtgatactatgtagtttatactaggaattctaaaaggccaagcaacaataaaaattacatgaaagatacagaggaagaataaaataataatgattattccaaagaagggaattaaaacgggtaataaatagtgtgggaagatttcagtgttgtctagaattgagaactctctgtcgcctactcaaaatcacactgagaatcacttctttgatgttatcactgatgaggttgtgctggacatgtgcacacaagggtagaccgacccaaacgcccagttctcagcagaaaccatcaggcatagcaaatttatatcatgaatattcagcttctatcaaactcccagcatattttatcatattcattaccagcattacaaatgtataatgtaaataatgttaggacattatatagtaaataattgatctggtgaaagagaaaaaaaaaacaagcagcagtaaagcatgactaaaatgatgaggaagaaatatttacaacatatttgcaagtttgctcaagtgagataaaaactgacagaagtcttctctgtgccaccttctcctatatcagatactggaatcctgagcgggaatcaccgagcaaggtttaggataatgtaaaagccatgccttattaactcttggacatctcatttcttggttataaatcctattaacttgtattacaaactgccataaaacttggagataaaagataatttatgctcagtgtacagaagctaatgtttctgtactcctgagaagcacaggaccagaaaatgagaaagaatgtatgtgaaacctagagccacccgcactccacacaggcagcatgataaacatggctctgagcacctgactcttcagcaggaagatggcctaactagttactgacatcagcgatgtttcatatctgaaatgtctgtcatctatttcatagcatcccctcctcataaaaggtgatgatgtcttatcaagaacacatttttggaagtaaaagaaggatgtttatttaaaggaagggactattatgcatcctattttgaattttctatttttcgaatggcaaattgaacattcctacaaagtaaatgctacctaccaaggttttcactcataattacattttgacccatagtaagtgaaatatgccaaaaatacaatatgaaaaaccttacatgctaaaaaaaacaaccagctaaaaaaattccaaacaccttcccatattcattttaactggaactacctcattgtatccttgttttaaaattcaatttataactaataaaaatacaccacagagaggggactgaaaagagaacacagactttagactgaaacaactatacactttaagtgaattgctactatgacatataggtcagtccgaaatgactaaaataatcttaatgaatggaagataattacttatttacacaacctagtctcatgagagtctcatatgtaaacactccaaaagaaacacagaacatcacagaaagactaagatgatatgaggataggcttttttaaaaagatcaagaaaagtgcattctggttccagggactaggactattctagccaattaaaattagtgtagcagatataacacaagctctcttaccaagttactagactaaaaaaatgatcagataaacagttgctgtaagatgacttattcctcctactattatctttaatttcagatcatctaattgaaaaaaaattctggaacactctaggctcaaatctaacactcgtaataattaacatttatattgaatttttaccacttttaacatactttagcaaagcttaatggtaaatcacttagtctgcttaaatgatgaaagattattattagatgtaaattttattataaaacttcagaaagtcatttttccttaaggatacagcaacaagatgaggtagatccttaaagtgcatccaagatttattttacttgaaaataatatcatagtggaaaaaacatatatgtacacatatacacacacacatatatttatacatacacatgcatacaccaactggccatcagttacacactgcttatggacaattaccagcctatgggctgtgacttgtttcaagagtttattatttgcatcttagtccattaaccccatgaaggaggaaatgtaatgttgtggaaaaagtgttgagacaaaacacttcactgtgtgaccatattatcctgcttttctcccagtattgttataaggctcagatgagatgcttcttgtaaaagtatcagtattatcttcctcctcaacaactatatgttaactttaatttaaaaaaatttaaaaatttagagttttgaagtcattctttatttggcgctaaagcacacgagacattttcttaagcctacttttgcaatatttttaaatgatttcagtttaaatttataacatttctcctgcccatccggactgtgactgtatgttctaaaaataatgaacagtctgctgtagatgtccattctgaataccttccccaaagtatgcacaccatgtaatgtataggcacatttagtgcatgtatcacatatattaatgatgcagttatatgaagtaacacctgacagagccatttcagccccagtggtgcaagtctcatttctaggatgtagaatgcttctgtgcagtaattttatagtagttttttttttgttttttgagacgacgttttgctcttgttgcccaggttagagcacagtggcgcaatctcagctcactgcaacctccacctcccatgttcaagcaattctcctgtttcagccttccaagtagctgggattacaggcatgcaccaccacgcctggctaattttgtatttttagtagagacagggtttcactatgttggtcaggctggtctcaaactcctgacctcaggtgacaggcccgtgtcggcctcccaaagtgctgggattataggcatgagccaccacacccggtctctagtagtttttaactgatttttagtattaatcccattcacgggtatacaattaaaacttgttaccaatatggtggatcacatgagatccatccataccttaaacccccaaacatattcacttcaacatatgcatttgtgttactaattttcttgctattcccttactaaaagtgatagaaaagcagagagccaggctgtgtctcgataaagaactccctagaacagagtggccaagacgagcaaaggctgcactgctaaccccacaggtggaagcctgtgcctgccattgtcactcccttaaagaacagagagtgtaattttgcatgttctttttgcaccacactatgtaataattacttcattaggataaggtaattttgtagttattccaatgacacaaaatcaaaattatcacagagagaatctacattgcattatatttggggatttggctatgcaggtacccttaacatgtttaccactttagagaactggggattccaccttaataactaactaaagcctaacacattgtatgttacattcctataagttatgtagggtcatgattccagaatttctttcaagatatccatgtctggcagtttgagaaagaattgctttgtaagtcagtgtttcctcttcctgggcccacaagcttcatttcctagactgcctttgcagttgggctggggcggcagaacttcattcctgcagaaggtgacacaggttataggcaggcctggcctgtaaaaaacatggtgccacattctagtaatcagtttccctgcttcagcaatgtgttccagttagcttagatataaaatgtgggatgcctctcaagccacatcagatattctattaataagaaaaaaaaacttaataaacctaatcttggaaagcctctcagatctggagttgatcatcactgcaacatagacggaggggggggtgggaagtaactgaggtacagaggcaatatgatagattagtgccctggccaactgaaaacaatacaaatactaaaaaaaaaaaattaagagaatcttctaaaatgcatcaaatgtatctttaaaaaaaaaagaattctaggaggcagaggctgcagtaagcctagatcacgccactgcactccagcctgggcaacagagggagactctgtctccaaaaaaaaaaaaaaaaaaaagaaagaaaaggaaagaaataagaattttgcccagaagccaaaaactacattttgatataaaaagaaggccaaggctaactttcatctggagagtgtttagcaaatcagatgaacctgagcttcagtttctaaagcccccaactagggaaggttgtcagaagacaaagcccaaggcctgcccaaggttgacgtctaaaaggatgctgtaccacgtaaagcagagatccaaaatatcaagatgaatatgaacaacactcccactggtctgctaggaaaagtggccaaccaaactttggcactccataactgagaagatgagaaaagtctcccctgagcatttgtaaccagacatcagattctcagcagtgttacattcagagtctacactgacaacgtggtccaaaatagtctcagacaaaatgtcctaagtacttagtgctcccacagaactgggctacaagtccactcagcagccaggcaaaagcaaatgtaaattctccttggatttacttttaacccacacctcaaataattcccacacttaaagttctcagaaatgtgaggtcctgccaaaaatcataaaacagagaaggaattgaggtcacgaaatgtgaaagcaaaagtgaacacaaaaggcagctggcttacattagaattattctagactataaaaccagtttgataattatgttttaagaaagagccccttgaaaatgtgagtaaagggcaagcgtgtaagaaagaataatcatggcaggaattaaaaacgcagagggtgggtctagcggcagataggtagagctgaagcgggacagtgaacagaacacagaggtggtgaagaacttcagaatgaagcccagagagattaagacatagaaaatatgaaagtgctgagatatatatgatacaagtagaggatcttaaatacatttaattggaggtacagaagaaaagagaaaaagaatagggcaatatttgaaaacataatgattgagagttttccagaaatgatgacagacaacaatctatagatggaagaaaatccaatgaatcccaagccaaatgcatttcagaaagctcataattataccaattatagggaaaacacagaaacccaaaacagtaaaaataccttaatgtagaattcatattttagatgtggctttttctatcagtgaatctgccaattataattttaaaaagtattgtactgcatctttaactagtaatatattgaccagagcatctatacagagacaagttatgactgaatactttagcagtcataccatcaattcagtgcaatagaacaaagctcattgcttcacaatagtagtaagtttcaaacttcagaagctgttgggagtctatgggtatttaacaaacatataaattgataagaaatctaaaaagcatatctgtactgctaaccaaaatcttttaatgactttccaaaacctatggcaaaaagaagttcacattccattgtgtggaatttaaagctcttcacaatcagtatcccaattagttttgtatcttatcttctggcattcttccataccacagcccatattgtagctgcacagcccatattttagctgcacagaattacctgcaaatcctataacacatcctgcatctccatgtttcttccctggctcttcttgcattaaataactttcccatcatcttccacagcaagaatctactcatccttgaagattctgttgaattgtaagcttagtagaaggtacattgcatgaaaggatttctgtttgtattgttaactgctctatccctagaaaggagcctggcaaatagcaggtactcagtaaacgtttgttgaattaattgagtgaatacaatgtgagtgcctctgtgaagacttttcttactacacacatgctccagttttctattatttcattttttggtactaatctttcaacattgcattgtgattacatttgtataaatggatctttcattgcacttaatctggagagcaaagatcacatgcaactatttatttttatccttaattgctaggcagtgcaacaaatacgtagaaggcagtctgtaacggttgacaaaatacatggatagtatagtttgaaatctgaattcttcttctccccttccatatttatccagaaagcaacatggctaggacacgcaaagatccaggaaaaaaatgcaaaactggctaaagaatagtgagcatgcactaaacccaccctattaaccaaactacaatttctagtaatgccaggctacagatggtgggtagcaacagggtagcagcaaaatataagtagtagaccacaatgagaggcaaaaatggaaagtactgtccactatcttttaaaaaaaaggttaccaaatgatattttaaaactgaaatccaccaataaacctcataaaatttgtttgtttagtaagaattctgttctatgcactacattgagagaaaatgtcgttaatgtttatcactggaaatgaaagacatcattagaaattattctgagacagagaaactaatcaccaggcaacttatgaatagtaaaagctaaagactgtcttctaagtgcctaacgaaatcaaacccagtttccagttatatccaatgataatgacaacactcaaaatacgtaagaattacattagcaacatttgccaaaccttgtgtttcccctattgaggtttttctcaaatgtcattcacattcagctgttcaaaacgcaaaagtgctcaatttaattcttagtcaatttagagttacaacactttctcttgttttttagacacaataaaatgaaaactttcaggattctccttcacatttttgctggtcagtgacctggggcaaaactaaagtggccacaagaaagcgcacatgttcaattccactcacagttcgaagacccaagcagggccaatgttttcttctagtctactcaagtggtagaagctttgtgaaggaaagggctcacattatattcacttttgactcactggttggagcaggtagatcagcgattcctcttggattattataattggaaaaggagtgatgtgagtcgcttggaacaaggtattcacagatgccataatctggtcaaaacgcccagcaaggcctcccagtgtcacgatcacatcaacctaagcaaggaaggtaaaactgggagtcacatagagtcacatacaaaaaataagtaaaaatacagaatattggtgtttaagttttaaaataatacattaaaaaggcttaatgtgtgatccataaagatggcatgactttagaataataacctgttaaccaagcaccaacagaacctattcaattcctagagaaataggtggtatcaggtcatgaagccaaatgttgtgtttctctggttcaatggttataccagtgattttgcaaagtgctttacatacaagaagttcaagagtttgacgaatgaataaatgaagacattgcaagaaaagactcattagcctaaagaagaaatagattaattgccatactgtgggaatgtatacttcaaaatggggttccataacagcactaaaagtaaattatagagaagaaccaagttctgaaatgagtttcctatctgtgaccttatcagaatgtaagaagaatgggaatttttactaagggtaacatgcttcacattaagcttaaaatattttaagacaggcaaaccaatagctaaaagattataactggattgtttgtaacacaaaggataaatgcttcaggggctggataccccagtttccatgatgtgattattacacactgcatgcctgtactaaaatatctgtatgttccccagaaatatatacatctagtatgtacccaggaacatcaaaaattaaaaatcaaagaaaccaggcaggccgggcacggtggctcacgcctgtaatcccagcactttgggaggccgaggtgggcggatcacgaggtcaagacatcgagatcatcctggccaacaagatgaaaccctgtctctactaaaaatacaaaaattagctgggcccacgtggtggtgcgcacctgtagtcccagctactggggaggctgaggcaggagaatcacttgaacccaggaggcagaggttgcggttagccgagattgcgccactgcactccagcctgggcgacagagtgagactccgtctcacaaaaaagaaaaaaagaaacagaaaccaggcaaaccatacatctaaaggatctattattctccttggacatctttttagaattcgaagaattaggttttgtggctcagaaagaccatgtactctagggagtatgtattactccaaatacacaggcaatttccaggacatctgttaatattcagaggaaagagttaacttgtaagccattagacaaagacttatcaaagggatggcttctgtttgtgatatcaagttaggtaactgatttctatttatgtttaggaggccttattaaaagggcctctacagaccagttgggaaaggcccagagattatttatgacttcagaaaaactacagcatttgctttaaactgaagagaaatacataaataagaaattgtatataaaatatagagaaagttctaaggctgcagtaaaaagctcatggcatatgcctatccacataatcctaaattcatatcagaagcaaggcctgataaaagtttattcactatacagaatccgaaatcccctttctaggttctcaatttttcattactatacgctaagccttgagggatcccataacctttaagactgaaatttaatccccatcttctacaatgggatatcatgatgaacaggcaatatctgtaaatcaatcattaaatttttcagaagaaagtagcagcaagattacttctcatcactactcattttccctacaggaagtatttagcaagattgattaaaaacactagaggatcaatgcaagctgcaggtgggacagaaaaggaattggctttggatcatttttgcagttctttagttctggctgtaagtaggacatttgaaattcacagagatatcggaaagaggacagagtgttcaatctaaaatagaccatttatagactgcaagtgtgtcttttctacatgaacccaaaccctggtgcatttatttctaacatcacccagtcatacttggttataaacattgacatacttgtgaatctctccttctagaggaggcctatgaatcacagccgctagcacagtgtttgcaacagagtagacaacaggtatttactgagcttcccttgagcatataaatactcaggaaaaactgaataaataaccagagaggcaagaagctaattattcagctgagttaacatcacctaactcctacaaaatagtactttcttacttggaaatgattccaacaggtagtagcttttgaaaaaaagcaaacacatcatacttattagctcagatatacatctgatgcttttaaaagctttagttacaagctaatgacaagaaaaattcaaccagtgtttgttgatcatttaccatgtgctaggaaatatcctaaacacttaggatatatcggcaaaaatacataagcccctgccttcatggagttaatattcaaatgaaggataatatacacttgataaaaaggtttttttaaatgaatatataagttagaatgtgaaaaaggtgaaaaatatatagatatttaaaatatatagatatttaaaatatatagatatgatctatatattttaaaaagtcagcatgctgagtgtgttgagaataaactgtggaaaggcaagaaggaaagtcaggagatataaagagatcattatagtaatacagataagagataagtttgctaccccttattactccatcaaacatgattattcatggcatctacacagcaaaactcagtggtcaattcccagtccttttattacttaatccttcagcaatatctgacaagtgaaaaaaggtaaggatagcttaagagacttatgggacaccatcaagtataacaatttaaacattattggtgtactagaagaacaagagaaagagaaaagaacagaaaatatatttgaagaaataatggcagaaaacatccccagcctggggaaggaaatagaaagcaaatacaagaagcctacgatatatcaaataagataaatccaaaaaagacccacaccaagacacatcactgtcaaaatgtcaaaagttagggtgttgaaagcagcaaggaaaaagtgaattgtcacatgtaaaggaatctccacaaaagcatcagtgtatttctcagcagaaatattgcaggccagaagggagttaaatgatacattcaaaatccagaagggggatgggggttgttctgtcaaccaagaatactattcccagcaatcttgtcttttgaaaatgaagaggtaataaacacttactcagacaaacaaaaactgagagagcttatcatcactagacttgtcttatgagaaatgccaaagggagttcttcaagcagaagaagaggatactaattagtaacattaaaatatatggaagtataaaactttaagtataaaagcaagtatattgtcaaatccaatacactctaataacgaaacagtgctgggtaaacaattatacctctagtataaaggataaaaggcaaaattaccaaaaacaaaactacagctttaataatttttcaagtgattatatattataaaaaacataaaacaagacattaaaaacataaaatgtgggaagtagaagagtaaatgtgtagtatgcgttatgtgatcaaaattaagctgttatcaatttaaaatagccagttttaagtataagatgttttacgtaagcctcagggtaaccacaaagcaaaatcctataagagatacacaaaagataagaagaaaaaatctaaagcatactactccagggagccatcaaaccacaaaggaagaacacaagaggaaaaaaagaacagaagatctaaaaaacaattgctctacagaaaacaatgaacaaaatggcactagtaagtctgcacttatcaataattatttaaatgtaaatggattaacttttccaatcaaaaagcatagagtggttgaatatattgttttaaagactcaacatggaatgccttttttattccttcattttcagtctatgagtgtcctttaaagacttactttactttaaaggatactcataggctgaaggtgaaggaataaaaaagacattccatgaaaatggaagcaaaaagaatgcaggggcagctgtacataatacaaacaaaatagactttaggcagaaaacagtaaaaatagacaaagaagattcttatatactgacaaagggatcaattcatcaagaggatataacaattgtaaatatatgtccacccaacattagagcacctaaatatataaagtaaacattaagagatctgaaaggagacaaagacttcaacacaatattagtagaagatttcaataccccactttaaacattagaaacattagacaggtcatccagacagaaaatcagtaagaaaacactggacttgaactatactttaaagtaccacaaatgaacccaaaagacatatacagaacattctatccaacagcaacagaagacacactcttcttaagtgcacacggaacattctccagaatagatcatatgttaggtcatggaacaagtctaacaaatttaagaagataaaaatcatattaagtacttcaacatagtcctgaaagtcttagccagagcaattaggcaagagaaagaaataaaaagcatccaaacaggaaaggatgaagtgaaattgtatctgtttgttgatgtcatgatcttattaatatacacagaaaatcctaaagaagctaccaaaaaatggtttaaactgataaattcagtaaagttctagggtgcaaaataaaaaatcagtagtttctatatagtaacaacgaaccgtctgaaaaagaagtgaagaaaacaatcccattaataataggatcaaaacatgtttaggagtatatttaatcaaattataagtgaaagatctgaatactaaaaactataaaacattaacaaaaaattaaagatgacacaaataaaagatatcccatgttcttgaattggaagaattaatactgttaaaatatccatattactcacaatgctacagattcaatgtaatccctataaaaattccaatgtagttcttcacagaaatagaaaaaaacattcctaaaattcatatggagtcataaaagacaccaaatagacaaagcaataatcaataaaaagaataaagctggaggtatcacactaccagatttcaaaatatattacaatgctatagtaatcaaaacagcatgatactgacataaaaacagatacatcaacccatgcaataggatagggagctccaaaataaacccacgtatctatggtcaattgatttgcaacaaaattgtgaagaacacacattggagaaagtgtagtctcttcaataaatgatgttgggaaaactagatatctacataagaaagaaagaaattggaggccaggcatggtagttcatgcttgtaatcccagaacttacggaggccaaagcaagaggactgcttgaggccaggagttcaagaccagcctaggtaacatagcaagatcccatctctaccaaataaataaataaataaataaataaataaataaataaataaaagataaaaagtaaaaaaaaattagctttgcatggtggcacgcatctgtagtcctagctacttggaaagctaaggcagaaggatcgcttgagtctaggagttgcttgggtccttacctcaccccttatgaaagaatcaactcaaaatatattaaggatttacacatacgagcagaaaccataaaacataagaagaaaacatgcagaaaacgctctatgaccgacattgttttgggtagaaacttcttagatactgaccccaaaatcacaagttacaagggctaaaatagacaaatgggattggttcaaactgaaaggcatctgcacagcaatagaaacaattaataaaggaggcacccatgagctgggagaaaatacttgcaaatcatacatcagataaggggctacttttcaaaatatacaagaaactcagactaccctgtaacaagataacaaataacccttttaaaatataggcaaaggatttgaagacatttctcaaaagaaaacatagaaatggccaacagatatgtgaagaaatgctcaacatgctttaaacatcagatgaatgcaaattaaaaccacaatgaattatcacctcacaacttttagattggctattatcaaagagttgaaagataagtgttggtgaagatgtggggaaaagggaaaccttatacatacactgttggtggttttacaaattagtacagctatttttcaaaaaaatgtatggaatttcctctaaaaactgaaaatagaatcatgatatgatccagcaatcccactactgggacatacccagtggaatggaaatcggtatgctgatgagatacctgcattcctgcattcattgcagcattattcacaatagtcaagatatggaaataacccaagtatccacctaatgggttaaaaactgtggtatacataaataatggaatacaattcagcctttaaaaataaactaggaaattctatcatttgtgacatgaatgaacctatataagccagaaacaaagaaacaaatactgtctgatctcatatgtggaatctataaaagtcaaactcatagaagtagagagtaaaatgataattatcagagcctggtgttgtatgggggaaaaaaagacattggtcaatgagtacaaagttacagttagaagaaataaggtctggtgttctatttcacagcacagtgatgacagttaataatgtattatatatttcaaaagagctaaaagtgaggattttcaatgttctcaccacaaagaaatgataaatacttaaagtgatggatactcaaattatcctgatttgatcattccgcaatgtatatacatgtatcaaaacatcactgtgtaccccataaacatatagtcaattaaaagtttaaaaaatattcgtgcatacatacataaagctactcagcacatacctattatgccgtattttaaatatataaaatgtaaaatatcaatttctgactgctttccatatatttcctaaagtcaggatattttacatggacctttttgtttacaagatgagtgtgatgggaataaaggtggcctgtggttttcatatgcaatcccatctagcgaaaaggaccttgaaaccctggattaaaacattggaggtctagctatagcactgtatgccacttaagtagccatggaaccacatatatgttacatgacctcttggtgatctaggtcactcatctgtaaaggaaggggatgcactaaattcattatcatatttttcaagattcttttcacgtttaagtccatataaggttctctgttttccaccataagttaaatagtcatagtgtgtattttgtttagaaaataaatgcaaaactcagctttgcattatttaccttaatagaatcatgacaagactggttgagggacatatagcaccaaaagagaagtaatttcatttttctattatagcagtaaaaatcttttagtaaataagtgacaagttttactccatttgtcctcaaaaagacttaagagacagtatgcatgaagtctacagcaggcacactggctgtcagcatgttttaattacatttacttcccataaattgaattctagaaatgcataaatggataatttctttgtggctctccctgatagggtgatcatacaatttaatgtacaaactgagatacttttgaaagtaaaaatggggcattataaataaattacaccaagaatacaggcataaactgggactatcccatgtaaaccaaggcacatgtttaccctactgtctgagagttacaactaacattagtatagcaacttaacaaaattaaacactagggtataaaaaatttagattatgcttaataagcttcctttaactctcaaagatgtgtactgcactctagtgaggcttcaatagaataatgaaattcttggtttgtttgattccataatttgaagatggaagagccaatacagcgtttggaggaatgagtgggatcaagatagagcaagaacaaataatctgaccaaaaaaaaaaaaaggcaatactaaaacatgttttagtaagcctataaaataattctactgattaatatgaagctcaatgagaaaccagagaaagtaaagaactcgtattttatagtaccaaggtatgttatatgaacaaacacaggatatatcttgttgcatcttgtcaggctatggaagcactactacagggatcctgtttacatttcaagcaggctacattataatgtaaggtccagtttcatgtaagcatgtttgggtgagatagaaataatgcctcttgcagtggcaaaattttgaggcttccattcatagataagaaaaccaaggaaattctagatttatctcaaataattcttatttcatcactgttgccacagccttaattcagaaatcataattctcacatggataattccactggcattcttatctacaatgttgcctctataaccaagtagtctttcaattggttatgacagtaagttttccaaatattaaatctggcttgccaatgttctgcttaaaattaggtattggtgccgggcatggtggctcacgcctgtaatcccagcactttaggaggctgaggtgggcagatcatgaggtcaggagatcaagaccatcctggctaacatggtgaaaccccatctctactaaaaatacaaaaacttagctgggcgtggtggcgggcgcctgtagtcccagctactcgtgaggctgaggcaggagaatggtgtgaacctgggaggtggaggttgcagtgagacgagattgcaccactgtactccagcctgggcgacagagcaagactccatctcaaaaaaaaaaaaaaaaaaaaattaggtattggttcttcaggctccacaagatgaagtccatttgcctccagtcctgtctcataaatcacatcttcaactcccaccccacatttacattctagaaatacaatcagccctctgtatccatgggttctgcatccattggtttcaaccaactatggatcaaaaatatacagaaaaaaaactgtgtccgtactgaacatgggcagatttttttccttgtcattattccttaatcaatacagtataacaattattacatagtattgacattgcattaggtattataaataatctagagatgacttaaagtatacagaatgatgtacataggttatatgcaaatactatgccattttgtatcagggacatgagcatccacagattttggtatgcacagtaggtcctggaacaaatcccccatagataccaagggacaaccatactttaattctcagaacacggctgggcgtggtggctcacgcctataattccagcactcctgggaggccgaggcaggtagatcacctgaagtcaggagtttgagaccagcctgaccaatatgatgaaacctcgtctctactaaaaacacaaaaatcagccggagatggtggcatgagcctgttatcgcatggtggtgcacatctgtagtcccagctacttgggaggctgaggcaggagaatcgcttgaacccgggaggaggaggttgcagtgatccaaggtcgtgccattgcactccagcctgggcaacgagcaaaactccatttcaaaaaaaaaaaaaaatctcagaaaacctcacaagatttccaactttagtgcttaaactatcacctgtccgctcctttccttgtaaagcatttaattactgtaagtatttccaaaagatgcctacctccaccacctaaaaaagtgaacttgattggatagagtgttttcatcctacttttctaaactcttaacatagtgttaataagaaatgtcataaatgtgttgtcttagctctggcagctttaacaaattagactgagtagctaaacaacatttatttttcacaggtctggaggctgggaagcccaagagcaaggtgtcagcagatgcagttctggtgaggaccctctacctggtttgcagatggccatctattcattgcatcctcacatggtcacggcagagagtagagagagagaaacaagctcttttttttataagggctaatcccattcatgaagtctccaccctcctgaacgaattaccttccaaaggcccaacctcctaaatacaatcacactgggggtaggatttcaacatatgaattttgggagacacgaacactcagtctataacacatgattataaaaaatctttttttcaacatgttatttttttaaaaaaggtgtttttaaaaaaggaggaggaaccacacatgaagagtcagcaatgtacacaagcttctttgcatttgaaaaactacgggagctgtgatgaagatctgtgctaagatatgcgtctgctataaatcataattcccccggtaaaagttttagcataaaatcccaggcagtctatactctcattaactctctagcactgatgcccctgtacctctctggagagctcagccaagggactccaacttccttgcataagtggaagaagaaagtcttgctggcagaggtccctgacacactaagataggaaccagcaggagaagagtccaggagagaatgaccaatcccagtgaagttctctgctagcttgttaaaggaagcaaatgtaaatattgcctgaacccagggtgtatgtgtgattattacattctctcaggactgcctattctttgacattccagaattaaggggtttacctttaactttgaatactcaaaataaacactccccttattctggttagcccttactataccttcaagactcagcagactgaccacctccactaggaaggagtctttgaacactctaggctggaaaacgtttgcttcaatgggcttctcacccaccctatcagacttctactgtagcactactgacagtgtatccagataatctgattacaagtgcatccacccccaaagacaggacagtcttagagtcagaaactgggtctcattcagtttgcatttctcaatctataatacttagcagagtgcctggcacatgcaaaatagatgtttgtttagctgaatagttatagttttgagctttcaattttgtcagaaaagatcaatcagcaccaagtatatactttaaggctaatttctgaggtctctattcctttctcaaattcttgatggagaaaatgactaaagtattgttcttcaaagaacactgtaattggttcattactgtcattagattttccatccttcaatgcagcttgcatacaaccattacattatttttctaaattgccttatgattttctgttcaaaattttttaatagcttaccattatctatatagatcaaggttcaaatttcttatctagaaattaaagattcttcatatgttgaccccaaacaacctaaatctgtgactgctgtgacatttctcctcctttagagcactccctagctacaatggatgcagtgcttttatcataggtgtgttctgtttaccctcagattgcttcaaagaatctctgaaagcactttaatttcaggtactctggtcatgacaatgtataggacaatgacagagagttcactccctgaacaatgaaaaccttttctgattcaccctaggcaaggattttgaatcttttaattaaacatttcaagcctggttgccttatgattttgtaataatcgtggttgtaataatagtgctttcctcacaaagctgtcttgaatattgatatttccttgattaactggactataggttttcaagccagatcagtgagatccctatagatgggacattttttgcatataaacaaaaacaataaccttatatctagaaaatgtagaaatgtgttatttttcttccccatataaatacaccatgggacagaaagggcaaataagcaggtatttacatttccctatatcagaagtgagtgataaacgagaggtgaatggaataaaaaaaccgttgtgggaagtttcttttttaacataattttattcaacttatctttgctgaaaattaaattctttgaggagaagagcaggaattatgagtaaataacaatacataaaattagtgtctgtataaacagcatagatattataaaacctactagaggtaattatggtgtccgaacctctcatattctcaggatatgaagatattttagtgaattcaaaggcattccttttgaattacgggggttatgaggaatggaaagatccattgtttgtggtttagaatggtcataatacctagtgtagcatctttaacacactaggtgtttagtgtaaaatgaaaaataaaagtgtgacttatattcagaaacaattagctatttgaagacagtcttttgaaaggatattacaattttattttataaatgttgcttggtacacaattgaaaacattccaaaatttattgttgaagtcttactcaaaaagtaccaagtattgtttactctggctaaaaattctctaacatacataatgccccgctaaagttgaatacctgaaagaacacgaaccagtcactccttccctttccatggaaaatgggttatgatagctcagaatctgtatcctctttcttcagtcacacccaccaatgatcaagttgacaaaagacaattttccaagccactttggaactgattgactgtgataaagacatgctctggtcccaggagattagtatatctgtacttgtgatcatttcttaatagcaactatcctctctttcattatcatgattcgttttaatctaagaatatttcttgcttgaattcagccatgaaataagtcttagtcgcacagtcttattgaaagtgatacatgaaacacctggcttccatgtctgcataaattagatttggctatttgtactatttttggtgtattatttcccccaaagtttagtggtttaaaaccctctccactttttattgcccagttataacaggtggccatcagacttgctgtagtgcaatccttagatctagcaatctggtgtaacatacacagtttacattaattatcccctttccaccttctgggagaacacagagcattttgattgcaaattttgtactttgccattaacattctggtttctagatatgcactggaccatttcataatgccaaatgagaatgttaaacatattactgtagtgacattaattaaagtgtatttcttgcaatgcagttaagtttgcttcacaatgcagtaagtttgcttcacaagttgaagcaaccccaaggttgaccttaaaatgataagcaatgctatttgctattttacttaaacgtattccatatccatgagcatcaaagtaaatctgtaatctgggataaaatatttgttcaaataataatttcctctctaaaataattccctttatttatatgaatgctttacaaaaaaatcagaatctttagggtcaatctgatacgcatctaaattctctagtagaaatagatgaggaaacagaattaaactgcaatcaatataacttgatttagatattcctatttcctatatgtttcaagataccctgatccggttgttcatattgagaattatatacatcgacatatatgttcacaggggaaggtacacagcagattcaggaaagaagctagaatcatcttatttctactccatgcatctggattttcgtatgccattttctgttttgaaacggcacgttaaccatggagtgctaagtacaaatgggaaagcagagggtcatggacacaacagaaacatcttctacttccagctactaacagaagagatggatagaaagtgaatactataggattccatcttcttctttaacttacatggaactttctgagatacctaggctcatcacctaacacaaagcaaaaaattacatgcatctcttttcttcattacctatttaatcaccactaaaaatatatcgatctgacatatgtagacctgtaatgaccagtaacatcattacagtttttcagtcatgacttaaactataagccaaacttttatttttgtttgtttgtttttgagacagggtctcactctgttgcccaggctggagtgcagtggtgcgagaacggctaaactgcagcctcgacctccaagtctcaagctatcctctccccttggcctcccaagtaactgagactaaaggcatgcacgactacaccctgctaatttttgcttgtttgtttttatagacgaggtctcactatgttgctcaggatggtctcaaacttctgggctcaagcaatcctctgcctcagcctcccaaagtgctgaagttattggcattagcccctgtgcccagccccaaaacatttcttaaaaatatagacagtattatcattgtggacaatcataattatagatatagggactaccacatgtaatatttctggctaaggaatatacagaatgaggacaaattttataatctactaagtaatttcaggatgttctattatatgtgaatttttcttacaaaagtcctcaatacatagtttctccatctgtaatttctgcattctcacaatgcggtaattcaaaataaaatactccttttcatgtaaggtcagcgtgtcttttgcagaggagccccacaccaaccaaatctggaattctctgcattaataagaaattttatctggcaagtgagtcatcaagctgagattcctggtaagcagataaacttaacccttgtcttggggcctataaaaagcatgcttctcctccggcagggatggattaggttgccacagcctctaaggtagtaagctttttatatccgtagcaacatctcccaagtcacttcaaagcactgggtttatctattttctcttgttgcacagcactataaaaaagattgctgatctctaagaagcagaaatagagatgtgaattcctcttttgaaggcttctccaaaatgatctaggaaatagcctgctaacacaggctgatgcccagaaatctgttccttctctttgcctctttgtctgatacttagcttgcactgcgtttgttccaaaatctgaacatattaagtagctactttggcactcaacaaacagaacaatgttgttatatactaaaaagcaaggattggtgtatgtagacatatttatgtgtaactgaatgattgaatatatatataaataaatatatgtgtcatgttactttctagaatcttatgaaaattatcaatttaagcttaccatatccctttgaggtacactggcacaggcaaaaaggtagtgaaacttgtcataaaagtattacgatgcctcggttacacagctgatgttggaattgaacagtattcctttcactgtttcttcttcaagaaagacagcaagatttattattatcaagttcacaatggcaatggcatatgagacaagctttatgtattctcatgttttagctcttgacttttacaaataacttagaacttggaggaagcagttccaaaaagttataaaataccaattaaggaaatgagaggaagatatatggactgtacaatttttacttacacacaacatacatcctattgaagatcctctgttgtaggtaaaaatactgaaggtatttataatcaaataatcatacacaatcatataatactggatatataaccatttacaacataattatatatataatcatgtaatagtagatataataatggatatttccatgtactgccaaaataaaaaatttctcaaggggtaagttctgtggcaatagaataagccctgttaagttaaagcagatacttaatgtttgctaacatttgataagagtttgttacaacaagattcttctgtatttgtttaactactgattcatttaataaatatttatgaagtgcccgctatgtgccaggtattgctttaaatgctgaggacacagcagagtacaaacatgcagaattccctgtccatgtgaagtttataatatattgaatgaatatgtaatagaaacaaacatcctaaatatgtagtatgtcagatggtgacaagaaaatggagcaggggaagatataaggatggcttaaccaagggattcaagaggtagagctgaggggtgctgccttaaatatgatgttcacagaaggcttcaacatgagctgcaatttcattagaaaaaaactatattattccattttctcaaaaaggaattatatataaataactgcagagtaatctatccaaaagaagttgaatctattctgaagaggcaagttacagtatttattacagtagtctaaatcattctatggtcacctgtaaatctgtctcctctattagaccgaaggctgtttgagattatggacttagtcacgaaatcacagcatactgacttaaacagaacagatattaagtaaaagtttgttaaggtgactggaagaagatacctaatagcctctatagtatatctaagaggaggaagtttgcctgtggaactctaatatgaacttttgcctaattttagggtaatataacctttcatgagcataaggcctataatgtccatactaggattagcaagggtagagcagatccttccttttttctccacacaaaggcaaggtacaaaaatagttacctgggttgtacatctcactctctgttggattccactattaaatatagagatacatttaatatatataggttctctgggaataggggaagttccagaactcacctgggaaatacattaacatgtaataagttctcagtttaattcaagtttctgatattgagagttcttgtaaaattagagtatgtccaaaaaaaaaaaaaaaaacccacaatactctattgagagtcccatgaacctgggtaaaaaactgtaactaatttaagagatttctaagacatactctaattcttaagtgatattattccacaaaatctattacatttagttgcacaagagtgtattacaattattaccaccactatcgctaatttttaaaataaggacttcctatgggacgggcactgaaatacgtgctttaccatgtaatgctctgttataggtgggttagtatttttactttacagatgagaaaatccaggcttaaagaacttaaatactggccgggcgcggtggctcacacctgtaatcccagcactttgggaggccaaggtgggtggatcacctgaggtcaggagttcaagaccaggctggccaacaaggtgaaacctcatctctactaaaactacaaacactagctgggcatggtggtgtgcgcctctaataccagctactcgggaggctgaggcaggaggattgcttgaacccaggaggtggaggttgcagtgagctgagatcacagcactgcactctagtctgggtgacagagttctcaaaaaaaaaaaaaaaaaaaaaagaaagaaagaaagaaaaagaaaaaaaaaaacagcaacaacaaaaaaaaacttaaatatctttctactgtcatgcagctaaaaagagtgccaggcctatcctgagcacctgaatacctgacttctaattacagtgctttgaagattaacattttattaaagtttaaggtggtattattactttcaataataagcatattcattgtcacaattggtagagacaagcaagattctaaagcacctggacacatgtcacaggagaattaacatggcatcaagaatgctagcaacaagagtcctgaagaaagttctatacgccagctaagttttagcataatgtcctttggaatagagaaaactgatgttattagaaatgcatttattcattaaataaatatttcttgaatacataacaatgagagacaataaaaaatttaaagcagatatagatttaagatatattatatgaattttggtaagataatgtactgaagggggcgagcagaggctaatatagtaacccaagtgagaaatgataaatgtttgaactcatatagtggcagcaagactgccataggacagagatctgaagaatttcagggaactgtgaccaactgtcaagggatggtagagtaaggcataaacttactcttaggtttccgccaggcagttggatggtagtgccattgaatgagaaaggaaatataaaaagagaaaacgagattcttgtgagactaataatgaattttgttttagacaataaaatgaagttcctctggtcgtccagttagcaaggagaaaaacagctttggagtttaggattaaaggtacgaattaggtacaaatttggagtttaggattaaaggtacaaattaatgaatggcacagaagtggtaagtgaaggtcacagaaacaagataaagaggagaaaagcaggtatgtcagaatgtcagcacaggcaatgcccaagagaaaatgagaggctgaaggagaccaggacagagactgacaggcaagaagaagaggcaggaatacataggttagtacttctagagttaatcctgataaaaacatatctagtggcagttctacctttgatagagtcttaccatattttgaaatttatcccttgggaaagtgggaaagttgagagcatctgggctgtctccatagtttaaagaccatcaaatgtctacctaagattttctaccaggcataattttcatgtaaaacagttgtctaaatatgcatcagaaactcacaatttaaaatttcctgaggaaatattttaaaggtgggagagtccacaaaaggcattgttttttttttgttttttgttttttgtttttttgcctaagtactaagaagcacttgcctttattctatattactgtgagccattcactaaaagattacacctgttctagggtaatagcatatttgaaacagtgaatatattttctcaatgaaatgttgtgttttggaataattttagatttactaaaaagttccaaaaatagtacaaggagtatactcttcatccagttttcagcagtgttaacatcttgtctaaacacagtacataggatacaactaagactgacattggtcactactattaactaaactttcaagcttattcagatttcaacagctttccctaatgtcctatttttccactacacaacagaaatcaggttaccatactgcagttagttgtcatgtcttcttcatctcctctggccataacaatttctcagtctttctctgttggccttaaaaatgttggtcaggcatttgatggaatattcttcaacttggagttctttgactactttaaaggttaaagtggaattgtggattttagagaagaactccacaagtgcccttctcaacttatatccatgtaggagggcattactagtatgatataacgatgttattaatgtttttcacttgattaatgtggtatctgccaggattctccactataaagattttttccttttcagaatacatttttacacatacacacacatatattttcctttagatcatgccaaagataccagttcatgaaagcaggctgtactgagacaccagagtacctggaaagatatctcttggggtactatcatggtttttcctgcaacccaatgagtcacatctttttatgctgctgagtaattagtccaatcagacagttagccttaaattgtattttcaatggaggagaatgttcatatttagtatgaaaataaaacaaatccaccagtccattgcagaaaagtaatgtacacctaaatccaatactgataattagaagataaaacaaaatattctaagctcatagaatttgctgctgtataaagataatgtatctatctgagaaatgccatgtagacattaaatagaaagactgttcttaacagagtcctaatggtcaagagttaataacttcaatttggacatactcaaattatacagaaatgtcttaaaatatgtaaatcacaattcagtacttgcccagcctattaagaaaataaaaaagaataatatgtaataaacctatggccttcagtattatttaattcagtcatttatgtgtgtgtgtagctgtatgtatatatatatatacacacacacatatatatataatataagcatttgccctcattcatataacctactcaccatccttcattatttgatttaaaaactgcttaagaaattacatggcataatataagctggctaaaatgtactgaggttttagcaaataaaactagtattggtttaaatctctaaagcattcagattgaaattaatggaaacttttctgctcagattttgtctaatatatagtctatgtttaaaattgaagtaactgattctgttgccatataatactagtaaatatcctaaagagacctatcctgttattcttagggcctcataatcttaatttatttctgctttattgtaaagaacatgcatcttatatgtttagatgtttagagagacagcttttaatgttttccaccaaatcccagggtttagatctcaagtgtgtatcacagcatccgaaaatatatgtgtcctttgaagactcagacatatcagatggcatcctgataatgtagtattcatgactcagttacagataaacaatgtggcaacatgaaagcaaagccttaaaaagtcccaggtatgagagaatccttttgtggaagagtaaatgttaagggtgattgggtttcaattagatggatacatgaactaaaaaggtaatttaggggaatttaaaaaaagtaatctcatgttctagatagtaaactcctttaggatcaggacagacctaattcaaattctatgaatttctaacatatagttctttaatatattaaatactattttgcattttatttacattacaattaacattttatagtaagaggcctattataaaatatactttgattataaattcatatttataatttaataagtagaaataaaaaatatataataatttgatatgatttattagatggagaagaggcatataaagatttgatacagtttatgtgtattatcaggagaaattttaaaaaggcttcatgatctcatatggagacaggagtatgggtggagggaaatcttgtattattttcccttctaatgttgcttttctcttgctataacatcaaataaaatacagtgttgaccttccaagttaaatgtaaagtcaggtggaagctcacagatactccacttcctcagatttaatataatcactctgcccactttttaatggggttgtttttctcatgtaaatctgtttaaattccttatagatgctgaatattagacctttatcagatgcacagattgcaaaaattttctcccattctgtaggttgtctgtttactgtttatagtttctattgctgtgcagaagctctttagtttaattacataccatttgtcaatttttgcttttgttccaattgcttttggtgtcttcatcatgaaatctttgcccgtgcctatttcctgaatggcattgcctaggttttcttctagagttttgagagttttgggtgttacatttaagtctttcatctatctcgagttgacttttgtatatggtgtaaggaagtggtccagtttctgttttctgtatatgactagccagttctcccagcaccatttactaaacagggaatctttcccccattgcttgtttttgtcaggtttgtcaaaaatcagatggttataggtgtgtggtcttatttctgggttctctgttctgctccattggtctatctgtcttttcttgtactgcagccctgtggtatagtttgaagtcgggtagcgtgatacctccaagctctgttgtttttgcttaggattgccttggttatttgggctgtttttttggttccatattaattttaaattagtttttttctacttctgtgaagaatgtgttggtagttttattattcaattattcaatgggaacagcattgaatctattaattactttgggcagtatagccattttcatgatattgattcttcctgtccatgagcatggaatgtttttccatttgtttgggtcatctctgatttcttagagccgtggtttgtagttctccttgaagaagtccttcactttcctcattagctgtattcctaggtattttattctttttgtggcaattatgagtggggagttcattcatggtttgctctcagcttgcctgttgttggtgtataggaatgctactgatttttgcacattgattttgtatcctgagactttgccgaagctgcttatcagcttaagaagcttttaggctgagacaatggggttttctagatataggatcaggtcatctgcaaacaaagatagttggacttcctctcttcctagttgaatagcctttatttctttctcttgcccgacaggcctgcctacaacttccaatactatgttgaataggagcgctgagagagggcatccttgtcttgttataaaataactcttatctttcggggaggtaccaagatggccgaataggaacagctccagtctacagctcccagcctgagcgatgcagaagacgggtgatttctgcatttccaacggaggtactgggttcatctcactggggcttgttggacagtgggtgcaggacaatgggtgcagtccacggactatgagccaaagcagggcgatgcatcacctcacccgggaagtgcaagaggtcggggaattacatttcctagccaagggaagccgtgatagacggcacctggaaaatcagtcactcccaccctaatactgcgcttttccaatggtcttagcaaacggcacaccaggagattacataccatgcctggctcagagggtcctatgcccacagcagtctgagattgaactggaaggtggcagcgaggctgggtgggggtccggggagggcacccgccattgctgaggcttgagtaggtaaacaaagcggcccggaagctccaactgggtggagcccaccacagctcaaggaggcctgcctgcctgtgtaaactccacctctgggggcagggcatagctgaacaaaaggcagcagaaacttctccagacttaaacattcctgtctgacagctttgaagagagtagtggttctcccaggatggagtttgagatctgagaacagacagactgcctcctcaagtgggttcctgaccccccagtcgcctaactaggaggcacctcccggtaggggtcgactgacacctcatatggctcagtgcccctgagacgaagcttccagaagaatgatcaggcagcaacatttgccgttctgtaatatttgtggctctgcagcctttgctggtggtacctaggcaaacagggtctggagtgggcctccagcaaactccaacagacctgcagctgagggtacggactgttagaaggaaaactaacaaacagaaaggacagccacatcaaaaccccatctgtacgtcaccatcatcaaagaccaaaggtagataaaaccacaaagatggagaggaaccagaacagaaaagctgaaaattctaaaaatcagagcgcctcttctcctccaaaggaatgcagctcctcgccagcaacagaacaaagctggatggagaatgactttgacgagttaagagaagaaggctttagaagatcggtaataataaacttctctgagctaaaggaggatgttcgaacccatcgcaaagaagctaaaaaccttgaaaaaagatgggacgaatggctaactagaataaacagcgtagagaagaccttaaatgacctgatggagctgaaaaccatggcacgagaactacacgatgcatgcacaagcttcagagaaagcaagaaagatctaaaattgacaccctaacatcacaattaaaagatctagagaagcaagagtaaacacattcaaaagctagcagaaggcaagaaataactaagatcagagcagaactgaaggaaatagagacacaaaaaaacccttcaaaaaatcatgaatgcaggagctggttttttgaaaagatcgacaaaattgatagaccgctagcaagactaataaagaagaaaagacagaagaatcaaatagacgcaataaaaaatgataaaggggatatcaccaccgatcccacagagatacaaactgccatcagagaatactataaacacctctacgcaaataaactagaaaatctagaagaaatggataaattcctggacacatagacactcccaagactaaactaggaagaagttgaatccctgaatagaccaataacaggctctgaaattgaggcaataattaagagcctaccaaccaaaaaaagtccaggaccagatgtattcacagccaatttctaccagaggtacaaagaggagctagtaccgttccttctgaaactattccaatcaacagaaaaagagggaatcctccctaactcattttatgaggccagcatcatcctgataccaaagcctggcagagacacaacaaaaaaaaagataattttagaccaatctccctgatgaacatcgatgcaaaaatcctcaataaaacattggcaaactgaatccagcagcacatcaaaaagcttatccaccatgatcaagttggcttcatccctgggatgcaaggctgcttcaacatatgcaaatcaataaacataagccatcatataaacagaaccaaagacaaaaaccacatgattatctcaatagatgcagaaaaggcctttgacaaaattcaacagcgcttcatgctaaaaactctcaataaattaggtattgatgggacatatctcaaaataataagagctatttatgacaaacccacagccaatatcatactgaatgggcaaacactggaagcattccctttgaaaactggcccaagacatggatgccttctctcaccactcctattcaacatagtgatggaagttctggccagggcaattaggcaggagaaagaaataaaaggtattcaattaggaaaagaggaagtcaaattgtccctgtttgcagatgacatgattgtatatttagaaaaccccatcatctcagcccaaaatctccttaagctgataagcaacctcagcaaagtctcaggatacaaaatcaatgtgcaaaaatcacaagcattcctatacaccaataacagacaaacagagagccaaatcatgtgtgaactcccattcataattgcttcaaagaaaataaaatacctaggaatccaacttacaagggatgtgaaggacctcttcaaggagaactacaaaccactgctcaatgaaataaaagaggacaaaaagaaatggaacaacattccatgctcatggataggaagaatcaatatcgtgaaaatggccatactgtccaaggtaatttgtagattcaatgccatccccatcaagctaccaatgactttcttcacagaattggaaaaaactactttaaagttcatatggaaccaaaaaagagcctgcattgccaagacaatcctaagccaaaagaacaaagctggaggcatcatgctatctgacttcaaactacactacaaggctacaataatcaaaacagcatggtactggtaccaaaacggagatatagaccaatggaacagaacagagccctcagaaataataccacacatctacaaccatctgatctttgataaacctgacaaaaacaagcaataggtaaaggattccctatttaataaatgctgctaggaaaactggctagccatatgtagaaagctgaaactggatcccttacttacatcttatacaaaaattaattcgagatggattaaagacttaaatgtcagacctaaaaccataaaaaccctagaagaaaacctaggcattgccattcaggacataggcatgggcaaggacttcatgtctaaaacaccaaaagcaatggcaacaaaagccaaaattgacaaatgggatctaattaaactaaagagcttctgcacagcaaaagaaactaccatcagagcaaacaggcaacctacggaatggcagaaaatttttgcaatctacccatctgacaaagggctaatatccagaatctacaaagaacttaaacaaatttacaagaaaaaaatcaaacaacccatcaacaagtgggcaaaggatatgaacagacacttctcataagaagacatttatgcagctaacagacagatgaaaaaatgctcatcatcactggccatcagagaaatgcaaatcaagaccacaatgagagaccatctcacaccagttagaatggcaatcattaaaaagtgaggaaacaacaggtactggagaggatgtggagaaataggaacacttttacactgctggtgggactgtaaactagttcaaccagtgtggaagacagtgtggcgattcctcaagaatctagaactagaaataccatttgacccagtcatcccattactgagtataaaggattataaatcatgctgctatcaagacacatgcacacgtatgtttattgcggcactattcacaatagcaaagacttggaaccaacccaaatgtccatcagtgatagactagattaagaaaatgtagcacatatacaccatggaatactatgcagccatagaaaaggatgagttcatgtcctttgtagggacatggataaagctggaaaccatcattctgagcaaactatcccaaggacagaaaaccaaacaccgcatgttcttactcataggtgggaattgaacaatgagaacacttggacacagggtggggaacaccacacaccggggcctgtcgtggggtgggggtagtggggagggatagcattaggagatatacctaatgtaaatgacgagttaatgggtgcagtgcaccaacatggcacaactatacatatgtaacaaacctgcacattgtgcacatgtaccctagaacttaaagtataaaaaaaaaacaaaaataaaaaatacaataaaataactcttatctttcaagcctctgcaagtaagttagatgcttcttcacaatgtactattctttgtccaatgtagtatataaagcaacaggctttaagtacttctctgggtcttcacttctttatgtgggctcccatgccatgtaaaatttgtatgaaataaaattttatgctttgttcttgttaatctatctcaggtcaatttaattctcaaggcccagtcaggaccctacgaggatggagataggagttgtgcccactcctacaaagtgctatacacactctgtgtgcactacagtacttcctgaaacactcttctcccctttgctgtctgatatagtctggatgtttgtcccctccaaatctcatgttgaaatgtgatccccaatttctgcagtggagcctggtgggaggtgtttgggacatgggggtggatccctcatgaatagcttagtgccacctttgtgctaatgagtaagttctcactctattagttcacaagagaactggttcttttttttttttttttttctgaggtggagtcttgctctgttgcccaggctggagggcagtggtgcgatctcagctcactgcaacctccgctataggatatcggtcagggtggtgggagattataaagttataggaaacagacacaaaccttcttggaaggccagtgggtttgcatagcttcagtgaaggatttggctgaaggcaactgaattctcttaaaagcttagggcaaagatacataggaatgtaaaggagtttatctaaatagcttttttactcatgtggtcctaagaccaacctttgatcatctgtgggctcatgactgctctctactcaggagatcaacaatgtaaattaccctctagtggtgtttacttgagaactttgtcatttaatttgtactaaataaacgcaaactttgccattttatggaggcgaaagctgcagactcaggcgtcagagccccttagtcccactgacaggcaaaatacctgtgtcagtgtatgtctttcatctgttgctgggtcagggtctgcgggttggacccggcactctgcctcctgggttcaagtgattctccctcctcagcctcccaagtagctgggactacaggtgtgtgccatcaccccagctaatttttttatttttagtagagatggggtttcaccatgttagccaggatggtctcgatctcctgacctcgtgatctgcccaccacaacctcccaaagtgctgggattataggtgtgagccaccatgctgggccaagagaactggttcttacgaagagcctgtcatctttctcgctcccttcttgccatgtgacaggcctgctgccccttcaccttttgccatgagtaaaagcttcctgaggggtcatgagaagccaaatagattctgatgccatgctcgtacagccagcataggcatacaccaaatacaactcttacctttataaattacccagcctcaggtattcctttatagcaatgcaaaatggactaatgcactgtctacctcctatttgcttactatgtctcagccttctctaaaaagccttctcctaactgtgttatgttccactctcctgtgtgttcttgtggtgcataaaacgtaccaaactttcaaggaatacttcttttatgcaaaatactgctgtcaagttatgaacaagcaaacctgagctcagcttcatgggctgtacagtcaagctggcaagaatgactttaggcaaacaattagaaacaattagtaaaatgatcaaaattgttcagaataccctaaagaaaaaataaaggagggtatggaaatgtagagtaactaaacctaacctagagtgatagttaaggacagccagtcaaactctgccatgcccactattctaagtgaagtaactcagaaatggaaaaccaaatactgcattttctcacttataagtgggagctaacctaagagtgtgcaaaggcatagtgatacaatggacacagaagactcagaagaggagagggtgggagggggttgagggatgaaaaactacctattgggtacaatgtacactacactggggtaacaggtgcactcaactctcggacttcaataatgtacaattcatccatgtaaccaaaaaccacatgtaccccaaaacccattgaaataaaaaatatataaaaataaataaatgtatcagacctgaaaaaaaaaaaaaaagaaaaagaagccctctagcatgcatggtctagacaaagaaaaggaaaaataagattccaagcagagggggcaacatatataaaaacacattaaagtaggagggaggagaaaatgcggcatagtttaagaacaaggagaaacactggtgtaggatggggctggagaatgcattgggtccaaagcatgttggggcctgaggcagcacaggcagtgtaccactgcattgctcttcaaaaaagaactcactgttaggctgtgtggaggccagtcatccgtcatcagcccccgctgcaaccccttcaggaggcagcacatcacagccaccaagtctgtactcttccttggcaacctctaagccaagtccaccctcctcatgagcaccctctagtctgtgactaagcacagttggagtacaaggttgttgctatttctgcccagtgcaggggccctctaacagctactcttgcttccagagtccccaccagattggccaagactgtcagatttgtttgcagatcataccctcctctctcagtttggggctctctctagatctgggccttgttgagtttaagatatgatgatttgtttcaagcctcaacgacagaatactgtattactgatactatcgattagacacaactcattagactcacataattgcgtcttagcttttaatcatgtcagtggaggtgatgggaaaaacaaaagacagctgtgaatatttacactgtttttccaaagaaacaccaaatcactgatatctggatgaaataagtaactctcaatttgctgtttcctgctttcattaaacaaatacttaattatatcaatttactgctggaaatatcacaatacatttgatatagatcagcaaagctacatcagagatgagaaatgttcactcaattatttttgtttgagttcgcagattgagctacttgccaattgtgatagttagcaaggttttatttcaaagggagaaaagaatttactactaactgcaacttagtaaatatatgctacagtgtatctttaacaaacttttgctagagagtaaatttttgttagagctgccactctgatatctatcccatcctgccaaatatgttttagccacgtagtttgaatatataagccacgtggattgatcccacacctggctccagcccaagacaatcaggattctctcgttctcctttgccaaaagcaagagtggtttaatggagagatcttaagggttaagtccaatgatggtgggaagtgatgtatctcaccagctctatgtcttaatccccctacatgtgaagggtaaaatgttactgcaggtggcagttggagacaatcaaggaagctagtgtgaagacaaaacctacaaagtgaagccaagataaataaaagaaaaagggcatgagttctgattaagctctgtctcaagactgccctacatcacttggttattgagagcaggttgacatgtgttttctgttacttgtactatcaaaatcgttctaatatacaagggtgttttcctacttttcttggtttaaaattacacaactgatcattcatctcagcttaaaacttattgcccctgctagtgggggaaaaaaaggtcaattgtcattcattgcttcaggtttaattttgtagctgttcattaaacacagtcttaagaaactttgcataccatttcaacaggtatcaaacaataaagtataaactggtgtactaattaatgcaattaaacatttggatgctaggtgaaaatcagtactgaataccttaaagagcacagaatgcaaagcagtagactcttctctggcttaaaaaaagctgatattcgtttaaataaaaatttgcaatgatagcccaggggccaaatcaaggccatatttgttttgcctatataatatgtaaatagacacagtccaaaaatacatatagctcttcatggcaacaatcaactagagacgaatagtagctagtcgctttcaggcaagaatgagttcccagttttgattacttgacacacggtccagttcacccattttattaccatgccactgtaagatgtttacatttgtgttccctggtttaagtgcacatgttaatgttttggcagctaagtgcagacttatctgctctacaggggaaaaaaaacctgacagcaatttaaaaaaaaagaaaaagcacaaaagtaaatatccatttcagctgagtgaaaaaataaacacaaattgttttcacatccttggaataaccaccaaatacatgtatatattacctttaagtctttttcttctatcttcttttggagcattttaaggcacttagtaaagtcagtgtggtcttgatcaggagttgaaatgagctcacatccctatgtattaaagtaaaagaaaaggtaagaataagtagtaaattcacctttatgaacaagatcaagagttacaaaagtaaagataaggtatcaatagacatatcctattatgcctttactattcctgtatcattagaatcattatcattatcttttttatttcacatcatgggacatttcaggaatggtattagagtgttacaataatggactgattatgacaatcgttttatttaagaaagtatagattatactacattaatgggtctttaaaaaatacttatgtgatgacattcacgattaacataaggactttgatacatgtataataaattatattctcaactacctgaaattgaaatgaaactattttgatgaaactttgaagttctttaagcagaaatgacaagtttacatgaatgaaaaaactaatctgaatattgaagtaataataaaagtttacattttaagtaaaaccaagacagctgtcctataatattatttgataaaagcctctttctcccttgtgagacacagaacaaggagctatgcctgtgtaaatatgtctcctggattatcttttggacatcatgaaatgaatttataagttctttgccttctctacaagataacttacccagtgaaaaacactgcaatatatttataagtatgaagccacaaaagtgccagtttgttggcactagtgaacttggatggctaaagagaccgtatttttgaaatgacaccttttcctccaatgtcatacagaggcaaaggtacataaaagtgagcacgatgggacttcagacttcttaattcaggaataaaacaattcttggactctgacaaacagctgagtaagggaaagttaaatataatctagtatataaagttgccattcaaagagttttcaaggatacaaaacacccatactgcctcttaaattattctaagaaccattctcggtagatttaaaggttcttcttttacttcaaggtctctttaattgtgtcaagctcaacctgtgcttcattcatttatgactgtcctacaatatagtgaccaatgaaaaaattaacttctcatcattcagaaatacattatgctctaaaagatgtatatgtcatctttacaagatcatcgacatatactttctcgaccctaaaagaacattgacatttactataatcaccaagcaaggacataaagaagtgacccttctcaggttaacactcctaaaaaggaagatagaagcatatggcagggcatacaggaatattagcatggttgaacagaacagactgccaccaaaccaaaaatcattacactgaaagttcctcaagggcaggttcattcattattgtttccagtgccaggcaccagtttgttgcatagtaaatgttcaataaatgtttaaataatattcttgaggaagaaaatggatttttacaaatacacttataaaaatgtacactggctagggggtacaatcgtgcagtatcttattgctaaatataccataaatgacaacgaaagttgtcttcctcttttaaatgttaaaaatagacatactcaccaaaaaggaaataaaatttaaatggcaaatagaaactacaacataatggacgattaatagatcactatctaccttcacagaatccatatagaaagccattgggaaaaagacagttaaacaaaacccaggaagtaatctatctagtactatcgcaacattttgtagattaagaaaataaaaacaagagataaaaattgactggctgacaactggacagctaggtagtaattagcagaaaagccatgagtagaaatcctatttctttactctcacaaagtaaaacaaaagttctgagatagctgattgaaaaatgtcagatgacatctctagagttagtttcacaaaaaggatactataaaaagaaaagctacttgaaacatatgagcaaggccggaatatcttactttacctcatcatttacaataaacacatagaaatgcttggctcaggacacggagagagattattagcactgagaaaatcagactgaatctaaaccaagaacgtctattaaactcgttgaaggtgtttaactgccaaacagcagccattcacaaggtgaaatggttctaatctcattacagactgagaatgaactcactagaagtggaaatagctctaataacagggcagcgtccgacagttagaaaggagacccgagaaacaaaatcttaaccaaagtgcaataacaggcctgtggccaactaaggatgtgttcactgttttctgggtcttagggtaacatactaagatctaagagaggagaaacagaaaggtaaagatgagaaactactaagaccctgcaaacaaggaataatgtagaaatactataaggtatcaagcaatactcacctactatatattaatatttatgattatttttatatagaataaagcccaatttcctagcatcagaagcactgaggtgctgtgaaaaattccactgatatgatattttcttaaaaaaaaagacaaccctcatattcactaaggactgagaagatattaaagccatgaaatttagcaaagtaagaaagtatatgactttctaataagttgtttgtaatgttagtttcctaatagaaaggtacaaaacatagacttatgatgccagtgagtgggaatttttgtttcaactacttctatctttgattttttttctcagttacataaaatatattgtttttaggatacaatgtatgatgttatgaaccaacaagtggctccatttttcagattatacttttgcttttttggttttttctttttgagacagggtctccctctgtcctacaggatggagtgcaatggcacaatcacagctcgctgcagccttcaccttctggactcaagcaatcctcccatctcagcctcccaagtagctgggactacaggcgtgcaccaccatgctcagctaatttgtgatggggttttgccatgttacccaggctggtctcaaatccctgggctcaagcaatcctacagccttggccccccacagtgctgggattatagatgtgagccaccacacctggctaattagtcttaaaatataatttttcacatatacatggaaagagtatcaaagactcagagggacagaaagataagaaaagttatctattgagtcaatgatatttttcgtggaactcaaacaaacgattatgatttacatgaaagaataagggaccaaaaaaaagcaaacgcaattttgcaaaaggacacggtagttgaacttgcctttcgggatattcagatatacaaagtaattaacacaacagggtactggcaaaatgaaacagtagaatatcagcaccacggaagcacaggtatttgcttgtgtgattcacagctgtcttctaggaactagaacagtgactggcacaaagaaagtgttctttgtgccatatggttggtaaatagatacctgaacagaattgggaagacagaaatatatacagatgcatatttgaaaacgtactagcaaagtctccaaacatttacaaaaaacaacagaaaagaaaatgattgcagtaggtagtattttaaacaaggtgcgaaaataaatataaatctgaagagaaagaactgataaattcagctacttttaactaagacccttctttcatcaataaacaatatgcataaagtaaaaaaagaaagcttcaaaatgaaagaaggtattttccacgaatataactaaaaacaaaaggttactatccagaatacataaagaatttgtaaaaatctataaagaatgaataactggatggaaaaacaggcaaaatattttaataggcaagttaaagaacagcaaacctgaaaaagccaattgtattaatctattttcatgctgctgataaagccatacccaagactgggcaatttacaaaagaaataggtttaatgggagttacagttccacgtggctggggaggcttcataatcatggcagaaggaaaggaggaccaagccacatcctacgtggatggcagcaggcaaagagagcttgttcaggaaaactcccctttttaaaaccatcagatttcatgagacttattcactaccacgagaacagcacaagaaagacctgccccccatgatttaattacctcccaccaggtccctcccacaacccgtgagaattccaaatgagattttggtggggacacagtcaaaccatatcaccaatacacatgaaaaagcaaatagacctgtaggattgcttgagcgcagaaaatggagacaagcctcggtaacacagcaaaagcccatcactacaaaaaaaattagccaaacatggtggtgcacactttggaaggctgaggtgggagaattgcttgggcccaggaggtcgaggctgcagtgagccatgaaagcaaatacacaaaatattttaataggcaagttaaagactagcaaaacagaaaaagccaatacacatgaaaggatgttgattttcaccagtaatcagataagcccaaataaaaatcactgatatacacttgtcgtaccttacattaacaaaaaaacttgtggcgtatttaaacactgggttattctatgacaaaaatgaatgaacaacaacaaaaataatagaagaataaatgtatgatacattcatgagttacagaatcacacaggcagtataactgcatatatacacacaatgtaaaaacatgcttattacctttacataggatttagtgttgcttttgttaaagtattaacaaatgtaagagaataaaaatttttagatttaaccataagaaagggccacagaagtcttgaactgtataggtagcatttattaagttgggttgtggttacaaaagtatttggtttattattttttatacttgtacatatcttaaacatttctgatatggcttggctgtgtcctcatcttgaattgtagttcccataatccccaagtattgtgggagggaccaggtgggaagttattgaatcttgggagcagtttcctccattctgttgactcatgatactgagtgagtctcatgagatctgatggttttataagcatctgacatttcccctgcttgcacttactccatctcgcctccctatgaagaaagttcctgtttatcctttgccatctgctacgattctaagtttcctgaggcctccccagcaacacaaaactgtgaatcaattaaagctctttcttttataaattacccagactttggtatttcttcatagcagtgtgagaacaataatacagtaagtaccaggagaagggtgctgctgtaaatatgcctgaaaatgaagaagcaactttggaactgggtaacagacagaggttggaaccatttggaggacgcagaagacagggaagtgtgtgaaagtttagaacttcctagagacttggagggttaagaagacaggaagatgtggggaagtttagaacttcctaaagacttgttgaatggctttgaccaaaatgctgatagtgatatgaacaatgtagtccaggctgaggtggtctcagatggagatgaggaacttcttgggaactggagcaaaggtgactcttgctatgctttagcaaagagactggcggcattttgcccctgtcacagaaatacgtggaactttgaacttgagagagatgacttaggatatctggcagaagaaacttctaagcattaaagcattgaagagtaagcagagcataaaaatttggaaaattcacagcctgatgatgcgatagaaaagagaaacacattttctggaggagaaattcaagtcgctgcagaaatttgcataagtaacaaagaatggaatgttaatccaaagacaatgaggaaaatatctccagggaatgtcagagaccttcacagcagcccctcccaacacaggcccagtggcctaggaggaaaaaaattgtttcatgtgctgcgcccagggttcccctgctctgtgcagcctcgggatatcgtgcctgtatcctagctgcttcagtcccagctgtggctaaaaggggacatgataaagctcgggccattgcctcagagggtccaagccccaagccttggcagcttactaatggtgttgggcgtgaaagtgcacagaaatcaagaagtgaggtttgggaacctctaaccaagatttcagaagatgtacagaaatgcctgaatgtccaggcagaagtttgctacaggggcagagccctcatggagaacctctgctagggcagtgcagaggggaaatgtggagtcagagcccacacacagagttctgactggggcactgcctagtagagctgtgagaggagggccaccattctctataccccagaatggtagacccagcaacagcttgcacttccacctggaaaagctgcaagcactcaatgccagcctgtgaaagcagccaagagtgaggctagtctgtaccctgcaaagccacaggggtggagctgcccaaggctgtgagaactgacctcttgcatcagcatgacctggacatgagacatggggtcaaagtagatcattttggaactttaaggtttaatgactgccttattggattttagacttgcatagggcctgtagccccattgttttttggccaatttctcccatttggaatgtgtatatttactcactagtaagtaactaacttgcttttgattttacatgttcataagcagaagggacttgccttatctcagatttggacttggacttttgagttcatgtgggaatgagttaagactttggggggactcttgggaaggaatgattgtgttttgaaatgtgaggacatgagatatgggaggagccagggccagcatgatatggtttggttgtgtcaccacctaaaccacatcttgaattgtaaaccccataatccccacaagtcgtgggaaggtcctggtgggaagtaattgaatcatggtggcagtctcccccatgctgttcttgtgatagtgaataaatctgataagatatgatggttttataagcgtcttgcatttcccctgtttgctctcactccatcataccaccctgtttagaaggtgcttgcttcttcttggccttctgccatgattgtaagtttcctgagtcctccccagcaatgtggaactgtgagtcaattaaacctctttcctttatacccagtctcaggtattccttcatatcagcatgagaatggactaatataatttcatactatttttaaagtcatttcgtgcttattactaaggagtggggtcagtgttgatttactttgatatccccagtacctagaacaatgaataatacacagtaagcatacattaaacatttggtatatgatcaaattgagtcctttctttatccctcacactaagctggtacaaatttacagtgacaggaaatttctaactagcccattgcatatctcaataattctattaaaattccataaaattattgtatcaagtatatctccctgtactgtcttgtaactggtcttagtagtaccttcttaagattgtatagaaaaggtcatacatttcatttaaattagaaaactgtgtttcattttcttatctccattccattgatcctgagatatttaggatccagatttatacccagtaacatataaaatatccctctcagcttcagtagacactcacagaggtaataaacatgtgttgcccagctgcatccacatctcagcccaacactgactaggacaggtgggaacagagtccttaaccaaaacattagcagtgggtatctgaatatcagtacaagacaaggcatattctcgaccaaaaccaaactaaatgaacatatatcaaaaaataacagtctgcaaaagcaagatattttattaagaaaatgccataaagcattaaatattataaatgttttcaaatattagagtgtgatttttacaagaaaataattcttcaagatgatttatgtcaaaatgacaaagaacttacaatgattttcctgcagtttttaaacaattcaaataccattggttctagtttcatcaacaaagctgttattctcaaagctgctacatgtatatgagaaataatcatatacagaggcagggaaagaaacactattttcttacatggtatcctgtaagtaatgaagattcagaaaatagataaatcatgctgtgaaacctatagtatgagatggattggaactcatgagaaataataacttacttagaaaaatggcaataataattataaatatttcctgaaggttctacactagatcattcacataaaattttatatatacacatatatgcaaatctatatgctatgagatataaaggtattaaataaatgtaaaatattatgacttcaatgatgataatcactaaagacaaatattagttatctaacatctgttaaatcaatgagctaataaatgaaaaatataaaaattaaaggcaaaaataattaggaatgaaaggtataggaagaacacattaattgctgattaaatagaatcatctctcaaagaaggaacaacggcaagaggtggctggggcttctccactcctagtctctctgaccaccaccaccaccaccacacaagaaaaagtacactacgtgtatgttgctatgtacatactgtatgtgcttgctgtgcaaatactgtcaaaacagcttccacctcgaactctactcccctctcctagaaattcagaaccctcaaactgccaggagcacactcaaatatgccatatatcctcaacataaactgaagatttcacttatatgtatcaaccacacacaaagagctgtcattttctacaattcgattgtttaccaaatctgcacgaaccagaaaatttccaactctccctaattttatactgccccagcctcttatgattcttcagtgaaatatggagaggatacaattcatatcaaaaagtagctgttgaacttaaataagatgtagatataaaaggtcttcataacttctttccttcatctaatctttgttaaaatttcacctcttaatgaggcacaccctgattaccctacttaaaactttgacttcacgcacttccctctgcccaaccctagcaagcttgatcttgactgtcccgactgcccttaccctactcagaattttctgttttctccaaaggaaataacactttctaacacattacatattatttattgtctctttataccaggaggcagggctaatcctcagttttgttttctgttttatcctgagtacctcaaacagcacatagtaagcactcagtaaatatttactcaataaatgaatgaatatttgctataatgcagatgtctcatgccatatgtttgaatagcagtacacgttttacatattgtaccttggtgacaaaatactattgacaatgacaaaaggaacattttgttatttcctaaaattataaagctgcaaatatattagtccactttcacactgctacaaagaactgcctgagcctggataatttataaaagaaagaggcataactgactcacacttcagcactgtaagttcaggaaacttacaatcatggcagaaggcaaaggggaaacaaggcaccttctacacagggtggcaggaaggaaaacaaatggaggaggaactgccacacgcttattaaatcatcagatctcatgagaactcactattaggagaccatcatgaaggaaaccactgccatgattcaattacctccagctggtttctccgttgacatgtgcagattataaggattatgggggttcaattcaagatgagattttgggtgggaacccagccaaaccgtatcagatatagtctatgcttttcagctggactggcacctcaatctcttggtagcctaaattaatcaatagaagacttttcccaattaaaaataattaaacaagcagtttagtttaacattcttgtagtagatgaatgctaataaaatattttgaggctaaactcaaataggtgacaggtgaatacttgtcatatcctttgattggcatttttcattcctctgtatgttaaagtgagactactggaattgatctgtaccccacctcacctcacaaatacacccaactgcaagcctttctgacatcaatgctaaaaacatacagacaaaacatatagtcccagctaaaatggaaacttgcaatagattaatttgtcatggtaatatgaagatggcgtcctttttatttcttccattttcttcaagttcttaggatgaacacttcaccagaacaagtacagtggtcccctcttttccatggttttgagctccagggtttcagttacccacaatcaacagctgcccaaaaacaggtgagtataatccaatcagatattttgagagagaatcacatttacataacttttatttcagtctgttcttatcaatgttctattttattactagttattactgctaatctcttactaatttacaaattaaattttatcaaaagtatgtatgcataggaaaacagtgtatatagagtttagtactatctgtggtaccaggcacccactagggatcttggaacatatcccctgtggaaaaaggggactcctatgtagtaaaaaaagatactacatccccagcatgcattcctcctctttatgagatactagcacctgacttttctttgaatatttatttaccctctctcaagtatacaattagatactcagttctggaggtatcaggactggtaaagatgatcgacataatttatccccttatccactgcaaattgtttggagatgagtacatgccacaatttgggccaaagagagcacaagaattgctggggtgtgtgcatcaaccctgcaagagatttctgctcttcagtagaaagacatgttgagatggcagccagtctacaacacaagaggacagcctagagccagagatccacaatgtggcacctgagaatgaagctggcagtgcaggtcaaagagttaagaaacaagaaaccagtacctgggggctgttttggtagcccatcaagcctcattgaagctgaattctcctctatccttttcagttatgtgaataaataattgttttattttgtgtggttaaagctatttgttttcattgcttgcagtataagcagttcttaccaccagccttcccacagatgaagaaaatattcatttatatggtagggctgaaaaagaagacacctaacaaatgacttcttttttcatttcaatgttttgtttatttatttaattttttttgagatggagtctggctctgtcacccaggctggagtgcaatggcacgatcttggctcactgcaacctccacctcccgggttcaagcagttctcctgcctcgcctcccgagtagctggaactacaggtgcacgccaccatgcccagctaatttttgtatttttagtagagatggggtttcaccattttggccaggatggttttgatcgcttgacctcgtgatccgcccgcctcagcctcccaaagtgctgggattacaggcatgagccaccacacttggcccatttcaatgttttatctgcatttagacatgaaaattactactaggtagattaaatatttaggttcttgcctgccatggccaggtcagtatctaggaatttaacatccaaaaacttaaagactatgtacattgggaggccaagggaagataaacattgaaaagtgtatagatctacagattgggaaagccatggtccctaaagacatgatatgttggcgtggtattagcaaactcattatcaggttgggtaatgaatttgtgctaatcaagtattgtcattataatagtgttctaccttcttcagccatttcagcacaaggtaagagtttataatgacatacataattttaccataaaacacagagaattaataccttagcaagcgttttatccttggtattatctaaaaggtcctagggcataattgaaaattagccagaaacaactgtaaattaagtaaaatagggaccaaaattgcaaattttatatataaatacacacttgtatgtacacacacatacatacatcatggaaaagacagaatttaggaacaacctggtaatataaaaaagaaattttcttccacatgtaaattttccttaaactttcatttgacttaagtatgaaactagagacctgccaaaaagttttaataaataatacattataaagatatgttccattatacttggctgtaataacaaaaataataaaaattgaattgaaaagatataataacaagctgaataccaagttcaataataacaatctgaaataattcacaatgataaaggaaatatcacaagttcacattaaaatgatgaatgccctaaggtctccaaaaacaaaatttgaaagcaaatattaaaggtgcagaaagttacaaataaggtaatttaatcctaatcgtcagcatgatcattcatcaggtttgaggagactgaagaacagaaagaggcaaaaaacttactaaaacagaagtagtattttacaaagggatactcatggaacaaattaaagtggtacaactcaatctcacgcatacacaagcaaaaattctcgtctggcaaatcttgtctattatttgtggaaaacaggatcttcaggcagaaagtgtaaacacaacactccatgcatacagggaaactgacgtctgcactctcagtcactaggttactatgggcacatatcaataagtcaatagatgttcagtggctagacaaatgatgattgaattaaaaccatttctctcctcatgaaaataatggtatttttctcataaatataaacacatataaaccagaaaatgagtctcacacagagaagaaacacttgttttttactcactatatactaatgctgccttgaggaaattaaataactcttttctatttggacacaattaatgcagattcttaaaataacaaaaattagcatttcatatgcaattaagtaaagtttaaaatacattaatgttaacaaaactaacatccagtaaggaaaattgaaatatacatgcacatcgaggttaacaaatgcagtagtataaagtactacaggaaaaattcagaatatgtttgaataagttttaacttgtttttaaaaaaaaatgacaaggaaaaaaactggtattaggaacttggcaaaaaattaacaataaacagttttcggaacatgccgtggaatgatcagggttcagctcaatttcccatactgccaacatctagagctatagcaaacataaaatatatgcttgtaatatatggtcctaatcacaataaaatcacaatcatctgagggataggtttatgttcagtgtggtatatgtatgcattttttaaaaagaaagaggatcaaacagtaaggtttatggtgaatatttattttaaccaaataattttactattggattaacctaatattttattaggtctatatgagtatgaaagtctaccttatgagtattacatattttattagaataaccaaataattttatcatatagaatatgataaaattatcaatctaccctatgactattaaaatattaattgaaacataagctttaagctgtaagctccttgaagctacccactgtattcctttgtttacgaccatattcccaggacaagagcccaacacggtatgtagcaagtggtaagcactcaataacaaataaagtcatttataaaggcatagcagatgagataagttatccctctaggcaagggatcagcaaacttttcctataaagggccagatagtaattttttcaactctgcaggccatagggcctgtgtccaaactagtcaactctacctgtgtagcatgaaagactctagagctaataaataaatgaatggaaatggctgtgttctaataaaactgaaatttaacttgcttacaattttcatgttataaaattttcatttgatttttttcaacttttaagaatgtaaaaaccattcttagcttgccaaaactacaaaaacagctatcaagccatatttggcctgcaagttgtattactagtttaccaaccaacacttattctaggccaacaattagatattgtccatatacaactaaatgctgtatattgtaagaaatttaatacaaggaaaaaggcttagattgaaaaaaaatccctctgaacttcatagctccatctgtaatagaactaatataaaaaccagaattgctgttaagattaaatgagatgatgcatagtgatgaatacatatcagatgctcacctcagaacctggaaagaatctttagaaacagcagatgttataggcagaccacctcacatcaaagtttactacagtgagcaaaatattaatattctccaaagaactttgtgtcaatatttgcaaaactatttttaatttactgacaactgaaagaaattattacaaggcaatgagtgtcaataatcaacctaatttcaaaacaccaatgcaaaagccattagactgtcattctcaattacttaatttactgtctgccaataatttaactaatataggttaatgagtttatacattttacatacataaaacctatcaggttatactatgctgactcctctaaaattctttaatgggaaagaaaacagatcctttgaaaaaaattgtaataacataataattgttatttcatggactatatccggagagacttggcttcataaaacaagaggcaaggaggtaagtctggtgaaaacatgcccaagtttcctattagcttattcattttaggtcaagtcatcatttagtacccatccatttatccaggacagaaaacacttgtgcaaattatcctggcaagatgttatggggctctgagacatctactgtaactttatggactgagtttataaggttacgaacttataagtgctacttcctcctaggtatcatgcacatcaattttgaaaatttatttccagtgacttgcatatagacccttacacagtgtaattaaatacaatgtatatatggctaataaactctaagattcttttcaataaactaaaattctccaacaaaatatagcctaatactctgataaataagataacctttaaagtatccaaccttaaaggatgtgatctattgacaactgtctccctcactaaatgagtaacattaataagaacatttgagtacatttagtatatgagatatgaatcactttacatgaattacatttctgaatccccataataaccttataaggcaagtgtaattatcacattttaaaatatgcagactgtagttcccagagattaaataacttgtccaaggtcacacaattgataggaacactgtgtgggatctgaacctgtcttgctttgtactttgcttagtaccctgcttaattaaacctctgttatttgggcacaactaagcagaaaaatgcctttacaatttataggaacatttatttagttattattctccagttttaaaatacctgaacattcactagctgttaggcagacatgatgaccccacatgaccatgctacatccgaagacttagaaattttcatggttttcgcagcctcctgaaaatgggcaatgaatgcttatctatccctctctccctttttcctccttcttcaactcattacattatcattatctttattatatttatgacataagttgactttttctttttcttttaaacataccattacaatcaacatctctgtgtataaatgtttggttccggttattttcttagaaatgaattctggaaataaaactactgggaaaattatgagagcattttcaggttccttgatatttgatgccagagtgctttctaggaaatttgtaaaaatatgtattcctattagtagtatataaggatgaacagttcatccttttaaaatataagtaattttaggagagacaattcatcatggatttcttgctgtgaattaattgaattgatttacttgctccttaatagcaagcagaaatctgtttcattatgggaaagatgatttccattggaggagaaggaaagagaaagtttagataattttggagtgtgcaacagggataggaagtggttctttcagttgaggactgagtggctaatggacagtatgaaaagaaatggacatgctcagagggcaaaatagttgtctatcaataaagtaaagtaaacaaggtaagaagaaatcaaagaccatcttcaaagttggctctgaaaacatgaagtataatttcctataccttcatattggcatattgatatggattttctttagcaaatagcaatgataaaattttactgggttttaacatgttagcttctttattttcccctattcattgctgacattgcctttcttctcatcagtatgcaagatatacacttaaaaatattttggggggatattttcaagagtcttggaagaattgaatatattcaagctttaacaataagagtccataatcattcattaaatggaattgactggaactctgtaattaaaaactgcctgccagattaagggcacagcaggcatagagcaaaatgacagatactccaaataaccaaagatacagatctaaaattagctcaaacttgttctcagatttgctaagaaggggaatagttccataaagtaaactgaaatctaaaagatctctgtttgtggatacaggtatgaatatcgtctttttccctgcagagatataatcacaaaataaccaattcccactttcttcttcattgtataaagtgtactgtggcagattgttccttttatttaccaggcttctagaaacatttatacttttcaagctaaaaaggttgttttttaaatcatcaaataacagccttcaaggaatgatttcttcagcaagaatgtcacaggattcaactcttaaaaacctaagtaacagtataaaaactctaagtatattgcctaatataatctagtattttctttctggtatctagatggtgtataaaggaaaagaagaaatgcaatttaaccttgtagcaattctccattctttcccaaacttaaagagacattctaatctagcataatcttcattgtcctatgtgttgtaaaataaccttttctttcaacaaggcattgaacgaaagctatagtgtttcaaacaagaaagtcatcccttctgttaatggaagtcgaacgtctttttagaacagcacagggttttaaatgatggctttcttcctaaaaccagagccagacttctgggtaaaagagggcacagggaaaacttagcatagcaggcttgagactgctgtctttaaaatggcctgcttgcaagactggcttttggctgacatcaggaaacttgaatggtaaatagtttctaaactgatagaaaactttctttctttgagaaagagtcttactctgtctcccagcctggagtacagtgacacaatctcggctcactgcaacctctgtctccagggtccaagcgattctcatgcctcagcctcctgattagctgggatcacaggtgtgtgacaccacgcctggccaattttttgtatttttagtagggtaaagagtaaatgttccggggtgaaatacatttgagaaatattaaggtaaaattagatttttggcagacttacttaaaatgatacatgcacagtgggtttccaaaaggggcatacagaatgtggcaaatttcacaaaatcatttgatcacagaaatcttttttatatgaagcaaagcaggaccagtgcttttctgtttcagttctaaaagagggatcagatacctgcttcatataaacttcaatctgaacctactaatgactggggataccaggatgaatgaccgcagacttcaacttccagaagttcacatgttaacagggaaaaggaataaaatgatgatagaattgtttatctcaaactcagcaagaaagtataaacaagggactaaccaccacctccagctggggaactgtgaagggatgaattcataaatgaaagtgcatataaaaatatctggcatattttaagcactaaaaatatttggttgttattactttttagattgtcatagttggttggtttaggcgaaggaagaatcccatgagtcagacgaaggaggaaagagagagtcacagaggccctggagaacacagagtgtaacatcagatgaatgaggagaggcaggcaggtgcccctggaggtcctgtgtgtctcactgggagctcttcaatgtaaagggcaaagtctcgccctttctaaaagccttcagtatgttaaacaaattcaaacaaaacaagattcaaaaaacatcgatgacaataaagtcaatttgaaaggactatgattgaggcaagcataagaattaaggtatagtcaagagatagtttcacctaatgttcccctggcagtctcatcattcccttggtgagatgctaataagggttagagagccagtctaaggaatataaagtgaagaacctgtcactcagttgtcaagggaaactgcctgtctataattcccttagcaaagccttcatatcttagcatatgttaattagacttcatgcttaagcctaaaaatttattacactccaggctttgtttcattttgtttacattttttaaagaaatatatcaaaaaatggagttgagctttatatatgttgtatagtttcctctgtttggtataatagtcaaacttactaactgttcacaatttctaacagtccagtttgtcattttctctaattaatttttcatctaaaagttgttggcatgtggctgagaagaactgaaaaagagacgtaggtaagagtagaaaataataagattcatgagattaggtggatcaatgcagatgtttttaactggagattctgtgaaatgtaaatagaatcaaacctgaggctttatcaaattcaaaaggatatcctaagcaattctgattatgaattacatctacattcataaattatgcacttacaaagaggaagtgtttgaaaatatttttaaaaagcaatgttactgagaaaaaaataaaatattaaaaaggtcttaagcaaacaattttaggaagtaaaataaaacactaccagcttatattaaatagtgctttagtatttccagagaactctacatgtatgccattattagatcattactataagcacatgagaaagtcaggaatataacaccatgatttagtttcacgtgtggtggtaagactttcatatatgtaaattaacaacacaaatgtaatttgcacttaattcaagaaaacaatcactttactacttataaaagcctgaaatctaaaatgcacactgctaacagccaagattaagtattagttatttgatatccacacttgaatgtacccttctcccaataacccgccctccccactatttgagaatcagtgtccccatctgtaagttggaattaaaatataggcattttctgcttatcatcagtagtccatttatgaaaaatcagacattctattcaaatgccaaacaggtaacaatttccaattattttaactgagaaagttatatttaaacccaaatccccaattccctaaaatgtaactgaaacacatttatacaggtaatagccattatgatgaaatgtaaaatgatgagacattttctgctactgcaactaacatttatagcattttatatttataaaagggagcattggtttttaaagattagatacactacccctgcccatcgagagcactcttcaaaaatttgggtatggccatgcaagtattcaatgacaatgggaaaatactataaaaaatattggttttataagatatattcttcaataattcatgcaatttgctttaaaaaaaacccttatctttcccaagagggaaaaagatacgatgaaagacaggagacaaaaatctgcctatgtttctttctccattcctccagtttatagtgctagaattatcaggggacctggaattatcttattatctctgtaatagaaaatctgtggttcagcatcgactcaccctttctgctagcctcattcaccatatatacagcggttcaatgtttcccttaaccaagcttgtcttcataaacacagttacaatgagtctttgggcaccttgttgcaatattcttgatgctatgttcttctaagactttgaaggattaacagagaagataaaatcagaacttggacctacagtcctattcctgacttatgctagggttgttttcatcataccatctagaacatggccttgtgttgatagcaacaccttctggaatggcaaaatactcattggtaacacaaggaaagacatactaaaaatttgcctatacccttgctaatttcatattaccaaatcactctgattcttcagtgttctatcttggctcaatccaatatcttgtaagtagctgttgttaataggtaatttaacaatttatcagtttataaggttttgctctttcctggtctggtccaactattgcacctttacccttgctacctcaaaatcaaaggtttagagggacataccagaaacacaatgtaaagtatttgattatgtcgttgacgttatgtcacactgacagtgatggtagcattcattcccagggatgctacatatccagcgcaaggaacaactgtcttaccccataggccaaaggctttacctgttgagaagcagtagcagtgacccagtcccagttctaacaacattctttttatagaaaatatggacattgatcctaaagctgtctctcactagttctgccattttgttgaagtcgcttagctttctgggcctcagttccctcatcaaaaaattgggataaagaatattgtttaatttcttctattttaaattacagtaggcccttcatatctacaggggattggctccaggaccctagagaacatcaaagtctgaggatgcttaagtcccttagtaggccctgcatgtcccaaggttccccatacactgttggatgaatccttggataccaagggttgactgtatttcatattttttattatacttatatattttaactcatatcctataaacctacatttatagcaatcccttgatattctgtaatttttaaggcattagctagatcctgcaattagttccttaaccccctaaatattaaggaaacaattttaaaactccctttcctaaatccattgaagacccaacagaatacaatagtgaaagaatatcaggagtttgataagatagtacagtttcttctaaagttctcagaaaattaacatggtggtaggcataacagatacactgaagtaggtgatttttagctttgaatcaaagaagcactgactgacccagaaaaatgaaaaataaaatatcaagaggaaaatcagtaagagatattcctcattctgagttaataggagtgaaccaggcagagacgaactaagacaaataggcaaaagagaaagcaccaagatgttacagctacctgaaaatgaggactttataaactaaggactgtacaccagttgccaggctcaacactttgtatcaacaatccactttttgattttaacaaagttttggtattttaaatttcttcactttactagatccccagtttcaccttcattgcaaactcagaccaggtcgggagggggtgtatttgaaaatgaagataaccgcctttcaattgtgaaagagcagtgtaaaggctgtttaatttggagataatggcttatatgaattgtgtgtaatgttgcattaacttgttgtaattgtcatggttattaaaactatagccaaacactcaccatgtgctctacagggcacattaactatataaaagacatcatctgtgccctctaggaacttagcctaaaagttcaaagcagtgagtttgatactcgttgatacatgaagaaagtggattatactgtatcaacctagaacgatgtagttcaagaattagaagattcagctaaatcttactttaaaaactaaacctcaacaaatgtaatttagtttttaaggttaaaataaagtgaagaaggaaatataagagaaattcatcaagaggcattaactcaaatttttcctctatccttgaccctcattttactgcctataggtataaaaaggctggcttcccctattttcttatcttggatagatgtgatcaggctggcacttctgattttggcaagccagcagcattaaagaagggggagaggagtcacacctgaccagatcttcaacttgtttttgagtctgcttgtccctgcctctctcgctgtttcttctgctcctgaaaatatgattaatatctatgcatttgtaaaactctgcattgtaagcaaggctgtggcttttccatcccaacgaggttgaggtatggagttaatgagaagtgagactgtggggaatgaacaggaacatgccaatgttaaagtaattgagcatgaatatcaaacactgacttgggaacagtcttcatttgctgagggaaagtctgatcagctggtgggcagatgggatgtgcagagacctgcgttcactgccagccccagaatttccatatcatacaggctataccttataagcacaacacctttgtgtttccacctagaatcatgtttctttttcttctttcttttcattttcctacctttttctcttccctccttcctgagaaaggttccttctcttctttgaaagatgtgcccaatattgagaaaattaacaccttttcaaaagatgtaggttattatcaatctcaagttgtaggaaatagttttattcaaaacagtaataataatctctttttttttctttcttttttttttttttgagaaggagtttcactcttgttgcccaggctggagtgcagtggcgcaaccttggctcactgcaacctccgcctcccaggttcaagcaattctcttgcctcagcctcccgagtagctgggattacaggcgcccaccacaacacccggctaattttttgtatttttagtagagacagggtttcaccatgttggccgggctggtctttaactcctgacctcaggtagtaataataatttcaagaaaactaaatgttaaagaaaattttctaacgttagtcctaaattcttatgaatacacaattatgcatttttacaaaaattcatttacaaagatgattttagcagagtttacaaagcaaaaaaatgcacacccgaaatgtacattaattgggaattggttaagtgaaataaggtacattcattaaatgaagttaaaatgatccacgagaaatatataataattaatgaggatataggcaacaattatgtattattaaatgagcatatataaattataagctcttttgaaatatatatgtttaaaggattaatttttacataatggtgataaaatttccccaagattgtgttccaacttgtcattttgtaagtttccatttttttttcctcattaaacttttttaatgggtctcaaaattctgtgacaaatttttggtcaagttgtttccattaaaaagtactgattttaaaaactagtaacttaaaactgccacaggcaaaaaagaaaatcaaggtggtccacaaaacattctcctttccttctgaaaattttacaatgcattgttatcattaaccagtcttttactactaaacgtaaatggccaattgaaacaaacagttctgagaccgttcttccatcactgatcaagagtggggtggcaggtattagggataatattcatttagctttctgagctttctggggagacttggtgaccatgccagctccagcagccttcttgtccactgctttgatgacactcatggcaactgtctgtctcatagcacgaacagcaaagcgacccagaggtagatattctgagaagctctcaacacacatgggcttgccaggaaccatatcaacgatgttagcatcactcgacttcaagaatttagggccatctcctagccttttaccagaacagcgatcgatcttttccttcagctcagcaaacttgcctgcaatgtgagccgtgtggcaatccagtacaggggaataggcagcactgatttggcctggatggttctagataatcacctgagcaatgaagccagctgcttccattggtgagtcatttttgctgtcaccagcaatgttgccttgatgaacatccttgagagacacattcttgacactgaagcccacagtgtccccaggaaaaacttcactcaaagcttcatggtgcatttcgacagactttacttcagttctaacggtgactggagcaaaggtgaccaccgtaccaggtttgagaatgccagtctccactcggccaacagaaacagcaccaataccaccaattttgtagaccccctggaggggcaggtgaaggggcttgtcagttggacgagttggtggtaggatgcaatccagaacctcaaacagcgtggttccactggcattgccatccttaccggtgactttccatcccttgaaccaaggcatgttagcacttggctccagcatgttgtcaccattccaactagaaattggcacaaattctactgtgtcagggttgtagccaattttcttaatgtaagtgctgacttccttaatgatttcctcgtatctcttctggctgtagggtggctcagtggaatccattttgttaataccaacaattagttgtttcacacccagtgtgtaagccagaagggcatgctctcgggtctgcccattctgggagataacagcttcaaattcaccaacaccagcagcaacaatcaggacagtacagtcagcctgtgatgtccctgtaatcatgtttttgatgaagtctctgtgtcctgcgacatcaatgatagtcatatagtacttgctggtctcaaatttccacaaggagatatcaacggtgatacgacattcatgctcagctttcagtttatccaagacccaggcacaacttgaatgagtcctttcccatctcagcagcctccttctcaaatttttcaatggttcttttgccaatgccaacgcacttgtagatcagatggccagtagtggtggacttccccgaatctacatgtccaatgacgataatgttgacgtgagtcttttcctttcccattttggcttttaggggtagttttcatgacacctgtgttctggtggcaaaccctttgtgaaaaagtgtaagtttccattttgaatgtatgttacaattgctaaaataaaaaaactataaaaagtaaccaaccaatgagtttatcaatctcttcctatacaccatgacaattggaaacatagaaaaagcaaccatatgagaaagatcttgaacaaaaaaatgtttataatttaccttagtagcatagtattctctgacttcaggcctaatagaatcaaagtctccattgatgaattcaggcaaaaagctgaaagaaacagtaagtaaagtaagtcaactagttatttctatttatttttgaaactttaaaactgtggccaagtgcagtggcttacaactataatcccaacactgagaggttgaagcaggaggactgctggaggccaggagttcaagaccagcctgggcaacatggcaagaccctatctctacaaaacaattaaaaaattagccgggcatgatagtgcacacctgtagtctcagctacttgggaggctacactgggaggatcacttgagcccaggagttcgaggatatagtaatccatgacagcataactccagcctgggtgacagagcaagactccatctctaatttaaaaaataaaactgtgattataaggaccaaagagaaaagtaatgtactcagaacaaaaccaaaaacacagaaactatttttagagagaataggatgttataccacatgctcttggtttcaatgactgaggcaaacaacaggtatccaaccaattcatcaactcagtcacaatgtcagagaatacttctttttaaacaaatcgataaaaattaaagattattggtttaaaaaatcctaatagaaatactcatcatctttgcatattaccttgtatatatatataaggttttacattattgtatcctcacacaaattcataaatttcaacagatatgaatagaacaaatgatcatgaggattctttgaaatctgtcccaagcaagagtcagttcaaagacattttccaaatattctattgacatatttctagacacaggaatcttttagataagtctgaaatactacaagagtcaaggttattaaatagagagagagattcacaaatgtggttgcttctaataatattactactgcctttacttttttccctgctatattaagtcagtttagaaagcataccttactccatctattatgcataaaccatcatttgctatttttacataaaacatttacatgatctggtagagtttcttcccacttaaaacacctaattgtagagaaataaaacatccctggatttctcagtactatgcagaaatccttagcctgctgagcctcagaaatgtatatgatacaaagaagggaatggttgctttcacttcctgtaataaaaatattccacccttcacatgccatgagaattaaaactgcaaacatttatctagttaactgctttgattcaaaatactaaaacttcttaggtcttctcaagagggccaaattgttatctgatgaactaggtccctagctaaagaagactggggtgttatatttctgggtattacatgtcaaaaaaggtgaagccccagaacttggagaaaactctatgtcataacaagaggtgacagcatgctggcagccctcgctcgctctcggcacctcctcggccttggcgcccactctggctgcacttgaggagcccttcagcctgccgctgcactgtgggagcccctctctgggctggccgaggccagagctggctccctcagcttgcggggaggtgtggagggagaggcacaggcgggaactggggctgcacgtggtgcttgcgggccagcgcgagttccaggtgggtgtgggctcagcgggccccgcatttggagtggccggctggtgccactggcctcaggtagtgaggggcttagcaaccaggccagcagctgcggagggtgcgccaggtcccccagcagtgccggcccgccaacgctgctcttgaattatcgccaggcctcagctgcctccccacagggcagggctcaggacctgcagcccggcatgcctgagcccccccaccgccacccgccatgggcacctgcgtggcccgagcctccccaacgagcgccgcccctgttccgcagtgctcagtcccatcgactgcccaagggctgaggagtgtgggcgcatggcacaggactggcaggcagctccacttgcagccccggtgcgggatccactaggtgaagccagctgggctcctgagtctagtggggacttggcgcacctttatgtctggctgggggattgtgaatacaccagtcagcactctgtgtctagctcaaggtttgtaaatgcaccaatcagcactctgtatctagctaatctggtgggaacctggagaatctttatgtctagctaagggattgtaaatacaccaatcagcactctgtgtctagctcaaggtttgtaaatgcactaatcagcactctgtatctagctaatctggtggggacttggagaacctttatgtctagctaagggattgtaaatacaccaatcagcactctgtgtctagctcaaggtttgtaaacacaccaatcagcactctgtgtctagctcaaggtttgtaaacatgccaatcagcaccctgtgtctagctcaaggtttgtaaatgcaccagtcagtgctctgtatctagctaatctagtggggacgtggagaatctttatgtctagctaagggattgtaaatacaccaatcagcactctgtgtctagctcaaggtttgtaaacgcaccaatcagcaccctgtcaaaacagaccaatcagttctctgtaaaacagaccaatcagctctctgtaaaatggaccaatcagcaggatgtgggtggggccagataagggaataaaagcaggctgcctgagttagcagtggcaacctgctagggtcccctttcacactgtggaagctttgttctttcactctttgcaataaatcttgctgctgctcactctttgtgtctgcactgcctttatgagctgtaacactcaccgcgaagatctacagcttcacttcggaagccagcaagaccacgaacccaccgggaggaatgagcaactcccgacgggaggaacgaacaactccagacgcaccgccttaagagctgtaacactcaccacgaaggtctgcagcctcactcctgaagccagcgagaccacaaacccatcagaaggaagaaactccaaacacatccaaacatcagaaggaacaaactccagatgtgccacctttaagaactgtaacactcaccgcgagggtccgcagcttcattattgaagtcagtgagaccaagaacccaccaattccagacacaataatatataaaacacggggggttatctggctcctggagacattctattaatataccaaagggtttcaggattcacgtccagaaaatttctatggagaccctttcacgaggggagaaacacagctgtattttctacttaataataagaaaaataaaaaacaaaaacatgttgccttatccttcacctatgggtgtgcaactaccagcagaagacaatggacctggctctcactgcttgggcaaaggggtaacaaactagggcaaaggggactaatgttatgacacatctctctcagaaaatctgatgtgtgagttcagaataaaattaatagagacaaaatttggagaaaaaaatgcaaaccctgtcctttagcacatttatttttgtaaggttcttgactcaattggaaatactatttctgaggtcaaacctaatctaactgatctgtgttgggccacctcttctttgagttaccacaaagatctgtaccatataaattccttagctcggatgagctaggcccaacaatttttttattagtcaattcattccacaaatattccctgaacaccaactatatgcaaaagactacagctaatctcagaaaaaaagtagaactggaaagtaaatgtaagtacttaggtgttcaaatcacatctggtttcaacatcttcccataagctttcttcctggaaacttccctgcacactgtatctattactttcaatttcattttatacctatttaggtaaataatttataccttaccctgttaggaccaaaaatagactattaagtttttttctctttattttttcttgttgtataaattcattcattttcaaagtttctttacaatgtttccacccatctccatataactgcatgcaaattaatactcagatgaatcacagaatattagggctggaaggaataaaagaaattacccttctaatatcctcattatcctttctgaagaactgagatccaagacgtcaagggcattttgtctgtaaagccaatatccaatctatttcaccaaataaagcaaccatttaaaattaggactctgggtctctgctggttcaagcaacatcctgggaagaccgactttatgttgctctccaaattttagtctgtcagatctctagaaccaatttggcagtttccaaatagcatattgattttgtcaataaataaaaatgaaaaataaaagctgatacacacaggcaactgagcatctatccccttagggacaattcatcctaaagacaattagatctcgctatatcttacactgtgaataatgaaagaaagcattcatgcaaattcacttacattttagtggaaaatattaacaggaaaacaaacttatataggtagtagatacctaacttctgttaacttttaatataattttctccaatgtaacatgtatgctttcaaattgaatcaggatgcttacttctaagaaggcccatgccaaaaatacacctggtattcatgctgagatgactaaaataattataacttttggtcatataatgcactcgtttttgaaacttgctgaaatgtactttttgacgctgcaattaaaagcccatctcacttttcctgaggtgcctgttgccatggtgcctgggcattctgaagaggaacttactgaggatgacacttcacagatgtagaagagctatgttatgatataaatgacagtttacacaagcagattattttcagaactctctggggactgattacacgtagcaactgactgtgggtatgtggatttgtgtagccactgaccatgtttctacctactgtcgacttagacacaccgatctatcttttctttgctatcctcaatctatgggcactgacttgttagtactgaaaggtgtcccaaactctccacaaatggcccagactccttaaacgttttcattttaactctttccatactggtcactcattcatgataaagtaagagtccaaaaagtactgagatcaattagtgaacttaagatccatcacatgtaataatcaagagggaggctgataaatttaggaaatattctaaatacaatggagtagatagaatataactactgcctttacagggcctttcctgataccactaaaggaaactgtccctccataaagccgggtttttttttgttttgtttttgttttgcccccaggaaagacaaacttattcccttaaaacttgaatggcactaaaatctcttactttccatttcattttaagcaagttgtttgtcttttagctactaatagatggtaaggcctctgaagcaggatgtgtctctgattgatcttggtacgccccaaaggataaagggcactgacgctgaaaatgatataataagatgacgaggtagagaaggagaacgaagggaagagggagaaaatggggggcggggggcgaaagagagagaagaggaagtaggaggaacaaggagaaaaggaaagaagggtgaagagggggaaaagagtgaagtgggggaagaggagataggagaaggtggaaaatggtacaaagagaaaagccaggagaggaaagaaagggcaagaggggagcagaaaagaagaatgaggaaagaaacatttattaggcacttacgattacaactgcccctccccccactttctagcttgtgcagattatttaagctttttctgaacctcatgtctccatgtataaaatgaggataatttagagtgcttgtgaggattaggagttaatatatataaagcacttggaaaatgcctggcacacagtaagcacagtttaagctattcagttcaaataaaaattattgcaagtgaagttaagtagtttgccctagataataaggctaataagagttagagccagaactcaaacccaggcagttcactctctgttctttaatggctaagtatacagcctcccacatatatgcatttacgaaacagaacaacgatgtttttggtagagaacgttctctgcataaatgtactctttcctgctgattttattaatcaccactaatttggtcaacctatatagtttataaaggtttccctgaggcacaagagaaaaaggatttgtgctagttgtaccagaaggaaggacaggatcttgaggacagactatgttaggagaagaaaatttgggaatattgttgaagagcatgaatacagacatagaaagaaagtagtattcagtctgataaaagaaggaatgaatcatttaaagatttgtgctaacattctctgtaaaatcatataaatttggtgggggggaacaagagtgacacaaaatataatccacaaaaacgttaccacattttgactatgtttataaacacaatcagttcaactgcttgcaataaataagtctctaaatataataatagtgccaaaagatatttaaatatttgtgtaaatttgggtaagagacagaaaacacaacaataaataagttgacagattatgtaaaaatgtaacaatatgttaataaaaaggtcaaattataacttttacatatgcaaaatatataacccataagaatttctgtccccaacacacgaagagcaccccaaagtggtaaaggaaaaagatacaaatagaaaaagtgccaaagcctattcacacaagcagtaagtatatgaaaacatggtaaatctaaaataattatcaagggaataaattttgaagcaaaaattgagtactttcttttacacaaaaacttaaaaattaagaaaagtgaagtgggtattgacaaggctgagtgaaaataggcgcaaacacaagactagtgaagtcgtgactaggatactgcctgcaaacaggcaatcccactttaggaatccatcctggcttttttgtttgtttttgtttttgttttaacagtacctaggatatctgcacaataaagcaagggaaataacaaggagagaaaaaaatggaatgttcaacaatatagggaaggtggaataaaacataatgtaacctgttagggaaagtaggcagcttttagatgagctaaccactgtctactgttctagagggaatgcccatcacatgttactaagtaaaaaaagcctaaatatatttgtgcatttttgtatagacacaaaggaagttatggaagtgaatgattcaagctattcacactgattatctcaggggatgggattaatttttctttgaaaaattttataaagcataccttaatttaataagctaaaagaaaattaataatgccacttgtgaaaggaaataaaaatgtgaaggaaaatgaaaaattaactgaaaacgcttagactctgattacaagaatattaaatagtacttagcagccactgaggttgttataaatgactttagttaagttacccaaagaagacagtgttttatctcttagaataattgatcgcatcgtctcaaactgtctagcccaggattcatcacaaggcagaaaataacattgtttcccaaaataattatttaaagatgtctttatatgctaatgacatccagagggaaaaaacagtaacaaaaacattaacaaatgaaatataatctccatatcacctagttaaaataatgattggggaacagaatgaggatagatcaatgacaagaaaacatatataattttgcagaaggcctcttcattgagacaaagaaggaaacacagaaaaagctgccaaaaagaagaagacttgagggctcttaccctagagaaaaccttccaggacacatttttttgaatatttgttctatgccagtctctgtattttattcatacattttatgtttattaatcaatataattttagctaatttccataacactcccatgaggctgatgtttatcatctgaattttatggtagaaagccaggactgagtgatatgaagccacctgcattggtgtcacacagattcaaaaggtcttctctccttctcctcctgctttcttcattgaacaacatatgcccttgaccggcacagagaaataatcctgctccacctccttcacaggatgcagttttactttttcgaaaatcctggcccttgtctgtaatctgctttgcttgcatgcccaacagaggtgcacagtcatcaagccgcagcaagagggcaatgcaaagttgctccacagcacaagtgacaggtccccaagcacactctctcgtgaagctaggttcgtggtttgtttttatgaatggagaagtggggaagggaggcaccatcacaaaatcacatgaggcttctagacagcatatttcattctagttagtaaacaaacaaatttaatattcaattccataactgagaaatcagcataagcaatgtaaattttatgggttagtaggaaattaaaacatacagactgctacttccacccctgcaatgggaattaacctctcactgcagccacttagaaaagccacacaaaagaagtagaaattcagacagcggaaaaatgacagctctgggcagtgattactgtatgattctataatggtggatacatgtcacacatttgtccaaatctatgcaatgtaaaacaccaattgtgaaccctaacataaactacagactttgggtgacaataatgtgtcaatgttggttcctcaattgtaaaaaaaaattctatcactctggtgagggatgttgataacggggaaactagcaatgtgtggggatatgtgctatcttggctgtctttgtatcctttcctcaattttcctgtgagcctaaaaactgctcttaaaaaatagtcttaacagaatgggcaatggatctgaatagaggagaaaacaatctggcaataaatgattaaacatggagttacaataaaaacatatggcaattttattcctaggtgtatactagatatagagagaaatgaaaacatgtgcatacaaaatcttatacactacaacttggaggaaccttgaaaacattatgccaagtgaaagaagccaggcacaaaagtccacataacatatgattccttccatttgcaaataccaaagaggaaaacctaaagggacaaaaagtagattagtggttgtcagggctgggggaaagaaagaggatgatagtcgaagggtacaggtttctttttgaggtggtaaaaacgttcagaattggcagcaatgaaagagagttcctgttgctccgcatgcttgccactaccgaaaatggagatggttgcagctatctatgaacactaaaacctctggactgtagactttaaatgggtaaattatttagaacatggttataactgaataaagctgttaaaaagtagtaagaaaaacgttatcagacagcttcatctaactggtatttctagaatattccagccaccaccaacagatatatacattctctttaacttgcacatgaaacattcttcaaactagacactattctaggccagggagcaacattttaaaaaatttttttgaaacggaatttcactcttgctgcccaggctggagtgcaatggtgcgatctcggctcgcagcaacctctgcctcccaggttcaagcgattctcctgcctcagccttccgagtagctgggatcacaggcatgtgccaccacacccggctaattttgtatttttagtagagacagggtccatgttggtcaggctggtttccaactcctgacctctggcccgcctcagcctcccaaagtgctgggattacaggcataagccaccgcaccaggccttataatttttttcttaaagagcaagacagtcaatattttaggatctacgggctataaggtctctgtcacaactacttaactctgccacggcagcatgatagcagccgtagaaaataagaagataataggcatggctgtgctccaggaaaactctgtttagagtagtttgccaacccctgttttaggccataaaacaagattcaatcgatttaagagggttgaaatcataacaagtatattctctaacacatacctttctctcttttctcccttcttcaaagtaatcaactgtaattagtactctctagaatggactatgactgctatcagaattagttgaggctttaaaacctccatttatataaagcaggcctgtattagtccattctcacactgctatgaagaaatatccgagactgggtaatttataaaggaaagaggtttaattgactcacagttccgtattgctggagagtcctcaggaaacttacaatcatggcagaaggcaaaggagaaacaggcaccttcttcacagggtggcaggatggagttagaacaagcaagggaaatgacagatgcttattaaaccatcagatcccgtgagactcactcactatcacaggaacagcacgggggaaccgcccccacggtccaattacctcctcctggtcccacccttgacacgtggggattatggggattacaactcgaggtgagatttgcgtaatgacacagagccaaacagtatcaagatccttgaataacgtcctttcattcaaggtcatttccttataaggttgatgaggaaaaaacctggctagggccattaaatgtatagggtctgcatgatctcaccacatctatgtgggctttctctaggtactctggtttctacctacatcccaaagatgtgcactttcggtgaactggctgtctacacagtcccactgtgaaagtgagagtgagtgtgtgtgtgtgtgtgtaagtgtgcctcagagtagaatgtgtcctgtcctggatcagttccctctttgtcccctgagctgcccagaaaagctccaactgcccatcaccctgaactgaaataagctggtaaataattatcttgcttgttgttttcattgatctttcttcacttgatcttagctaaaaggctgagaagtgatttttattgatttttcttaaatgtacatatagctcatatttatttcagtgttaaatactagaagtgtttggtctttattcagaagtttggtgatgtttttgtgacaagaaacatgctgtaggaacttaactcttgctgataccaattagcctagggtaaaatgggttttcttttatgtcattttggttaaaatcagtttctaaaaaactatcaacaatgttaaggatttactgtacacaataatactgatattaattgaaaccaattatattaaagcaagttaaaaattttaattttcctaatcatattgtatcctacttatttacactagtttaagttgtcgcactagattatatatttagttagatcttatatttagtatttattcataattatatttaatgaatatacagctaattttgaaatattttatagttcaggcacacacaaattttgaaaaagatacattttaaaaagtcactttattattgccttacattataatttcaaattttaatcagtacctaaaatgttacataaagattattcttaatataaaacagtaatttcataatcacaaatttaattaaaaaatttaatattcagtgtaacatttgctaagatactattatattaggcttagtatgatttatcagaaatgatttcactgtatctccaatgctagcagtttagtattatacatttaggtggtagaatgtgttgtcagtaactttcacgactcatgatgacagattttccctataggaaagaaaatatcttgtctgcttttatggctttgctaggatttcaaggttcagaaaactctatataagtgtccagcagcttctggaaatgagattatgtccagtctagagaaccagtttacatttttaacgacctgtctagttggagaaaaggaaggatgagatataaggaagaaaaaggtaaagtcaatagcaaacctaaagtaaaaaaggtttttgatgaaaagcagtttaaaatttactatcaactttttgcccaaaatgtactgtctcctttgctctagaaaaagaaagatgaaatcgctaagaaaagaggacaaaggaaataaaacttatagaatattaacaatacatacatgaagagcaaaaactgtgtgcacataattgtatacaattgaattaggtactacatatgagatacaataaacaatacattaatttttatgtactacatataacctagcaaattttctctgaggtgattaatacggcaagaactaaataggagtttctgtgaagatagtttctgtactaaatcacatgtgttatatgatgtgattccaaaaagcaaaatttataattacactgaagcacatggactatagtcattttattctctttcatcgttcctgaaagatgctgagaaaaagaaaagtgggttgccatttacttaattaaggcttactgctgcccatctaaacacacggcaagcagaatgatttaatataaaactcttctaacaagccaccaccatctattcctataagataggcaagtcactatggcattctataagctgattcaatcaacctttctaatcatatttctcaacattctcttatgtaaacagtatacaatcttaattttaaaataaaaaaaaccaatatgtgagtcttgtaaataacaagaataagaacaatattttagacagagtttgagattgtagaatatttcagggtccaagttcagctaaaagttgcaaacgcagaaggaaagctcaggagaggccagagccaaaactacacactggtgaatcctccatctataggatacttaatcaaattcatcaaatatttattaaatatatattttatatatactagactactgatacaatagttgtcacagtcccaacaggtttgaagtctaagagtagggatagacaagccaggccatcatggaactgacactataagtaattgacagagtgctacagtggcacacaagaagtgccaggcttgggggagcaagctagtaagagaaaaggaaggaaaggcttcctagtaattgataggacaagaaaagtccaaataaataaatgaagccatggcaagagggtgagagagaaaaataatacccagattcagggaatagaaagaaaagtaggaagacaaaagtgtttgtaaaagaaatggtatgaaatgagggaggagcaaggaagaccatgaaggccacttcatttcttagctcacagcttgctatgttctgaatatctatgcctccccccgccaaaattcgtatgttgaaacctaattctcgatgtgatggtatcaagaggtaaggcctttgggggaggattaggtgagattagtgtctttataaaagaggcctgaggcggtctgccccttccactatgtggggacaaagtgagaagataccatttatgaaccagaaaacagtcccccaccagacacagaagctgctagtgcgatgatcttggacactgcagcctccagaactgtgagaaataagcttctgttgtttataaaccacactgtttataatattttgttacaacagcccaatcacttaaggtcagtattgttatgtgtgaatttgatcctgtcattatgatgctagctggttattctgcagacatatttacgtggttgcttcatagtgtcactggtctgtacttcaatgtgtttttgtagtggctggtaatgccactacaaatatttcagggtcctgaaaaggaccatatttagtgcttgcttcaagagctcttgcaaggcctggtggtgacgaattccctcagcatttgcctatttgaaaaggattttatttctccgtcgcttatgaagcttagtttggccagatatgaaattctgggttggaaattcttttctttaagaatgttgaatattggcccccaatctcttctggcttgcagagtttctgctgaaaggtctgctgttagcctgacgggcttccctttgtaggcggtatggcctttctctctggctgccctaaacattttttctttcattctgatggtggagaatctgatgattatgcatcttgtggtagattttcccatggagcaccttattgggattctctgcatttcaagaatttgaatgttggcctatcttgctagtttgggaagttctcctggatgatatcctgaagtgtgttttccaacttggttccattctccctgtctcttttgggtacctcagtcataggttcagtctctttacataatcccatatttctcagaggtttcgttcattcctttcattcttttttctctattcttgtctgcctatcttatttaagtaagatagtcttcaagttctgaaattctttcctctgcttggtgtattccactattgatatttgtgattacgttgtgaatttctcatgttgtgtttttcagccccatcaggttggttatgtttctctctaaactggctatcagctactgtattgtttttatcatcattcttagcttctttacattgggttacaacatgctcctttagctcggtgaagttcattattacccaccttctgaagcctagttctgtcaactcagccatctcagcctcagctcagttctgtgcccttgttagaggggtgttgcagtcatttggaagaaacgaggcactctggctttctgagttttcagcaatgtaagtgggctgaatgccccaattaaaagacacagaatggcaagctggacaaagagccaagaaacagtggtatgctatctttaagagatccatctcatgggcaaagacacacatagactcaaaataaagggatgaaggaaaattcaccaatcaagtgaaaaacagaaaaaaaaaacagtggttgtaatagctggaaaaccccattgtctcagcccaaaagcttcttaagctgataagcaactttagtaaagtctcaggcaaaaattgctagcattcctataaaccaataacagcaagcagacaagcaaatcatcaataagctgccattcacaactgctcataagagtgaacagacaacctacagaataggagagaatttttgcaatcgattcatctgacaaaggtctaatatccagagtctacaaagaacttaaacaaatttacaagaaaaaaaaaaacaaccccattaaaaagtgggcaaagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaagggggcaaagtacatcaacagacacttctcaaaacaagacatacatatggccaacaaatgaaaaagagctcaacatcactggtcattagagaaatgcaaatcaaaaccacagagataccatcttaccatctcgtgccagtcagaatggctattactaaaaagtgaaaaaacaacagatgctcatgaggtcaaggagaaaaaggaatgcactgttggtgggtgtgtaaattagttcaaccattgtggaagacagtgtggccatacttcaaagacctagaggaagaaataccatttgacctagcaattccattattaggtatatatccaaagacatataaatggttctattataaagatacatgcacacatatgttcactgcagcactatttacaatagcaaagacatggaatcaacctaaatgcccatcaatgatagactggataaagaaaatgtggtacatatacaccatggaatactatgcagccataaaaaggaacgagaccatgtcctcatgtcctttgcagggacatggatggggttggaaaccattatcctcagcaaactaacacaggaacagaaaatcaaacaccgcacactctcacttttaagtgggagctgagtgatgagaacatatggacacatggtagggaacaacacacactggagcctgttgttgaggggaggggagggagagcatcaggaagaatagctaatggatgctgggcttaatacctaggtgatgggatgatctgtgcagcaaaccaccatggcacacgtttacctatataacaaacctgcacatcctgcacatgaatccctgaacttaaaataaaagttgaagaaaaaaaaaataacagcccaatcagactaagacatagctgacttctcattcaatcacttgtatttacatgtggctagccatgctacaatttttaaagaatgagtgactttgcaggatctcttagccccaaaatagagctttgtataatattaacgtattcaataaaagttgtacaagtaaacatttcctctggctctgaacatcaggtcacttcctcttcagtcatttgttgtaattatttgttttccgaaagaggccagaaggggtgagaagaatgaaaggttattttaatagaaactaacctacggagttattttcctagaagaacgtggtagcggcagtagggtaaggtagtgccagaaaatgcgatatatacatttagaagactcatgctaacccctatgtagtccagagtggaaggtttcatcttttctgatttacaaacatgaaagagtcccaaagtatatttataggttaatgccaattcttcaccttaacaaatataaaaagctagctcaatgatagtgaattactttgtgtaatttgtttgctttatgcttctctctgtgattcagctgagacataatccacagaattcaataaatacagctagtgattaatgccattagggtcactaataggttgtctgatcctcccaagttttccaaagcaaagagtaataagctgcctagctacagtttctgctagtagagtgtttttcatcttgattctgcctttccaatacagcttccctcacagcaggaactaaaaccttacttaagaaaatgacacaaacacacgaaaaagaaatttcttatggcatacactttcttggtgaagtaagtactgtattttctaccttggatagtttctgtttttatcttgctgctgccatccattatatagatgtatgagtcactgtcctaaaagacagagactaaagcatgggtggttctctacggtatttaatactgatctctgcattataggaatccaaaagaatgcagccagatgataatggcttgggtacaggccacccagaaatcataaaatcatgagatgactattattaaaattaaaaagaatattaggaaaaacatttaaaagaaatacaaaagacaaagggtgagtatccttgttcaaacagagttgatcccaatagcttataaaatgaaaataaaatcatataggaaaaatgaaatagaaaaaagacatgacacaaaagggaaggaatttaaatagcagatatataatctctaatcatacacacacacatacacacacacacacacacacacacacatattttccaatgccaaagacttccatattgctaaatctaatggtcaattatcctatgttactttacccatcagatatatataacacaaatgatcactctgtattccttgattttctttcatcatttaaggaccatgaccatagtttcctggttgtcccctaactcatgggttactcctgctttgtccctcggaatttttaacactggagtattccacagctcagtatctgtactgtctgcagtcattaggttattttcactgtctcatggccttatatggctttctatatactgatgactctgtatccaacaacctactcaatgtgaggtggataaataactcaaacttaaatcactgaatctcttctctttcccccactgtaaccactactcttacaatctccccaatctaaggaaaaatcattcttttctagttgtttagttcaaaatccttgacttttcttggagtcatccttcacttttctttcttgcacctagtaactgatttgtcagccagttctataggggaaaatacattctcaatctggctctttctttgcatcctccgtggtacaatcctgaaaaaacagctgatggcattcctctgctgaaaaccttccagtgacttcccatctcattcatagtaaatcatcaatactatctacaaaggaactttaagatctaccctgttatctttctgatcactctccttcctagtaagttcccctcattatctccacttgcagattgtttgcacaattatccataattatttcctcctcccaatctatacccctttataatgtgactttccagactgtttcatcacaagctattaatatgcatccctttccccacctcaataatttgtattagccttgaaacctgctttcacttaaaaaatgcagtagaagtgacagcatggcagttaggaatagaggcttcaagtggagctgcagccttccctttgctctcttggaaccctcccctgttaccatgagagtaattctgagcatgcctgatggatggaggatgagactggagtcaggtacagcttacagacatccaacctctaaacatgtgggtcctttctacatgctgacatcatcaacaaaactgcctacccaactgtgatatcatgatataagaggaaatatacatttggtcttcacctctcgtttccgataaaagagttgccaagacccttggaagctccacagtaatgggtgtctttcggtgtcctgatgagatgactggtggctgggggcctcgaggagagtttcaagttggaggctgatacccaagaaagacaaaggcatgatcagagtgtggaacgttcatacccaccactcccagtggagctacagattatgctaatcaccgatggccaatgatgtaatcaatcatgcccatgtaacagaacccccatttaaaaaccctaaacaatgtggttcagagagctttcaggttggggaacatatccacatgccgggagggtagtgtatcccaaagccaagggggacagaagctcctgccttaggacttctccagatcccaccctctgtaccacatcagctggctgttcacattcatcctttataacatccttttataataaattgtaaacataagtgtttccctgagttctgtgagccattatagcaaattaccaaacacgaggagggagttctggggacccactagttgcaactggcatttaaagtgcatggcaatctagtaggactaagtcctttacctgtgtgtgtgttggagggtggtggtctgtgcttactctgaataatgtcagattgaattaaattgtcggacacccagttggtggccacagacaactggcaaattgtttgatgtataaaacccagatgtttagtggcagaagtgttgtgagtacaggaacagttttcctttaccaacccacgtaactggcacatgaatgagcccacaagatctgcctagctgaccttagacttgtgagtaaataaataaatcagtgtttaaagccattaattttgggggtagcttatgatacagcaaaagctaactgatatcattctcatgtctcagggcctctgcacaagcatccccacttcctggaaggttcttcctttggctgagcaaatggcttgcttctccaccccctgcaggtcttaactcagaagtcacctgctcagtgaggctctccctcactttaactgctaacaacctactgcaaagcatgctacctcttctcctgcgttattattctccttctcactagtaatatacttaatattttaattatttgtcttgcttatttcctctatgggaggtcaatgaagtcaagtattttgctctccgctgcatcataggtgactacaataatgcctgttatatagaatgactccataattaaaatatgctaaaataataatggaatatgatttcctacataatatatcaaaaaaacttaagttaataaatctggcaagagcagagagaaatgtaaattgtcttatactgttgatgaaggttaacttaagcaacaatattctggaaagcaagttgtcaacttagacttaaatacattttttaaaatttataacttctggagcatgtcttaacgtctgtgaaactactgtaagtgtcacaaactcatacacttataatactacttaatgtttttataatacttaacaaagttttatttaccaaagatttacttataaaaaacttataagctgtctgggcgcagtggcttacgcctgtaatcccagcactttgggaggccaaagtgggtggatcacctaaggtcaggagtttgagaccagcctggcgaaaccccgtctctactaaaaatacaaaaattagccgggcgtggtggcgcacgtctatagtcccagctacttaggaggctgaggcaggagaatcatttgaacccgggaggcagaggttgtagtgagccaagattgcgccactgcactccagcctgggtgacaaagtgagactctgtctcaaaaaaaaaaaaaacacacaacttatgagctacataactttctgatatatggagaatggttgagagataaaaatgtaacaaaatttatatataatgacttggtagcatgttcataatataatgttaaaaacaggcatgatataaagcaatatatagataaaaatctgtatttcattacatgtacacacatacatacacagagcaataaacatacaaaaatgtaaaattgaaaaaaattatatatgtaaaaatattaacagacgttatctatagaagtgggattttaggttattttaacttttttctttatgtcttcctctattccccaaattcattataataatcctatgtccataggtgggggaaaagttagaggcgatagcagagaatttgccttttaaaatatataaagtttaaaagaaaggtaaatactaaatgatacaaattcgaggtgtttaatttatctttatatattttgtaattatgactgcatcaaaaattacttgaatacggttttatttaaaattgaacaaataagctcaattaaaataaataagttcagttcagatttctgtcacacaatttggctaaaatctcactttgataatccttgcctcctgtattcttacttgattgcatcctattaaaagcattagagggcatcagtgtaatgcataatcactaactctctcctcccacatcagaattaagctttggcaagcaactgccacatggagaaaagtcgctgggaaagccctattactgctaataggaatcataagaccacactattatgcaaaaatgttctttttactgactgataaaatgccaagatgacacaaactggagttgtttttcttgttcctaacacatggaacagctctccagttactaataaccaactaatgtatagtcgagcagaaaaaaaaattgaatatacactagaggccgctagtgataaataagtgaattttgcatgaagtggaaaaaaaatgctgctagttctacaaagaaaactgcatactaagctcctaagcttcagctgcccttttaactactgtgctggaagccacaaagcaatttttttcttaattatttctcgccttaaatattttttaacaaaagaactaaatctgggaaattttcatattgggaaattttgtaaaaacttattattattgtatatttaaattaaagccttacctttaagtaataaaacctttttagatattacaaattagaaaaataatgttattctctcactttgttgtcacaaagacccaaaccaactaaagaaagctctatgttgtaaaatataagcttgtcttggtaatatttcattaagaggggggaaatatttttaaatgcaaaagatatctaaaaaaaatttacaaccctctccctggaaatttatgaatcataagagtaaaattttaaagtttacttggaaacaaatgtaacatgaattcagaaaacaagaatcttttgattaaaaaaaattttataaaactaaagaggaattatacttcctacatacttttttaaatttgcaaagaacgttattaaatttctcagaatacacaagaggcatttttgtcacttatttgcatgacagatgaccatttcattccctttcactgtcattacatagtgaggaataaaaacagttcccaaccaggggcattttataccccagtaagttagggacgtgtgtggggaggcagaagtaaggaggagattaataaagaccattagactatcctagggcaagaagacagcacaggcagcagagaaaagatgctgttgatgtatacgcatgaggattctttttgtttttttttttgtttgtatttatagttggctggtcccacttaggcgtgcagaaactagcatggtctcagtcttgaccggaggcaaatcccactccagaaacaaacacaaccaatagaaacaaggacatgggcagatattctctcagaaccacctcaactcagttgaacaccatattacactagaaaagagacacaggaattcacctgtagtacacccagtggccggctcacaggtggctaagtgcaagtcctaacttgttcttagagtgcaagcatagctgtggatctggcttccagcttcccttgattcctaaatgtttcccaagcctcccaattcctgcatattcccccagccttcccactttctctattaattatatcatgtttgatttttgtttacgttggccagagttcttgttctgtacaactaaaaacccacacaaatacaaaaagttaaataagtcccaatattgttaacagaagagattttggtataggtctctgattctcctcttaaataaaaataatcttaagaattacctttttgggtcggaaacacacattcatactgcaatctgtgacagtaggctatatgaagttttgatgagtatttctaatcattctttagtaactcttaagcacatagttaagaactaattgctggggataagacagtaaaaatgctagagaaatgtatgctttcactgaggttacaggctggtgggaatttgcaaataggtgattctaatacgttgtgataaatgtttgataatagaagtgctggataagagaacttcaaggacaaattacgtaagagagatgcagaataataatgtaatataacctggtaaggtaagaaatctagccacgaaacacccttagtttatttaggatttgtcacttacttgcttaattgaatatgtggggaaattattttcagtatgaattgtctaaaaggagtaacgctgattagttaaaaatatttacttatcatctattagttatcaaacctgatcctagctgctaggattatttccaaagatgagtaaaacaagaacagggaatttttcccaattaaatagaaacacccatggataatttcaacatcatgtgacattacagtgaaggactgcttagagaattcattcctaacttgggtctgtgaaaactaagatttctggggagacacaacacatgggctgagttttgaaagataatgatgcataacacatggaagaaagcaggaggcttttagaaatgaattacatagtgttctgtaaaaaacaaacaaacaaacaaaaaactccagttgtacctaaaacctgctccttgatatttccaagggcactccgatggcttgaaaataataggcttttttcaacatttagatggcaccaagattttaaataatcttttaaacagtgttaatgcatacacatcttctccccacatggctcctctagccctgggtatcacacccaggtgtcagcacccctacatgacacccagcagaaacagatggaacctgacatccaaggtgaaaagaaagtgttccctggtctaagccctgtagagagggacaacaccatcttccctgtagtctaaggagaagcattgttagtctcattcaacaaaagtgctccttgcaattcaaaatcacaggatttagaggagtcagcgtttttaatatttacgattttttattttagttccttttagtctagtcattgatacactaaatgcactcttattcccttcctctgactttctctagctctcttctacttccaaagccagagttaactatagtgtagttaagtatattgcatataatgtacacacacacaatgacttttttcttagtgtggtgtaatatcttctgttgtattttaaatgccctctctgagattcttcagcatattcttgaccttgctggctacagcagcaaaactgaagtctttaaggaatacacctcaaacaactctcagattcctaaccccacattgtaagtgatagttcagtgctcatctttgtgtaattgccatttggatattttcccataaaatttactcactagcccttgcttaaattgaattccagctgtcacttctgttccccaacaattggaagaccgtggatagctcagttgcaatcctatcatcaactaaaatgtcctgccctatagtgacgtgtcaacaaataatataagtcatcttgcctagtgttggagttattctgtttgctcttggccaaataatacaaatcccaactcttaataacaagaaaaccaggcaggaagaatccgagggtgtatttgcaagaagacctgtatgtgcgatcacataagtgtgtatgaaaaaccagacagggacaattccacaactttttaagaaacaattttgttggtgtggtattatgtgattactttcaaccatcacttcttaactcattgatctaaaaatctattaaaaataagtttaaaacatgacaagaaaacatgagctcttatattaacaatcactaaaacaattcaacattttttttaaaaaaagtaaaatgtaaaaagccacgttactcaaaacttttgacaaatgatctagcattctctaaaatattactggaagataatttatttctgaagactccatccacagtgcaggaagggaaaagggttctgtcaggaacatactttatgaaatagaatagccataaaaaacaatgcctctgattaaatttagttgtaaactgacttcctgcagctgcttaaaatggtctcgctctgaaaatttattttgggttcatgcatgatctgagaaacatagcaccttcgcatacacattcctccctcctctaacactccaaaatgattcatagctatgcatggataattttgagacctctgatttatagcatttgataacgaacagactaaaatatattactaaactaatctaatcaataatttaagataaatatgccttcacggtttgttgtgtaaggttctttaataccaagacttctgttgtaaattatattttaaatgcactaatcatttttacctttcatcattttgattcaaagacctaataatgttgacatgcttacacagcttggtaatttgattgcataaatactttttaatggaaatttactgaagcaaatgactaatcattgctaaggctaggcttataagaatcaactgaaccaaagatctttggttcatatttgtttcctttctgcatatgttaaagcatatagaaattacatgttttgactattccatgagaggcttgaaaagcagtaaaaaaaaaaaaaaacacaatcaatgagaaaattagtcatagagagactgaaatcaactgccacatatattggaggttatcaagatcacaacttatgctcagatacttgacaccaacttacttcacactgatttcatgtttattgtcttgctcctttaaaaacagaattgaacaagcttttatatactttttactaagatatagcaaatatagaccttacatataagtctttactactattttatataatgtctaggattgagttgaaaacactgagaattttgctttgttccaactaaaagaacatgtattccaaagaagcacataaaaaaatgataacaaatttcaacaaaaaggcaacttttagaaatcaggttcatcaactgtgtaaaataaagaaagaaaattgtggtatacgcatatactggaacactactcgacagcaaaaaggaacaaactacataaaataacataataaatacataaaatacatggatgaataaaataacacggatgaatctcaaaagcatttgataagtgaaaaataacagaaaagacaacaaattgtgtgatttcatttgtatgacattctagaagtctacaggggacacggtgtgggaggaggcgaatgactgcaaagcgggaggtaggaactttctgggatgatggacgtgttttaatctcgactgtggtggtgggtacacaactatataacgcttcaaaaataattgaactgtatgtttaaagtggatgaattttgttgtatgaaattatagctaaacaaagtggatttaaaacaaaagaaatcagatgccaaacactaccttcctatatgccaaccactatctgaaaaatgcttacaacgtttctgaaaagtaatacaattattacattcagaatagttaaccatgacaaaaatatttacagctatggcctaaaactacatcaggtacatgctgaactattcaataatttatcattatagcttttaagagccatgctccatcctcttgatttatccagatcttctgtaatcagccacagtaatgttacctcatcaagatttctctgaatactccaaaagaaagtgatctcttcctgaaacgtcacagatgaagaaactacagcccaaaaagttaaattacttgctaaaagtaatgaagtggcagaacccgattttgaaccttaatctaactctctgactacataatgtcccttctggagggtgctgctacctgcaatgaaataaaacaaaattgttcaaagttactcacaggtagccagacttagactgtcactgattcactgattccttcaagagtaatcagacacttgctactaccagatgcctgggttaattgtattgataaaggctttagaagctaattctttttttttttttttttttttttttttttgagacggagtctcgttccgtcacccaggctggagtgcagtggcacgatctcggctcactgcaagctccgcctcccaggttcacgccattctcctgcctcagcctcccaagtagctgggactacaggcgcccaccaccatgcccagctaagtttttgtatttttagtggagacggggtttcaccgtgttagccagcatggtcttgatctcccgacctcgtgatccgcccgcctcagcctcccaaagagctgggattacaggtgtgagccaccacacccagcctagaagctaattcttaagagctctcctcccacattattcagttattttaattatattttgaacttcatttagctggggcacaaatagttgtagagttagagttacaacagtcatcctcttcacacttgattaatctaaaaagtagattgatctgatgagtaagttgcatgattatataaagctcaaagaccgaaattttaactgtgagaaaattaatgaagtgagaggaaaaagagatcaagaacgtattttgcttttcggtttaaataggccctcgtcatcctgccattggtaatgagtgtttaattatgtcgtcatttccatgagtgctaggaatttttgttaggtgctcatatttaaagagaaagaaaactcctaaacagttgagctaactttgaacaatgtttatataaagatactctcctgtagacctttccattcaggattctatattcattaattactctgagaaaactaacctaaaaacacccctccccacatttcagatatcctacacacaatattaaagatatagcaacttcttagactgttatgctgatgagcctgagaatctctaagtaccacaaaatcacaaataaaaaaaaaacctcacatttagcactgatattcatggtacatattgctctcaaaataccaatgaattcaaaagccaggaccttagttccaggacaaaagattcatttagacaggaattagaatgcaacgtaacataagatattctggaaataagtgggatatatactatacatgactttggacaaaaatgcacaatctttttagacataagccatttctggcttataatactaataagatatataattatcgaaagtttctttaacaacaagatacttccaatagctggtgttgtatcttataaatccttgacttaacaaaactcagttttacatctctgctaacatatcaaggaaaaatcacaaattcaataaattctcaaatgctcattagtgtagtagatatgaagcatataaagatgattaattatgattgctgccttccaggagtttaccacctagtgaagaagatacatctacccgtagctaaatcacaagataaaataagaaagtaaataattacaaagtattatgcaaagttaaagggcaatagatcactagaaatttacaacctagtacagaatataagtctttacagctttaaatcaaggtaaaatgtgaatgtaacattgtgatttaagagtattattacagtgtaggaaatgccaaatcacttcaggctggaagggaagaggagccctcctggagtacatggtgtgttagttgaacactgatgcacggatacgactgttacaaaacatgctggcacatgctgctgaaaccatctaagaatgagtacagcctaggatctaccatcactgattatttcgaatggctgcacaattgtaatggactatgggtggggctaatgtgtaccagatcagccatgagaaagggcctgaggaaagtcagaggggagaaagcgcgtggcaaatttaggacagtgagcagttctgcttgaccagaatacaagggaagaaattgggcatgcctaaaaagataaccctgcatctcaaggtagttaattgagatttcatccaggagacaaaggagaatctccctgcctctccccagtcgctacaaatgcacacacatatgtatacctcacatgctctatggtcctaatcttttacagcccattaggatcctcagaatattttttaataccttcactctgatataactgtccttgctccatgtcttcctttgttacagaatctatcacactgaactagaattttctctttatgtcatataatctgtcatactgaatggcaccagggagcttatgtttactgagcttgcatccacttaacaagtaactacagaaaaattaatcatatgtcctactgtcccacaggtcagaaccaatagatattaacagatacactgcaattcacgataagaaaaaatatttagggcttgtttatcaaaacaaaacctgataaatgaagagaggctactttcatagttgaaacagagacagacgtttatgaaagatggaatggccttgaggacattatgctacataaaataagccagtcacagacagacaaatgctgcaagattatctcatctgaggtatctaaaatagtcaaattcatagaatcaaactgtagaatggggttgccaggggtggaggagagtgagaaatgaggagttactaatcaatgagaataaattttcagttaagcaagatgagtaagttctggagatctaatgtataacactgtatctgtagtcaacaatatgtattatacacgaaaatttgttaagaggtagatctcatgttaagttttgttaccacaattttaaaacaattttaataaagatggtgtgcaagcatttcacacatctagtatagaactggacctaagctcacagctgtttttttaattaataaaagtaacaaataagaattgtgttacaagctattatatatcaagtcatgaaataccaatggtcaataaatacatgaaaagatgctcaacatccttagttatcagaaaaatttaaattaaaatcacaaattccattcacaaacactaaatggctaaaatcaaaaagataaaaaagaacaaatattggtgaggatatggagcaatacagacattactcatggaaatataaaatggtataacaactttggaaaagtgaaatgccaatttctagaaagttaaatatatatttaccctgttacccagaaacttcattctttgtacctgcttccccaaattaaaacatgttcacagaaacccttgtataagaagtggcatttacacataatagccaaaaactggaaacaaccaaatgtacatctggtgaataaacaaatgtaattgtggtatattcatacaataaaatactactgagcaataaaaaagaactaccaatacataaatgaattgcaaaaacatgtgagcaaaagaaaaaagacacaaaagaatacatactatatgatttattttgctcgaaattcagtaatagatttttttaagttctatagtaacggaaatcagaaagtagttgactgggggtaaaaaactagattatcaatcatgagggaattttctggggctagagaaatgttctctctcgttttggatggtagataagaggctgtaaataaatgtctaacaaaacccatgtaattaaacatctatgatatgcattttattgtacattaactatgcctaaaaattacatatatataatttatatatgtgatttatataatacacatgatttatatttatatatatgtgtgtatacatatatataacctttatatatgtatacaaaggtaactttttaaaaagaacataggatctaacttaaagaagtttatattggccaaagatgagacaatttgaacactgaaaacaatgatatctgcatatctgtaataaaatgaaacctatctaatatgtataagccaagagtttgggagcactaattcagtactctgaaagcaggtaacagaagaacattaatcacctctacttcataaactatgcttccgttgtctaatcttggactttctgggctgcaggataaatgggcactatgtttctacttgctgattatggccaaatccaatacccttttctgagtcttctttttactacacacatctccccatgggtcccaacagcctcacctgccacactttaaccttccctttccctctgggtccatgaaagagtaaaggggccagcaggcccaggcaggggcctggagcacacctgggtcctcttcaggctctcctagggccctagctccatgagggacagagatggacctcaatgtccagcagtatccagaagcagagtgacacggggcctggggcctcacgccctgccactcctcagcctgagcagaggagagaaggtcccatgactgatttttccttcagctccactcctctgtaaactttgttcctctgctactgtctatatgtcttccttccttccattcaaaatgtacaaatattttgtcttcaactgaagatgattctttaaaaattcatgttttatcacataattatgaggcattgcattgtacatatggatgttaagtaaataaataagaacagggcaagtagtggtccacaaaatacatactggctttttaaaactcatgcatattttttcgttttttattgtgatgcctttctattagaaatacaattaagaggaattatgcttagtcacctgaatccaactagtttgactggttagggtttgtatttagaggttgattcaaggacttaattcccacatgagacagttagtttcactcatcttcctattagagattctaccctcacccaggccagcgatgtccccgggcatcagagtaggaatcattgcaaacacataattacaattacaaaatcaatgaaaagtacaatgttttattgaacatcttcatacatgaacaaacagttgttaaattatataaattttcttggaagacttctataagattacttataaatgtgttgagaaacatcacacgtggttattttgaaatttgggccaaaaataatggtactcaccccctaaatctggtaatctgttttgctttcaaatatgaataaaagtgttctgtttgaaatcatctgctttgtagcaacatggatgcagctggaagccattatcctaagtgaattaatgcagtaacaggaatccaaatactgcatgttctcacttataagtgggagctaaacactgagtactcatgtacataatgatggcaacaatagacactggtaactatgagaatggggagggagggggttaggggttgaaaaagtaactactggatattacactcactacctgggtaacgggatcattcatatcccaaacttcagcatcacacaatatacacatgtaacaaaactacatatatatatatatatatatatatatatatatatatatatatatatatatatatatatgccctgaatctaaaataaaagttgaaatcattttttaaagtgctctgttatctttattagtgtccactccaattcagtaaaaataatcaatatgagagtctatatttcttcacaagcattatcgacagatcttatgatcaaagatcacttggaaggcacagtgttgagatcctttcacagttgtggttacaattacgttcacaagctacacctgccatgagagaatacttggcaccagattatttgccagcaagcaggctacaggcccaatacataagcttggcctcatgggcattatgctcttatctgaagtaactggcctagaccctttttttacaacacatacttgagcgctttttcacacattgtccatgtcaggtcttggaggatactgtcagaggaatctgtaaagttacaaaatgaaggagcaaaaaatgttaagaatttaaactgtcttcttggctgtcactcttgctatactttttgataatgcatctagtccccagatattagcattagcacgtccagtctcgaaggaaacatgccttcctcctataagaaaccggctgctttcaaaaagcagctccagtgttagaatttttcatcccataaagaaaaatatattatttcaaaatacatatatttaatttgtacctagagtgtgttacatcataatgtttttattttttgcaccaagaaggtaatttcttaaactataaacatttcaatataataacacatatgatagagatgaaactatgtttcatagttagtctacttatatgttcactataaattcttgtgtttgccaaggtgtttggactacaaacatgttcacaatgagctaggtttaaaatctacttccatcaaacatactgtcgtatctaaaaataccttaccgcatacagataagacaaatcagacagcagggatagtaaatcttaaggaaactctttatctcttaacatataagtgtatgcataactgagaaataattaagttaaattatactgggctttactcaacactaatataaaatctcatattttctatgagggaatatacatctactttatataaaatcagttttcattcatttacactgtttgaataacatctcaaattgcaatttgaagttttatttaagctgactttcacagttctcacaagtatcaagatctgataatgctacttaatgtggctttgaagtagcagaatgaaggtttttaaaataagaatagatgggcctcattctactaagagataccattcaaagcaagaaataatacaacatggttaagcagctcaggttactcttccctcactgaggagattttctataaaagagtctgaaggagaattaacaatgtccacttacaagaagaaaataaaacaacagaagagcagaaattcatggtactatgcacattgactaaaagaaagcatacctttctctctctccttcggtgatatcatataagcggttggcacctccatcggcacaggctcttaaaagagcttcaaatagaaagaacaaaatcatttcaatacaggaggcacagagcaatatctttcaaatgatgatcactaaaaagcaggcactcagacgcacagagtcacgctaacctctgtgaatcatttcacattcatctgttgacactgctggtactaaaaacaattctatattgcacatgacaaatgacaagtttatttcctttctgcatctttttttttttttttttcctgaaatggagtctggctctgttgcccaggctggagtgcagtggtgtgatctcggctcactgcaacctccacttcccgggttctagagattctccagcctcagcctcccaagtagctgggattacaggcatgcgccaccatgcctagcatatttttgtatttttagtggagacgtggtttcaccatattggccaggctggtctcaaactcctgacctcaggtgatccacccacctcagcctcccaaagtgctgggataacaggcatgagccaccgcgcccaggctttgcatcttttttgattaaataaaggagaagactgtagacggtgctagcatgtcttcaatgtttcttgaaattttttttcctttttataacagaagataggcctcaggctctatgacaggcaacagaaaatggtttgttgtttttgcagtttgagacagggtcttgcgctgtcacccaggcgtgagtccaatggctcgatcacagcccactgcagcctcaacctcctggactcaggtgatcctcccacctcagtctcccaggtagctggggctacagacacacaccaccgtatcctgctaatttttatattttttgtagagatagggtttgcccaggctggttccaaactcctgggctcaagtgatccacccaccttggactcccaaagtgttgggattacaggcgtgagcctctgcacccggcaggatatggttttcattgtgttccctccttttaataatttttacatatccttttgatttacaatatgtagtatgggtttcaatttttattttgattaaaacatttcctcttaaaaataaatgtttattttaaaatataagtaaataataatctagataatatgagcataatgtaaaaattgtgaaggtggtacaaaattaactgaaacttggaaatgctaaggtaatcaaataaatcctgctgtctctccaacttgggccttggcctcctcctttcgcatgatttctccctgctactgctctcggatttgatgctgcttatcaactgctccctgaagtttttgcagtccatggaaagctatttttattgctggtgctacctttctgagttttgttcttcatagaaatatttagtatcttagcatcagctcagaatgaacattgttaggcatcaaactagcaggttctttgctagaggcctaagataatgtgacagggtctccactttaagcatcttctaaccagtgcaaataagccagaagccgatttattaaagtccactctcagaattgacaaacaaagtgagaaactacttttctttgaaattaaaattaatggcacaggtaagcggaattgagggaaagaaaacaaacagccactttcccttatgtattcctcaggtatttgaaatacaaaatagttcagatgagtacagcctctagaaaaagatcagtgacacatgatttgttttagaaactgtaaaataatagatgctagaaaatgaccacttaaacaaataaaaatccacagtttccattgtgggaatttcccctgaatttaatccacccacgagggcaagatgtcgtatgaaagtatttgaaataggatggaatggtccgaaatctcagcaggggacctaaccacctcctgacatttcacacctgcataccccacccagctttaatgtacatttaatgagcctctcttggtggtaaagacactcctcttccgtgtggctgcaaatgtaatgacttcagcttcattctggaataatagattagctgagtataaataatactgtaaattggtagtaaatttgacggtattagtacattggcttctgattgccattggtacactgatactttcagaaagccgctgtcagtccaatattcttgtgtatctaacctgttttctctttttggcaaattttaagactttccctttgtctttagttttccgaatttcaccatcgtgtagcttatttggaattaactgtgcttccaaggttgggcgtggaggccttaggaatgtaatcccagcactttgagaggcaaaggcgggaggactgcttgagctgagaaattcaagaccggcctgggcaacatggcacgaccctgtctctacaagaaatttttaaaaattagctgagcatggtggcactcacctgtagtcccagctacttaggaggctgagctggaggatcgcttgagcctggggaggtccaggctgcagtaagccaagatggcaccactgcactccagcctaggcgacagagccagaccctgtctgaaaaacaacaacaacaaaatgtgcttcctaaatctgaggacccatgactttcttcagttctggataattcttagccacttttaattccattatttcctaccttccattctctctacgcatcaattttctgactctccatttaaacgtatttttagacagtctcattctgcccttcacatttctttttttttttttttttttttttttttttcttttttttttttttttattatactctaagttttagggtacatgtgcacattgtgcaggttagttacatatgtatacatgtgccatgctggtgcactgcacccactaatgtcacatttcttaaactgtgtcgcttctatcaccttttctttctgtgtatgcatgtaatttcttcaaacctctcttgcaattatgtctagtcacctgtttaaaacattaaagtttatagtcttactgattctttttaaagaagttctatttgattcttttttcaattcaaggtcttttctgataatctgttgctaatattttctataccttcttttatctttttttttttaaaatccttttcctatggatgggatatttaaagaatatctacctgactatattgtcagaaataaaagttccaatgtattttccacttatccatgatatgtaagactattttctgtgttctatggtacatgagaaataaagcagaggcgaagtggaaaaaaaaatattcattttctctgtagcttactcaccagtaaataagcatattacttatggaataaggttattaagtaattacttaatgattatatatagtgctcattacgatacaagaatacaataagcattcaataaacattgagtcctctttttccatttttgtcagaatgaaaaaaaaatctgaaaagattgtgtttctggaaaagaaaagccttatctacttagaaaataaaaaacaaaaataagagtttttataaagacatctaaaagggatgtctcattttacaaattaccaacacacatttcctagtaaggagtgacactcaaattcaaattatgtcacaaatataacttgcagaagatcacagaagatatcgcacatttcctaagtatcaaaaccatcaaaagctaaaaaacagagatcatttcacgtataaaatatagcacaaaacaagtgattagggagatagaaaggactcgttaatagaaacagatggtaaactatcggtaattatctttagagaatataaaacaattctctgtaaacaaaactaacaagtgtatggaatatttttatgtaataaccgattcactaaagtaatatgaaaatctcagaaatagtagtttttaatggtcaaggattatcaaatagaatgacttgccaatttttcacattacaccattttgcaaagatcggttgaattcaacgtgtattcctattatgtgctaggcttacataagataaaaagatgaacaataaacagatctagttctctgggttcatattatagtgaaaaacacgaaaacagaagcaaatacatgcaatgcactgtagactgtggtgagggctgtaaagaagtcaccaaaatgcaagaggaagacaaggaaagaagaaatgaatttcagcgggcaaatgtgtaaaactgctaataataaatccagttcagctaagatcattgttacttttacaatagaaaaaacgctaatgcctgttatttccaacatccacctttaaattgatatttcttgagcagtgtataaaaagagaaacacctatatcataggaagtaaatttgtccacatctattcctgctttaaatggcaaagggagctaaaataagcatgatgaaatgtttagactattttctcagtgcttgtaggttgagagtagggattcaatccatctggaaggaaaaacaagttccagtctgtccctaaaaccattttgttttcaataaagcatgaccaaaaaaatgtattctacctctccttcattttattaacaaagaggttttcaccagtttcaaatattttctataaacataaataaaactgcatttgaaaaatgaaatgtttccaacacattgtaaacaacattggcataagttcacacacagcgacatttgaaaaatgtgtaaaccaatatcactgttagagaaagtgaccaactaaaggaaccagaagtagaggacattctttaatttttgataaatcgtaatgaatctacctaaaaaaagttcactttatcatcatttaagttgtcccaagctttaatgaatagaagttactgcatgagttatcttttaatgtaaaaattctattggcttatacagcaaaatttctgcagatttgtcacataccataacttcaatggttgagcaattacttaccatgcaacaggctgataaacagatgaagactaaaatatattaaaaacctctacagcaactttatattttagtagaacccgtaagtaggtgaaatacatctttaacttttttttttttttacttggcataagttaacattactgacaaataatgaagagcttcaggcacaagcagaggttagttccctatttcaaatagttccctatttctttggaataaagttgagttgaaataacttcactttctgcaaagtagattataaattagttccaaatattaaagtaggagaataaaacaaaatagattctgcagtttcagttaactcaaagaatacgagagacagacagtgctagtctagatcagccacttagtcctatgatgttgagctaatcctaagcattctgattttagtgcaaaatcaagatcattttgtatatcctaccaaaatcacacacacaaaaattcagggactagagagagacaacataaataaaagtagaaggaaggtgcaggaggaaacattatctcacacgctgttgatgagactataacgttgagggacagtttggcagatttataaaaaatttaaaggtgtttacctttttatccagaaattctatgtagcttgcataaatacttgcccaaaattacaaggaaatatgtacaaggatatttgctgtgacagtatgtgtaatcatgaaaaactaatagcaaacttatactgcccacagctgaatactgataaaatataccatggtcctattttactaccaacaaaaacgttagatcttatatgtattagtatattatctgttatgagatatattgttacttttaaagtttgaataaccttggtcaaatcttccttgcaatagcaattcatggaaggtataggaacataccaaatccaagaaagcatcagggaaaggtctttatgtcaaggttgtagatcaagtaatcggccatcagcattaataagatgcacctgcactggaaaatggtccctagtctggcaccccgaaggaaacaaagggataaaaactaaagagaccccaaaatcaatggcttccctggaaaagcatatccaaaatgtggacttactggtacatttgaaagcaattactgtgaaatgacagacctcactaattttgttatcaagctttattacctgccttgtgcccttaaacttggcattgagtaaagcctatcatgtcttattagtttgttaatccaaacacaagaccacttctatattccatacaccaaactcattaacagggattatttatgagaaatggggttggcataatgaaaaagactttttaaaaaattacttacaataatcactgtgctgttaaagatatttttctcagtaatatgaattatattgtaattacaattttaaaaccaacagtaataattaaaaggaaaaataagagttatagacttaagatatagcaagaatgattccagatacaatctcaggagaaagaattagatattttgccaggttggtcaggattgagtcacaggtgtccacagttaaattacaggacagagaagttccagaatcttatttagaagatgtttcactgagtcccaggagagctaaataattctaattacttaaatcctgtttattcctaaccaagttcttgcccctattactccgaagattcaattaagtcttatgttcctgaaatcaatctaatctgtcaatattcatagtttgagctagggattctgtcccaaacccgagaaacaacagtaaaccacttaatctccaacttctggtaagccacctctagcacccataagagttagaaagaaaatatatcccgtctgaatgcacctcagaaacagcccactagcaactgcacatcaataaggaagtgataattatttgttaaacatgtgagtacatacataactacacaggtatcagtttaaagtttactatcaggcatgaagaagataagtgagtttttgtttttgttttaatttgtattgaattaagaacacaagatcagatctaatcccttaaataagtatataaaaaacagtattgttaactatagatacaatagcgtacaaaagatctctagaatttgttcatctggcattgactaaaactttacactcattgaagagcaactccccatttgcccttcccccaagctcctggtaaccagcattctaccctctgattatatatgtctgactatttttgatacttcatattaagtagaatcacgctgtatttgtctttctgtgactggctcgcttcggttagcataatgttatctcggttcatctatgttgtcacatattatgttcattcttttttaaggctgaaaaacatttcattatatgtatagtctacatttctttattgatttatccattgacatttaggttgtttccatatcttagctattgtgagtggtgccacaatgaacatgggagtgctaatacctgtttgggatcctgatttccattcttttggattaaacacccagaagtgggatttcaggactttatggtaattttattgttaattttcaccatacagttttcaacagtgtaaaccaaccgagtgcacatgtttttcactcctaccaagtgtccaagtgttccaatttctccatatcctcaacaatacatgctgtcttttgttttttgataatagtcatcctaacaggtgtgagtcaatacctcactgtggttttgatttgtatttccctgatgattagtgaattgaacatcttttcatgtacctgttggccatttgtgtgtcttctttagagaaatgtctattcaagtcctttaaccattttgaagagagtagattttagatgtgcttaccaaaaaaaaaaaaatatatatatatatatatataagatgatgagtatgttaaactgcttacctctaatcattatgtatatcaaaacatcatgttgtacctttcaaaagaagacatacacatggccaacatctaaaaatgctcagcatcactaattattagagaaatgcaaattaaaaccacaatgagataccatctcacatcaatcagaatggctattgttaaaaagtcaaaaaataacaagatgccggcaagactgtggagaaaagggaattcttatacactgctggtgggaatgtaaattagttctgccactatggaaagcagtttggtgatttctcaaagaacttaaaacagaattaccattcaacccagcaatcccattattgggtatatacccaaaggaatatagatcgttctgccataaagacacacacacacgtatgttcactgcaacactattcacaatagcaaaaacacggaatcaacctaaatgcccatcaacagtagagtggataaagaaaatgtggtacagatatgtcatggaatactacagagccataaaaaaaaaacagattatgtcttttgcagcaacatggatgaagctggaggccagtatcataagcaaactaacacaggaacagaaaaccaaatactgcatgttctcacttataaaagggtgctaaccactgagaacacacacacacaaagaagggaacaacacataccagaacctacttgagggcagaaggtgagaaaaaggagaggatcaaaaaactacctattgaatactatgattagtacctgagtgataaaacagcctgtacactaaaccccatgacacaaaatttaccaatataacaaacccacatatatacccctgaacctaaaagttcacaaaaaatcatactgtataccttaaatttatattaaaaacttctcaatttttttttattatacttttttagggtacatgtgcacattgtgcaggttagttacatatgtatacatgtgccatgctggtgcactgcacccactaactcatcatctagcattaggtatatctcccaatgctatccctcccccctcccccgaccccaccacagtccccagagtgtgatattccccttcctgtgtccatgtgatctcattgttcaattcccacctatgagtgagaatatgtggcgtttggttttttgttcttgccatagtttactgagaatgatgatttccaatttcatccatgtccctacaaaggacatgaactcatccttttttatggctgcatagtattccatggtgtatatgtgccacattttcttaatccactctatcattgttggacatttgggttggttccaagtctttgctgttgtgaataatgccccaataaacatacatgtgcatgtgtctttatagcagcacaatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagaccccatttgtcaattttggcttttgttgccgttgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctgtatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttctttccaattctgtgaagaaaggcattggtagcttgatggggatggcactgaatctgtaaattaccttgggcagtatggccattttcacgatattgattcttcctacccacgagcatggaatgttaatccatttgtttgtatcctcttttatttccttgagcagtggtttgtagttctccttgaagaggtccttcacatcccttgtaagttggattcctaggtatttcattctctttgaagcaattgtgaatgggagttcactcatgatttggctcatgatcaagtgggcttcatccctgggttgcaaggctggttcaatatacgcaaatcaataaatgtaatccagcatataaacagagccaaagacaaaaaccacatgattatctcaatagatgcagaaaaagcctttgacaaaattcaacaacgcttcatgctaaaaactctcaataagttaggtattgatgggacgtatttcaaaataataagagctatctatgacaaacccacagccaatatcatactgaatgggcaaaaactggaagcattccctttgaaaactggcacaagactgggatgccctgtctcaccactcctgttcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacaaaacttctcactttaaaatagggttattagttttctcactattgagttctaggagttccttatgtattttagaaattaaccccttatcagatacatggtttgcaaatattttctcctattccataggttgccttttcactccattgcttcctttgctctgcagaagctcttaaatttgatgtagtcccacttgtctatttctgctttggtttcctttgcttttgatgtcatatccatgaaatcattgccatgatcaatgtcatgaagtttccccgctatgttttgttttaggtctttcatagtttcaggtcttacagttaaatctttaatttattttcagttgaaaatctgagtttttaaccagctcttttctttctttctttttttttttttttttgagacagggtcttatgctgatgctcaggctggaatgcagtggtgcgatcacagctcatggtcacctcaaactcctgggctcgagcaatcctcttacctcaaccttcaagtagttgaagctacaggtacatctcaccatacgtgactaatgtttttaaattttatagagacaaggtctaactatgttgcccaggctggtctcaaaatcctggcctcaactgatcccctcaatgtggcctcccaaagccaggattatagaggcatgagccaccatacacccagtcttatccaattttcatcactagggacaatactgatataatactttatactttaatcagccaagatgctctaaactgatacattctttcagaaatattacttgctgaaaagtatttaatttacctacaggtatttttctgcctgtgttaaaaccccaaatatagattgaagcctaataagaaatacactttataaaaagactcatggaaattttcacttaatgaattcctaagaatgtttgggtggtcggttttgatatttcttaaatactttataaacaataaaatgtctatttaggatatttctattatttaaaagagaagttatggtatttccttgaagatcttcataagtagggggtataaaatatattgatcaatgacaaaagcaagagaaagaaacacatacggtactatacatatacaacataaaaaggtattaatttttacatctatagaattgcaagtgcaataaacttgttacagtggtacttctggaaagagagaagagttaggacaaatatttatattgtacataatttaaattttcttcagggcaacttactcttgcactctcagctataagtggtattgaatcccaaccaaatccaagctcagcatatggctcaatctatgccatcacaatctcctggctagagtgactgattcagagacagaaatatgacccaggcaaagaaaatgagagctaaggagactttgcaggtttcctcttcaactgtcctgtaacttgtgggactaagcatttgattctatgatcatgtattactctaccctgagaatgaagccaaaacagtgaaggtaaggctaggagacaagagaagacactgtttgagtgtctataactgcaggcaaagccagccactagcctttccaactatgtgagctaataaatgctctttctaggttcaggcaaatttaagctgggttgtctgtcacttaaaacagaattaatatctgtattaatacaaatattaatttctgctccaaagacacaaaatcctcctttcagttggaaaattctactttattatgcctcaaatatatgttggaacaagcacgtaagaggaggtgtatatttttgcaggtactttgcctattgttggtatacgctatcatgagcgaaggtctaaatgagtttatggacatagttaacagaaacagatcagtagatttccctatcaagacattatttcatgtggaatacttgtattacaagcatttcacagaaatatatgctctccttgagagacagtaacaatttacttggctcataagagtgctgaaatgtataattaattgtttagagaactctttcagcactgtagaaagttttattatagtatatttatgtgcaattatcaagaaagttcacattatttgtaatatcctacaaacaatgagtctaatactctgaattttagtcaagtcagtagcacagaattacattacatagaataaaaatcaggtggcatttatattaagcatctacaagtacagtgctgtgctagtcctcatgatatggttcttaccaggtaatgaagagttttattacattttggtaaatattgttgtgtaaattctattaccctttttatctaacacttcctgcttcctcctctcctagttatattcactatggagaaaaagtatgacatttaatcatccttgatcctattcataaagtctacgatcagataattctttaatactgagtgacactaaatacctcattactaagaaatctgagggaaacaaccaaacctcaactatctctcttcatcctaaagtggcacagaaaaatttttctaaaagatgagcaaaactcggccaggtgtggtggctcacgcctgtaatcccagcactttgggaggccaaggcgggcagatcacaaggtggagatcaagaccatcctggctaacacggtgaaaccccgtctctactaaaaaatacaaaaaatcagccaggtgtggtggtgggcgcctgtagtcccaactacttgggaggctgaggcaggaggatggcgtgaacctgggaggcggagcttgcagtgagccgggatcacgccactgcactccagcctgggtgacagagtgagactctgtctcaaaaaaaaaaaaaaaaagataggcaaaactcatattgtataaaaactgcaaataggtaaacagcacagaaaaaaaaacttgtatgtgtaaagctagtacatgcacgtttgtccaaatattagttgataggaaccattaaggtttacgtgtaccctcaatcattgtatttttactaaagattggccatgctttaggaacaaggtagcaaacatgcaagctcaacctttaacgaataagaaaacttacaaaagaactttgttggtgtttctctagtaccttggcactatcacattttgggtctttttatatgggtagatgtctggtgcattgtagcatagttagcagcattcttggcctctaccagttagatgccaatagtaatcctcggttgtgacaaccaaaatatctgcaaatgtcaaatgtcccttggtgggcaaaatcactaccagttgaaaatgagtgcaacaaagagagcacaactcaaacttcagcaggctgcccagagtcccataatacttagctgtgtagcagactgctcgctgttattctctaacttttccaattttgaaaacaaacctatcacccagaaactacactctacctggcaaccaaagtcaggtaaattaacacagcaatttatgtgctaagttgccttcacatctatcccagatgcacaggtaacaacttactatttcaggcttactgaatcttcagtaagacttctcatacaatctggatatgtacggataactgtgatactctgggtagtcttatagcagtcttatagcataatcccacatcatctccatttatgcctcctatttatttgagaacctattcctaaattattgctatactagtgacaacagtcaaagtcaggtccttctgactaccgtcctggatctgctggatagttcacatcatctcccacgatggtgagaaaaagaaaacatccggctgggcacagtggctcacgcctgtaatcccagcactttgggaggctgaggcaggcggatcacttgaggccacgagttcgagaccagcctggccaacatggtgaaaccccatctctcctaaaaaaataaaaaatacaaaaattagccaggcatggtggcgcatgcctataatcccagccactcgggaggctgaggcaggagaattgctggaatccaggaagcagaggttgcagtgagctgagattgcaccactgcactccagcctgggtgacacagagagactgtttcaaaaaaaaaagaaaaagaagaaaaaaaagaaagaaaacataccacatgtatcaccaccacagagaatgagcaccaaaagtgacaatttctattggatcagttaacttcataatgtaaaaacatcagtaaagtggcagtgtcaaaataatgaaatgtggcagatatctatgaatgagcaaaatagtaaaatatatataactaccaagaagcgttggaataaaagaaatgggtaataatagtggttggtccagtcagcaaaagtaaaagtatttaagtaaagcttttaaattaaaataactgttgctgcaaccatattacataatgaatgtagaagaaggtggaaaagcttggaactgtttcgcctccttgcctgtttctttgtcaccagaattccttttctcttcatcttttctggatcagtggtcacagatcccagaactcatatacaagtcatatttcaaatgagagattcattgttgcatatatcaaaagtgaaagcacatcaaaatcagatactttgttacacaaaaatgtgatacttaacctttatcttactctgtagaggtagaaggaaaaaagtacctaatcagcttatatctccacctatcctggtacctttgatatatttacaaaaatatcaacacaatttactgagtaggagtttctagcaaacacatctattctcttaaacagtgatcattaaatctaagcggtgataataggttaacttggggaatcagaccttaatgccaaataattagaaacagaaatgactgtatatttttactaccgactaatgcaagaatttcacatattatggtcttagaactcgactatgctctttttctaaatgagcacaatcaaaagttaattcttccttaggaaacaggggacagtgtgaagactaagaatagaaagaagggagaggaattgtggagagtgtttctagaaaagaaaaacggaaagaaaaagaataactggattcaggttaaaagcaagagataattacccaaaaattcacagtgggccttctgtagatgaagagttacaatcttgtggggtgaggggcaacttaagagcaaagtgcttaaaggaggtcaaagtgtttaaaatgaatgctttactaattaccacatttcttggtttgtggaacacagaatggtttttggtatttaggctatctcagggcatcttaggaatacattaatcttcatccttaaaatatgattgatcaaggcatggaaaagcttgtaacttaaaataactaaaagtaggccagctgtttttgagtttacttagataacagaataattatacaagataaagttgagaggtagtcaaaaaccgattatttagaccacaatgacaaagacagtttaaatataaagggaagtcattaaagattttaagttgaagagtgttatattctagcttacatgttaagaccattcttccatgatactataagaaaagaaaatcacaggccaataaccctgatgaacataaatacaaaagtcctcaacagaatactagcaaacaaactcaatagcacttgaaaggatcattcatcataatcaggtaggatttatccctgggatgcatggataattcaacatacacaaattaataaatgtgatgcatcacattaatagaacggacaaaaaccatatgatcatctcaatagatacagaaaaaacatttgaaaaaattctacatccttttatgataaaaactcacaagttaggcatagaaggaatttatctcaacacaatactggccatatatgaaaaccccacagctaacaccatatccaatggtgaaaagtggaaagcttttcctttaaggttaggaacaagacaaaggtgcccactctcacagcttgttttcaacacagtactgcaagtactagccagagcaattaggcaagaaaaagaaataaaagacatccaaataggaaataaagaagtaaaattgtctgtttgctgatgacatgagcttatatatagaaaaccctaagaactatactatcaaactattagaactgataaacaaatacagtaaagttgcaaggtacaaaatcaagaagcaaaaatccatagcatttccttacactagcagtgacctatctgaaaaacaaatcaggaaatcaacctcatttaaaatagcatcaaacaaataaaatacgttaagaaatgtgatcaaggaggcagaagatctatatgcagaaaactatgaaacaatgaaataagttgtaaatgatacaaagaaaaagatatcttgtgtccacggattggaaaaattaataatgttaaaatgcccatactacccaaagtgatctatagagtctatgcaatccctagcaaaattccaatgtcttttcacagaaacagaaatacaatcctaaaactcatagagaaccacaaaagatctttaattcaatagtcaaagtaatctcgagcaataagaacaaggctggaggaatcattatctgacttcaaatctagtacaaagctatagtaatcaaaacaatatggtactggcataaaaacggacacaatgactgaaagaacagaatagagaggccagaaataaactcatatatatggtcaattgatttttgacaaaggtatcatgagcacacaatagagaaagaataatctcttcaataaattggaaaactgaatatccacaagcaaaagaataaaactggacccttttctaaccccatatgaaaaaatcaactcaaatggattaaagaattaaacatgtgacttgaaactgtaaaactacaagaaaaacaaacataggaaaatgcttcatgacattgcgctaggccaagatttcttttgccaaaagtacaggcaacaaaagcaaaaatagaaaaatgggattgcatcaaactaaaagtcttctgcacagcaaagaaagcaactaatagagggaaaagacaatccatggactgagatataatatttgcaaactatatatctgataagaagacaatattcaaaatacatgaagaattcaaataactcaatagcaagaaaatacatcaaaaacaaggaaaagacctaaacagacacttaataaaagacatacaaatgagtaacagataaacaaatattcatcatcactaatcatcagagaaatacaaattaaaatcacaatgaaatatcacttagcacctgttactatggctattatctaaaagacaaaagctaagccaggcacaatggctcaagcctgtaatcccagcactttgggaggccaaggccagtggaccacttgaggtcaggagttcaagagcagcctggccagcatggtgaaaccccatctctacttaaaaaaaaaaaaaaaaaaaaaaaagccacgcgtggtagtgcgtgcctgtaatttaagttactcgggaggctgaagtgggagaatcacttgagcccagaggtggagatcacagtgagccaagatgtactccagcctgggcaacagagcgaaaccctgtctcaaaacaaaaaagaaggcaaaagataacaaatgttggcaaggaaggatgcagagagaaagaaacctttgcgcactgttgaggaaatgcaaattaacacagtgtttcttttttatttttttgaattttttcttctttattggcatattagtgataactattagttttgttacatgctctaaaatttatatttattttgaaattttcctagtctacttagaagtgatataagttctcacatagcacaataaaaatataacagtatacttcctttctccccttttggcctttatatgttattatgcattctgtttttcatatggtttctgggtttttttgttttttgttttttgatttctggttttttttttaagggagtctcactctgtcgcccaggctagagtgcagtggtgcgatctcagttcatcgcaacctccgcctcccaggtccaagccattctcctgcctcagcctcctgagtagctgggattacaagcgtctgctagcacacctggctattttttgtatttttagtagagatggggtttcaccatgttggccaggctggtctcaaactccccacatcaggtgatccacccgcctcggcctcccaaagtgttaggattacaggcgcaagccaccaagcccagtcttttcatatgttattaaccccacattatgtttttatcatttttgtttaaatggtcaattatcttccaaaaatacttaagtcacaagaaaaacattctcctatattttgccttgtagacaccattcccagcattttgtttgtttgtttctttgtgttgattcatatttctccctggaatcattttccttcttcctgaaggactcctttaacatttcttgggtcttttagagatcaattactttgtgtttctgaaaaagtttagtttgcctccaatttggaaagatatttgctttggaaagataaaattctgagttgatatttactttttaaattattttaaaggtcttactccattgtcttttgcttgcattgctgcttatgagaaacctgctttaacacagcaattttgaaaaacagtatggaggttcctcagaaaatttaaaatagaattaccatgtgatccggcaatcctacctctaggtatatttccaaaaggaattgaaaactgtatgtcaaagatatctgtactcccaaactcactgcagaattattcacaatagctaagatgtggaagcaacctaggtgtctgtcatcggatgaatggataaagaaaatgtggtacatatacacaacagagtactatttagccttttaaaagggaggaaattctgtcatttgtaataacaggaatgaacccgtaagacattatgctaagtgaaataagccagacaaagaaagataaatacagcatgatctcacttacatgtggaatctaaaaaagttgaactcatagaagaagagagtagaataggggtttccagaggctgggggttggggtagatgaggtaaaggaagatgttcacagggtataaagtttcagttcgacaagtggaatttgagtgatctattgcacagaaggatggctacaataaataataatgcattgtatattttaaaatcaaataaaatgtagattttaaatgttttcaccacaaaaaataagtatttgaggtgatggatttggtaattagcctgatttagttattccacattgtaaacatatatcagcacatcacattgtagccccataaatatatacaattattattatcaattaataacatttaatatgtttctaaagattattcttccttttacagtggaaagaagttagacgggtacaagagtgaaactaatgaaactggttaggaggtcattccaatagcccaggaaagatggtgacttggattagggcaaggaaaaatggatgtatgtcaagatgtattcaggagatagaaatggctggattgtctgagactggatatggaagacagtgcaaaaggaatcaaagataactttcatgttcctgtcttgagcaactgacagattctggtactatttacaactatttagtatcttctgtattgtttatttgttagtttgttccaatgcttggccacatttcacaagatgtttcttgctattactggctctctatcacctttcacaattttacagttctgtttatattctaattatatgggccttcctatgatctccttacaatgaataatacagtattttagatagcttatctcctacttttccactttctctacattgcatttaccccaaggtgtctctgcttaatggaaatattttatactaattgagattaaaaattaaaaggcattattttaaaaaatgtttaagaatttaaaacattaaataaaatttgtagaatagatgagttgttagtgaatgttgtggttcagagcagttttgtcgtttgggcttgagtttgggtttccttgtttattttggtcattcccaaattaaaggaaacatgaaaacagaatgttaatgatatggttaggttttgtgtcccacccaaatctcatcttgaattgtaatccccatgtgtcaaaggtgggaggcaattggatcatgggggcggtttcccctacactgttctcgtaacagcgagtgagttctcatgagatctgttggtttataaagcagttttccctgctcttgttcactctcctctctccttccaccacgtgaagaaggtgcttgcttcctattccccttccaccatgattgtaagtttcctgaggcctcccgagccatgcagaactaactgtgagtcaattaaatctctttcctttataaattacccagtctcaggtagtatctttatagcaacgtgagaacagactaagatagttaggaagaacctgagataaatctagatatgtgagataacttctagaaaagaagccatgatttggaaacccaggaacaactgctatagcaaatagccaaaagagaaacctaaacagatcagtttttttcctgcctattttcaaaaaagaattgtaagaaaactgtaagaaatgttgttttcaaaaaatttttacaaacagaacagaggctatagagatggcagacaagcacatgaaacgatgttcaacatcattagtcattagggaaaatcaaataaaaaccacaataagacatcacaacataccttttattttacatcaaatgctggtgagggagcaaagaaaatggactactcatatattgctggtgggaatgtaaaatggtacagccgctctgaaaaaaacagtttggcagtatcatataaaactaaacatggaactaccctacaacacaacaattgcactcttgggcatgtaacccagagaaatgagaacttatgttcacagaaaaacctatgcaagaatgttcataaaagttttatctataatagccctaaagtggaaacaacccagctgctcttcaacatgtgagaggtaaaacaaaccgtggtatgtcatactgtggaacacttctcaacaacaaaaaggaacgagctcttcgtacatgcgacaatctagatacatctctacagaaagatgctgggtgaaaaaaccaaaccccataatgttttcatgtttcagttcatataacattcttgaaatggcaaaattatagagaataaattagtggtttcctgaagttaagaatgaagagcagagagcatggttataaaggtagcaacaggcatgcttgtgcagatggaagtgctctgtgtcttgactgtggtggtgatggctgcatcaacttacacgtgataaagtttaactgaactgaatgcctacatatacaatacacataatgcagaagtggtgaaatctacagaagatgactgaattgtatcaatgtgtcaattttcccatagtgatattgtactataattttgcaagatattatcagcggtgaaaacttgttgaagggcacatgagatctctctatattacttaaaactgcatatgattctgtaagtatttcaaaacaagatgtttaactgaaaatagtagaacagcagctgtcacactaactacgtgaaagatcctgatattattttgtgcagcattctttcatggaaatcttgctaatgatactaaaattgttctaggaaatataataattttgtttattagtagtatgtgttttaaacaaacaaggacaaaagtttttaaaataagctaaagaacagaacacaatatagctgccacttactgaggccatattagaaagcatacaacaggctgggcatggtggctcacacctgtaatcgcagcactttgggagactgaggtgggcagatcacctgaagtcaggagttcgagaccagcctggccaacatggtgaaaccttgtctctactaaaactaaaaattagctgggcatggtggcacacacctgtaatcccagctacttgggaggctgaggcagaagaatcgcttgaacctgggagacagaggttgcagtgagctgagatcatgccattgcactccagcctgggcaacagagtgagactgtctcaaaaaaaaaaaaaaaggcacacaaaagatgtctaatacatggcagctatccatgatgatagtactcttccccacatactatgccaaatgttttattataacatgattaacctacagcaaccagaatgtctcatgaaaaatgagctcaaagatgcaaagtaattatataagttacataattattttcctgtggtcttcaaagtaagaacttagatatataagagttagtatgtttgtgatatacaattataatataactgtggcacctgaatcagaaactagatccatatggcaataaattccacattattttttttataccacaaagccactgctgtgcatttaggatggcaaaagtgaagcataaaggatgaaatacgaaatgtaaaaaccgcaaacatcaactttaataatgacaataatgcagatggcttttccaatgcaatacatggtaggagccatagagatgttcacatctactaatccagtaacccattcatagagctaggttaaagccctacagaaagaaaaatggagaaaagattaaagagatcttttaaatattaaagtccattttgttgactttagcatgctggaacaaacacagtttgctttctctatgcaacacaatccaatcagaaggtcccatgggctaacttgaacagagaaagtaatttgtgaaagtaatttgaacttgagagcagatccagagactaggaagccacctgccgggactaagaaatgacatcactaaaaagggcccaatggaagactagctggacctgctcactcctgagtgttggggacacatccacagggaggtgacagccttgaaactcactgctaagccccctgaagggtactagcgaaagcaggtggagggaggtgtccccacatgatagtaatcttctgcgtaaccatctaagaggatgctgggaaactgaccaagggaagagaccacagagtacttcagaaaaaacactgtgcttcaggcacctgacaagacaaggacattggaaagtgacgagtagccctttcatccagcagcctccctctaagccctctactgacacagttcaacatcaaactcatggcaaaggagaaatgctctaaaggtccagctccattatcagagcagataataaaggcaggatgcagagctgaaaggcaatatactgataactccattaacaaaatatactgcttcccactccaacagtcaaggtttatttactccattgatcatttccaaactgtgtcaacatcctagaagtctagagcagtcatttatttccccgcctcctctcattttctactcactctctcctagtcatcctcacgcttgatgcagtatctgtacatacaacaggcattccataagtgcctgtgcaattgaattaaaatacattacagcctaaagtgtttcaaaggctcagaccatttcatactttaaaaaatactttttaccttaacacacgagaatacagaaagccctgtgggacattgagtttttaggtatttcctaatatattacaattccagcctgagagacaggataaagtaaatttgtttataaaatgcacttttgtacttgtgtacatcaaaagggctactgctccatctgtgcaccctttttcagcaaagaactgaaataatttgtaaaaggactaaaatgaaaaaatatccctactatttttaatcctaaatttttactttcaaaatacattgtacagacccaagggaaatcctctgggtctctgagaatgcataaaatgtatcttataaattaaatccaaaatacatcaaagaataatataacacctctgtgacctccacctaaaattgccagttgctatcattcagtgctttgtcatgcagtaaaactagagaagtttttaggccctagagtcctctctaatgcccccaacccactcccacaccccttaccagtagtatatactattctagctttacccttatggcttagctgtggttgttttgtttacttttatatggcatgtatttgcatcaatgagcaatatgtaatattgtgtgatgtgttatttttaattttttagaaaggtgttccaaaacatgcttattatatcattcaacactatgttttcaagggctttccatttagaaatacaaatctagttcactagattcatttgatttctgtacagagctaatgaatgtgtcaaaattatctcatctcccaataatagatgtaaggtgacttacatgttttcatgattttttaaaaagctgcaattatcatttataggcctccttatggaaatataaaacattttttcaatagtacatatagtcatgatcacataatgacattttagtcagcaacagattgcatatatgaaagtagacccaaaagattataatggagctgaaaaattcctatcacccagtgatgtcacagccattgcaatgtcatggcacataatgtcatgtgctacttatgtgtttgtggtgatactggtataaacaaatctactgtgctaccagtcatataaaagtataacacattcaattatgtacagcacataatacttgataatgacaataaatgaccatgttattggtttatgtatttactatactatatatttatcattagagtgtactttctagttttttaaaaagttaaatgtaaaacagcctcaggcaggtccttttagcaggtattccagaaggcattgttatcatagcagatgacagctccatgagtgctactgtccctgaagaccttctagtgggatagatgtgaggtggaagaaagtaatattggcaaccctgaccctatatagacatgagctaatgggtgcgtttgtgtcttagttattaacaacaaagtttaaaacataaaaaaattaaaaatagacaaaagcttatagcataaagatgtaaagaaaaaaatattttctacagcttacaatgtgtttgttttaagctgtgttattatgaaagagttttaaaaaatttaaagtttatagagtaaaaatgttacagtaagctaaggttaatttattcctgaagaaaggaaactgttttaataaatttagtacagcctaagtgtacagcgtttagaaagtctaatgtcatgtacagtcatgtcctaggccttcacattcattcagcagtcattcactgacttacccagagcaacttccaggaaagtactgtaagctccattcacagtcagtgccctagacaggtgtgccatttttatcttttcttctgtatttttagtgtactttttctctatttagacatgtttagataaacaaatacttaccattgtgttacaatcacctacagtattcagtacagtaacatgccgtataagtttgtagcctagaagcaacaggacggatatatcataatatgttatgtagtaggatataccatctagatttgtgtaagtacactctatgacatctgcacaaagacgaaatcacctaatgatccatttctcataacacatacacattgttaagcaatgcatggctgtaccaaaataatcactgggtcataggatatgcacactattcatatttctacataataccgaattgctatccataatgactgtaccaggttataccaagttaagttttatattttgagcagcaagccaaattagacacattggcctctatttgtattaaaagggtatgcacaggacttgattttgaatttgaataggactactgtggtagaaggcgattagtctaccagtagaagtgatggctgactgtcaaatgctctggatcaaaggatatcagctggaaaatagactctggatagagactggccatcctcttaatttcttctcctatctgtccccagtaatcaatccttggcaattaatctattcaaaacctgtccccactgtcctaacttatgactgaaatgtgcagaattctctgagatcacagtcctatttttagccaatgtacctttaggtctcttgacgaatggtactaatattattagctattggcatcactcaatataatatccctcccagcatattttacttactcattcattcattcataggcacttatttaatgggcactgactgtagccataagtacagtaaaaaccagacatggtttcaaccctcaagcagaccacagactagaactattgtataacaatatggtagccaccagccatgtgtagtattgagcatctgaaatgcagatcataccaacttagatgtgcggtaagtgtaaaacaatagattttgaagacttagtacaaaaagaatataaaatatatcattaataattttatattagttatttgctaaaatgataatattctgaatatggtaggttagaaaataagacagtatgaatttatccttttacttttttaacatggctacagcaagatttaattttacgtatgtggttcacctaatattttataaatgtaaaatatatttctggtcaagaagataggagagacaagtagaatcatacagtgagatgattcctaaggtgggtaagtacaaagctctataggggcatgcagaaaggacaaagccaattcagctataagcacgaaagaaagcaaaccacagaaactgagaccgtaagtaatcaaaatggtaagaagttttattattacttaaaaagcttgagttaactaagtgagaaaagatgaagggaatgaaattattccgggcagaggcccagaggcaaaagagagcaaaaactagctagattagtcaaaactaggcttgattagtttgctcttgtaaccttgggcgaataataacaataatcattgtttctgtattatttcttcccttaaaaaagcaactttagacaactgaacaaaaaacatcaaataagcagaaagtaatttttgaccatttatctacataatactgtcgtatatgataagaatcaccgaatctaaaggataagcagctttagaataacacccattgtgcatgtaaacttacaccacaaaagatgaagctgaggaattattttaacctccagggcttttgcacaggtcttgactcaaatctatggagaataatagaatcttcacgttttagcagttcaaaaatgcattatgttatagctagcttttctctgttttagaggccataggctttttgtctttttactctatgctttttaaattgtgaaacaaaaagaatgcaaaattaaaattttgattaactcatctggtgaatgaaagagtaagttatataaagataagaatgccttttatttatatactctattcctatctcaaacatcaagcatcactgaaaaacactcataaataaaatcaagaaaaaagtggaaaaggggatgtattgaggtttgttgttagataactgtttttaacaagacttaaaaaacaatttcaacagctggaaattacatttggctcatgttaaagaaatgttgctgctgctgcttgcaaatatgatgaatggagaacatcttgcaaatatattggataaaaataaatatttcattatgctaaatgggttttattgttctgtttgtaaatttgaaacaactgtaagcactgcatggcagcacatgctgttggtcatttttactgaattgcaggtagtgacttttgttttgttttttctttcccatcccaactctttttttgcctgtagtgcctttgaaaataacttttggtatttgatgatagaaactaaaatagttatctcctcccccattgaagtacagaactatgcacttttaaaaattatatctttgatctttgaaatgtaaaaagcaatgctaagttggtaacactaagtagaattcaataataaaaggaaatcagtgattccagaaaaatggcaggcaagtaaaacctaggcctattatttttaaaagatgcatccaagcttgccttaataattcataaaatatacaacctcataaatgcacaaagaagtacaacatagcccagagaaataaactgagatggaaatattgatctccacaatatttttaataaatgcaataccaagttatgccctccaagcaaataatcctcacagcacactcatgccctacttgttcatagttacctcatctgggaattcaaaccatagacagtgaaatctagtcctcgaggaaaacaacaatgggaagaaatatcaccagacaatgaaaggaaggaaggaagaagtcaagaaaccaaatcttaaacgttactctgaagaaggctttgttagctggaacacatttactgaaagatgtaaaggaaagaaaaaccttgttttaagacagtgttgagaagaaacctgcccttactacaacccaaaacaacagaagaatttctaaaaagaaatggaattcccatcttaaataaagctaggcaaaaatctatcataccactcacaatgtatatgaaagaatagtgaaacccaagcaagggtgagggaagatggcagaggagggctctgccacagactcactcaaactccatgtgggaaacactgttattgaggtgggtggaaaacagtgatctgtgaacagactgtggcttccagggcactggcagtaagcagtcaaggttaaatactctctaatatacactcctgtgccataaaggaagaaatgctgctctctcttctcttccagccccaacataaacctgtttcagatcagaggtccagggggaattcaattcattcaaagattcagagagaggaactggcataggacctagaatagacaaagatattaaaggagagagagggaaggaggggaaaaaaatagaggtagggaagaaagggggggatgggatggagggttaagtgataggaaaaacaagaaaaacagctaagaaaatgtcaccagaaaaaaatgtttccaccaagtaaataataatcatgactaaaagatcactaaaacttgaagaacttaatgaaaaagtaaaatcactcttttttttttttttttttttttttttgagacagagtctcgctctgtggcccaggcgggagtgcagtggtgcaatctcggctcactgcaagctccgcctcccgggttcacgccattctcctgcctcagcctcccgagtagctgggactacaggcgcccgccatcacgcccggctaattttttttgtatttttagtagagacggggtttcaccgtgttagccaggatgtaaaatcactcttgaaaaagaagatataaaagagctcttgaaagatatggcaaaaccacagaatgagatgacttaggaacttgcagagctcattaaaaaaaattaaatctacacaagaagctgctcaaagtgaaaaaagcatcactgaaaaatccattaaggggcatgaaagacacaatgaataaatgagcaaaaggaaatggaaattaacaacgaattagaaagaagattaataaaaattacatgtgtctaactgctttcccaagaagaacacggaacaaattaaagacaaattttccagaactagcagaagacttaaacttatacactgagagggcacacacatgtcaggacacaccaatacagaatgataacactgaattgggtataactaaacttgctggtacttaaagaaaaaagcccaaaagtatttttagtggaaaaaaaaatcaagccaacctcagacttctccatagaaacattcaatatacttaaacaattaaaagatccctgtaaagtactcaggaaatgaaagtgtaaccaaactgctgtttaattttaaacaaaacaaacccccgaaaagtttaaaggaaaaaaatgcttatttttaaacattttaaagcccacaaaatttcatttatatagctaaaaaaaaaaaactacagaagaaaaacttcaatatataaaaaaattacttggaaatgctatgactggctggctgtcactccaaagccttgtagcagccacctctgcctcaaggtcctcctacttttcccacggtgtcccctccctccctcaccctcatatattaccatggtccttcttcctttcaacaagactttgctcaagcagcagcttttccttcaaatcttttctgattccacttttctgggcttgtgtcccttctgcatttctaataaactgaccaacttatatgctataaatattatccctaaactaacagaactctaaaatattgaaaatgggcaaaggcttgccttttaattaaaaactaaaagaaaccacgggtcatacatcactagtggaagaagcttattttcctttctcaattcaggaagataaacgacaaataaaaaataactagtgagctataattaagtgaagtatatcaaatgatgtgatataaaaacagatcttttccactgtctattgaaaatttacaaaaatagatctttttcattgtctattgaaatatacccaggccacaaagaaaactagacaaaaggtccaaatagcaaaaaataagccagagaatattctgtggtcataatgcaataaaactatgaattaattataaactagaaataacaaaaaaaccctaagagctagaaatttccttaagtcaaaagcaaaagatggggttgaagagttaaatgaactgattatttggggaaggaaaaagacaatgctatgttaacctaattaggaacatgaaaaggaatcatttaaaagatacagtgctgaacagaacaaataaaactgaaacaactgaagaaaaaaataatctgactgtagcatcccagttcttggcctaggtctaacaagagaagccaagaatttgcccactcttaacattttagggctattgtctgaaggaaacaattaagtccagcgggaattaagacagctactgaatgtactggtactcctgggactgagaggatccaccagcttcctccgctactctcctccacatttaaatgaaaaccgtcacagattgggagaccacatttgtaatacatatgtagcaaaatgcttgtaacttaaatatataagcaatggctacaaatcatcaataaaaccaccaccaacataataaaaattaagcaaatggtttgaactgatgacacttcacaaaagaaaatacacaaatagctaaacaagcacatgaaaaggaaatgaaaattgaatcaaaaccataatgatgctatttcacatccactagaatgtctaaaaattaagacaacgaaaatcagatattgagagggtgtgaagctgctgaaacttcactcattgctggtagaattgtaaaacagttcaaccacttggaacacctgctggcaggtcgtaatgttaaatatacaattactctatggtatttaccccaaataaagaaaaacatacattgacaaaaaaagatttttccagctttattgaaatgtgatcaacatacaaaaattatatatgtttaaggtgttgtattaatcaggattctctagagggacagaaatagtaggataaatatatattatatattatattaacatgcatatattatacatattatatattatatgcatattatataatatatatggattatatctatatatataaattacatatatatatatatatatatatgggattttattaactcacatgatcaaaaggtcccacaataggcagtcggcaagctgaggagcaaggaagccagtccgagtgccaaaactgaagaacttggagtccaatgttcaagggcatgcagcatgggagaaagatgtagtctggaagtctagaccagtctagtcttttcacatttttctgcctgctttatgttctagccacaatggcagctgattagatggtgcccacccagattaagggtgggtctacctttcccagcccactgacgcaaatgttaatctcctttggcaacagtctcacagacacatccaggatcaatactttgcttctttcaatccaatcaagttgacactcagtattaaccatcacgggtgtacagcatgatgttttgatataaatatacattgtgaaatgattaccacaatcaagctaattaacgtatcatctcacatagttacctttttttctcccaataagatttgtacaaggattttacagcagctttactgataaaggcaaaaactgaaaacaccaaatacaccccattaacagaaaaatagataaaaagtgtagtttattcagttaatggctactatatggaaagggacagtttaacaatttgtccccacccaaatctcatgtcaaattgtaatccccaatgttgaaggtgaggcctggtgggaggtgtttgggccatcgggacagatccctcatggcttgctgctgtcctggagacagtgagtgagttgtctcaagatctggttgttgtaaagagtagcagcttccctcccactctctttcttgctcgtactcctatcatgtgagatgcctgctccccttttgccttccaccataattttaagcttcctgaggtctcagaagtagatgctaggattatgcttcctgtacagcctacagaagtgtgagccaattaaaactcttatgaattacccagtctcaggttttttgtttgtttgtttgttttttttgagacagactctcactctgtcacccaggctggagtgcagtggagtgatttcggctccctgcaacctccgcctccagggttcaagtgattctcctgcctgagcctcccaagtagctgggattacaggtgtgtgccaccacacccagctaatttatttatatatatatatatatatatatatatatatatatatatatatatatatatatatattttttttttttagtagagacagggttttgccatgttggccaggctggtctcaaactcctgacctcagatgatcctcccgccttgacctcccggccaggtatttcgttatagcaatgcaagaatggcctaatacagaaaattggtaccaaggagtggcgcactgctataaagatacctgaaaatgaggaggtggctttgcaactgagtaacaggcagacattggaagagttttggagggctagaagacaggaagatgagggaaggtttgcaacttcttgaagactggttaaatcgtctgaccaaaatgctgttagggatatggatagtgaagtctaggctggtgaggtctcggatagaaatcaggaacttattgggaactggagcaaaggtcacccatattatgccttagcagagaacttggctgcagtgtgccctgccataggaatctgtggaagtttgaacttcagagtgataatttagagtatctggtgcataaaatttctaagcagcaaagcaaccaagatgtgccctgactgcttcaaacaacctatgctcagatgtaaagcaaacaaatgtcttaaagttgaaatttatatctaaacgaaagcagaacataaaagtttgaaaaatgtacagcccagtcatgtggcagagaatgaaaaagcctctcttcggagagaaattcaagcaggctgtggagcaaacacttggtagagagatttgcacaactaaaagggagccaagtgctattaaaatatccaaaacaacagggaaaaggcctgcaaggaattttagagacttcacagcagcccctcctgtcacagcccagaggcctaggagggaagaatggtttcttgggccaggcccaggcccagatgtcctgcacagcctcaggacactgctccctgcatcctggatgctctagctccagccttggctcaaagggccccaaatatagctcagactgctgcttcaaatggtgtaagccataagccttcacagcttccacatggtgttaagcctacaggcatgcagagtgtaagactgaagaatgcttggcagcctctacctacatttcaaagcctggctgcccaggcagaagcctgctgcagggctggagccctcacagagaacctctactagggcagggtggaggtgaaatgtggggttggggtctccacacattgtcgccactagagcactgcctagtggagctatgggaagggggccaccatcctccagatcccagaatggtagatccaccagaggttgcatcctgcacctggaaaagctgcaggcactcagcagcctataagcagctataggggttccaccctgcaaagccacaggggtggagctgcccagggccttgggatcccacttcttacactagtattccccagatgcagaacctgaaatcaaggactattttggcgttttaagatttaatgactgccctgctggtttctgagcttccatggggtctgtagtccctttcttttggctgatctctccctttcagaacaggaatattaacccaattcctatactcccattgtatcttaggagtaaataacttgtttttgatgttacaggctcataggtggaaggatcttgctttgtctcacatgagattttggacttttgaattactgcaggaataagtgagactttggaagactgttagaaagatatgaattgtattttccaatgcaaggaagacataaaatttgggagtccaggggtagaatgatatagtttggatatttgtccccactcaaatctcatgttgaaatgtaatccccaatgctggagatgggacctggtgggaagtgtttgggttatgggggtgcatccctcatggcttggtgctgtccttgagagagtgagtccgttcgctgaagatctggttgttgtgaaatgtggcacctccccccaaatctctctcttgctcctgctcttgccgtgtgagacacttgctccctcttcgatttctgccatgattataagcttcctgaggcctccccagaatcagatgccagcactatgcttcctgtacagtctgcagaaccatgagccaattaaacctcttttcttttagtcagtctcaggtatttccttatagccaagcaagaacagcctaatacatggcaattaggatggaagaagtagaagaaagcaagtaaactactgatacatgcaataacatggatgaaccgcaaaatcttattatgcaaaaggagcgtgatgcaaaatgtgcattctttatgactccatgtatatgaagtccaagaactgcaaaactcctcgattacgatggaaaccaaaactgtggttgcctatgaacggggtgggaattgatagaaatgagacttgaagggaatttctgggttgatgcaaatatcctctatcttaactgaagtggtagttgatgcatgtatacaatttataaatactcatcaaattacatacttactatgccaactcatggtatggaaattttatctcaatttcagaaacaaaacaaaaagtaacaaagactatatagatgtcagaatttccaggagtagagtgtgcatatttttagttcagagacttccctaggtaaggataatgcccatgtctagttaagaatcactacattagacttagcaccatgtttggcagctaaagtttaacattcaaacaaatgactgacactgcggtaggtagcacacgttcagacatggcagaactgggagtcaaggccatgacgtctcatgtcatatccagtgtgcttcattcccttatatattatagatcctttatatagtcaacccaagttactaagctcaaatatataatatagttcaattagacctaagacacataatccgaatgacacatcattgttatatatataacaccaaaaaagaaaagctctaccaaggaagctatgacacaatgcatatgagttgaatttttataatacctaagtactacactgtaggtaactgccctccagcttcagtcttggaggatcctaaattatggctctccttacttgaaagagcttacatatacttgttctgcagttatgcatatatgtgtacacacacacacacacacacacacacacacacatataaattgaataatttcatcaagaacattttctatgacttaatgcttgaaaatgtacaggtaagaaaatactgtttcattactagttcaatgatacggtcctgcatctactataaaataatgtcagaattctgactactcaaaatatgtaaacacattctactgtcacataagtgcagagtcctactcaggtaacgcaaatgtaatatctttcagcaatcatgagcctgccaaagtgcatctttagtacgtcaacggtcagagtggtgttctgcaaacttgcctggtgagaatcacctggggcactagttttaaaaccacaactctcaggaccctcccccgctggagatgatgcgttgttctgagtcagagccttggaatcacatgccatgtgtgaatcttattaggcaaaacaggggaacactattccagaatatgtgaactctcggaatacataattacagaaaacatttcaccaatcatgagagttgcacaaagacctttcaaattcattacaaataaaaagcagatttttatctttcctgtgcctgaaattctgttacaaatcaaaacagaggaagcctggggacagatatgcatattcagactctacttgatgattctgaggaatctacaaaagaaacctagggaaaaaaaaaaaagtcgagcaatttcacagattctgtcgataaacttgcaactaggcaccactttaaaaacaattctgctcttttcctattttaaaagcaacttgtgtacttaaaatacaaacattttattctaatcatgaaagcgaaacgtttgttcatttaacatatttaaaatctataaattcttctaagtgttacagtgttgacttgtccaatagaatgccccatggtaatggagatgttcaacatccgtgctaatacaggcacctctaaccacatgtggccactgagcacttaagaggacttaagatgactaactgcatttcaacatttatttaattttaattaatttaaatggccacatgtggcttgtggacacaggtccagaaaataaaatggttacacacacatctaaaagtttatttttgttcatgatctgggttgagagcgttttgagatccaggtgagctgaattaccaatgggatcgcatgaccagcaggcaatgcaaaattatcaaaatcaccacaactaccaacagcttaagatttttaaaaaatatagtctcttcttaatttccaagagttacttctgataatgacctcttagaactttttattagctttattctttataatgtttcgctcttttaaacaataggagaattagaatatctaaatatctaaaatattagtcccattcctaacagcaaaaacaaagggtacatttcttttccactccaacttctgggctctccttttttttttaattattaaatttgcagcatatcttttcctttcctttttttaaaatccataactcttctctcaggcttcctccctccctacttaaaactgctcttaccactcacctgtaccttttttcttttttttttgttcttttcctatacacattttacatttatccatctcttacctagctttatatactgctatccttacttttttttttttttttttttttttttttttgagacgtctgtttctgtcacccaggctggagtgcagtggcgcagtggcgtgatctcggctcactgcaacctccacctcccgagttcaagcaattcccctccctcagtctcccaagtagctgggattacaggcgcctgccaccatgcctggttaattttttgtagttttagtagagacagggtttcaccctattagccaggatggtcttgatctcctgacctcatgatccgcccacctcagcctctcaacgtgctgggattacaggtgtgagccaccacgcctagcactatccttacttttcatttcccctccttcccctttttttcctgtgccagaaaatctaaagcttatttgctcatttaatgagcctattattacaaaaagtcttttcaaaggggtttaatcaatctcagagcctccttttttccttctgcttgaataagaagacttgggtgtaaaggttgaggaggagcactcaccactcacaacactcataacaccagccccttcattgataggagaggtatggtgatgaggatgaggatgaagatgaggatgagaactatgtaaggatgaggatgagaactatgtaaggatattaactcctctccttctttgttcacctgtataagaaatgaaaggttatcaactggcgttaatgatcaaaagaaaatgcaacaaagaaaagatggccaactttgttttgaaaagtccctgcacccaagaaggtatttatccaaattagacacaaaaatccatcaacaactggaagataatacaagacaaaagcaaaaccaaagatcccatttcacagcatcaactattcacacttgtggaaattctgaaaagggaaagatacgcgtagcttggagtcatcaagatggatttgacaggaaaggaagaaaatatgctggactttgatggaaaggtagactatagatcaaaaagaggacagatttataaactgaggagagggcaggcagagcagaggcaagaatgagtatgacccaaaacacagaaagggcattcaggacagcagcctaaaggttaatgttggtaaacagaaaaagatgtggttatgaaagggtcatcttgaggaataaactgaatataagaacagaaatgtaagtgggatgaattaaacactgtctttactacaaagatatggtgagaggaagggcaatctctcagaatgagagatctgagattccgagaaattgcccttcctaaccacaacaggagggaaaatgtaatcagaaaaaaatcactgaagacacttataatttcttttttttttttttttttttttttttttgagatagagtcttgctctgtcacccaggctggagtgcaatggcgcaatcttggctcactgcaacctccgcctcccggattcaagcaattctcatgcctcagcctcctgagtagctgggattacaggcatgcaccaccacaccaccacacccgactaatttttgtaattttagtagagacggggtttcaccatattggtcaggctggtcttgaactcctgaccccaggtgatccacctgcctcagcctcccaaagtgctgggataacaggcatgagccaccaagactggcctgaagacacttatcatagtcagtaagtaagtggcagcaatggagatacacagttaaaagtcaattaaagagacatttaaggaataaaaatcgataaagtttgaagatatatttaaaaggcgagaaggaaaaaaaggaagcatcaaggatgacttaatgtttccatcctgaaaagcagaatgaaggattggtggcacacgtgatcacaacatctaaaacacataaaaattccatctgttttcacatctttcttgggcagctggcttgattcatgcataccaaatgaggccctccagcatttttcaatacaataagcttaagaatattatggtaatattaagtgcaaccacataaaacaaacactaggaatattttttcaattatttccttatttatggattaaaatgacgtatctcacatttgcttgcaaatactccagtagaaaagggtaatatcaagcaaaattggccatgagttagcaaatgttgaagatggaggctcattaaactattctctccatttaaaaacaaaaacgtgctcactgcttttatgtattcacacagatttaaccattcactgagcactcccttctaaggaaaaagattgtgaactctgacaatgaaatctgtaactaatttttactaaaaaaaaaggtaagtctaacacactataccatcattaaacataactacaaaaaacatatttaaaaacaaactgaaaaaccctacctcattctaccctgcccttccataagcctgtgtgctttacatgatgtcaagaataaacataaaaaaatgattcaaatgctatgttttttaaaaggtattcatagaataatatcaagacataccaaagcaaacgatgttgtagtcaagcagtacataaaatgcacagtactttgggtaaaatatatttatgaaagtttacaccttgggcaagctgtaaatattctctaaatattaactgatattttaacatttattagtggatattaactaactgaataaatattaaccgatgttttaaatattaactaaatattttaccgttggtcattgcatcctaataaaaatgtgacatataactgactgcacgaacatcaaatattattaatcttaaactgtagttcatcttaaactttagttaagactcagtaaattatctttaataaagtgtaaatggttaactgagtccctgagataatctaaaacataagagacccttaagacatttgttttcctggaactgttttgggatgcagagcatacgtttaagctcttagggatgctgaatgtgttgaatcccaagcgcaaaccactgctgcaaatttaagcactaagatccaaatcaaagcctgaaaaaatgttttgtcacattacaaacaacaatataactagataaaagtttacagtctgttttccctagtaagatgtgtgtgtgtgtgtgtgtgtgtgtgttttgtttgtttgtttttgagatggagtttcactctttttgcccaggctggagtgcaatggcacaatctcagctcactgcaactgagtagctgggattacagtcgcgcgccaccacacctggctaattttttttttttaagtagagacagggtttcaccacgctggccaggctggtgaaaactcccaacctcaggtgatccacccacctcagcctcccaaagtgttgggattacaggtgtgagccactgcgcccggcccctagtaagtttttttttttttaaagttttgtgaaacactaacagtgtttgaaagagggcattttccaaaacaaattactatattatatgttgtaatcattaacttttcatatgataaaaggagatgaatcactaatgacttaatagaaagtttaattgagcagatacgtataaattaggggttaagcccactctgccactggctgtgttaccttgagcacatgtgacttgctatgtgatcttgagcaaatcattaatctcaacttcctcatctgttacatgaagataataagagcacctgcttctcagggtaagagttaaatgagtcaatctatgaaaaggtctcagcacagtgactgacacatagtaaacatgataaattgttaactatcattgtcactgccaccatcaacaccatcatcatcattaaacatctgaaatgctactatatctacaatatgaatccattttagtaaataagatcacatgcctatgcacacaaaactagaaagaaatggtccaaggtgttagcagaggatatttctggataatataattatagacattattattatttcccctgggtgcttcttttttattgttttgtcgaagttcttaactgcatttgcaattttgataaaattgtttttaaatttgtgtttttctttcggttttgctcttaagaaagaacaaacgtaatactgaatcaagttaaggaaataatctaattatagtccttaaacataagaaggaggataagttcatgggaccataggtatatgacatttatgaaattccttaagatgctgaaaagatagaaactgtacattgttcttaataataacaattctaataatggctaccatttatcaagtaattacaaccttccagtttagatattattttatcctcacagtaatctaataagatatttttgttgtttctatttataacttaagaaaacagagactccatagtaaaaaactggtaggcatgtgcacacacacacacacacacacacacacacacacattctctctctctctttcacttaaattttcaatggggatgtggtgctattctctaaatgtctaaaaggtttcattataaaaactctcataccacttaacttcttttttaagtgttaactttttaaatatttatttccattataaactcaaattttataccaagctatacaccaatgtgtacaaatcccactaggattgcagcagtgataactacatcttctttataataacacttaaaaacataataaaatcttttgatcccagaataacagtcttgttcaaatgattaaaaatcacatatcaggcaaggcgcagtggctcacgcctgtaatcccagcactttgggaggctgaggcaggcagatcacctgaggtcgggagttcacaaccagcctgaccaatatggagaaaccccatctctactaaaaatacaaaattagccgggcgtggtggcacatgcctgtaatcccagctactcggaaggctgaggcaggagaattgcttgaacctgggaggcggaggttgcaccattgcactccagcctgggcaacaagagcaaaactccgtctcaaaaacaaaacaaaacaaaacaaaaacaaacaaacaaaaaaatgacatatcaaggacattcggcattaacacgcttccaggatgccaagagtggccccttcagaaggatgatggagagacaactgtccacagtctgttgaagcataaagtgtgggtggaaagccacccaggcgccaaggcaagagacagaggacatgagctgttccagtataataaaatataaaacaagaatagttataccagatatagatcttagatatgattatatatgcatatcattaatcattagtttgtagcaattactttttattccaatattataataatccttgctctataatcatagccaaggaaccaggccatacagagataggagctgaggggacatagtaaggtgtgaccagaagacaagagtgcgagccttctgttatgcccggacagggccaccagagggctccttggtctagcggtgacgccagcgtctgggaagacgcccgttgccaggcggactgtggtctagcagtagcgaaaagtgtcaaggaacaacacccgctacttagcagaccaggaaagggagtctccctttccccaggggagttcagagaagattctgctcctctacctcttgtggagggcctgacgtcagtcaggtttgcccgcagttatctggaggcctaaccgtctccctgtgatgctgtgcttcagtggtcacactcctagtccgccttcatgttccatcctgtacacctggctctgccttccagatagcagtagtaaattagtgaaagtactaatagtccctgatatgcagaaataatagcataagctgtctttctctctgtctcctctccctctctgcctcggctgccaggcagggaagggccccctgtccagtggacacctgacccacgtgaccttacctatcactggagatgactcacactctttaccctgccccttttgccttgtatccaataaataacagtgcagccagacattcggggccactaccggtctccgtgcattggtggtagtggtcccctgggcccagctgccttttcttttatctctgtcttgtgtctctatttctacactctctcgtcgccgcacacagggagagacccaccgaccctgtggggctggtccctacataaagcatgtttcattatatcctattttggccaaaagacatgcctcattagcatgacattccaattgcagaatattttactccaattgtcaaaggggaaatgatcataattttatctatataaaaaatcatttaaaagttttaagccaagaataattgttcaaacctcatataattgaaaaaaaattctagttgtgctgcattttttattcctgatttcaggcctgccacagtggctcacacctgtaacgccagcaatgggaggctgaagcaggaggatcacttgaagacaggaggtggagaccaacctgggccacaaagcaagactccatcgctacaaaaattaaaatttaaaaattagccacacatattggtgcacaccagttgtaggtcctagctacttgggaggctacagcgtgaggatcacttgagcctaggagttcaaagccatgctgaaccatgatcacaccactgccctccagcctgagcaagagcatgacctggtctctgaaataaataaatacacatatacataaatatcccataaaagttactagcagagtaatgtgtaattccctaatgttaaataacagaacaattcaatttggccacctctcacttttatcactctatacaggcaacataaggaaagtggctaacaaatagcaaaattagaggcataatggaattctgtatatttactttggattgattccatttccaatgtatatattaaaattctcacttctttaaaaatgatctttccctccaaacagtcgtctggcttacagtgatatcagttcatgaactaaacaaaataaaggagctatgggctcattccatccaaactggttaaaatatgtcattgggccattttaaaacttccttgtaatcaaagggtcgttactgacttgcctactacgtagggaagaaataatctaaggaatagcaaaggagggattagcaagaatcctcgctatttacatgcactggaacagatcagcggagggtgcagcagagcagtaaggaggcctggcagccagaggagctccatttgtatgtttcctgtcctggaaactcccagaggatttcttatctatgatttcacttgaggaaaagaattttgctggtaaaacaaaattaaagcactgtaaaatgtttttgaatatatgcaaacatgtttatatatgtattatattaatatacacatatgtatttgcatatctaatccccaaaacacacatgtgaaatgaagctggacagagctccaataaacacactagaaggaacaagccttacctgccagggtctgaattaggctagagatatttccattttaactccagcacttcattaaaaaacattaaacagtctctgtacagcatcagtcagtgtctcttactcttgtcaaactgttagttacagggaattggaaggataaaataaacaacccttcccaatcctattcatcaagcttgaataataaaatgtcattattgaatcatcattattctgaaccaaatgtgatataaccataaaacacaacatggaaggagtaaaaatgcacatttttttcctaaacttgttaaggatgaccattaaactccactttcctctgacaagcgtgatttagatggcagccaaaaatgcatgaaaataaattgtctattctatctcttccttctcttcatgctgtctttatttatggtggtcgtaactctgcaacccataaagagtggtagtgaatactgtgcaaaggcagcaaagtcaacattaactaataaaggcaggttttatcagaggataacaaagttactagcaaaccttaggttactgagaaaaataacacataaatctactgtaagacttcaaatatgaatgtgtgtgctgactactaaatttacctattatatatttttaaatagatgattgaatgagcaaagataatatgtataattcattttaaatgtcattaattagatgtccaaatcattacgtttaatatatgtctatttagaaggagatacactgagtgatttttagaggcaaggctatcaagctgacttttgaaaactacgcagataatcaaaactaatttagtcttaaaaaaaattaaacttaaatgattctttctgcatattgaattatcaatatattccaaaaattatgtatcatggatcattcaattccttataaaattattttctctcgatgaatatttctttcaaaaattttctgctaaaataaagttatattttaaatgatttgtatgctatagctgaacattatataaaacctaaaaaaagttaccaaaaacattgaagatttttcctaaataagaacattgccttttgtgtggttcattatttctatgggaacaaatagtgttaattttcaaattaggatctctttacccccatacaaaaatcaatcacatttctatctaccaataatgaacatgtggaaaaaaaattttaaaaacaatgtcatttatgatcactttaaagaaaaagaatacttaggcaaaaacattaaaatatatgtactatattttttaaatatcattttatggtatttaaaataccatcgttcatcagcattttggtaatttttaccatatattatttaaaatactattttaaacaccattttttaaaaatatatggtaaaaattaccaaaatgctgagtcatgttagatacaaattttaatagtaatatttatatactgtttacacagagcttatctaaacattgaaaattacacattaaaaactcggtacttttaaaaatatatggtaaaagctaccaaaatgctgatgaaagaaatcaaaaaagacctaaaaaacagtaatttttcagcaacgcctagtttttaatgttcaagtaaactttgtaaaaacagtatataaatattactattaaaatttacatctaacatgactattctcttgagcagccatattcagtggcatgaagcctggtgtaacaaatgtcccacgtataaattgaattgttcagtacttcacacttccggtattgctaagacttccattttcttcattacaaattgatactacttcttagtcaaataaattttgtctaagccaaaggtaaaccataggaacaacattaggcaatttctaaagtctgttattttcctgaagaaacattttggatagctaacaagttcctagttatcttccctttgtattaattatgcaacaaaaagtcacttattggtgaatctaacagttttatgtatatatacatatattttttgagacagagtctctatcgcccaagctggagtgcagtggtacagtaatggctcactgcagcctcaacctcctgggttcaagtgatcctcccacctcagcctcccgagtagctgacactgcaggaacagaacaccatgctcagttcatttttaaaattttttttgcagagatgggatctcgccatgttacctaggctggtcttgaactcctgggctcaactgatccatctggcctcccaaaatgctgagattataactgtgaaccaccatgcctagactaaaagttatattattaataaaaggttatgtatttcccaactacaagagtgatgtttttgaaaaccatagtagtaaaagtatcttcagttaaagaaaacaaaagctaatggacaaaatagggttggcgacaaagtcataaaataaaaatcacatcagccctcaaggctgatgtgatttttatgttttattgtatacaaaggcaaaacacatagataatgaaattatagtttaccaattttaatgggtcagaacaggatcccaacttgaactaccgtaagcaaagcaggtgaatttatttataaaagtccttgttagcatcatggctttctgcaggttctgcccctgtcactccaagccagaacacgtctgcaagggaaactgaaatttctttcatatttcctaaacaatgccagaaaagcactttacctggctagttccagtttaaaaataaaatccaaagaacacagataggactgagtcatgtgtccatccctgagccaatctcagtggccagggggaccatcgacctggacacagctcagggaatccaccactgcagccaatgtctgggctatgatgactggcagcttccactagaactacatggttagaatgagagaggagaggtatttttgccaacaaagggggagtactgagccaacaaaaagaatagctatctacatcactgagtaataacaagcatgttctttttatattttaacaatctgaaaataggatatgtctcaaaaacatttgttggcccgatgaaaatcatgatatagtgtcattatccatatatgcaaaaactgggtgacgtatctgggccaggaaacttttcaacatttcaatcaataagccgtttgagaaccatcttaggaaggtaaatgaatattcatatttcactgaatcctttccattgactcatatggtaagattatgaaaacaatagcattgaaacatgcatctttgatgacagcagcttgaagaaagatctggaagtcaacactctatcattcgtttaaaaatgcttcatcgccagtgttattagtggcacagaagacaatattatgttgaaaaacatgaacatcaacaactctcttgcaaagtgattcagaagagttacacaataaatgcaaagttttaaaaaatatccttcaccatttttttcacttatatctttaagagtgctgtggtttcaaatatgtccacaaattccttgtttttcctcatttgacacgtagaagggtagagtctaattttcttacccttgaaagttggcttgacttagcaactcacttctaacaaatatgacagaaataatgaaatgtgattttggaaactaggtcataaaagacatttcagaatctttctcacttgttctcttggatcatttactctggggaaagacaatcaccatgctgtaagagtagtcaaccatctccatgggggacaagggattctcccatcagcatcaacaatgtgagtatgccatcttgatactacattctccagccccaggaaatccttcagatgaccacagcaccaaccaacatcttgactacaatttcataagcgatactaagcctgaaccacctatgataactagctcttgaattcttgccccagagaatctgtgagataataactgttaatataataaataggccgggcacagtggctcatggctctaatcccagcactttgggaggctgaggtgggtggatcacctgaggtcaggagttcgagaccagcctgaccaacatggagaaaccctgtctctattaaaaatacaaaatttgcccagagtggtggtgcatgcctgtaatcccagctactcgggagggtgaggcaggagaatcacttgaacccgggagatggaggttgcagtgagccgaggttgttccattgcactccagcctgggcaataagagcgaagctctgtctcacacacacacaaaaaaattatatgtacacacacacatatatatgaatatacatatataagaaaaacttgcttattaaactatatgtatatacatatatatttacatatataaaatagtttatatgtatatacatatatatatatttacatacatataaaagtttaataagcaagtttttctttcctgtggtacataaaatactcatgcatcataaaactgatagagtctcttagactcaataaaatgcagcaattaatttccatttacaatctattgctttgttgttttttccattgagtttaaaacagaaatatatactctttctccattctgcactttctttcttgctgccccccacctagcatgcattctctaaatcctcctggaagccttccctgatctccctcaggcaaattatatacctcgcctctgtgtgccactgtatgcaggacttatctatgtcataaataagtgttatccatatgtttattgaaataataattgaatactatattaagcatttctgaatgtcatttttctcaaataaattggagattcagagcaacacagaagattgcaatataaaaaggtttaccaaccattagacaaaaaacagtagtgagaaaagcttttttatagttatcaaatatgtatttctcaaaaccttattatagttctgcctataaccaaaggagatgtctacagtcaattctgtttttatacatatcagctcccactctttcacattatttttaattgtcttcaattttaactacacatacacagcttatataattatctcaaatcttatatgtataaatgtgttcatatcataaaggcttttatttatgctatttgtgcagtttttgtttttcgcttgctctctccctctctcttctctatgctcacaccttattcccttccccaacccgtctaagagacacattataggatccctgcttctccatgttgataaacagacaaataaattttcacccatacacagtaaatatgtatatgtggatttgtttacttcacttattttattaaaatcacatcaaataatgggaacttttctgcatcctacttttctcctcactcaatacctcactgaaattccaaggcaatgagtgcagctctaattcttttttttcaaaatggcatcatattctttgacacatatatgccataatctataactattcaatgatgattgggcatttactttgtttatacttataattccatatctattgtttttctactaacactatggtattttatgccaacgaaaatgtaccttttttttttttttgagataggatctcgctgtcacccaggctagagtgtagtgctgtaatcatggctccctgcagcctcaacctcctgggctcaagtgatcctcccacctcaacctctcaagtagctgggactacagttgtgttccaccacacccaggtactaacttttaaacagtcaaatactcctagcttttaaacttctaggtttccaatcctagatgagaaagaccttccctaatcctacattcatatatatcctgattgccttcaaaaatttttgtttttcttttttacatttatgtatttttatgtatttggaaatattttcacatgtgatataagggtctgatacaatcacatagtctctatagatgaggaaaatattttgaagacgtttaaatcagcagtgttacaaaacagtttaaattgactgattcaagtttccttattaaattttttgcaataaggtaaaaaaatgtgaataggtattatctatccatcgtatttataaactgttggctaattcaccctagcaagcatctctcctcaatttaaaaatctggctaagtcaaggaagcatgttctcattaattaaaagtcataaggcctaggcaagactatactgatataataattacaatatttgactgcaattcaatacacatacataaaacaactataatgagtaaaaaagttttaggttaaattcaaactgttttcaggagatagtgcctaactgtgctacatgacattctccatacaagtcttccaatgtaactgttactgttacatgaaggacagacaatccaattctttggctaaaaatggatgtttgtaatcaaattttccacggttattaggactcgagactgttctaacactcaaatgtggcagataagtccaaggtagtaggttgcttctaatattctctatattacaatctttttcattacatttctgcctctgctcataaagtagaattcttaatcctagtggcatactttacttcaacattgtgaaatattttaagtataacctggctgggtttttggcttccaggttcttctacttttccagaaggatccttgaacactgtcatgccagccaaagcccaagaaaaaacatcctctataatacagtagaagagagaggcactaaactggtcagtgtcagtcaggattcttcagtttgaaagataacagctgttcccttccacaccagcataataaataaagaattctatgccctggtgttttttttttttttcctttttgaaacatcacttttgatctccttacaatttattatcagcgatggcatttttgcctgcagcagtttttcagccaactcctgacgtgtgtgcatccacgcagatctctgctcaatccctaaagtcccttttagaattgcagcagcatgcatactccccaccacacaaaatacgacacgcatacaggtggttatttcttgtgctgggtttcatcttcagtacaggttaaaaactctcaagggcacagccttccttatctgcctctcaaatttcctttcaagcatcctgcacagtacattggtaaaatcccggatgatacataaatcctcactgattgatttataacacacacttacagattgtaaatcctgctaaggaaagggtcctgtctcgttgtctttgtaatcccggcaatctgctagctcctcagctcatggagctcactcattttttaacctaataagcattttgaacattattaatttgcaacattggacaagaggcttaagaactttatagtgacataatcctaaggatatgtccttttcactaaacactttgcttgtttgttttaaatcaagaagacaaatttcttcagaaaacagtgtctttaattaagaatttaatgctaataatgatagcttgtcacactcttccacataaagctcaccctagtaaaaatattgtaaacaagagtgttctaattaaaataaacaaagatccctctttgatctgggaattaaaataataagtactaaaaacagcgaagtacaccaaaatatggtaacaactgacatttttgcctagcttcataaatgtatcactttttaaagaaattaacttttttctgttcaaaatattttattttctgtagtattacagaatttctaagctttctaaggggatattttcaaagaagcagttgccgtaaatgttaaagaaaatcaaaattaaaacccagtaaacaaaagctttcacttaaacatcaaacttatcatgcagagaggagaagggaagtattcacaaaaggaaatataatattaaaaagctatgttctcactggtaaaagacaagaattgatgctatatgagactttagtagggctgaagtctaaatctatgaaggccattatctcagaatctaataaaagttgtgctaaaacaaaaatgttcccctaagacctaagccactggttatcaaaccagaccagagggaggcaaaggagggaggagagaaagaaaagaaaaaagagaagagaagagagaaaagaaaagagaagagaaagagaaaaaaaagaaaaaagagaagaaaagaaaaaagaaaaggaaaggaaaggaaaagggaaagggaaagagagaaagagaaagaaaagaaaaaacgtgggggaagaaggaaggaaaggagggagggagggaggggaggggagggaagggcagggcagtagagtagagaggaggcaagtgaataagggagggggagaagggagggaggaaggaaaagaagaaggaagtaagacaaacctgttaggaatgttaattcttaaatcctatcccagacccactgaatccaaaatgctgggctagggccctccaggtaattctgatgcatgctaaatttgagaaccactggcctatagcacatgaacaaaatgaacatatccagaagtgaggacagaatataaaataaattttgctataagttaaagctcataaaaaagtgaacatcctaatcaagacaaatattacattgatggaataataaagattaaaatataataaattacaccttaatgtctatttttgggggtaacaccttattgaaatataactcacatgccataaaattaatacatttaaattgtacaattaatggttttagtatatcacagagttgtgcaaccatcatgaccaattttagaatattttcatcatcctaaaaagaaaccctacactttggtaagtctcccctattgccctagtctccagcatctactaatatattctgtatctctacagatgtgcctgttctggacatttcatatgaatggaaccataatatgttcttctgtgtctgcattccttcatttaacttaatattttcaaggttcagcaatgtcacagcatgtatcaatacatcattcctttttctgaccaagtaattttctattatatgaatggaacatattctttagccattgttttttccattcatccacccattactggacgtttgggttgtttctacctttgggctattataagtaacacagctatgaacatttgagtacaagttttgtttggacatatatcttcatttctcttgggtacatacctaggagtggaaatagctgggtcaaatggtaactctatttttaacaatttgaggaattgccagactgttttccaaatttattgcacaatgttgcattcccacgagcggtatatgagggttctgctttctccatatccaccccaacacttgctagtatctgaattttttactctagccatcttagagggtgtgaggtggtatctcatttgggttttgatttgcatttccctgatgactaatgatgtcaggcatcttttcatgtgcatgttggccatttgtatatcttccctggaataagtctattcagatcccttgttcgtttctaaattggatcatttttcttattattgagctgtaagaattctttatatgttctagatataagtcttttatcagatataagattggcaaatatgattggcaaatatttcttcccattctctgggtttcctttcactttcttgatagcaatctttgaaacacaaaatgtttactttttaaaaaatatgaaaaaaagccaaattaaaaaaaaacaaagaaaaagatacaacaaaaacaaaccaaaaaaaacaaaaacaaaaaacaaaaaatacagaaaaaagtttacttttttaatgtttcctgaaaaatactggttttcaattcactatacaatgctaagtgtaatttttcattaagatgctggatattaacatatagaaacttacgggttttgcggtggacagtttattggaaacactgttcatgttacagagctatggcatacaaccaccacttggtggcagttaactgccaaaagagtattacgaataagttacctgaatgtaaaagtcaatggttctgtgacaatcttgccattatctatattaattaatcacttccactgcatggataatcagaaatacagagaaacacaaaataaagagtccatctgctttccacggaaacactttaaaaatactgtatacactacaaggataatttcccttgagatacaacatgcagagagctcccatgctataagggactcaaggaagcaatgcaatgatattctggaaaaaaaaaaaaaactggttgtagaagtctttaaattttagaagaaaagtaaacattgaagaaaaaaaaaacttgtttatgtgctcaccgaaaaaaaggagggggggatcaaattgaagtagccagtagacatcagaccaattttcctcaaatggaaaacgtagaacatgaagtcacagtaaataaatgggcataagcaggcagacaggcaggctgccagacacacagaaagaagtgcgggcaggcagaaaaacagaaatgtacaagtaacagagattacaagagctaggaatgctgatctcatggaggtagtgagtagaaggatagtaaccagaggctgggaaggctatggcacaggcagatgaagagaggctggttaatgggtacaaacataaagttagatagaaagaataagttttagtattcaatagcacagtagtgtaactacagttaacaataatatatatttcaaaacagaagatctgaagtgttcccaacacagagaaatgatacatgtttgagacaatggatatgctaaatactctgattggatcatgacacactgtaggcatatatcaaatatcacatgtaccacataaacatgtacaactaatatgcatcaatttaaatattttctttagaaagagattctcttcttcaacacaatctccaacggcgcacaacatgcaaggtgctatacgaagcaccaacataaagagagagaagccaaagactttatgctcagtctacctgtgaagacacacatatatgagtaaggatgggaaagaaatttcaaatataaattgtaaacacttcttaaagcctaaggaagctggatgtcacgctctaggaaatgtttacacctgcaaagcttctgaactgagagaacaagaacatagacaaatgaatctaaaaggtaacgtgcagcataaatgtaactggaaaataatcagaagcagacaactcagagaacagctgaaataggacagaattagcatcaagaagagattagtttaggtaggaagtaaaaatggatgagaacaatatgaaaacactgtaaagaaaaacttgacaatagttgatcatacccataaggatgaaaaaaaaataaggaagtcgtgggttaaaaatagctccacagagtgagccttagtgaataaaaaaggaggtaagtccaccgaagttctgattttaagacaaagatgtggtttcaaatgtgtcaggtaagagacttacatagaaatatccagtagaggccaggcatggtggctcatgcctgtattcccagcactttgggaggctgagcaggaggatcacttgaggtcaggagttcaagaccagcctggccaacatggtgaaaccctgtctctactaaaaatacaaaaattagccgggcgtggtggtgcacacctgtagtcccagctactcaggaggctgaggcaagagaatcatgtgaacctgggaggcagaggctgcagtgagccaagatcgcgccactgccctccagcctgggtaacagtgtgaagctccatctcaaaaaaagaaaaaagaaatatgcggtagagagcatatttcaggctaagaataatagagttaatatcagtttagcaatttgaaaacaaataaatcttaatccaatattcaaagtaaacagccaaaacaattctattaaatgtagtcccctatggaaaacttccgtactgttttaattaaaattacctattgctattctccaggcacagttataaagcaaaacttagatgggcttgtagggtgggagggagagaggggatacagagttaaaaagtaccagtttatatatggaatataggtagcaaaaggaattggaagcagacaaaagctgaagggaaaaataaatgtagcctcaatttctgacattaatgtggccatttaaaagcttaattattgcttataatctatgtctgtgctgtattaataaatttaaatctcatgaaatataaatcttcacttttttttttttttttgagacagtcttgtcccttcacccaagctggagtgcaatggcgcaatctcagctcactgcgacctctacctcctaggttctagcataaatcttcactttatttgctactatataatgcttatctccaaaagctcaaaagaacattattgcctttacctttataaaatttatataggaaagactccatttcctgagaaaataaagttaggagaaatttagttttttccaaaattagaaaatggtccttaatttatctggatttggaattgttgttgttgttgttttggcatattgaaagatacctgtattttacaatattccacatagttagataacagacttaaataaatactttaaattaaatactcataaagaatactattctttccaattctttaatttccttcagttgttatatttttaacataatagttattagtgtatttttaaaagaaagtttcaaatagctagcttaaacattaaaaataccatcttcatctattacattatctaaggtgctaacattttaatcattccaaataacactgatagtagataaaatgtgcaaaaaaatcatacaaactttgaagaaattaatcaaaaacaacccattccataagttaaaaaaataaaaacacatctgtttaccaatgctttaagaagacaaaatagtgataagtatgttgattattttggagaaatgttttctctcactttttgttacggcaccaaaactgaaaagaaaatgggctatttggtgagttcaaataaagataatggcggcacccaattaagtaatcaagtataacaaccacctaattttatgtaacaacacagtagtcagataccatccaaagactgtcttaacacagtcacactggaggagatcatatacacacacacacacacataaatacacacgagatgacattaagacaggattacttttggctggaggaagaaatgggtgaagcttggtgaagggaaaaaacagaaatgagcaacctgagtgtgtaaacattttgcagaatccaagtggcttcttttacctccattgatcatctgtcatttctggagaaccaaatactactaggcacaaagtatctcaactggcactcttccagagagtaaaagtgtgacctgattagaaattagaagtttgtaggaaactataaggtaatatttgatcagggcagtcacatctttaagcagatgaggaaagcctaatcagaatgatgggttattctctgggaaatatcctgatactaacatggcgaagtgggtctcacaaggcaggtctcacaggctcagaagaggcacaaatcacaggttatagtaccatcagccctactagtacaagtctttcacatctcctttattagtacctagcatttaactcacaggcacacatgagactgggtggaaaagagaacggaaagaaagatagtctcaataatttattaacaaggatgatgcagtatagtaacaaaaaagaatgacttcaaaaaataaaaaaagttaaaaaatagaggaaaagaaagagcaagggaaagaaatatagtagtcagtaaaaaataagcctctggaggaaaaatacagcctccaggtatacatcaaaatgcttcccagcatcttcaggaagttctgatgtccagtattggaaaatctcaatataaggtaacattcatttccattaatatgacatttttctaaacatatatgcttgaagactacaggtgacagcacttcaaaaattattattcaagacagaaaaaaagcacaggcaatgacagaaagttcagtgataaatattcttctgtatacattttaagttaatttagttttataatttcttcattccacagttaacctgttatctctataatcttttctcattcattttgctgacatatttattatgtttgcttgagttgcagaattatgcaggtatcattcattaaataaaaggacagaagtttaattatttatgactttggcttttatttgaaatactctttaaatttactaaggtaaatactatccatgtgctataacttataattatcttttcattttgattcaaaactgaaaataagaccagtgaaattataattagttcaatgttcaagataaaaaaggtagacattggccaggtgtggtggctcacgcctgtaattccagcactttgggaggccaaggcgggcggaccacaaggtcaggagatcgacaccatcctggctaaaatggtgaaaccccatctctactaaaatacaaaaagttagctggccgtggtggtgcatgcctgtagccccatctactcaggaggctgaggcaggggaatcacttgaacccaagaggcggaggttgcagtgagccgagatcacgccactgcactccagcctggcaatagaggaagactccttctcaaaaaaagaaagacatcatcagctgatatggtttggctgtgtccccacccaaatcttatcttgaattgtcactcccataattcccacctattgtgggaattaattttatcatggggtaggtcttttccatgctgttatcatgatagtaactctcatgagagctgatggttttataaagggaagctcccctgcacacactctctttgcctgccaccatttaagacgtgacgactttgttcctcctttgccttctgccaggattgtgaaccatgtggtaccgcatgtcaattaaacctctttcatttataaattacccagtctcaggtatgtctttattagcagtgtgagaatgaactaatacagtaagttggtaccaggaatgtggtgttgccgtaaagatacccgaaaatgtggaagcaactttggaacagaggtcggaatagtttggagagctcagaatttgtaatggggtaaacatcgctcttgctatgcaaagaaactggtggcattttgcccttgccctagagactaatacctcaacagtgtatgataacataaaattggttaaaagggacacaaaatgctcatcagtaggataaagtaagtcttacattaataataaattggaatgctgacaaaattgttccaggtattacaatgaaatagatatatctgttaagtaatatgtaatcacttccagtttgtttaaacatgtgtttaacaagtatcaaaatcctcacaaaaagtatcgaaagttccttacataataagcactatataaaaacataattgaaacccactccaatggcaaaagatcctgaagtaccaaggttaatactcaggatttgaagactcattagtgcagagatagaataaataaaagagaatgaactgaatctttaccaaatttttaaatactgatttgggagtttgacatttatgatttatgacttctaaaagtagagttagcagaaaaatttctactttgctaagatacacagtttatcaagactgctaggatacaggtattgtatcacctaatcctcccttcactggaagtcagaagcttaaacaccacatgtgcctaataaagaataaaatacaaaatgcaaaatacaaaaatatcttagccacaaatttttattaaactggatgaatgagaaaagaaagaatgcctccaattactgtgaaagcctcaggattctactttgctatggtagttcacagttgcattctcatggaaatataaaggatgttatatttcattttctacgagtagaacctcacaaccatttctatcatctagaaaatgatataaaaatcattttctacaagtagaccctcacaaccccatttaatgaaacataaagtaacgcagccatagcctttaatactgttaagtataaaaatattgcttctctcttcttttaaaaaagtttgcacatgcttcctgtttattttcccctcatagaagaaagaagtgttgcttctttaaaactagaaagcagatatacataggttttttaatatacattgagaagatcaatagctcacctcttcaaaaaaatgttaagaaattattaaagcatgcgaacaattctgcaatcattggatagaaaatcctagttttagacaaaacaattctgctatcattggataaaaaaatcctagttttggacaaaacaattttgctatcattggatagaaaatcctagttttagactgaacaattacgccatcattggatagaaaatcctagttttagactgaacaattacgccatcattggatagaaaatactagttttagactaatctatagccaaaaaatgcacttttgctttgttctgtaagacaagataaaaagggcacaaatgaaagttctcgaggcctctgctaaaaactccccataaaaactagaaagagcattctgattgtaatattataaaatattcctatttcacttccaactataaaaatggtattttatttaaccagcaagagttttagaacacagtatttagaggcctattgaatgctatagttgaatgcataccatctcatgaaggtctttgattcaataacaattgagattaatacaataaaaagcaaggaaaaacaaaaccaatagacctacctaaataatcaaagcaaaggagagtctggcaaatttaagcatatggacatggataagccatatggataactgaaaccaatcaaaacaattgggttaaataaatatggttaagttggcatatttatatttcccaagatcctaaatttgctttcagtgaacactcacatccgtgctcctctaagtttcagtttatatttctttttttcttctctctaagatgacagacccagcctacttgcaagcagttccaagatgatgcccctgtttttattcctgcagtgttttacatgctattgaatgtaaacaaggcacaatgcaacgaagcatgattaactgcaactgaaaacccaggaaaaagactgaaattactgaaggcatcattatgaacgagatgtaaaaagtaaccataaagcaaaaagtccggcttggatttgtaactagttacaattaataagttcaataaatatttgtccaatgagtgatccaggctggtaatgatacatacattttaaatatagtattatcattccttttttaaaataaccaaacattgctggcaatggaaaaaaaaatcagctgtatcttatctgtcccctaaggtctcctcttctgaactctcaagaacaactctcatcactgagtaaatcacagtacttctccacaatacctcaacggagaacaagagggagggcacattttggacacttcaaggtaaaaatcacaaacaattttcctttagtgacagaatcttaatttcaaaaactgagatattctggatgattctccactaacttctactataactttggaatgtgttttaaacactcaccatttatatctagatgaatttaaatgtaaaggtaaaaatttcaaagtaaaatacttcataatattaaattctttcttacattaattatgttttcttggagagtagatagccaccatcacggatatttttccccttttactatctaagttgtagggaaagaaaaagagagacagatgaagactggtaactttgaaaagatatgacatttgatgagtatatcttggctgatttcactgacctaatttatataccatccttagacagtatgaggaattttttttcacgaaggacaagccaatgagtctattcacttcataaaactcaaatttttatatttatatttgcattaacatggcaggagttagggggaaaatgtaggttgtttttctaatgaagatattcaaaaggaagtcacatattttaaatatttttattaaaggtctatatatatgttcccacgttaaaaactcaaaatataaaaacaaaaaaataacagtatgcatggcagcaacccttcttttataaaaatatacaaatctttgtctaaaagctactgtgccccacatctaaaacctcctttccctcagtgatcatacctagtactgaaagagttttactaactctttaaattacagttgccagtggtggcaactgtaatctcttatttaccattctgtgaacaaatctagggcaatggggctggctatcatactacaagccgactacatcctataaaggagcaggttggcctcactgtgcaatgacctacagaacaccttcattaaagtttatgatagtcccaaagtaattcaatgaatcctaattgatgttttacaagaaaagcaaattctcatctacataaaggttaatagattgatgcccaaataaccatagataggtgagttatttaaatttccactttaggccaggcgcggtggctcacgcctgtaatcccagcactttgggaggccgaggcaggtggatcacgaggttagaagatcgagaccatcctggctcacacagtgaaaccccgtctctactaaaaatacaaaaaaattagccgggcgtggtggcaggtgcctgtagtctcagctacctcgggaggctgaggcaggagaatggagtgaacccgggaggcagagcttgcagtgagctgagattgcaccattgcactccagcctgggcgacagagcgagactccatctcaaaaaaaaaaaaaacaaaaacaaaaacaaaaaattccactttaatcaatctatttcatctatactttgttctatatctgtttcaggtgtccaaaatatattccctaagttctcattgtatcaaaaaacatgtaatacaagaggtatttccactgttttctgaagtcagcaaaatttcttctacaaagaggggccaatatgagaccctagttataacataattctaagggaaagttcaatgtctaacagtaattggagctacaaagtactaagataagattgagactgcctacaagaaaacctggctccaggcttataaatgaaaaggacctttgagatcatgcttatatagagaaaagagagttgaacatttctcaacttggcaagaagccttctaatacacatgaatctttaaagaacattatgacgcagttgatttgtaagccctttaagaaaaggacctatgtctttctcaccgtgctatctccaaactttttacactgcttgacacagaaggtgctcaaaaaatattgactaaaaacaataaaataatggaaacatttttgtctctcaggaaacgtatttttaaaatgttatactgtaaagctggcacttaaaaaatgacttctcttataaacatcaagtgaaacccttcatacacagtatcacggaattaggaagtatagcagatttataaactcacttaaaatattaagctcttgagactttagcataaattccttgaattcctgtgatactgtgattactaaaacaaaacaaaaattgtaaggttataaaatttcataagaaggattccacacacatataatgtgattatgaaaaatgatggttcaatgctagctatttgagattcattcactttacttacgctaaaagaaaaggttgtgaatatttccattcagacttctttttactactttcaaatgtttgttttatatttgttatgacataacatttaatgtaagagagatttagaatgcttggaatattcctttacaaatggtaagttttgaaactaatgatctgttaaacagaaaaacactcagtctgaaatttaaagctgttgctaggaggaatgttcattgagacccctaacagaacatgcaaatgaggactcagtgtcctataagttagtagtatttccatgaaacacacttaggcttcccagtttctagaaaagcctcttatccccttgaaaaaaaggaggaaagtataaatgcaagacacagccactaagagctgaagctctaaagcagagaggtctggcttcagtcactctctagctctgttatctctgtactcaacgcttctcatttaacaaataagaataattgtaataattattccataagattgttgaggtgattacattcaaacttgcatatagagtgctttagcagagtgacaagcactcaatacatagttactactatggttattattaataaacatgtcattgattaatcataacctatagatacacattttccatcacccacagaaatgtctatgtgtaaatataggtacatgtgcatgtatgtttcaagaaacaataattatcctaactcctgatacactgtcttttagtcttcaatttccattttttgtaaatactgggcttacctcattaaactgttttcataactcattagtaggtaacaattcatagatccaaaatagagtcaggaaatcacattcttacttctgaagaaaggataggtaatatttgtattaataattacaactaattgataccatcttagatatatttctgaattgtgatctttcaattctttacacatttgttattactctttatttcagtttcatgaagaaatcaggcatggccactaagtgccatgcaatgaaaaattgttactaataattattgtaatagctatgcattattaatatttatagaaaagaaataatgtgaaaagccttaaataattataaccatttttataacaattagtcagaaaaataattatttactatcaattttggaagaagaggtcagaacaaatgataaagcatctgcatgtatatgagagagcatatgtgaacagttagtgacagaggaaaaagcgacagagaagtagacaaaatatataagcataaaaaaaaatgaatgagaaggaggagagaaggaaggaaagaagaaaggagaagaaaagagagaaaccacactaagaaaaagatggttacaaatgagagaaaattggaaaatgaagaatatggtaacagacgtttttaggtaaggagaaagactctcgttagataatgttctttttagtaaggcagtgacaaagtcttttgtcaggcagtttacaagctttaaagcaagacacttatttggaaactaagaccaataatgaaacacttcattctctctaatagattcctcaaagttcaccctatttatagctgttatagaaaatatacaatatatacaattcaggtgcatatgatgatatagaagagaatttagttgtcattaaatatcaaatctatataccctcggttggcagcatagcatgacttccactagctgacttggtaagcctgttcacgaatgagagatggtaaggaaagtaaagggataattcaggctgactattcagatgctagaaaagatagagaagtgagagggtagggaattaccataggataaatattatcactaaaatcagggtcagaataaaagcagatagcaaccaatatactatgaaaattggtatagactaaatatctgaatgcagtaataaaaattaggagcagaatcagtaagtatggaagaacaggagatgatgatctaccagccaaagagagaaatgtatgatcctgaaacactgaaggtggaacagttttccaggaagatatccaaattccacataggaggtactggctggtagctaaaatggactaggggatcaggaaactatggactatgtgccaaaatccactcctctacctatttttgcaaataaaatgcttttagaacacagcatcttttgtttcctgactttttaatgattgccattttaactggtgtgagatggtttctcattgtggttttgatttcatttctctaatgaccagtgatgatgaattttttcatatatttgttggctgcataaatgtcttcttttgagaagtgtctgttcatatccgtcacccacattttgatcgggttgtttttttctttttaatttaagttccttgtagattctggatattagccctttgtcagatggatagattgcaaaaattttctcccattctgtaggttgcctgttcactctgacagtttcctttgttgtgcaaaagctctttggtttaattagatcccatttgtcaattttggcttttcttgccattgcttttgctgttttagtcatgaagtctttgcccaggcctatgtcccgaatggtattgcctaagttttcttctagggtttctatgattttaggtctaacatttaagtctttaatccatcttgagttaatttttgtataatgtgtaaggaaggggtccagtttcagttttctgccatatggttagccagttttcccaataccatttattaaacagggaatcctttccccattgcttgtttttgtcaggtttgtcaaagatcagatggttgtacatgtgtggcgttatttctgaagcctctgttctgttctcttggtctatatctcttttttggtaccattaccatcctgttttggttaccatagccttgtagtatagtttgaaatcaggcagtgtgatgcctccagctttgttccttttgcttaggattgtcttggctatacaagcttttttagttccatataaaatttaaagtagtttttttttctaattctgtgaagaaagtcaatggcagcttgctggggataacactgaatctataaattactttgggcagtatggccattttcacgatattgattcttcctatccatgagcatggaatgtttttccatttgtttctctttgatttccttgagcagtggtttgtagttccccttgaagcggtccttcaaattccttctaagttgtactcctaggtattttattctctttgtagcaattgtgaatgggagttcactcatggtttggctattatcagtgcatagggatgcttgtgatttttgcacattgattttgtatcctgagactttgctgaagttacttatcaacttaaggagatttttgggctaagacgacgaggttttctaaatatacaatcatttcatctgcaaacagacaatttgacttcctctcttcctatgtgaatagtctttatttctttctcttgcctgattgccctggccagaacttccaatgctatgttgaacaggagtggtgagagtgggcatccttgtcttttgccagttttcaaagggaatgcttccagcttttgcccattcagtatgatatcggctgtgggtctgtcataaatagctattattttgagatacgttccatcaatacctagtttgttgagagtttttagcatgaagggctgttgaattttgtcaaaggccttttctgcatctattgagataatcatatggcttttgtcattggttctgtttatgtgatggattacgtttattgatttttgtctgctgaaccagccttagatcccagggataaagccgacttgatcgtggtggataagctttttgatgtgctgctggattcagtttgccagtattttattgaggatttttgcactgatgttcatcaggaatactggcctgaaattttctttttttgttgtgtctctgccaggtttttgtatcagaatgatgctgccctcataaaatgatttagggaggagtccctctttttctattgtttggaatagtttcaaaaggaatggtaccagctcctctttgtacctctggtagaattcggctgtgaatccatctggtcctggacttactttggttggtaggctattaattactgcctcaatttcagaacttgttattggtctattcagggattcgacttcttcctggtttagtcttgggagggtgtatgtgtccaggaatttatccttttcttcttgattttctagtttatttgcatagaggtgtttacagtattctctgatggtagtttctatttctgtgggatcagcggtgatatcccctttatcatgttttattgggtctatttgattcttctctcttttcgtctttgttactctggctagtgatctattttattaatcttttcaaaaaaccagctcctgtattcactgattttttgaagggtttttttgtgtcgctatctccttcagttctgctctgatcttagttatttcttttcttctgcactagcttttgaatttgtttgctcttgcttctctagttcttttaattgtgatgttagggtgtcgattttagatgtttcctgctttcttctgtgggcatttagtgctataaatttccctctaaacactgctttagctgtgtcccagagattctggtatgttgtgtctttgttctcattggtttcaaataacttttttatttctgccttaatttcattatttaccagtcattcaggagtaggttattcagtttccatgtagttgtgcagctttgagtgagtttcttgatcctgagttctaatttgatagaactgtggtctgagagactgtttattatttctgttcttttgcgtttgctgaggagcgttttacttccaattatacggtcagttttagagtaagtatgatgtggcactgagaagaatgtatattctgttgattagagatggagggttctgtagatgtctattaggtctgcttggtccagagttgagttcaagtcctgaatatgcttgttaattttctgtctcattgatctgtctaatgttgacagtggggtgttaaagtctcccactattattgtgtgggagtgtaagtctctttggaggtctccaagaacaggctttataaatctgggtgctcctgtattgggggtatatatatttaggatagttagttcttcttgttatgttgatccctttaccattatctaatgccctcctttgtttattttaatctttgttggttcaaagtctgtttgatcacagacaaggattgcaatccctgcttttttttcttcttccatttgcttggtaaatattcctccatacctttattttgagcctatgtgtgtctctgcaagtgagatgggtctcctgaatacagcacactgatgggtcttgactctttatccaatttgccagtctgtatcttttaattggggcatttagcccatttacatttaaggttaatattgttatgtgtgaatttgatcctgtcactatgatgctagctggttattttgcccattacttgatgcagtttcttcatagtgtcaatggtctttatattttggtatgtttttgcagtggctggtaccggcttttcctttccatatttagtgcttccttcaggagctcttgtaaggcaggcctggtgggatttggtacagctgattttgcactataacagcagagttgaagagttgtgacagagaccacatggcctgcagggcctaaaatatctactatctggctcttcacagaaaaactttgcctccctccttgtctatgagctgagggcataatcatgtaagccttaacactaacattcaagtcaccaaacatacatatgcctggcacatactacacaaatatttacactgtttgaattatctgcttgagtttaattcccagcttttccatttactagaactgtgaatgaaaactggccattcaatcttacagtgcctcagtctactcatctgtagaatgaggatgataatggtattgatctcacaagagtgacaaaggattaagttagttaatcatgcaaagctcttagagcactacttggcacatgataattactatctgtgtgctggctactgttaaatatagtaggttcataatagtcattagtcgaatgctggatgaattaactaatgaattaatatatttgagagataaattctaagacagtaatttactgaaaaacatggtggtagttaatggtaagaagcttgtagatgaagtaaattcaaaaaagaagatatatcatttaattgtgatagaggaatatgaccagaagtggcactaaacacaaagattaagtcattccatctcgtctgagtgaatcctgggaaagaaggtagcacagggcttcttaaaaatctcacaatatttgtatgacaatacctaaattgattaaatattgatttcaatagaaatgggccatcatttgggggatgggaatagaatttacctctggcctcatataaagaaatatgtattttcatctgtaccacccatatattaaaatgtcttatatatttaaataatctttctgcagtcccccatatatttttgtgtgactgagatacatcgtttctgacagccttatttacagaaactacagcttgtacataactgttttgttcaatggacctgaaccaagtatgcaaattgctcatcagatctttggctcaatgttcacttaaatgtgctcaaagcataagttctatgaaacactaaacacagaaacagacacaaataatgtcaatttggtactttaatacaactataatagctgaactattacagaattccaattctaatgactaaagctactcaataccagaacagatgcctccgagatcatcctaactgaaattcagatacccttttaaagcccagcattttccaggtgaagtgacctcctgcatctctgcctgggtgcatttaaatgataaaaacgtacatggtagtctgcctgttcatgtactcgtaatgagcaaatccctaacagctacattcgtgacaactacttagataacaaagaagctttacctaaaggtatcactattttacttccacagagattctgccactagatatgccagagtgcacactattcagttcttttaaacatgttcaaaaatagaatatgtcttctccccacagttcctcttctaccagcataaacaagtgtttcagcccatggtttctcccatgtcaccccattcaatttgttccaaacatcacctgtaaactctgaacatagaaagaacgtagaccagactttcaaatgtgtctcccagtgaattggaggagagcatggttttttttttttctaattatactttaagttgtagggtacatgtatacaacatgcaggtttgttacatatgtatacatgtgccttgttggtgtgctgtacccattaactcgccatttacagtaggtatttctcctaatgctatccctccccactcccccaaccctacgacaggcccccgtgagtgatgttccccaccctgtgtccaagtgttctcattgttcaattcccacctatgagtgagaacatgcggtgtttggtttcctgtccttgtgatagtttgctcagaatgatggtttccagcttcatccatgtccctacaaaggacatgaactcatccttttttatggttgcatagtattccatggtgtatatgtgccacattttctttaatccagtctatcactgatggacattcgggttggttccaagtctttgctattgtgaatagtgccgcaataaacatatgtgtgcatgtgtcttgatagcagcatgatttacaatcctttatacccagtaatgggattgctgggtcaaatggtatttctagttctagatccttgaggaatcgccacactgacttccacaatggttgaactagtttactgtcccaccaacagtgtacaagtgttcttatttctccacatcctctccagaacctattgtttcctgactttctaatgatcaccattctaactggtgtgagatggtatctcattgtggttttgatttgcatttctctgatggccagtgatgatgagcattttttcatgtgtctcttggctgcataaatgtcttcttttgagaagtgtctgttcatatccttcgcccactttttgatggggttgttttttttcttgtaaatttgtttaagttctttgtagattctggatattagccctttgtcagatgggtagattgcagaaattttctcccattctgtaggttgcctgttcactctgttggcagtttcctttgctgtgcagaacctctttagtttaatcagatcccatttgtcaattttggcttttgttgccattgcttttggtgttttagtcatgaagtccttgcacatgcatatgtcctgagtggtgttgcctaggttttcttctagggtttttacggttttatgtctaaaatttaagtttttttgtttttttgttttttggtttttgttttttgatatggagtctcgctctgtcgcccaggctggagtgcagtggcatgatctcagctcactacaagctccgcctcctgggttcacgccattctcctgtctcagcctcctgagtagctgggcctataggcacccgccaccatgcccggctaattttttgtatttttagtagagacagggtttcaccatgttagccaggatggtctcgatctcctgaccttgtgatctgcccacctcggcctcccaaagtgctgggattacaggcatgagccaccgcgcctggcctaacatttaagtctttaatccatcttgaattaatttttgtataaggtgtaaggaagggatccagtttcagctttctacatatggctagccagttttcccagcaccatttattgaacagggaatcctttccctatttcttgtttttgtcatgtttgtcaaagatcagatggttgtagatgtgtgctattatttctgagggctctgttctgttccgttggtctacatctctgttttggtaccagtaccatgctgttttggttactgtagccttgtagcatagtttgaagttaggtagcgtgatgggaggagagcatgttatatcccctcatgatcttttctgtgccatggacgtttctttccatggaccccaaagcagctatcactgtaaaactgagagctcaaaagtctcagttgcccccaagaactaggactattaaaaaagttcaagttattttttaatgtataatcacacacaaatgctcagtgtaaacgttctttaatttacctatattcaattaaatggcatgatcttaaaaataagattctagaaggaatcaatcttggaacaaattattacaaaagagaagcaacatggaatgacaatttaaatatatataggaggaacaataatatacatctaacatataacattatgtagagcttatagtagggcagggcaaaaatatctgtttctgtgtattactatacactacgcaatgtgggaaaaaacgaaggtgaaccccaccatgtttctctggctgttttcccaagcctacattttcagatgtctttaaaactaactgattaaatgtatattacaagtgaaatagaaagaaaaaaaaaaagaaacaccaccaaggagaaaagaccttaattactgcataacaaatatattaccaggaaagtaaatatttgttaaaaatgaagatgtctgtgtttcagtaaagggcatttgagacccaagcattttgattgggagaatgataccacaccttctaaagaactgggcaccaacaactataagaaaataaatgcaaaatgttgacttcacctctagtaaattgtctgttttgaagttccacttatattttctagttttatgtaatagcctaccacctggttagtataaaaatagaattctttgtgtttttttaaattttaatttctttcactaaaggtacagcatcacaaagatactacttagcctctctagcaaggataattattagcaatgagtttaaactcctcaaattatccacacaccaggcccacttcactgaagcaaacaaaagataaaactgtgtgtctgtttgtgtttgtgtatctgtgtgtgtatacacatgcaagtgaattaaacatggagcaaacaatcaaaaaacatacataaaatgttgaatgttaaaaaagaaaacataagtagccatacaaacttggcagtcattttctggatacattaaaaattgacatacaaattggacagagatctaaatggcataaagaatgaagtaaaacaggcagttgaaatgcctatactaactgccatgaagcacacagagtcacatggtcttacaatcaccaattcaggggcatctttctatttagtagtaggatttcacttattaccctgttagaaattacatttaaaaatcatttcatgagaaataatgaaaagtaaaattaaaagcataaaacaaagataatgacagaaataatagttcatgggtctgggcatggtggctcacacttgtaatcccagcactttgcgaggccaaggtgggcagatcacttgaggtcaggagtttgagaccagcctggcctacatggcgaaaccccatctctactaaaaatacaaaaattagctgagtgtggtggtgggtgcctgtaatcccagctactgaggaggctgaggcaggagaatcacttgcatccaggaggtggaggttgcaatgagccgagatcgtgccattgcactccagcctgggcaataagagcaaaactccatctcaaaaaagaaaaaagaaaaaaaaaacatatatatatatatatatatatatatatatatggttaatggggactgacatttttaaaccaaactgtgaggttttaacttttaaaaatgcacacatggttctataattaaagatgaaaaatctaaggaaaaactaaagaatttacatttatgaaaataaggttaatggctgggcacagtggctcattcctatcatctcagcactctgggaagccgaggcaggaggatcacttgaggccacaagtttgagaccagcctggacaacatagggagaccccacctctacaaaaaataaaaaattagctgggtatgtggtgcacgcctgtagtcctagctactcaggaggctgaggtgggaggagtgcttgagctcatgacgtcatgactgcagtgagctgtgatcatgccactgtactccagcctaggtcacagagtgagaccgtgtctcaaaaataaataaataaataagttaatctacagttctcataaacaagttatttaacaaaaaggacccaatatatgactaatctctttagacaataatgtcagaagacaatggtactgctaacttatatatccttctataattaaaagaggcaccctaccataatatcttaatagacaaagaagatatattcgaatgctacatttactggcatcttaactgtcaaaggcatgaaaccaaaaaggcaaaaaaaaaaaaaatacatttttgcacatgcactataacgaaagaaggagagagtaatgaaaatatcagttctgattgggtgtaccaggaaatatcaaataagtacagaggagtcatagagcagagaaaaaaaatgtgagtgacaaagctcaagtttagcagaattagaaaagggactcaactgagactgaagaccaaagaggaatctggggaaaaagagagaaagagagtgcatgaggaggcgcaagcatgtgcctgcagcctgctaactggtccacatcagcgcaagaggatttccaggacctgtctttggctgcatcaaagacaggcagtgaccttccccaattgtcaggatgacccacaacggctaccaggccagtctcacaagaactaagaaaacaccatcagctaagcactttgcatccattttcaagaagttcatcctcaaggaaagataaggtgacatttgagaaaatctatctctacctggggaagctaaggaagttttcagaagaggtggcatttgagttggaccttaaaggatgggtgaaagtctgcaatataaataagtaaaagtctattttccgcaggaaaaaagtaaatggcagttctatttagattaatcattaaatacacaggaagaggtagccatagagatgaggccaaaggaaaaaattatgttggatatacattcttggggggactggcccttccagggtcagcttaaagaaatcaccttaaggtgatttcaaaatttcaaagttatcatcaaaaaacatgtttcccttaaaattcctctaacaggaatagtgcatacaatagatgaaacaggattaaaatagcaactgataccaagcacattaaagcataactatctattcaaccaatctacacgtaaaagtgacaggtatctgatttctctattttaatgagaaaaaaacacagaagacaccaaaactgagataaataggtcccactaaatagagaaataagaatgaaaaaggaaagataaaggaaaactttaatataaagtttataggatagaaaactttaatataaagtttataggatagaaaactttatataatataaagttggttgtgtttaacttaaaataatcaagtgaaaacctcaaggcttacataaaagcctggggtacataatttaagaaggaaagagtttgtcacaaaaaaactacaattgaaataaggtgctttatagcagatttctacctcatttaaaacaaacctaatgccaatactaatcactagcacaagattagcataattattatggcaagtctatttagtctattacaaactaggtagagtgttttcattttaaagaaaagcaaatagaaatgaacgagtagagtcaattaaccaactattacaaaaatatcaattcttaagaagcaggggcatggctagttcattctaagcacttgcggcttggacagacagagcttcggacatgccgtcacaggaacaggctgcacttaacagactccacctctcaattctagccactatcatgtccctggcaaccagcccaatgcctgacacagaagggcctcaactagtgtcagtcaataacaaatggaacataactaatgctataaaaccaaagaccttgcttatactttaattcacgaatgctacttgtgcctctttttaatctgtaagacctgcctgatatgtcaaatattttatgacttcagtgtcaatgaaaataagtacactgcccataccctggggtgatcttaaggatgatagtaaaagaatctgatcatctagccataatctaattaacatgatcaccactgtgctgtaaatcatgtggaaaaagtggagaaaggctgtgaatacatgctaacaatgaggatatgtgttaagctgaactcctagaaacttcatacacactcaatataaccttattccaatatgtctgtttttcatgatgttttgtagcacagagatctccactactaactttgagaacactgttagcactgtgactccagtcgagaataactaacctacaagaaataggcagagcccttctaacatacatatccctacttttgcacttatcacatatttcaggtagagaaagacacttcctgaaataaagcctgactcaaaatattttttaaaaacatgttagtagctgggcacggtggctcaagcctgtaatcccagcactttgggaggccgaggcaggcagatcacgaggtcaggagttcaagaccagcctgactaacatggtgaaaccccatctctactaaaaaatacaaaaattagccaggcatggtggcgtgcgcctgtaatctcagctactcaggaggctgaggcaggagaatcacttgaacccgggaggcagaggctgcagtgagctgagatcgtgccactgtactccagcctgggagacagagcaagactccatctcaaaaaaaaaaaaaaaaaaaaaagttagtaaacctaagaccaatagcaagtcacaaatagcaataacctctgatattacagaaaagttagatattaactctacttctatctacccatttttctatttacccatctacctacctaagtgcttactttatcatcaaaccaaacgtagaaaatgctggaacaggtagagagatatgctccaagacttctaaccaagaaaatcactaaacttcatgatgtataaaagagaaaatacattaaaacctccataattttaatctctcttgaactccctccttaggcatttaagctaaatctcataactgacattgtcagagtaggtagttaggcagacatgagcacagcaggagaactcccctccccaggaatgtcaggggaccataggtgatggtcaggcagttgttaaactgtttctctaaaataatttgtggcagccagcaccagggaaaggcaacctcccaatagatagaaaacacctggagctggtgatcagctgcttccttataaggtctctggagttgggcaagtaggctcagcatgcacactgcaagaggcaaaatggtggcgtttaactggtatatgatcttcctctgggaatacttgactggtaaaggaaaaatggctcaaatgagcatgcacacaactttagtaaacacactgagcatgtggcccctcccaagtgctggctggccactgggccactgggctactgtaatgcagacagcccaccctaaaggaagaatcaggggagaagaaacacaaaccctgaactatggccatgtataaaaccccaaatcaaggtccaaacagggcactcaaatctctcaagtcacccgcttggccctcttccaggtgtactttgcttcctttcgctcctgctctaacactttttaataaactctcactccggctctaaaacttgcctcagtctctccctttaccttaaacctacttctgccctcagctgaattatatccctgagcaggcaaggatggggttgctgcaggcccgtatggattcgctgctggtaaaaatatcacttaaccattgcaggaagaaactttaagataaactttcaacatagtctttcccctgaaatgaatctcaggaaacatctactcagcagaagtccttggcataaagtgaaattgccagttttatgcaggagtctcatatactatgcaacactcttcagatttctctgcattttgaagcttgcaaccattttaacagcccagtcttcatcccttgatttcagctcttcacaaatctttgtatcatagaacagaagttacagaaaatgttgagcgtattaaaaggtaatggggacagcacccccaagccacttcatacttgctaataccccaacccataatactgtctcctctcccaaactctcaatgctgccctatccattttcctaagcctttcctatgttaagattaacaactcaagctcaatacttctctattttgtttcctttactcgggagaaaagaaacacaaaaggggacactacaagcataaaaagcacagcttctgttaagagaatcacaaaaaacctacactttagtatttatcaataggcctgtttcttacaatggttaaaggctccagaacaccaaggattatcctagtatatatgtgaaagaacttaacatctcaataatctaaaaaagacaaattattttggaaatgagaattaactagccatttcagtataccggatacttcagataccttagttttttttcatgtacagactgatccttatggaaaaactaatgaaatgaggaacttcggtcggctcaaaagtctacatcattcacactgtttgcaaaattaagaccctcaactcccccaaacgtaacagacttctttagatgtagctttgaatattcaaggtctccaatggtttggatcaacggttattctatttctaatgtttgcaataaaacagtcactcacactctccccaaacaatataaaatatgatacaataaattcaattagaaaggatatacctaaccattttagtattttctagcaatagaagctatactaaattcattctttcatttattgtcattaatagcaattatgtgacagatactgcactaggcactagagacacagtgacaaaagacatcacagccattcaaataactacctaattagtggggtgctaagaaagaaaagttaatggttaaataatttttatgctttgagagaaatgttagtacaattataatgtgaaattttaagttcactaacttacacatagttcaatttagaataccaagagttttcactatattagacaaaaaaggttctttacacaaaaatcacttgtgatgatttattccctctagtatcacaactatctcaactacagatgtgagcttattcacatacgaggtttgcattctaagaaacataaacacaatgttgagaatactaaagagttctatgatgataagagggaatcaggaatggcaaaaatatgcatcaatgcatcacgaatcaagttcttctgcctatctaccttggcctaaaacttccactgacaactcaacaaaaatgctcctttggaaaaacaacaacaacaacaacaacaaaattcattgtttcatgggagaagaacagagattcaaaacagcaaacgatattgaacattattttccaacctagagataatcctataaaagttaaagaataatataaacagttaatgaagcctgtttcttacacaaaaccttccaatagtatcaattctgtgacactatcccatttttaactatatttttcagcaccccaagaggttcttacatactagcatcatcatcttttttgattttgcaaatctgatcaccctgcagataccttattggatgctgcaacagatgaggcatgtggatgcttttctgctaccactggtgccaaaaataatttacacttgaacaaatacttgttgaggattcaggcttaatatctacactgtagttctgaaatacagtatggtattccgtccttcggagtccatgctttggaaatcacatttaaacagtttaacagagaagcgataataaattattctaatcattaataattgaatcaccttattatgaattccactttttagtcaggtttcagggtacttaatagtcatgttggtcagtcacaaataaagtaagaaagcaaagaaacagaaatgctaattaaggttacctttgttccaaagatgacgaaaatagttgtccaaaggctgattaagaattacaaggcagtacttcaaattccctagagaaaaaaagaaagcaaaataaaatacataagtgaactgagtcttttgttcctcttatatgagtctaaaatcatacactactagtccagattttcagtatacacagaactaaagttcaatcacagtgaatttcccataccttaattttaaaaggcatcatacataaacgggtcctattttacttagtgtatctgtcacattaccatattgttgagcaatgtatcatagaaacaactgggtaaactttttgtagggggtgaagagcacaaatgttcttgatataaattctcatccttccaatatatctactactttgacacaactatccttctacctggctagttttatatcatcctgaccttatttatcaaatggtatgggtctagtgggtgtgtattttcacattcattcatattctttttctctctttccttccacgcttaccctatcctgaactttccaaagcaaaaccctgtgtgctttcagaaatcctactaggtcttctcatgattctcttattccaggtttttaatgacactccaaagacaaagatgaagaaaagtttacttttaagacaatcattccacaccttttataatgtacttaaaatagtgcaaagcaaagtacaatcaggtattgaaaatctgtcattcagttcagtccaagcaccctccatttcatttgtgaaaaattaaatgtttaagaaaaattgtttttaagcaatctcactgttagaaatggaacacaataagtaaataaaaagggtatgccatcatccatagcaaatattattaagtgccaattgtataccaggcactgggagtacaaagagggataagattacaagctgtgagatgagacacttaaaataaagatgatttattcaaaatacaatataacagaagcacaggaggaatgccagataaatagataaatgagtatagcgggagttcaaaggctaggaagccaataaagtctggtgtcatcccagagatttttgtgaaatgtagatttttgaacttgatctttcaaagagaaagaaggtgcaaagaataaaggaaggggctttctagacaagaaaaacagcccacgagaagctgctctccttatccattagggttactccaatgaacagtttcagaagcaatgccctaatgatgtgatactaacatcagtaattttaaacataatgtttaagataacgtaggaatttaagttgaggcaccaacttaaattcctctacaaaaagagtgatgcagtaatgagtagtaaacacaatttatataattcggaatccatatagagatcagagctgaaggtaaaagagtaggcaagccactgagatactgcacaaagcaggggagggcaaagagagaaaagaataaagacgaaagcaaagacattgtgttttcctcaccgtaacagagccgaaggaggtcaacagagaaaatacagaaggaaaacccataaaggcagaaggataagaaggtatttccaagaacatgcagccgataacacagcatgctacagaaatgtcaaggagattgaacaagaggccgaggggagggagatctcaaagaaaatctgaaaattcatagagggagactcaagatagtgaagtgaccaaggaattagtgaacagtcaggagttgattaagaaggaagaatagtcacctttccttaaaatataaaaagttaactgtgagaaatggaaaaaataatgcaacaaagtcgagataaaatattttcaatatagaaacaatcttatatcctaaataggagagggaagtaagaggaagaagggaaattgtccatttgttctttcaacaggtattttcagagcacaccttgttcaggcactgctctgaacagcagtcaagagaaatggtgtgtcccccaccaccaccaccacctgtaaggcgtatctcctgctgagaaaagagggactgagactgaggcacatgaaggcgcgtcatgtgcctcaaaactgaggttgtctttttttttttttttttttttttttttttttaaagagatagggtctcactctgccacccaggccagagcacagtggtacaatcgtagctcactgcagtctcaaactcctcggcacaggtgatcctcccacctcagcctcctgagtagctgagactacaggtgcacaccaccatgcccagctaatatttttattttttgtaagaagcagtttccaatgcctggcatcaagcgaccctctaccacccaaagtgctgggactgcaggcctgagccactggaactgtccctatttatttattaatttttagagatggagtcttgctctgttgcccaggctggagtacagcggcactatcttggctcagtgcaacctccacctcccaggttcaagtgattctcctgcctcagcctcccaagtagctgggatgacaggcgcccaccaccaagcctggctaatttttgtatttttagtagaggcagggtttcatcatgttggccaggctggtctcgaactcctgacctcaggtgatccacccacctcggcctcccatagtgctgggattacaggcatgagccacctgggattacaggtgcccggcctgcacctacacctatttaaaacaaggtaaaataaagtgagaggggagaattagagtggaatacggaacatttttaaaacaactgtataaaaaacagactacaggacataacaatccacattttaaaaatagaaatataattggaattaactaaaaggtaatatgaaatcatatttatctataattttagcacttttcccaccaattatgaggaggagacataagagtaggcgtaaacaggatggtgacgatagctggttttgagaactggcaaaatcacttgccaagaggtcaacagaatccaggatgtttatttgggcagctttagaatgaatgattatggtgaagaccagtaatagcctcttctttattaagaggatcctgaggggatttttgttcatttcactgggccaggtaagaaaaaaataaccttgtggccaaatgtggtcataaggctaagttctggccaaagagatgtatatagctttctttgttatatctggcaagtctccttaaaataaagggggatttatcttctactcatttccttcctccttcctgccatctggaagtaagaattgatagattctttgaatgaaattctagcagccaccttggatcataagaacaagggcatcagagtaaagaagcctgggttgctgatgacttcatgaatcttcctccgttccagcacttcactacctgcctcaaagcttattttacatgagtgaaaaataaacttctaagtcatttcctaatcttggccttaattctggagagcactcctagaagcaataggtcctaccatgacttcaggagccaggactggaaatagagcccctgccactactttatgagaatttattaaaaggttgtgagactgcaaatcagtttcttcctctcctttcctttccttcccagtggttctcagatcacccagaggaatttataagacatgaaaatttctggaccgtatcctacacctttcaaattacatcccttggcatgaggcatggcaatctacattttacaagcaagttattctaccacaggtggtccatggactaagctttaagaaatcctgctttgttatcaccataccagttccctaaacccagatggtgcttgtttcataggctaaaatctatcacctcagtgggggcagtgaagcttaatcgggcaaggcaatgcatttattatttcaagtaacatgtgtcaagccctgacctaggttttggggacacaaaaacgaaaacaaaaaacaaaaaacaaaaacatacttctatgctgtacaagtcgctgttattttgggtttctatattctagagaaaaaaaaaaacctaattgtaatgaatgcagtgatcacagtccagattgtgttaaggtaaagatgacctaaacaagaatctgagatgactctaaagaagagaagacaagcatcaaaatgcactattcaaaatgaatgcattagctcattcattcatcccacctggacagagcatcagtttaagagattcagagtctggctcatggtaaatgctcaataagatttcaacagcaaggagctaataatttggataacccaatggtccttttctctgtagcaaagtctacactgccaaaagaggcattcaacaatattgaatgtaagtttacatgaatgattgaaactgctgttactgattatttgatatatgaacttggtatttttgtgcttcacagagccatctggtaagagaggaaagcactattatccacattactgctcctctagaccaatactttcattaaggtaatatccgtgaaggcatttcatttttgaaaagaatgaagcagtataaaatgtatagtacagttaggctttactaatgatgttattaataaaaaagaattaaccacttcagctatttctatacataacatttatggtaggctgtttctgtatataaagttatttaggtaatgggatctgatattctcttctaatctagtttagttttctaataagatctgacagtctttccttttctaatcttgtctcccctggaagtcagtatggcatttattttacgctcgcagccttcctgattactaatccatagcgggttgcagaaaaaatagcatacagaatcaccatggttcctaaatagtgtatgggtgtttctcagccaaacattccaccacaatatagctccatatcactctcagatactgaattatgggacaatgcctctggttctaaatgccccaaaattcagaaaactctgggaactaaggaagtaagaaaaatcaatagtcttatttcaagtagttctccagctgtcacattgattctgttcctgggatatgcaaaaagatttaagaaaaaaactagaaagaacttcttcattatgttataaaaattataaaattttttaatcaggtgtcctaaggcaatctcaaagacaaatgtaggcacagacagcaggatttcaaatgcgatggtgaaataaccttttcattatttataaaaatgtatgatgcactccatttaaaagaacaaagacagacagactagtcttaatccttcaaatgttaagtcaaaagtccctgaattgctttctcgaatgcgcttcaatgacagaagatgaaaaatccctaatcatggatgtattgaaaccaaaatgctccaaattgcatgaaaatcctgagttaagtacaaaaggccaagtttataacatgaaaataaaaataaggtcaaatcatcagccttgagctaaaaagggaagaggccctttgaaggtaaaaaactaaacgtaacaagttcagattttaagaaagggggaggggcatcccatctgtctttactgtatgtagttctccctcttctgtaaccacaacaacaaaatcctgcctctatagagaaatggctgattctattattaaggaagtattcaagatgagcttggagcaccaggtagttccggtaagaaagaaagaacatgatcccctaaacaaacaaacaaaaatactcacagagatgagagtaggtcagaggggcacaagagccaactgaaagaggtcccaatggccaaaactgttaacaatttgaggaaaaagtaaagtagcattggattacaacccagagtatgaaataaatatccatcaatccatatggattaatacacaggtgacaagagacaaatctcccaggcagaataattccaaataaattatacaatcctccatcctaaaggagaaagaacatagctataggctatacacagcagagagtgggctgcacatagtaacttccttccaaagaggattatgaaaagagggagaaacctttacagtagagaaatataataagcactacacttcaggatggtgatcaaggtcaacatcaatagtcataaatcatgtttatagtatgtatctttaacatgatgtgattaaaatggcactgtctccagggtctttctcccccaagtctataaccctagtctaatcaggagaaaaatataagataaattccaatagaggcgcatcctacaatacaacttaccaatgttactcaaaactgccaaggtcagcaaaaacaaagaaagtctgaaaaactgccactgtcagaggagccaaggggacctgacaactaaacgtaatgtggtatcctggaggggatgcctggacagtaaaaggatgctgggcaaaaactaaggaaatctgaataaactatggaataataaaatgataataatgtatcaatattggttcattaattataacaaatgcaccatactaacgtccaatgttaatataggggaagctgctcatggggcttatataacaactctctgtactatcttctcaactgtttctgtaaatctaaagttatttttttcagtctattaatttttttaaaaagctctgaggcaagcaaaaacagaactgaacaactattccatcaggtattcattcagtgattactccatgggacaaaactgtcaacccttatgacggaagcccaaaagcatgtttggacttcaggaaaaaaggcaagaaaaaaacccactatgccagaaggcaaagataattctattccacctttggaaaactaaatgacatccagattttcttttaattaagaagtaaaacaagaacagaagagaaaatctcaagaaaaccaatttctttttatatccgactgtgagaaggaaaactatttgaattctatgagagaaaccacagtcactctctaaatcaatgatctcgaaaacgcagtcatgcaactcaggagtgaaaggttgatgtattttttaattaaaaagaaattaagacgatatttagtatgcagacaagcacaaggacctcacttgtccttatagtagatggtcacaggttatctactgcgagtgagatatgctaaggaaatgcgagagctgcaccacacagagatgtcagcagcacctcacactcttctcctgtatatcaggatgacctacagtttacctgtgcccaggaaagcaaaactacagattattcagttttgcataatcttcacaaaatgggtaagtggcttaaagatattctttaacacatattgaagataatacaaattctgcacaagcatgcagaagcatacaagtaaatactgaactgctcacttcttcctcctagaactagcaagtcttaacaagcttgaagtagactctaactagctctgataagaactaagctctgaagaaagggatggagggaggaagggaaattataaacacatttgaacttcagacttacatcaattatcataaatgataaatttatccttcagtatatagagtagtaggtctcagcctctctgtaatcacagattttttttaatgccagctagcacagtggctataatcccagcactgtgggtggtcaaggtagaaggattgcttgaggacaggagttgaggaccagcctgggcaacacaacaagaacctgtctctataaaaaaaaagtttaaaaaactggcttggcacagtggcacatgtctgtagtcctagctactctggaggctgaggtgggagaattgcttgagcccaggagttcaaggttacactgagctatgatcatgccactgcatcccagcctgaactacagagtgacaccctctctctaaataaataaataagcaagcaagcaagccaactccttccccaagagatccttattcaacttgcctggagtagggcccatgcatcatgattttttacaagcaccacaagagtctaacatgtcaccaaagttgagaaccactggtatggtgtcttatgctattagctaatgacagtgtaaagccctcataaccagcaatgttactttaaaacatattaatttcatctgtatctcactctttttcattgctgttctctgaaaattttatatataaatagcaaacaataaattatttgtggattttcataaacacaaatgaattcccctttgaaaattgatatggtatgagatttgtttaggaaaaaaactgaagcccagtattgtaaatgaaattacattataataaaacacaatttacaatagaaaaaatattaatggcaagttatcaagggtttttatgttctgtttaaaaaattactgaaactgatataaaatgaatattagccaaagcacatgccagtcattataacagttattttgccaaaggaccaaagattattattacgaatatctcatccctaaaaagtatttcaattaaaccatgaaaattctagagtactgagtttcgtattcatattgcacaaacttctatatttaagcacagtatttttttcaagtgtgcatagggaaatcaaaagtgtcaagtcaattcattctttgaggaaataaattgcatgtggacaaagcagaactattaaagtgctctgaacaaatattccataccagagtctattaaaataattgaattaccaatggactaaaaaaattggtaagtcacatataagaaattgcttcagagaaagtaaacaaagagtagaaataaacaggtacttccttgagaaatctttcttgtcctctcccaagagtgaccaaatggtatatgccagttgcacaagcataataacaaactgtgtccccttccattcattcgcagactgccctggcttggataataaattatataatcactgtatccttcatcatcttcgggtttcgcctcatccttctatttcagtctccagcaaaacttacttcaatgagatgtacatcctaccatatcccataaataatgctcatcagggtcaccagtgacctcttctgtaaaactcaatgactaattctcagttctcttcttgcctaatacatctcggcagcataacagggtagatcaccccttgaatctttcttcttgaatgatcagggatgggggcggtgggggagaaaggagggggacaggaaataaagtagggagagagttgtgtggttgcactttgtgaaccatctccagttttattagattgttcttgagctatcatgatcaaaacacgatttaacgatttgaaggcaagacaactggcttttgctgctgttgctattgtcctttctagtacccttcctggaacattttgtatcatattgatttaagcgtagtactcagggcttcaggacatagggccatcgagttttaggagggagtgatttcattctgcggagaatcactttgggcaagcaatccccccatcccttgacttgaggaaaacactctctattggttctccttctgtgtgactgacccactccttctcagccttgtttgctgcttattccttatctgcatagaaagtactgaataaaacttgttgaataaatagtgaatatctctagcttccatatgtaagagtgcccagtgccccagatgcagatctttggaccttttctcaatctatacccactccctaagtaatcccctttagtctcatggcttcaaatgccgtctataatagtgacttccatatgcaagacaccaacccggggctttccccctgaactccagaactctatgtctaactgcctattcaacaattccacttggagaactaacagacatctcaaactcaacaagtccaaatcagatttctgaatcttctctccatgcaaacctgctccatccacagtgctgcccatccaagtaccatatctaccaccgacgctctattccccgtgaacagttttcatctctagactgtataaaacagccctctaattggcctctctgcttctacacttgcctctcttatactctattctccacacaccagccagatggatcttgttaaaatatagtcagaggaagttatttcctggttcaaaaacctccactggcttcctttcacagtaaaagtcaaattcctcacaaatcacctacaaagctctacataacctggcttctctctctccctactttatctcctatgtccctccctcctcccccacaggccccatccctgcgacagacacactgccctccttgctgctcttaaaacatacagagcacaatgccaccttttagacttactgtagatagccacatattcagttaatgccttactttccgtttcacactaattccttggctctctgctcaaatgttagttatcatagtacttccctgagcaatctatgtaagatagaaacaccttcgactccacactagcactcactcttaacctgatttgttttttataataaatttatcaccagtttgttcattcaatcttttttctaatgtctgtctccccacactagcacataaattcctggatccattacctaaaactgtgccacatacacagtaagcactcaataagtatctgctgagcggcactttcagcaatgactttatgtccacttacaataaatcaattccatatgctttctctaaaaatcaagtgactcgtccccaatttgaataagtactcttcccttggttgcttgcccaaaaggattctttgcagaatgaaattactccctcctaaaactcagtggccctttccaggtcctgaagccctgagtactacacttaaatcaatatgatacaaaatgttccaggaacggtattagaaaggacaacagcaacagctacagatgccaaatggcttcccttcaaatcgctaaatcgtgttttgatcatgatagctcaagaacaatctaatgaaactggagatggttcaaaatgtgcaactatacaatttcaaagtttgtaaatattttctttgagaatagattaagtatttttgaggtaaatagatgtttaggcttactacctatatagtgaaagaaatccatgtaatatgccttgggccctgcaaacctgagcatatatctagttattgtcatccaacctttcaagttgaaagtgtaaagagattctgaatgatttaaatcagtttccatctaagagcattacctcccataatgcaactgtaatgggtctgtccaagtttactaaacctaatattataaaatctatgccactataaacaaaatgccccaataaattctcacaagaatctatatatgttagaaatgcatgagaaaaagaacactttatattttacaactagtaagcttctgctctgtaggaagtggggggaagtgcaagtgaaacctgacaaagttctgagtctttcttgacataaaagtagaaggctatagcaagaaatgttttctttctttacgcttacaaaggttagccatattcttgttgccaataaacacattctcactataaccaaatgaatgaagttgagttctttatcttggcacactgacatctctggattgctggcagagttcaaagctgctccatcaactgtcccttgccctgcagacatggggcacaataaactgtgtctcctgtcaatcaagaaaatcaatcactgcctagcaaactgtagatgtaatgccataaccctaagggttcatcataaagtactaaaaattatagtccatcacattagttttgacatgttgacagcagggcccacaatagtctttacacttgaaaagccggttcaacacacttcctgaaggcagactctaagtttggaatgcgcttctaaatcaaacagaaagcctgacttttatccttaggctactcctgtaacctcaacccatgtccacccatatcaaaaagcacagaatctcttcatggcaagcagtagaagaaaggccaaggaggttcaacatggcagtaaatactccctttgaaaaccctttctacttaggtttggttaggtttgatgagaattattttgggaagaggtgggctttaaagctttgtgggcttcacatgtaataactgtattcatccattcgcacactgatatgaagaaatacctgagactgggtaatttacaaaggaaagaggtttcattgactcgcagttccacatggctggggaggcctcagaaaacttacaatcatgaaggaaggcaactctttacaaggcagcaggagagagaatgagtgccagcaggagagagaatgagtgccagcaggagagagaatgagtgccagcaggggagagaatgagtgccagcaggagaaatgccagacgcttataaaaccatcagatcttgtgagaactcactatcacaagaacagcatgggggaaaacacccccatgattcagtcacctcccagcaggtccctcccatggcatgtgggaattatgggattacaattcaagatgagatttgggtggggacacaaagccaaatcatatcaacaatactaagaataaacaattatactatgtagatcttttctttctttaatattccttaaagaggactttgactcgagttataccaatacatataattaaaataaatacacatgctcactttgacagcacatatactaaaaatataatcaaaataagtacaaattaagctaaattagacatacttaaacaacagtctgatgttccccgagacctacagtttaagaggaaaaaacatctgacaattacttggaattagagtttaaaaagcacttttaataaccttctttaaaggaccttctttaaatgatatagattacataacacactatgtcatcgaagtacttctgaacagaagtcattttattcactcagttttttaaaaataaaatgtaaaaatttaaatgcaaaagacctgtgattcacgaatgacttctgattacacagacacaatccaccatatcaagagtcaaacccatactgaaggaaatcctactaaacccaaaacaggcaaacattttcatctcatgggcactgtgggctttaagagaaattaagagcaacttctgctatcaacaggaaaagctttgacaccaactgatgacttacactaggccacagataagtactctggcaaatgataccacctcagtctcagtgtcccttaatcagatccaggtccaggtgaagtaaacagaacaagtcaggtatctctacaattgcatttctttttcacagagattatatgtcaccaaagctggagtgcagtggcacgatctcggctcactacagcctccacctccaaggttcaagcaattctcatacctcagcctccggagtaattgggattacaggtatgtcccaacacatccagctaatttttgtatttttagtagagatggggtttcaccatattggtcaggatggtctcgaactcctgatctcaagtgatccacccacctcaacctcacaaagtggtgctatcaggtgcgagccaccacatccagcctatataattgtgtgtgtgtatacatatacatacgcacaaaaaaaagtttgctaacaaagagtattcaaaggttttgtttttaataaagaatggaaagaacacaaaagcccattgatacagctgtgctatgtcccacatagtgaaatagctatatattacctaaactacaggaatatgggaataaacatggaacattctccaagacaaaaataagtaggaaaggagggttcaaataacagatgatacattaccatttgtgtaaaaaaaattttttatacgtatatttttacacatatatcttttcatccttagactatccatcaaaagggaaaatgttaagagcacaatagtgaaaagaagcattactctgcatatcttactcttgtatcttattaattttgtacttttttaaaaaatttatttatttatttttgagacggagtctcgctctgttgcccagactggagtgcagcggtgcaatcttggctcactgcaacctccaggttcaagcgatttatcctgcttcagcctcctgagtagatgggattataggcacgagtcaccaagcccagctaattttttatatttttaatagagacagggtttcaccatgttagctaggatggtctcaatctcctgaactcatgattggcccgccttggcctcccaaagtgctgggattacaggcatacaccaccacgcctggctattttttttttttttgtatttttagtagagatggggcttctccatgttggtcaggctggtctcaaactcccgacctctggtgatgtgcctgcctcggcctctcaaagtgctgggattacaggcatgagccactgcaactggctttttttttttttttttttttagagacaaggtctcaatctgttgcccaggcaagagggtagtggtgcaatcatgactcacagtagcctcaaactcctggactcaagtgatcctcctgcctgcctgtctgacaagtacctgggactacaggaacatactaccacatcaagttagttttcttgttgttgttgttgtttctgtagagacgaggtctctatgtcaggagtccccagctccccagccgcatcccagtactggttcctggcctgttaggaactggctgggcagcaggaggtgagcagtaggcatgcaagcattaccacctgagcttgcataatataatatactatattatatagtatataatatagtatattatatactatataatatagtatattatatactatactatataatatatattatgtatattatatataacatatataatatatatattttatatatataaaatgtataatatatattatatattatatatattatatattatatattatataatatataatatatataatatatatactatatataatatatatcatatatattatattatatattatatatataatatattatatataatatataatatatataatatattatatatataatatatattatattttatatattatatatataatatataatcaatatatataacattatatattatatattatatattatataatatatattaattatatcatattatatattatattatatattaattatattatatatattatatattatattatatatgatatattatatatcatatatattatatagtatatgtaatatattatatagtatatgtaatatattatatattatatatgtaatatgtaatatatgtaatatattatatattatatatgtaatatgtaatatatgtaatatattatatatgtaatatgtaatatatgtaatatattatatattatatgtaatatatattatatatatgtaatgtatattatatattatatgtaatgtatattatatattatatgtaatttatatattataatatataaatatatgtgttatatatttattatataatatatatgtgaataagttatatatatatatatatgtgaaacaagtaaaatagaagagttcctactgatggaaagcgacctcccaagcaatgtatcccactcctaagaagttgctggccaacaatccttaaatgttaggctagaatataataaaggatcactaaaatgatagattgtttgggtttcagactacaagtaaagcaaataatttgtgcaacactatctagcatcctttcttcccaaaaattattaaataattcatgctgatttgtctgcgtagattggaaacttttaagagactagagaaagggacttagaaccactaattccctaaacagcaaaaggagatgcaactcactctaaacaccatgtaggggttttttcctctgctgaaataagttatagggaactcagaaaacatttgttcttcaaagcttaggggaagattttataaaacagtgttatatttaagaacttactcatatccatatccatcctaattcctaattctattcatctttttaaattacttcttgacatacaacagttctcttcatcaatagttactagaaatgaatatagaaaaggtgttaacatgtcaaaaccataccttaggagagtagaaatgaaaagcagaaagggaaaattaacgttttctatatttgcctttggatcagataaatgtttatactaagtctgtactacattcaaaagctttgttaaaaagaagtgaggataggaaatttatgagtaattacagaagattgaaacagattggaaaattattaaaaggctgaggtatacttcaaaatatttccgttctgtcaggggaagaagcagcagcacaccagccacatattagttaaaggaaagcaacgttgcatttgcgttcattcagtcacagattgatttgacactcgtttatgaaacttttaagaattttaacagcaggagcaatgtactttttaagtcaatagcttcagcactgaaattatgagaaccaagtatatcaaaatagtagtagttcaacaaggaaaataaaggggcctctttcttggaaaaaaaattgaagataaaagataccaaaattacttgcctcaattaatttcagaataaagttataaaactacatctctatatatacatagtgtgtatataggtacaacatatatgtctatatatatatattgtgtgtgtgtgtgtgtgtgtagagagagaaagaagattctcactctgtttgtgctgctataacagaatacaatagactgggcaatttataaagaagagaaatttattagagttctgaaggctgagaagtccaagatcaaagcgccagcatcaatgtctagtgagcgccttctaggcaaggccctcatgacccaagcaccccatctctcaacactgccatgttggaagatgaattttccaacacacggattttgggggacacattccgaacagaacacatgtacctaatatagttttgaaactgtaagataattcaacaatctagacatttatattgagtgaggaagtacttcttaggcaaacaagcaaagcaaaaaatcatcactgacagtctcagttttgttactagactcagcttttaaaggcaagagcatgtgttcatttctgaatccctagcaccaagcaaactgcctggcacacaacagatactcagtaacactcatcaaaaaactgatcaatgactgaacagacagcacatcctggtttgacagagactgtgtcagagaccaagtgtccagctccaccttggctctagtctagcaggctgatcctgattctgtgaacctgtcaggaactgtcatagttcccagatctttgttatggtttttcctctgtcttgaatacctttcagaatagtacagtgattaagtacacatgaataagaatagtacagtcattaggcacagtgattaatacaatgattggaatcagacctagctcaaatccaagttttctcgtttattagctgccttactggaatatttgggaaattaatttaacatctctgagcctacaaagtgtggactatagtaacaggagactcagtgagattatacttatagagagctgtatagtgcctagcaatgtaagtaaatattcaacaaatgtagattcctgtccctgccaaagacctacctatctttcaaaaccaacagaaaatactttacccccctcccctttccctacatcttttctttttacccattaatcattttcacctgccaaccatggtattcacaattccgtctaataataactatatacatctcatttaacagtttataaatttcagatatgctgaaaacataatttattcatcctattagcttgaaaattcaacgtaagacctggcacaaagaagttatacaatgaactgtttctaacataacctaaaaaagccattcattgtgctgtttcctgtgtcatgaaaatagttacccataaaactaaatgtgtgcacatgcacataaactaaaccatcacaatttcggagtgttctaaatttctttccacttaatctttaaaactttctatgtcaatattgcacaacagaagcacaatattgcttctaacgatactatactctgtatgaacagaaacacaatcttaaaacagatgggcagatgaacggacagatacatagagacagaaagaacaaggtataacacacttactatcagcatccctcacttaatgaagtatatgatccaattctaaatcagctagaaactgaattttatttcttctcatgatattcattataagttagacaatgaatctaaagaaaatgaaacactcccacacttgcagggccagttaataataaaaaacacttataattgcaaatccctggaaggtttccatctaaactgcactcctctaccattcttccactcacacccacacctggaaatgatctcggccaacaaaagggaacatacaaagttttcacacattatgagacacatatccataattttatgaataaacaatgtggctaatcaactctctacttacaattcccttactttatatgtagattatttttaatattacaggaatggattatgtaatctgctgggttcccaaatcctttgtcaggtcctccatctttcagttgtctagcatctatgaggactttgctgctcattagtacatctaccaaaggcaatgaaggaaaggaaaacaaacagaaacaaatctttcattttgttcaagtgagttcttacatcttttttagatgtatcatcaatttaaaagtgaaaatatttacacattttaacatctctgatgcgcattctagaatacatttagaatgcattttagagtcaatgagatcttagcacagtgtgggtgtaattggcaattgttgttactttcttagtggtacataaaacaatgacgtatcttataattaatggcatcaaggatgcaatttaaaccagtatttaagctatacttattatttttattattttacaccaatatcatgaatatttgtgagttgtaatgaggtttataaataaatcaaaatttgtggaattaagatactaggataaaagatatcaaatattaacaaagaataatcaacatgttctctgcttttctaacaaaagctaatgtttataatatttaaaaaccatgatttccttataatgtcatgaaaaagcaaatgatattgttattaatgctttggatccaatgaagaacacaggcccaaaaatagtgtgaagaacaacagactgaagaaaacacccaatgtgccaaacgcaatgagatcacagggaaggggaagctgtcccaggggaatggggaaggagtcatagaagagtcattctagcagtactggaggctgagttacagtgccctatgtggaggaggtaggatagtcccggagaaaacaccatatgcaaagagtcaaaacgcatgaaaagtggccaatactgtgaatggggaaaaagaggtaatgacagcagaaaacctaggagagaggtggtggccacacagtaaaatatattttaggccattttaagtaatgatcaccagctccctctccccatcaatttcagctggaagactcaaataaatgattttttttaaatctccattttgatatggctattactggccttattgcttagagcaatgtcaaggtgctacatatagccctaacattgtcaatgtcttctttagatttgacacactagaattaaaatgaaatcactcttaacattatttttgctaatcaactcatgttctcccacattatgattcaggagctaaggcttctaaaattacagacttctcaaagaagctaaaaagaacttgtgaataagattatgaatgaaatctaagaagacacgttaaatctgctcccaagtataaaagccaaagaatttatccattagcatctgaataataagtgccaacacagcaagctgtcatctgaaactcttggcagttccttcctttgagccctgatgaagcaggagccataaggtatggatgtgtaaggagataattagaattctcatttcccccaggtattgtcagccccaagagaataacaaggtgttattattttattacacagtaagttctactgttacataaactgtataacttcttacacaagattattatgtatcaagtactgatctcattccactaagaaagaagctcaactgtgagctgaatttttatctcctattcactgggtatccctagtacctaacacagagaagctcagtaaatatccagtaaatacaagtaaaaagaaaaaaaaatagaaatcaaagtatcatatatgcactctttcatttaagccctacaaattatggggaaaatcctattacttttcctatttgccaaaggaagaactaaggcttgagaaggaaaataattgaccagaggtcaccagtggcataacaaagccagactactttaagccagtctcctgcttaacctctaggctgcccctttcctatctacgtggatttccttgatgactacacttaatgcaaatctcaagaggtctgtagcattaggtttagagaaaactcaggaaaggctaagtgaaagattctcagtaacccattagcaaactgagtttccagcagattaacacactacctatgaatctttaaagtagaaaatagaaaattagaggaatcttaagggcagcagaatataccactccaaagtatgtcacaatgttcaatgactgttttgagctaaaggcaattgagaagaaacagatacacaaaaagctctccgctttctccctatttgcctaaaagccagacataaatttataaaggtgcccctcttcccttctctatcagaaaggacaagtaaatcaccagagatgacttctgacccttatcagtctagagagggcgccagagaaacctctgtccaaagtacactaactgccattactttgtttaccattagtctcccctatatttatacctccccagaatgtgtacccctaaacactcaaggttcttttccattatcatgtccccctgtaaacattcatcatttttgggggaagatgctatataagccatagttctaagccacctcttttgagagttactctttccttgagttttctcccttataagatatacacaagttaatgaatctttttctctcttgttagtctgtcttttgttacaaaggtcccagctaagaactcagaagggtagagggaagattattttcctcccctaagaacctcagagataaaggacaattttggtggaaaatgcggttattggagtatcttaaatttttctgattactaatttgtttctatttctaccctattattttccttctattaatcttttaaaagcatttcccaaattatatccaataactacattatttggatttttcaaagtaatatttcatttcattaaatctaaaccagaggttacgagagaatgtttcaagtaataattttccacacaactaggccatgactgccacctggctgacagtgattgcaaggtgccatccaattgtaggaagcttaaaatatgacagaaaaatgtgtctctaagaatccatggaaaaagagaaagagcaagagagtatctcaagaacagaagcatcgtgcttctttttaagagccttacaaaaaatggagtactaagtagaagctcaataaatatcaattgaaaacaattattggtttgctttgaaattctgcatatgtagatgacttcccttttaaaaaaatatttaatctataatatctaaggtaaaaaatgttcaacagaaaagtatatctttttaatatttttccatataaactggaaaaaacgagtcatttctaaactcttagatgtgttgacattttatgagagactgtatatttaaattaaaaaataaataaataaaatggaaagaatgcacagcagataaagattacttcacacaaacatatgacttagtgcttgggaacccctacaaatgccgaaaggtttcaatggaaaacaaaaaaataattttacttgcataggctatggagcaggccctcactgttggtaattgtaattactgtagttaatttacatactattataatttatatactatttagttaatttcatattatagttaatttatatactattctataccatgtgcatgacaaattaatcttcatgcacactttatcaatataaatcaacaataaacaaaacacatcaatataaagcttgatgtccaacttgattttcttcaaacgtgtgtgtttgtatttgcatcaaacaaaaataaggtagagctataagaactttaagttgtcaaaacaaagtaaaaatggtctctagtaagaaagcaaatactttaaaaggctgatatagtgctaaggttatacatgcaaggactttctcctttttctgtacaacttttgacagagggaggagcaaagagaatagtagaataagaatcaagcatatgagaaaacaaaaaagtttgcggtcagaaatttcagcaagggcactgacttaaaaaaactggagaattatctacaaaagattttgataaaactatatataacacaagctcaaatggatctgaataaattttggggaatataccatataaggaggagtaggattagacaccttgtgattaggctgaatggcaagtgacatgtcaattatggaacaggaagaaaaactatccacaggcccatctctggattaaatatactctttcttagtaccatggggcagggcagggcagggagagaaagcggagaaacagaacttgataaacacctgttttaggggccaaaaagcaatataaaagaaatcacagccgggtgcactggctcatgcctgtaatcccagaactttgggaggccgaggcaggcggattacctgaagtcgggagtttgagaccagcctgaccaacatggaaaaaccccatctctactaaacatacaaaattagccgggcctggtggtgcatgcctgtaatcccagctacttgggaggctgaggcaggagaatcgcttaaacccggagggtggagggtgcagtgagctgagattgcaccactgcactccagcctgggcaaaaagagcgaaattctatcttaaaaagaaaagaaaagaaaagaaaagaaatcacagacctagtccttatctttggctaccaaatgggaaaatctcacaagtccaaatggactgagtctaaccacgaaataatatcacggattcagccattacaactctctagaattttctcatttcttctccattaaagagcaaagagtagacacagatgtaaaactggacctgagttccagttctgccagtagttgaacctctgctctgtaagagctgtatgacagatctgtctgcaggactcaacaaataagaaacgttcagtatacaactgtagctttttaaaagtcagtcctcaattttctcatagacttcaattttctcatccatctgtttattcaacatgttttagcatgcttggcatttttatgagctcggcataagggcactgaaaatagaaatattctacctgccctccaacagcccagagtttcgtgggagacagaccattaacacaaggttgtggaagagaaataaaggcgtaagaataaacctcaaactggcatagcttcagcgccaaagtcatttagccaatctatcccaaaactgttcataaaaattggtattaatctaatgagataaataactcctacccatttctcaatgtataactaccaccaaccatttttaataaattagaatatctgcataaaattaattataaaattgattcactctgtctttatttaaaaggattacagacaaggggaaaatgccatatacctgtatcacagccagaatcttttttagataatttctcaaataccccactgttagcaataaaaattcatgggtcttataaaatgtattaatttctaatcatgaggcctgtatttgagattttcttaatggaagaatctgtatggatatagagttagctcctttatgacttagctccttaattagtagaggggaaagaaggctcttttgcactaagaggaaccacctacatggcttcaacttggttgtgttctccagagaatgtttctgagttactgcttttttttttatgagacgaagtcttgctcttgtcccccaggctggagtgcaatggcacgatctcggctcactgcaacttctgcctcccgggttcaagcgattctcctgcctcagcctcctgagtagctgggattacaggtacctgccaccacacccggctaatttttgtatttttagtagagacagggtttcaccatgttggccaggctggtctcaaactcctgacctcaggtgatccacccacctcggtctcccaaagtgctgggattacaggcgtgagccaccacgcccagcaagtcactgatttcttaggaacattatgagtaatctcctggaaaaaaaaaaagttcatgtacaccaaatgtacatacaaatgtaagaagtaactttttctttaagaaatatatatgtattagcacctgcattgctataaagaaatacctgagactgggtaatttataaagaaaagaggtttcattggctcaaattctacggctgtacaggaagtatggtggcatctgcttggcttctagggaggcctcaggaaacttaacaatcgtggcagaaggagaagggaaagccagcactttacacggccagagcaggaagaagtggcagggaaggtgccacacacttttaaatgaccagatctcagaacttactatcaggagaacagcaccaagggggaaatctgcccccatgatccagtcacctcccaccaggcttcaccttcaacactggggattacaattccacttgggatttcgccagggacacagatccaaaccgtataaatatacttagtgcccatttttccctctcaaacaattcaggtgtgccagagcaatgcaagtgcaggtgtgcgtgtgtgtgtgtacgtgtgttgaagggtgaggagggagccacccaggcccacagtgaggtgtcagagccaatcaagggtgaagggggtggggttggctgaccatgggatgtcagagctccagtgggagcgggaagaaaatgtcactctcattaagccatcatggggattaagtcatatggacagtttagcgcaatgtctagcatagagtatgtaaacccatggggtaggaactttttacccgttttgttcaacactgtagtctccgtgcctaggtaactactaccttatcaacgttcaatcatatttgacaaactggtaagtttcagtgttaactctccactcaataattggaattacgataaggtaaaaggagttagagaagaccaaaaaggcacagtgagtaaaaaaggaaaacagcagggactccccctagagcaaagaggagctgacttcacagggaactcttctatacactgttgtggtgtcttctacctccgagtatgtagtaagaagcattaaatgcctgtacttccctgtcccataagagccggaggggatcacccagatgaggaagagtgatatataaagtgctagttgaaaatatagattgtttctcaacccttctccctacctgtggtccaagagaagcaaaatagaatcccaggagaagggtaatcacaatcttgaataaggacttaaaggcagcaggggtagtaaagagaagcaacatctcaatacaaccaacggccacatctggccagtgaaaaagactaacaggagttggaggcttacagtgaatgctgatcacctgaattcagttgttgctgctagagtcccagctattctagccactgcaactgtaactgaaaccactgcacaggctgctggcactaagtctgaggtcctgggcattaccaacaccttgtttttcatcccacaggtacctgaggaccaaaatccattttcatttacatgcaaggcctccaggtacttccaaacgggaagctacactctttggggctatatgccaagagggagtagagtcaggatttcgtgccttgtgacatctaaagttttcactacagaggagagcccgttggtaaacaagtcagaagcctcactttcaacagtcctgactgtggtgttaccatacctctgcctgaaaaggaggctgagaaactctcacagtgtacaagaatcttcccaagtaaaagttcttgggactatgaagacagttttctgctcaattcctctggcagttaaggaattctgctgtcttattagtctctttgggtacaggaaacagtatgtacctcaccttggcattctacttggtgctttactttggttagtttgcaaaccagcaaccttggagcatagcccagagtccccattggaaaccaaccagcaagctgtggcacactctcaacctctggcactccacagactcacgacgagtctctacgatgagttgggaatctaagtatggagtgaagggagatgatctccaaccagcagcaacctttggggttctgggctcatcacctccctgatgtggctgccaggtacatcccttttaaaaagcagctatgagcttgctgcttggctcttgtttaaactctccacctaacccacagaggccttgtgactcacttgcctgatagtcccattgaaggactctataaatatcaaggtgggtaggacccaataagcctagcttatcaaatagaaatgataccttcaaggaccagctagcctactcccagtggcatctcaactttaccttaaaaaagtggcagctatccctctggggaaaactatccccccttccccgccggccccaactctggcacctgaagcaaagtcattggctcatgcggccatgggttgcctgggcttggttcattgatggttcagctaagttgaaactcaatgttcactggactgctaaagctgtacaatctcagtgctcaactgtgcagaaatgaaaatagccgtggtgtttctgcacagggaggcaaagcccaaagccactctcacagctttggccaatatttgacttgatgtacattatatttctactgactaaaattattcctagtgttctatctcaggttggcctcattctgctgcttggactattactgataatgcccttggttaaatttcatatgagacaagttgaacagtctggtctgagtctctgtcaatccaattaatcagagtggctgacagagtggggtattcaggttaaaattcttcagaagccaggacagcacaggagtaagtgcagatggtgttgagaagtagttctctatgggtctctcatgtttctgtatgtcttgtgaggtactgcccatttttgttccagatcatcttttcaaggatagcttagaggacagagacagtgtcagctctggaggaaaaggcagccatgcttactaaagataatgtctccttccagggcatttacttaacattatgaaaaattcaagagtcataagctctgggattgtctcaggcagccctaggtgtcatctgactgtcttcccatcatcctatgggaagcaagatccagaaaactggcccaaaatgctgctgccactgctgtaagaaattgtccttcatctctgactcaggagtctcatgtcttccaccagtatccatgaaattgtggctgacttattagtttgcaagaggggtaaaatctgaagcgattccctgttcttgacatttatagcatcacatatacacacgagagtattttatcatatttttaggcataagaatgagctgcaagtaaccatttatgaaacccctgaaaaagttaagaaaaatcttttatttttttttttttagatggagtctcactctgtcacccaggctggagtgcagtggcacgatctcagctcactgcaacctctgcctcccaggttcaagtcattctcctgcctcagcctcccgagtagctaggattacaggcacgcaccaccgtgcccagctaatttttctatttttagtagagatggggtttcaccatgttggtcaggctggtctcaaactcctgacctcatgatcttcctgcctcggcctcccaaagtgctgtgattacaggcgtgagccaccacgcctggcgaaaaatcttaaacttaataatgcatcctcttctcctctactcagcccttccccctacccacaaatatcaccaatatttgtaaatacctaattttattatttatatcatgctatttgaactttataaatttctaatattttattttcagctatgaaacaaacaagagtgaaattatcattaagagctgaagaacattagtaaattacaaaagacttatttcaaacattttcatggactaaaaaatgcaccgatacctaaaatattgtctcttgggaatttgtagttgttttaatatgaacttttctcaaaatctaaaattctagtatatgctataaacactatatcagcagaggataaatataatagcagttgcatttctgaaatgtttaagaataccatggtttctagaaatagtaaacatgtcagaagaatacatattcaggcttgcgggtagaaaacatatgtctatgtcaacaagactgctgaaaatgatagttgattttctttccttccataagacaatattaactatcccacaaagcacagacacttttgttcacatcataaactaccaagtcagaatatgtgcgtgaacacagccatggaataatatgtcttagtaaatgccagttatcattgtcataaatttctaacagttcattataaacaaaactcaggaacaagattcaaaattatgttattttaaagacaggtcatcattcatgattgatttctgtacaaaactgaggtagaggctattgtatagtagtaacttttaaaccctgtaagaaaaaacgattttcacattttttgagttttttcaacacaaaggcaataaacatattactaaaatccaagacattgtatcatttcatctgtaaatatttcagcatgtattaccaaaggagttcttagaaaaaaaatagacacactattaccacatcaaaaatgaacaataattgcttaatatcaaacatccagaatgttcaaatttcctgtcacatacaaaaaaatttttatacttcattcattgaaatgagaatccaaagaaggcccacacatatgtctcttaaatctcttttaatccagatttctcttccatttctttgtgttgttttccttgatgtttatctgttgaaggaactaggttgtttatcccacatactatattttgctgattttatctaatgatatcatttgatatcttcctctactccctgaatttcttataagctagtagtttgtgtctgttgtcaattttttgcctccagatataaatccattcttcctagccagctctgcaagagtggggttgaacttggaaatatttctcctctgatgagctatcccagtacaaggctttgtcactagaaggcagtggaaagacaagcagaaggaagagcttctctttctggttctagtgtatttgtctctctgggcttcagcatggcatacagttccttacagccgagctgaaaagccagcatcaaccagcaccttcccatggacgtcacacacacacacacacacacacacacacacacacacggccagtgtatccctcttgggagcttccacaaccagtgccaatagcagggcacttcaccatcaccagcctcccccaactcaaccccatccccaggaggttttgcaatagagcacaggagctgccacctgcctttagacgacctccctggagcccccaatggctgtgcagcagagtggcagtgagtagggattgataggtggttttccaccgacacccaccatcaggtgtctttgaagaagggtgccaccaggtaagcacctccatttgaacaaatcctctgtcacccacccatcccagagaataggctgactcagtaaattccaagtcattgcatcttcctgtgaataccttccacagtactcctgagcatgggtttccaggcagcacagaacctcggccaactacccccagcagtaagccacagctgcacagcctccacccaggctaggctctcagccctgagagtgggtggtctcttccttggacactttcttccatgctggtggtggtgactgctctccatgtatctgctattcctatacatctttgcctcttattagttaatccacctactccactcccctagtgaccattctttagatgaaactttccatttccaaataactgtatggtttctgtcccttatttagaccatgacacatattcagttaaatctaaaggcttaatcagactcaggcttatttcctaagtcaggctgagtacttctgtcaggaggcaaaagtctggttgtctatttttgttatgattataatctagacatctatcattctgttagcggttaaaattctaattctagagggaggggccaagatggccgagtagaaacagctgcggtggaaggctcctatcaagaatgaaaacgatgagtgaatcctgcaccggcaactgaggtatccaggttctcccattggaactgactagacagttggaatgaactacagagctgggtgcagcgacagcccacccaggaactgcacagggcacagggagctcccacccttagctaaggaaggtgggaagtgattgtgctgccccacttgggaaaccatgcattttccacggatctgtgcagacggatctgtgcagattctcagtggctgcctaagactgcctaagactaccgaggtcctgaggggaaaggggaggccaccatcactgcagatgcctgctgcctaagacaactgagctcctgggcggaggggaggcaacaaccatcactgcagctccagtctgccgttttctcctgccggtgccagggagactggacggtttggacccacaaggaattccccacagtgcagcacagcgggtgtggcagatcatggccagactgcctcttcaggccaaatttggacccatcactcctcaccaggcagggcctctctgcaacaatctcagcaactccagccatggatatgtgaacagaactctgatatccttagtacagagcctgtcagggaagggtcagccatgatctccatggatcagcagacttagtctttccctgctggtgctgaggaatctgggcagtccggacaagtgggattcccccagagcagcgcaccctctccaccaaagggcagccagagtgctttgttacacaggtccttgatcccatgcctcctgactgggtgagaacctccaacagcggtcgccagacactttgtacaggagcattcccactggcatcaggtcggtgcccctctgggacagagatcccagaggaaggagaaggcagctatctttgctgttctgcagccttcaatagtgacacctccaggtgcagataggacccaggcaaatagggtctggagtggaactccagcaaacctcagcagccctacaaaagaggggcatgttaaaagaaaaacaaagagaaagcaaaaacaagaacatcatcacaaaaaagtccccacaaaaactccatccaaaggtcagtagcctcaaagaccaaaggtagataaagtcacaaagatgagaaagaattaaggaaaacaatgctgaaaactcaaaaagccagagtgcctcttctcccacaaatgactgcaacacctctccagcaagggcacagaactgggctgaggctgagatggatgaactgacagaggtaggcttcagaaggtgggtaataacaaacttcactgaactaaagaagcatgttcaaacccaatgcaaagaagctaagaatcatgataaaacactattaaccagaataagccattcagggaggaacataaatgacctgatggagccgaggaacacaacatgagaactccacaatgcaaccacaagtatcaatagcaaaatagacaaagtagaggagaaaatttcagagcttaaagactatcttgctgaaataaagcagactaaattagagaaaaaataataaataggaatgaataaaagctccgagaactacgggattatgtaaaaagaccaatcctcagtggttcacgcctgtaatcgcagcactttgggaggccaaggcaggtcgaccacaaggtcaagagatcaagaccatcctggccaacatggtgaaaccccatctctactaaaaatacaaaaaattagccgggcgtggtggtgggtgcctgtagtcccagctactactcaggaggctgaagcaggagaatcacttgaacccaggaggtggaggttgcagtgagccaagattgcaccgctgcactccagcctggtgacagaccaagactccgtctcaaaaaaaaaaaaaaaaaaaaaaagaccaatcctacaactgcttggggtacctgaaaaagacagggggaacgggaccaaattggaaagcatacttcaggatatcattgaggagaacttccccaacctagcaagacagaccaacatccaaattcaggatatccagagaaccccaataagatactccatgagaagatcaacccctaacacataatcatcagattctccaaggccaaaatgaaggaaaaagtgctaagggcagccagagagaatggctaggtcacctacaaagggaagcccatcagactaatagtggacctctcagcagaaaccctacaagccagaagagattgggggccaatattcaacattcttaaacaaaagaatttccaatccagaatttcacatctggccaaactaagcttcataagtgaatgagaaataaaacccttttcagacaagcaaatgctgaggaaatccatctccaccaggcctgtcttgcaagagctcctgaaggaagatattaaatatgcaaaggagaaaccattaccagccactacaaaaacacactgaagtacaaagaccaatgacactgtgaaacaactacctcaacaagtctgcaaaataaccagctagcatcatgatgatgggatcaaattcaaatataacactgttaaccttaaacgtaagtgggctaaatcccccaattaaaagacagagaatggcaagttggataatgaatcaagacccattggtatgctgccttcaagagagacatttaccaagcaaatggaaacaagaaaaaagcagaagtcgcaatagtactttctgacaaaaggcactttaaaccaaaaaagacttaaaaagacaatgaagggcactacataatggtacagggttcaattcaacaagagctaactatcctaaatatatatgcacccaatacaggaggaccaggattcataaagtaaactcttagagacctacaaagagacttcgacacaataatagtgggagactttaacaccccactgacaatattagacagatcatccaaacagaaagttaacaaaaatattcaggacctgtactcagctctggatcaagtgaacctgatagacatctacagaactctcaacccaaaaaaacagaatatacattctcctcattgccacatggcatttactctaaaattgatcacataaccggtagtaaaacactcctcggcaaatgcaaaagaactgaaacaataacagtctctcagatcacaatgcaatcaaattagaactcaagattaagaaactcactcaaaaccacacaactacatggaaagcgaacaacttgctcctgattggctcctgggtaaataatgaaattatggcagaaatcaagaagttcttagacaccaatgagaacaaagagacaaatgtgccagattctctgggatgcagccaaaacggtgttaagagagaaatttatagcactaaatgctgacatcaaaaagctagaaagatctcaagtcaacatcctatcatcataacaaaaagaactagagaaccaagagcaaacaaaccccacagctaccagaagacaagaaataaccaacatcagagcagaattgaatgagtcagagacatgaaaatccttcaaaaaaatcaacaaatcagccgggtgctgtggctcatgcctgtaatcccagcactttgggagtctgaggcgggcagattacttgaggtcacgagtttgagaccagcctggccaacatggtgaaaccccatctctacaaaaatataaaaattagccaggcatgatggtgcatgcctgtaatcctggctgcttgggaggctgaggcagaagaatcgcttgaacccaagaggcagaggttgcagtgagctgagatcgtgccactgcactccagcctgggcgacagagcgagacactgtctcaaaagaaaaaaaaaaacacaaatccagaagctggttttttgaaaaaattaatataaaataggactattttattaatagtctagctagactaataagaaaagagagaggaatcaagtagagacaataaaacatgatacaggataaagccactatcgccactgaccccacagaaatacaaacaaccatcagaaaatactataaacacctctatgcaaacaaactagaaaatatagaagaaatggataaattcctaaacatatacaccctcccaagactgaaccaggaagaagttgaatccctgaatagtccaatatcaggttctgaaattgaggctgtaataaatagcataccaaccaaaaatgcccagaaacagatatatttacagctaaaaatctgccggaggtacaaagaggggctggtacaatttcttctgaaattattccaaacaattgaaaaggcgggactcctccctaattcattttatgaggccagcaacatcctgctaccaaaacctggcaaagatacaaccaacaaaagaaagcttcatgccaatatccctgatgaatatcgatgcaaaaatcctcaacaaaatactggcaaaccaaatctagcagcacatcaaaaagcttatcaaccacaatcaagtcagcttcatccccaggatacaaggctggttaaacatatgcaaatcagtaaatgcaattcattacataaacagaactaaagacaaaagccacacaattatctcaatagatgcagaaaaggcctaagataaaattaaacttccttcatgttaaaaaactctcaataaactaggtattgatggaacatagctcaaaatagtaagagccatttatgacaaacccacagctaatatcatactaaatgggcaaaagctggaagcattccccttgaaaactgtcataagacaaggataccctctctcaccactcctattcaacagagtattggaacttctagccagggcaatcaggcaagagaaagaaataaagagtattcaagacaaagagatgacgtcaaactgtctctgcagatgacatgttcctgtatctagaaaaccccatcgacccatcctgaaagcttcttgagctgataagcaacttcagcaaagtctcaggatacaaaatcaatgtgcaaaaatcacaggcattcctatacgctaatagtagccaaatcatgaatgaactcccattcacaatttctacaaagagaataaaatacccaggaatacagctagcaagggaagtgaaggacctcttcaaggagaactacaaaccactgcttgaggaaataagagaggacacaaacagatggaaaaacattccatgctcatggataaaaagagtcaatactgtgaaaatggccattctgcccaaagtatctatagattcaatgctatgcccattaaactagcattgacattcttcacagaattagaaaaaacctactttagaattcacgtggaaccaaaaaagagctcatacaaccaagataatcctaaacaaaaagaacaaagctggaggcatcatgctacccagcttcaaacaataatacaaggctacagtaacaaaaacagcatgacactggtacaaaaacagaaacatagaccaatggaacagaatagagatctcagaaataagactgtacatctacaaccatctgatctttgacaaacctgacaaaaacaagcaatggggaaagaatcccccatttaataaatgatgctggcataactggctagccatatgcagaaaattgaaactggaccctgttcttatactttatacaaaaattaactcaagatagattaaagacttaaatgtaaaaaccaaaactataaaaaccctagaagaaaatctaggcaataccattcacgacacatgcatgggcaaagatttcatgatgaaaatgtcaaaagaaattgcaacaagagcaaaatttgacaaatgggatctaattaaactaaagagctgcacagcaaaagaaactatcatcagagtgaacagacaacctacagaatgggagaaaattcttacactctatccatctcacaaaggtctaatatccagaatctacaaggaacttaaatttacaagaataaaacaaacaaccccattaaaaagtgggcaaagaagatgaacagactactcagaaaaaggcatttatgcggccaaaaaatgtatggaaaaaagctcagcatcactgatcattagagaaatgcaaatcaaaaccacagcgagatccatctcgcaccagtcaaaatgcattattaaaaagtcaagaaacaacaaattttggctaggctgtgaataaataggaatacttttacactactggtgggaatgtaaattagttcaactattgtggaagacagtgtggcaattcctcgaagacctaaaaccagaaatactatttggctcagcaatcctattactgggtataaacccaaaggaatataaatcattctgttatgaagataaatgcacacacatgttcactgcagcactattcacaatagcagacatagaatcaacccaaatgcctgtcaagaatagagtggataaagaaaatgtagcacatatacaccatggaatactatgcagtcacaaaaaggaatgagatcatgtcgtttgcagagacatggatggagctggaaaccactatcctcagcaaagtaatgcaggaacagaaaaccaaacactgcatgttctcacttataagtaggagttgaacaatgagaacacatggacacaagcaggggcctgtcaggggtggtggcaaggggaggtagagcatcgggaaaaatagctaatgcaggctgggcttaatacctaggtgatgggttgacaggtgcagcaaatcaccatggcacatgttttcttatgtaacaaacctgcacatcctgcacatgtatcccagaacttgaaaagaaattcgaatgctacttttactcattaattctaacattactcacaaggggctagtgagattcgaattctatcatgagtgactaccacatttattacctggagtatgtgggtaaggaaaaactgcctcataataatcatttgtttaccctgatgtttagtttatacaagaatggcaagataaacacttggcttctttttccttatctatcagtcattctgggaggaatttctttgtgtgtgtgttttttaaagccatagagaaaagacattgtagtaagaaatgacaatcagactgacaatttactctgcagcaacatgggaatccagatgacagtggaatactataaagtgtccatactttgatacctaaaatgaacaaaacaaatatatttacagacaatgaaagcattttttgactgaataaacctcttacaaagaatattctaaaatgtgtatacttcatggataagaaaaaaaattctagaagaaaggtctgaaaaacaaagtatagagaggaaaaaagtaaacatgaataaatcaaataagataaatctaaataaaacacttataaaataattacagtgatagctatagtaaccaaagtggtaactaagagtagcctaagtctgaaaagaagatataagagtcaaagcattctgagatcccatactttgtttagaagaaaggtaaatatagtgattgatatggtttggctctatgtccccattcagatctcacctcaaattgtaatccccacaatctccacgtgtcgagggcaggaccaggtaaagggagaattggatcatgtgggcagtttctcccatgctgtactttttatagtagtgagttctcatgagatctgatgttgtataagcatctggcatttcccgtttgcactcactccatcctgccacgctgtgaagaaggtacctgcttctttaccttccaccatcattgtaagtttcctgaggcctccccaacaatgcagaagtgtgagtcaattaaacctctttcctttataaattacccagtctcaggtatttcttcatagctgtgtgagaacacactaatacagtgattaactttatacttcaaatcaaacatccaagcaagaaattttataaggctgaaaagaatgtacacatgcaatatgtaacttttcaaacagtaaagtttgaaaaagtaaagaaaaagaaaatgaaacaagaaaataacaaataaaatataacaacaaagtgcctagaaaggaaagttgagagaggaggttttaaaaaaaaaaaaaaaatcacacttcacaccaaaggacattacattacagtaaaaattgtaaactggactttgtcaaaataaaaacttttgttctgcaaaatatcctgttaaggaggataaaaacacaggcatggactgggagaaaatatttgaaaaccacatacctgacaaaagacttgcacctagaatatagaaaaaactctcaaaattcaacagtaaaaaaatgaataatccaattagaaatgcacaaaaaccataaaaaacatttcagcagagaatacatggatggcaaataaacatgaaaagatgttcttcattagctactagggtaatgcaaattaaaccacaatatgttatcattatagacctatcaaaaaggtttgaataaaaatagtaatgatggccaggtgcagtggctcacacctgtaatcccagcactttgggagtccgaggcgggtggatcacctgagatcagaagttcaagaccagcctgaccaacatggagaaaccctgtctctactaaaaatacaaaattcgccgggcgtggtggtgcatgcctataatcccagctactcaggagcctaaggcaggaaaattgcttgaacccgggaggcagaggttgtggtgagccgagatcgcaccactgcactccagcctgggcaacaaaagcaaaactgtctcaaaaaaaaaaaaaaaaaaaaaccagtgatgatatcaagtgattcagagggtaaagaaaaactgcatcactcatacatcagtgagtgagggtgagaatagccactctggaaatcagtatggcagtttcttaaaaaaactaaacatgcatctaccatataacccagcaattgcactcctgggcatttatctcagagaaaccggtatgtgaatgttgacagcagctttactcgtgacacccaaaaactggaaatgacccaaatccatccattaaagggccaatggttaaacaaataatagtgcatttctaccatggaacactgctcaagaataaaaggaatgaactattgataggctgaacaacttgaatggataccaagagaattatgctgaatgaataaagataatctcaaaaggttacaaacagttggttccatttatataaaattcttaaaataaaattataaagatagagaacggataagaggatgtcagggattagggatggagggggaaaagagaagagtatgtgaagctataaaggggtaacataagggagtctggtggatgtatcttgatgaggtacttacacaaatatacacaagataaaactgcatagaattaaacacacacacaaacgcgcacgcaccccaaatgtatgcatgtaaaacgggaaatctgaataagctatgtgaatagtaccaatgtcaatttcctacttttgcaattgtactgtatttacacaagatgttgccatcatggtaaactgggtggggcatacaagagacctctctgtatattttctctgcaacttcctgtaaatctgtacttattttaaaataaaaagataaaaaacacatcaacactgctatggtctgaatgaatcttccctaaaattactatgttgaaacctaatcatcagcatgatagtattagcaggtggggcctttgcagaggtgattaagtcataagggcagagccctcaaaaatggaattagttcacttataaaataggcccaagggagtttgttcgcactttccatcctttgaaaacacagctggaaagcaccatctgtgaagcagaaagtaggtcttcaccaaacatcaaatttgccaacaccttgatcttggacttcccagactccagaactgtgagaaagaaagttttgtcatttacaagctacccagtttatggagtttggttacggcagccagaagagactaacagatacaaacttttatgttaaataaaatcagagaaatgaatataaatttaccagtaatcacggtcaaaaaacaaagcaaaatctccagtttaaagacagattatcagactgaatgtaaaattaaaatccagctatatgttgtttacaagacagatagctaaaatataaggacccaataaatctaaaagcataaaattagaaacaaatatgtaataggaaaacactaaccaaaagataactactacagttacacaaaataacaaacctcatcacaactagcttgttatagttacttatttcaggatatacattgccaacttggcaccatccttcaaaaacagggtattatagaaatacgtgccaaatagtggtgacatttctgtaacacttacaatgcctaagagggtttgggaccaacagtaaatattcaaatactgttgactgattgactgaatggtaagtattgccagaattttcaaataatgtaaacctccaggcaatggctgtgggggtctgtttgctaaaacatttatcacaggcctccacaccagggctcaaagtgtataaggtaaaacttagataccagtatatcccttatcctcaaaagcatataaacagagagagtatttgattctcatttaaacaaacaagttaatttaaaagaagatatatttgtcacacacaaaatatttaaaacctcacattgaaataaatctttctctaaaatttgatagtgtctttctaagggctgttttctagttagcacaggtgtatccaataagcagttaaatattaaaacaatgctgtatgagtctgttttcatgctgctgataaagacatatacaagactgggtaatttacaaagaaaaatggtttaatgaactcacagttccacatggctggggaggcctcactatcatggtggaaggcaaggaggaacaaagtcacgtctcacatggtggcaggcaagagggcttgtgcaggagaactcccctttataaaaccatcagatcttgtgagatttattcactaccacaagaacagtatgggggaactgccaccatgattcaattacctcccactgtgtccctcccatgacacgtgggaattatgggagctataattctagatgagatttgggtggagacacagccaaattatatcaattgctatcctaatccaattaaccttcactcaattttcctagtaattattaaatcagataatagttaattaatgtcctattttactcattttgttactcattttcatgaaatattaaaatgctactaaaaccatccttattttaacactttgtcatcctaaatgatacaatattcaaaataccattttaaaacaaattttacagattatattcactctgtaagtatacattatcttgattcaagtactcaacaattttcttacggcaataataaaattcacttgcaaataagtaaaaaacacaaaattcaacacttgaattttatatttttgtcaagaatggaattatagtctttaaaaggcatcaataaaaaggataactaattattttaagaacaagtctaagaaactacaaaacccacaaagcacatataaaaatactagtttgagaataaagttttcttagttgaccacatctccccccaagaaaataaaactcctaaactgattaggtattctgtaaatttaaaatgtattcatgtggtaattactgtgtaatccattaattaaaactggttaggcatagtgattttataacctgttacatgcagatgtgacatctcttctccaaccctacctaaccactaacatagcataattttataatcaccgtagagtaagaagctaaatttgagtactctaactccatggatttaaaaataggggtaacagactacatttggttctggtaaagatcaaattttggtatcatctctacctcaaacctcagtggcagaaatctggtcttctatttcctttctatctctcctacagcattgtctatagggctttgcactcagcaggtgatcaacaaatgcttcttaactaaaacaagtaagatccaagccacaatattccatgaagccaccactttcataaaagatttcatttttttatatacaataagcaacatatcataaaagatttctattagcgccatggttcactgaaactcaattacaatgaactattttacaaaaatgtctcatttaaaacagaagatctctcttttcatcagtaaaacagcactttttgcatactgcagttttaattctctagtacttcataatttttctagggtgttggcatagcaaataaatttttacagtaaatgaccacaaaatgtcacatttcctcagaatataaatacttccaattataaaaaaaagctaataaatcctcagtttagaaggggcattcaatttaaggtaaatatatagaaattgtaagccttttattgcttcctcctaaaagcaagagaatgctcatgcagtgttttaattatgataccgaggacttgtatttctttccattctgctttattcacccagtttttgatggctagccagtttgatcacagatctatgaagaagcccccaagaagtctctgtgtcacttaaaccgcttctgcacaactaaaaagaggcctttactggagagtacgagtccacccagaatcagaagaaaagtgccagttaatatcacagcaagtcagatctgtgcctaacttacccagattacttggaccaaatacttgggaggatactgactgaaacatcttttttccaattttgacaacagcaaagttatggaacaaagagacattataaatacatcagaattatatgcagatgaacttaaaagttggaaattttttaaaaagaattacacacagagattaaatttcatggagatggataaaaataaccaacctcaaaccaaatgaaaacaatgtcaaaaagttgctgatgtgcaactcagggacagagagatggccaaatgtgaatcagctgcaacatgggtgcacacagggtctatagtctgctactctcttctagactatttattacacatcttctctcacctcaaacctcttttccccattctcacccaccttataaccttatactcctcctcagtgataaaacggaaccaatcagaaaacttccataaattcatacaaacacacatatccaagtaccatcatctctctgctcatacaccctgtgccccttcctacacaaataaataatgtatgctcctaacgcccaactcatccttttgtgccttggaccccatccacttgcactaggaactgacaataatttccgtagttcttccctcttttctcctacattataaattaattccctttctgctggagcacatataatgctgttaattctccatgctttaaaacacacacacacacacacacacacacacacacacacacaattcctcctcaggctaccccatcatttctctgccctgttatagcaaaatgcctcaaaaagtcttttgagaattttgttttaaaatagtaagtggatacaaatccaaaataaatgaaagaacactcaaaagaagtaagaggtttatttgtttttttaaaaagatttgcaaactttctctagatttgagcaaacattattagtagattgaacaggtcaataatgggtacctagagtaactgatatactttaaaacatgagcagtttgttctggctgataaattagacagctgttctgaattcgatttcacgctattttcacaaacagctaatttcctgctaccagtaataaagctacctgaaactatacacagttaacatcatcacctttatctttcaagaaagatatcaaattacttgcttacagttagttttggacatatccaaaaatatgccccctcttcaaaaatacaaacagctacattagcttcacatttatttcaaaattatactatacaaaaatcatattacaatatggagttttaaaatacgctattttctcctctgcaagttttcttaaactaatatattctttacttcccacgttttcataggtcaaacttgtaagctcagggagaaaaaaaatcaagtcgtaccagtctttgattgaaaatccaatttacattttcatctccaacccctcctaatcagcgttatgcaaattgcaatacaaaatttcaattctaataaaaatttaaagaaaaaagactttaatttcaaagttcatttttcaagcatgagattattccattttaacttactataaaggaaatagttctaaagtaattccaaaaacatacacatttgtatatactgaatatcagcatgatattcctaaataaacatcatcaaatttgagaaacaggtaactactcagattctctttcctcaataagttgaacgagttcatgcttctggatttgttaataaacaacaaattaaatttatgcaaggctctttctttaagtgatactgtgtagtaatgaaaattctgactataaaaaatggtaagctagtatttacccttgtggttatggcattctattaaaataatttatcctcctgaaatttaagtttcatttctgtgttccttagttaaatgtgtaacaaatgtaaaatggattctacacaaatatatataaatactcactggaggttccaaataaaaatatttttatagcaaatttcatttattcctctatatgtagcacgtagtagcagaggaaagctacttttcttcccctgtatattatcatgaaatttcacattttaaaaataagacttcatttcaaatcctgaaatcactgaaaaatctccagccttacatgaaacttcttttaagtcttttactttaataatacatctctacatacaattgcagcgattgtgatggcttttattagtattatatttcaacagtttgttgcttttcacattctcttaactgttctgcaagaggcttattaaaaagattcagtgacaaatgccaagatattctgctatatctgtaattatattaaataaaatacccactactttttcactaaaaaaaatatttcttcaacacgttggctactttctactgagtcaaagcaggagtcctgagtgacctatgatcaactcagaccaccatgcctgaattctttagttaacaaccactctccatgatacactttatcatacttcttgccttcactgcccttttatcagaggaaacaaatcggatttcatcacctacagccaagatgtccaaaatccctaactacttcctgtgaccagaaaaaaaaaaaagtatgcttcactagactgggcacactgctggtcctcccctttgtcccactctgtaaggcaagctagcgtcacaggcttcttgcctgaaaatcaatataagttaatccaaccacccatccagttcaatctctcccaagaaggccttgaagactaatgttccaacacctcaaaaataggaagattataaaaaggcagaataacaatagaggagtatccttcctacaaggacaaagatgtgctgggcaaaatctagagaaaagaaatgccaaatctgaatttcgacagccatttcaacctgaaattaatgttatgacatccagagcacagccaaaaattatagtcggaataagccacacaaaaactgtagctatgagatcactgttgaactaagccaaagcttcctttatatagcatccacatcccagtattgtttctctttacagcaaagaaatcttgtactctcaagagctgaccacagcattatcgaaatagccttacatagaggcaagtttggggaaaaaaaaggtaaaggaaatttaaagtttatagcttcagaagaaactctctaccaccattttgttggatggaagaaacatgccagagataaaaaaccaggaaacctttaatttagagtaattcagcctatttttcatcccttggaaacgttaccatttctatgtagagtatgggcattcaacagcatagaattcagctctgcaggaattcacattttaaaacatcattttttaaaccaactggatacatgagaactttcaataaaaatataataaactttaaaatcttggcatgtgcaaactatcagatcagctgcctagaattcaagctcgcataaagactgaatacacctgaaattacatgtgtaggatagtaatggttacagcccacaagaattatttgtatcattctaccacgagtttgacagtgttgccattaaaaaaggagaagaattgcttttcaaccctcagtgaaaatttagcctgttatcactatgtgagattctgacattacgggaaagaagaacagctcttctgaaaattagtccttattttaaaagcttaagatactgaacaaagataaaagaaattaaagtaattctcaaagaaaaaactgtcaatatattccaagcttcttcaagaacacagagatttcagtttcacattataattagctttcacaattgaaacttagaattgctcatgcacaatgactacgtgaaggaataaagaaaaactaaaatattataatgcagcctgtgatttactgggaaagtagagctttaatacatgaagtgaggctcaaagaaaaatgggctggaatatataatacaggcaaccaaccaggtttagaacccacatatttaaagggccacagcttctgtcatgcttggaacctggggacacttcctccactgccttaacaacctgttaccactgccacttccggagtctcaatctcacacttcctgccaaaaattcagaagccaggaagcatatctgattgccaaaagttctaaaatcctgctacattatgcattgagtgagttttataaggcagtctaagaccttaaccaacattgtaatttcatttccatgagaaaatatattctgagtttaaaactacaaacacaacagagactttggataaaactgtctgcgcacatttaaacttaattagagctaatcagcatagctaataaatttcttttactaaggtaaacctgacactttccaggctcaaccattcaccattaactttaaaaaacaaattaaaccaagcaagtatcttatcttcaactatgcacaaaggccaaaaactgacttaaaattcacaggacctgcatacaacaacttaaaaaatgcgcatgacccacagccctttctcgtatgctattacacggcagaataaagcatttagcacatattaccacgaatcctatattgatgacataacggtaattggttttggattcatttccgtgttttcaaacaccttctagttttgccaaaaacagagtgaacatattcctataagtaatttattgacagaatcctgtattttaaaaccgactattcgtcaaagattctgtgatgaggtagggctaaaatagggcaggtggtggtttggacaaagggacaatttatattacaagtgactttgagaactttttatatatatcatatatatcttcattccattttaataacctgttttgaggacttctttagttccctgtatttatatctcaatacacaaatccttaagatccagggcacattgaaaggaagcttcaaagacaggaaaagtaaaaaaaaaatctaaaaggctgagaagagggaaaagggaaaggggagaaggccaggaataatctgtaatcaatcttttttatttttgtattaatactgcttactgtaacttataaggtgcaggtagccattccaggtccaatttcaagttatatcgctaaactaatgaaaaaacttttttataacttttctgagatcccattttgtcctctttaagtgaacccttaattagacctaactttgatgaactcaaaccagcaattaatacttcctagacccactgacttttgttacttgttaaatcctcctgagacatacattaaaacctgatgtttttagtagccatagcactaacacaaagtaatgaatatatttacattttcattataccttgacagcattttttcctaaatagattatttatttaacatattataaactgtaatatgcactgaaatttttcagtaagcaggctatttatataacattcacccagatgctatctaatgcagttgactagaataacactgtgtagacagccattcttctatgagttatggctcacataaaaaatattccagcaaatataactgctattgtttttaaactcctttaaatacgcaatcactacctctcttcctacaatggctttccaggtcaaatatctttttttttaagtctaaaatcctgtcatagtgttaccttctccaagttccaatttcctcccattctatcataaccttcattcatttggcattcagtcactaccatgtaccatctaaattagaagctctacaaaagacaaaatctcttgggctccaaggttttctacatgctagccttcatttctgttttttaataaggttatccatacatcatcagtagaaaatcttccccaaccttttacaaactcagccttatctagaaaacaatagaacagtaattcagccactataagaaagatttaatggattatactgttaacattctataagaatactagaccattctactaaaaaacctttaaagtaaaaacaggcaggttacctaattattttaaaacaactggtgaaagggatatggctgaaaatacacgtatcattctcatatatattattacttaactttttacatgtatatcaaaaggaactgtttttaatttttacacattttaggtgtttaaaactgcatgggatggccgggcacggtggctgacgcctgtaatcccagcactttgggaggccaaggtgggtggatcacgagtcacaaggtcaggagatcgagaccgtcctggctaacatagtgaaactccgtctctactaaaaatacaaaaaattagccggacgtggtggcgagcgtctgtagtcccagctacttgggaggttgaggcaggagaatggcgtgaaaccaggaggcagagcttgcagtgagccaagactgcaccactgtactccagcctgggcgacagagagagactccatctcaaaaataaataaataaataaatataaataaaaataaaaatgcacgggcaacatacacaattaaagaaatgtaaacactgtctcactgtaccacctcaactctccagcaaactgagactctaaccaaaagcatctaagataattctgtgcaacaaacatagaagtcaaaaggtccaggaataaagaaaaacacacacacattttcctcagaaaataggcttaatgccttcatttgctacctatttttcctcttttcctatcttccttcagttattcctatggttgacaattctaacaactatttggtttgtaaaacaattgaaagtaactttggaaaacagtattttgactagatactgtaaggctaaagacaaaaagactgtacacaaaattcttactctagttaataagtctgtttctcacagggatatgggctagcaatcctttacatgtatactatccacttcacttcatatgtatacatattaagcaaagccactttatatgtatagtatgtatgagcaaataagtgtattacaggtaatgagaaccaagtttttcactgtcagagaaattacaaataaggaaattgataaggctagaatgaactctgtgctgttggactgtaatccaacatatcagtatgaactaatgttttttattatatatgaacactaatacataaatatacataccaaaatatagatgtgtatgtatgcatgagttagtatacatattatcctgactctagtcactgaaaggaccttgaagcaattgacaccaccgtagcaatgagcacaggtagccccgagaccttggcttctagattccattctccaataaggggccaaggcaccttgaagtggttgattctggggctggggcagggaacaaacaagatgagcctagagcatcctgtggtgccaggtattaagaatgctcagaaagaatgggaatatataaaaaggtcccagaaaccaaactgaccttccaagggccaaagctagaacaatgagcaacaaaataaatagcattgaattataatacataaaatacctatgtattcatattgatataaattataatcaatttaaaataaatggagcagcttttccttacaaaaaaatcctaatacatgtaaaagggagccaggcgcggcggctaacgcctgtaatcccagcatgttgggaggccaaggcaggtggatcacaaggtcaggagttcgagaccagcctggccaacatggtgaaaccccatccctactaaaaatacaaaagttagctgggcatggtggggcacacctgtaatcccagctactcaggaggctgagacaggagaattgcttgaacctgggaggcagaggttgcagtgagccaagaccaggccaccgtgctccagcctggacaactgagcaagactccgtctagaaaataaaataaaataaaaataaatgtaaaaggaaagagggaaatagaaaatcaccattagaacagcacagtaataattgttgcagataaaaacccatcgaacaatgggatataaaaatagtgagcaaaagtttgagaagaaacaggatatgtgcataattccaaagtatctacctgaagatatttaactgcaaaaagaaagaagctttacagtagaaaaagctgggtaagaacagcttattcaagcatgaacaaggttacctgcaccagtaagacacatcaacataacatacccttgacatcatgcactggaagggtacatcgtttctgtgggcctcttgccaaaaatgtattacttaaatctaatcatgaggaaacatcagacaaccccatatttagggacattctacaaaataactggccactactcttcaaaagtatccaagccatgaaagacctggaaagattaaggagacgtggcaagtaaatgcaatatgggatcctggatgcgatcctacaccagaaaatgggtattagtgaaaaaactggtggacactgaataaagcctgtagtttagtaaacagcattataccaatgttaatttttaatttgtggttatgcagtatgttaacattagtagaagccaggtgaaaggcataagggaattctactatttttgcaactttttggtaaatctaacattatctcaaaatatgaagtataatattatggttgccaactttaaaaggaggaagatagttataacaacaaaattcactgtagacaaaacaaaatggaataaaatgcactcccttccacaaaactgactgcaagaaatcatatacaatgtgtataaggtggtaaaccactctgttatactgatggtacccaaatcgcacccctaatatccaagtgcttgtacctctagctcccagctgggtcatgtgatggctttggcagtgtaacattagcatgcataaggcaagcttctttctacatcagaaattactttcctggtacgcaccttctcggagcccttagtaaagaggtccaggaaccacactggagaaatcatgtggaaagacaggcccagccaggccttttccaggcctaccagaaaagacacctaacatgtgagtaaaagaagccatcttaaacgttccaacctcaaaaggtggcaactggagcagaagaaagacccacctgatccagcccagaatgcagaatcatgaggaaaaaataaatcatattgggtgatatacacagtccatacaacagtcagctgtctattaaaggtttcagtgtatataagattctttgctttataagaaagacagttttggaaacacagcagactaagctgatacagaacttttttttttcttttttttgagatggagtctcgctctgttgcccacgctggagtgcagtggtgcgatctcggctcactgcaacctccgccccccaagttcaagtgattctcctgccttagcctcccgagtagctgggattacaggcgcccaccaccacacccagctaatttttgtattttcagtagagacggggtttcaccatgttggccaggctggtctcaactcctgacttcagatgatccaccccccttagcctcccaaagtgctggaactataggcatgagccaccatgcccggcccatatacataactcttttagcatgaacccctctaaatgctggatggaatagaataaataaatactgctctctaaaaacatagctgccctcacaagagagggaaatccccaagtttgtgtgtagttggaggcagggcttgccaagaggaaatttgaagccacaataacatgctcatgagcagatgctgctgaggctcagtagcaagagggtgagtgaaggaagtctagccaaaggctgcgggccttattggttagggttttgacaccaatgcgaggataggggaaaaaatcatgggacatgcaaggtaggtacgtcttaggtatttatgacatatatcacagctttggtaagttaacccatagaagattaccaagtgatgtttaatgtaaatgcctgactgcccattaaaatttgatttggagctgagcagcctggcaactcaacttaaaggcaactcattgtctaaatatatgtggtaggatgcttagcataggaggcataaagaagaataagaattcatgtcactcccctccaagagcatacataagcaaacagatcaactagagtaccactcaataagtgatactgccttgtgatcctcaatttacttttctctgaactctcttcctctccaaaagcttaaaaataggcaatcctttctgttagacataaagagcacacataggaatatcaaaagaaaacacaatatgagaataaaaaaaattatgtcccaaaccactacaactacatcttaggtatttatgacatatatcacagctttggttaagttaacccatagaagattaccaagtaatgtttaatgtaaatgcctgactgcccattaaaatttgaatttcagataaaagcaaataatttggtggcatgctactgtcatttttgtatgctttagcatataatcagaccacccagttatcttaaaatagtgcctgaccaatgatatgaacacagtgaacaaaactgcgacattaggaatggttcaatataaaataagcatctcgggtaagagaatcaaaaaaaatcaaagcagattatactgtgggacaaaggacagtatcagagaaacctgtcaacaagtaacaaggcctcatcactagctggaattcagcagtaagaatatgtcatatttgaggagctctggaataggcagaaaacaaagatcaaggtaaactcccaaatccagagaaaccacattcctgagagtattacaaaaaggcttccaagaaaaagcaggaattgaaccactgaatctgagatcaaagacggcagatgtatcctgcaaactttcacctcaaacactcagatcccaactacaagcaagattacaatgattccaaaccttgagtatttggctagagttcttggaagtcatcctgtggccaattctgtccactgtctccaccatatctatccatccaacttctctgtcagtaccacttcagtttatttagttgctagtatgcccatatcccagtcccagaagatgaactgtttctggccaaaatcagtcataagaacagaattccacgtgattgctttttaggaatggccacataacctagttctggccaatatgaaataaaacaaaagtgaattatgtggattgtggatcttaggagaaggcttttagttttctgatatagggggatgaaccaggttggcgtgaccctttttaaaatccctccatactttttttctgcttacaatgcatccttgatgcctgaagttctaataactaccttgcctctaatgagatcacaagcatgaggctaacggccaacacagaaagacagaagagcaaagaacaggcctgcatccctatcaacagtgtacagcagctacgccagccctccaccacctacctccagattcatcgtttaagaaaaatcaattcctaattgttgaagctactgtgagatgagtttccctattacttacacccaaatgcattccttaactgatgtactgtttcccactaaggatagtgatagactcactcaccaggttgagaataaactgaaagtttattaaacttgtctctgagaataaactcagagacaagagatgtagagattggggaaaaaagtcttcaaagagaaataaaactccatcagccataccacatatacacatacaaaatcagtattgtggtagtggttacccaacaggctctgcagccagactacctgggcctaaacctcaactctgctgcttcctggacctgtgaccttgggcaagatagtcaacctctctgtacctatctcagcattctcatttctaaaatggggctaacagtatattccccttaagaatgtttgtgagaataaacaaggtaatacatagaaaacttggaatagttccttgcatacagtaagctctcagtaaatactggtaatcacctgtattatgcaaacatatataaatatataaaaatgaatgatacagtttatgcagtgcaaacatgacacaaattgtgtggtacaagtgagcagaaaattcctcacagaactcacccacctctaacacattgtctcaactgagtagtgcttctgtgtctgctaatagctgcatcagcagctctaactcttggatggcataaaaatgatgcaatttcacaacaagaagattgactaaacataagccatttacacttcaaaaagcagtgcaagggcaaaagcgtaacgtcagatctcatctcaagtattgttcttacctggcaagtggaaacaataactcatctcctaacagtaatagaaaggttaaatttatgataggcttcaagtatacaataccaccatatgcctaatcctttcatagttatctagtgtcacagtccaatgcacacttcaacggaatcactagtttctatgaatgtcattagtacgagctggtctgcacatgggttcccttcacttgcatttttttttttaatcaacaagaattgtcacaggcagattctaacagatccactgaaacagataacactaaatcagttgaactgataataggcaagagagaacgttcagaaaccaattgttcctatgataatagtaacctggatcaagacagacagcaaaaaataaacaaggaaactattttacagttttgaacaaaacagtataaacattccaccaggcttcccacaccctaactactctggttttgtaagctactttagagctttgggtattggacacctacttgtaaattcccattaccatcttatttttctcagtcctaatatatgcctgatgttcctatataaacattcctagccttgtacttcagtttaggccagcttcttttactttccattccttggatatctcatcaaacctaaatatattctattctatttccaaattttagttataattttagaagtttaaaatttgaaggagaggacaatatttttagagttgactccaacactcactggtttggcgaaataaagtcatttctgtagttagaaggtaatacttagcacatggagatcaagcatatggaaattaaaatgacaaaactatataactgctgtctaaatgcaaagttatgactactggatacatttcacttttttaaaaaacaagtgagggaccataaatacaaatgcagatggtcctggagttcatttcacctcctccccttccccaatttctggatttttcaaggagctagttcagcaggtcagagttaacaacgcaagaataggctgaaattagctgcttagcaacacaagctccccactctagtaacctggaagttcccagacacacagtattacagtcacctggaggttccagcaaatatgtggaacttttgtgggggtgggagggcagcagttgagattcctctcctggagtgattacagggcaccctgcagcacaggcgagcctagcctaagtcctttccgtgggatgagcacctgaggaatcccacaagctcccaggtatgtgtgacctgcccactttgtacattgtcctcaaaggctgcatgctatgcttttacaggtgcattttcacttttaattctcatagtctatgacaggtcatttacagataaggaaactgacttccaagaaagttaagatgacctatttactcaccttttaaattaacaacaaactaaggagaatttagtgcttaaagtgtaatttccaaaaggtttagaatcatgaccttcatgcaaatataaaaggaacacatgccaaagatattattcagctcatcaattaatgagattattagtacaaacttgagtgtgtgtgtgtgtgtgtgtgtgtgtgtgtgtgtgtgtgtgtaggtggagtattactgaaatcaatggtgaatctattataagaagggtttccaagctgagtgacaaagcattcagggtgcctcactgaactaacagagacactgtatgaactactaacaggttttttggacccaattacttagtagaagttactattaggtatttggtgctggtggccccatgaaaaaattactgagacactgaagactaaaactgaaagtttagtaatgtctaccatagagcaatgaaacataatatctggggatatttcttcagggtggaaatcaattctatcctactggacaaaattcatttgcattattatagataagaatcttggtcgggcgcggtggctcatgcctgtaatcccagcactttgggaggccgaggcgggtggatcatgaggtcaggagtttaaaaccagcctggccaagatggtgaaatcccgtctctaccaaaaatacaaaaattagctcagagcagtggcaggcgcctgtaatcccagctactcgggaggctgaggcaggagaattgcttaaatccgggtggcagaggttgcagtgagccaagattgtgccactgcactccagcctggatgacagagtaagactccatctagaatcgtttgcatgactattagttaacttctatccctacagcattgcaaaattgcctaatcaaaaaaaaagtgaaaggtatacaccctgtatctagtcacttcaggatccactaaacaagcccagcgttccactgaaaagactcctagtaatcttttctgatcattttcaagtcttggacaacctttcccaccttagattatgggcagtactaccaagagtaccacaaaaatcacgatgcgggagtgaaaaagcaggatcagctataatccatgaatatttccatccagaattgcagagcatccactgccagcaaggacatattgaaagggacacactaatatgctgatactgccacataacctgctacagcctttctggaaagccacctaggaacatgtactggaaaccctacaggctcataactttgattatttaattctactcccagaaatacacactcaacatacaatcagaagtggactaaggtacataaatatctcacagtgttaatcacaaaaataaaaaatttaaaacaagttaatttaccaccttaaatatttcttctttccagaagccttcaataaacccccaaatccttcctgtgtgatccaaggttgcccttacatgtctcttaccacattgtactctaatgtctcacttgcttatccatttgccctactaggctataatctctatggaaacttggaccatgtatttcaattgcatggatttagtatgatgctacatgcataacagacaaagttggctcaataaataaaatgttaaacagcctgaaaacatatgtttcctctatagaaatgaaaccataattacaagtattaacaagtatttttcacaaagaggccattttaattccattttcaaaaagctttgatatattctgacttacagtaaccaattcagatgcgagattcaccaaaaaaaaaaaaaaaaaagtgaggtcagaaacagctttactgacttcaaacttcagaactcttcaactatcattccttaaaatcaaaagcatgggcttatttaataggatgatatcatccagagaaaagaatgtgatcgtgtgactactttctttggctttaagccataactagaagaatgtattcagtcacagatgtctcatttgtaaagggatactcaggaattgaaatgcctgaagaagcataacttacaaacatctctctggttaacgattttccaaaagaaaattgtttgtgtgattttaacacccaaactttatagagtgtatatatctcataatatagtaatttttggccaataattccaaaggaaaattttagatttacttcccccaaactcaataaaacaccaaaacaaaattatatatgagaaaagcctgaagttatatcttaaccaattacattgataaaatatcagcattacgtgtagacattttgaaaggcagaccaagggccaaaaaagtggatatgcacctcagatgttgctggtgtggaaaaaggtatcacctcatcgcactcaggtgagccatcctctgccactgggtatgtgtcctgaatgcctcatcacactatacattttcacagacaacaataaagctcaaaagaaaaccactggatattaatcgttgaaaagaagttctagataatgataaatgttatcatgaaatgtgatggagggtgtttttaattattttaaaaggaagttgctattcctcttgggtagtgcctttcacattttaaggagcattaaggctgaccgagggtctcgttaaaatgcagatatttattcagtcagtctgaagtggggcctgagattctgcttttctaacaggcactgaggcatgccaatgctattggcctaagaatttcaatttaagtaacaaggttttagagcaccatacaaagaaatttataaacttaaacaaggtatgcaactgtgcgaccttccattttcctgctcccgcttcctcttttcatttcttctttaatctcaaagcactgattgtctcccctgatgatttatcaagaccttcctgttcaggattctcaatatcctacagaagctgcaatttaagataacaaaacaggccaagcatggtggtacacctgtaatcccagcactttgggaggccaaggcgggcagatcacctgaggtcaagagttcaagagaaccctggccaacatggcgaaaccccgtctctactaaaaataaaaaaattagccaggcgtggtggcatgcacctgtagccccagctactcaggaggatgaggcaggaggatcgatagaacctgggagacagaggttgcagtgagccaagattgtcactgcactccagcctgagcaacagagcgagactccatctccaaaataaaataaaataaaataacgaaaacaggtcccagtaagcattcttgacaaggacatctgattttccaaaagtaggtaactgatacctatattgggataggctggaaagcattacatgaaaagaaaattgttgatatgtcttcccatgcctagaatggttcccagtacacagcaggcaggcactcaaataattgttcaacaaatggctatgatctgattaagatttttcagtatttgaagggtaattaggtagaaaacaagtaaagatcttctatgctatttacggtggaaaatagagagctaagggtaaacttcagcttttttaaaatacatattttagtcatcagttgtctgtccaataatgctacatgttttctcaaaaagactgagctatctgaacatgttccagcataaaaaccagatggctatctcagaggattactaaggaatacacacaccaggaacagtaaaggtttcaaaggtctcctacccatccaaaggattcactcagagcatgtgtatttggattaggaagaaactttttctagaacagttttcctattttgaaaaaagaaaaaaaggttttttggcagcaattgggctggcaagccaaaaccttacacatgacctatgagtaaatcaaaagcttaaattcactggaactcataaaaacaaaagaaactattccactgtgaaaaatgaataccttcaaagacaatggtgtgacaaagacacagaaatactcagaataacatccatttgttgcagcatttgtttgccacctacaaagaataactttcagatgcattttaccaacagcaacaaaaaaaataaaatgtatttgatgggaagttaatgcacaaattcacctcgttttcctagaaaacctcaaagacatctcgtgttaatgtgtcaatacccacagatttttttggtgtaattatgccgtaatattttatcattgtgaatattaaaactaccccacaggctcacttgatattttcaattttttcatctaaaaaaaccattttttctaatactgctacaaaataaaaatttagataattttttaaagatttaaaattatttttaaactcactttagaagttttagtttctaaaagcatggaactattaaaatgctaatatggaaagatgggggggcaggtgccataagactaaataccactgaatcaaaggaaattgattgtctagatgatgtggaaaagatagcttataaagttaatgagatcttatttaaggcaagagaaacaatttgctcacggacaacaaggatgaatcaaaatgttgtcatcaagtataactaatctaattaaaagtacagcaaaggctgggctcgggcctgtaatcccaacactttgggaggccgaggcgggcggatcacgaggtcaggaaatcgagaccatcctggctgacacggtgaaaccccgtgtctctactaaaaatacaaaaacttagccaggcgtggtggcgggcgcctgtggtcccagctactcgcgaggctgaggcaggagaatagcatgaacccgggaggtggaggttgcagtgagctgagatcacgccactgcactccagcctgggcgacagagcaagacaccatctcaaaaaaaaaaaaaaaaaaaaaaaaaaggacagcaaatattaaggcaaatatgaaaataaaacaaaatacgaagaaaagttaaactataccaaatgcagtaagtaataagtaaaaaataagtaaagggtagttaacagcaagtctcagtaaattagaaataggttgaaagaaataaaaaagaagaattccaacaattataagttatacgccaagaaaagcatgaacagtcaacacagtgagtgtcctggaaacattccagagatttgagagctacgtaggaggatttctgattgggtaggagagtaccataagatccttgaaactctggaattcacaaattcgtatcttccactatcttagcccttgataacaaaaatatcacaatccttaagcagcagataaggctaatccttacacagcagctttagtcagagatttctttaccataccagatgaaagtgtcttgggcaacccgctggggtccccttccacactttggaagctttgttcttttgctctttgcaataaatcttgctactgctcactctttggaaaaaaaaaaaaaaagaaagtgtcttaaaaaaccaatcaacaataaccctgaaagttttctaggttttaaagcaagaatactgctttaaacaacaagaacaaaagtcattataattttaggggaaatagacattcagaaaacctaggttttagtccagttctatctctagtatctatttctaaggctttctttggaaaagaaatattcttttccttgcctatgaagttctttccaaacttacaaggctacgacgtactccttgctaatacgaataaaaacaaaacatttgacaaattaccacaaattaaacacagatcaagtatgtctaatgaaaatttatcatctgaattgagatgtgccagatacgtaaactacacacctgagtttgaagattctgtgcaaaaaacggaaactatagcattagtagtgatttctattgaccacatgtcaaaataatataattttagattaaataagacaaacaaaattaaaattcataacctttataatgagactattagaaaattttgaattatataacatacgaaattacatttccattgtgttgtactaaacagcctgttatgtactgaaatctttcacagtaagatttgtcaaccctttttattttcctacaacatctattagatgtgtggcccataatggataagcaggaatgaacagagaaacctttgtatgtaagtagaaaacagaaactaaataagaccaaaattgactctctgattcatatactagctctatgctattagaattacatgttaaaacctcttttttggaagtcatggtaatactgaaatatggacccagtcaatttttttttagtttacagctgaaaagctaattgacataccctatttgttatgagctaaattgtgcccacccacccccccactcccaccaaattcataagttgaagtcctaacccccagaacctcagaatatggctgtatttgcagacaggatctttaaagagataaatatagtacagtgaagtcagataggtgggcctctcccagatgggtgctgggaatacaggtgagagccaccacacgtggctaactatagcacttttatttgtcaatcatgcctcaaaaaagttgaaaaaataaaaataaaaagatcagtattcttagtaaactggaaattaaaacctctgtaactgctgtgtcttaaaagtttgtgaaataagtacatggcaaataactgttctgagttttgactatttacctttattttggcaataaagtgtttcaagtaaatcaactttacttttttaaaaaaagtttaaagcatattaatttctgaacataaatcttcatgataaaaactgaaatgatcacaggcactgaagaacaaagcaaaaagtttagatgtctaagactatgctgaaaaggcacctagtttacaaggcctcaaacagccatagtacacccttaccagttaaatattctgtattaatttaaaaataaaaacctttcagatgaaaagtttaaaaagacaaaaaatacttaaaatgcttgaattcttacatgtcaccattacatgctttacacatattgtttaattttcacaactctccttggaaagtgtcattctccctattttaataatgagaaaatcacaatgtaaagaactgcaaccagaatatattaaaaaaaaaaaaaaaactcctaaaatacgtttttataaaaaaggaaagataacctaattgaaacaatgagtaagagccataaacacttaagacgagcaaaagtcaataaacacattatgagaaatctgtcataaggaaaatgacaaaaatcatagagacatctctatacacccaccacaatggctaaaatttaagaataataattctaaggattggcaaagatcattctaggtggcaaatttagcatgagctaagggaaaacactgaagcaagaacaaatgttcctataaggcaatagtgggtatgtgagtttaccttaggtgcaaagaggtgattgtaccatcacagtgactacagttaataaataatatattgtatgcttgaaaactgccttcaagataaggactttaacctacagttggttggcaaatcagaaccatgacatcaatgacacaactaaatgagttttaaagtacagtagttccccttatctgtatataacctacacacaccctcctgtatactttaaatcatctgtagattagactgtctgtggccagttacgaacccacccacacagtagggcaggaaggagtgaagctgagctccacctcctgtcatatcagcagggcattagattctcacatgatcccaaagcctattgtggactgcacatgcaaaggatctaggttgcacactccttatgagaatctaatgcctgatgatctgtcactgtatatattacatgtaataataaatacctacatacattatatattacaatgcaataatagaaataaagtggacaataaatgtaatggcttgagtcatcctgaaaccaccaccacccacccctccagtggtccatagaaaaactgtctaatataaaaccagttcctggtgccaaaaaaagttgggtgactcgctgcagtggagttcttagaatatatcactctaggatatgggggggattactgtttataaaaagctgctttgtatagaatgttccaaagacagaagacacagaaactttcaaaaactatctctttctctgcaataaatgtctcttcctccacaatctgattctaccctcactgttcaaccacattcttccaaaaccctcatgagcactctccaacctggccacactctctctctctcaccaccgtgtccattttcacgtccagatgcaacactgagttctctctctaggatggcccatcacttgcgatgctcttctggaaacctccctgtgcttctctccatttaaatccagtgctcttttgcaggcccagctgatgtctgactcaccccatgatttatctgccgactccagcctgcctctcatcccggtgtctacagttcctatgtgggttctacaatacataattcagcatctcactggaatcttatgttttgttcttgacactcaattagcccataaactcctagatagaagggaccacttctttcaattttgtatccccctcagcacctagtaccaaagggtatacaccagttagctgatagatccccttgataaccagaaatacagacacaccctctggcctggcaactgcatttctagaaatttacactactaaaatacataaatatgaaaaatagtatgatcaaaaatatgcattgtagactgtaacagtacaaattggaagtaacataaatgtctattaagactagtgaggccaggccgggcgcagtggttcacgcctctataatcccagcactttgggagaccgaggctggtggatcacctgaggtcaggagttcgagaccagcctggccaacatggtgaaaccccgtaactactaaaactagaaaaattagccaggcgcagtggcaggcgcctgtaatcccagcaacttgggagcctgaggcaggagaagccaggaggcagaggatgcagtaagctgagattgcaccactgcactccagcctagggtacagagcgagactctgtctcaggaaaaaaaaaaaaagactagtgaggccaggcacagcggatcatgcccgtaatcccaacactttgggaggccaaggcaggaggactgcttgagcccaggagtcagaggttacagtgagcaatgatcacaccactgcatttgagcctgggctaacagagcaagaccctgtctctaaaaaaaaagaaaaaaaaagaatgaccagtgaatttcagtccattactgtccattaaaaaaacaaacagttgggatatctatacacatagacataacaaagtagtaggtgaaaacagttgcagaaaagggtattcaataggcctatttttgttttattcatacacacaaaatttaaaagaacacataaatttttagactgataatgtccggtaactaggacacattttttagtttggaaaaaaaatgaacaaagagcacatgtgatgtttgtagtaacaaatatttatgtattttaactcactgcccacaaacagtaatttacaaaacaatttataatatgaacacattttgtttaaagtatgagaaataatagttatttctggaaaagggagtacaggaaactttcacattctagggcagatagttgttttttcttaaataatgagcacttagttacaaaaaaaaaaaaaagaattttaaaaagaattccatctttccctgggctagtgatcatcccagagggttaagtattttggtccacaaaacttttcttagcaacttcttaatctgtagagaactacctttattgttggattgtccactatactaaatcttaataagcattacagataaatcataccaacaaataaaattcacagaagctggtatcagaaaaaacttctctgccaggtgagtattaaacactgaacctgtttgataaagggaatctctccaataaaaaaattaacctcaaaaatttactgaattactgtaaaagatccggcatcacactggcccttatagtaatagttctgttgttaaacaccttatacatatccagagtaatcacaaacttgcccaaatccttgtttcaaggtcaaaactagagataagacaagaatcctacacagttttacccataggaacaacaggaggtaactgtgagaaccacccaagaggccaggcactggattctgttccctggatctgtacttcatatatcaccatttccctacaggccttgctccaatgtggaacttacaaatgtcctgacttaagcagtcaaggccttctccactaagcctctattaaaaacaaaggggcagagctatcagctccctccttttccatctcagcatccaccctgagattcaactgcctttttgctttcccctcaaacttactgctgaacagcttatagctactgaagctaagtgcttgatttgtactaattcatttatacacataataaccctatgatgtattcctattttacagatgaagaaatggaagtacaaggtgaaataactattaagtggcaaagctaggatttaaacccagatattatagttcctcaatacaatctttattatgcagcagtcagtatccctgatatatgtcttttaacctagaaaccattagaaatcttcagacagtaatgctcttaggtttcagtaacaaatctgaaagtcaacatttcacccaaatcaaatgtttactctagaaaatgctgtttgtcctggtaatactggataaacgagaactaggaaatttgcaaaatgtgcttcccagtgccttttggggttttttttctttggattgtttttgtttttgtttttgtttttgttttgagatggaggatggagtctctctctgtctcccaggctggagtgcaatggtgcaatctcagctcactacaacctccacctcccaggttcaagcaattctcctacaattctcctacctcagcctcccaagtagctgggattacaggcgtgtgccgccacaaccaactaattttagcagagactatttttagtacagacagggtttcaccatgttggccaggctggtctcagaattcctgacctcaggtgatcctcctgcctcagcctcccaaagtgctgggattacaggcctgagccaccgcgcctggccttttttttttttttttttaactttgaaaagctgtttaaagtaataaacactcaaccttttaatctactaaaataataaagggattaagactctagttatgtaactgttttccttcacctgtagaataagacataaacatgtatatgtatataaagcttttagcataactaggcgtggtagttcatacccacaatcccagcactttgggagactgaggcaggagaatgggatcacttgagcccaggagtttaagaccagcctgggcaacacagggagaccccttctccacaaaaaatttaaaaattagccaggtggggtagtgcacacctgtagtcctagctactccagaagttaaggtgggaggatcgcttgagcatgggaggtcgaggctgcagtgagccatgatggcaccactgcactccagccagggcgacaaagcaagaccctgtcacaaacaaaaacatgacttgggagtaaggagtcaatgtcacctactattcccagcatgtggaaaaacgtacaagttaaattcaatgcccaaaacacgacccatgaattcatgttgacagaaaacaaatgtaaacgtttaaacaattatactttctgtttaaatttacgaaagttatgagaaaaaactaatagttaattgaaaatactttaacattaccaaattatcacacagtagtcaattattacacaagaatgaatgctaacaacctgcctcataaactcattcattccatctatttccatgtgaagtacctgaatgtcttattttcaaaagtttttctctttcctgtgcgatgccttgtcttacctttaacaatgagataatagtctttgctctcctttcccccacgaacacccttacacaacgtttcccttatctaattatgtgttcgtctgaagttccagagactaatcttgaaacaattcaggcgactactgaattctcctccacctggagattacttcaaggctgcagttaatttgcaacccagttatactcaggcgccagcccattcaccagatgaggcaaaaacccaagataaatatctgagcaagtcacgtagactggggcccccgagccccaataccaagcgcccctttataagctcttacattttgtccaaatttgaaatggtttcgttaaggcagaagcttggactacttccccattgctagctttggaaagtagtcactttcctttccgggcccttcgtccttgttgattggctctgcaagcagcgagcagcccagcctgaactcggttacacagtaatttcaaatcttagaagaataaaatatcctgagtgttatatagatttaaaacacttgatataatcatttgccaatcttttattagataagctcggggcactttcaatggattaaaaatgcatcacggtcaggcaacgatgaccgtccttaatgcctgcaatgtctaatgttccgctatgttccagatttgttcgcgctgttggtggaggcgcaacagccgggaagcgcttactgggctccacacggactacacacactgtatcttgtcatttcgtcctcacagcaaggactgatacgtaagctcatttttcagatgaggaaaatgagaccggcgagaggctgatatgcttagcggtacagagctaggaaatcagggacagaacccaggctggaagtcacgctggctctagagccccgtcctttcgacctgttcccgtcgctggggaggggcacgtcagtgacactaaaccgtggaaagaaatacagtaccagtggaaagcaggggctccaacggggtaaaggcatgctccataacggattattggcctctgcattaaaaaaaaaaaagtgaagttagactctcagttttaattaaacatcgcgcagaaccaacagcacgggagccgcctgaacctggcactcggcagcggcgcgctccgggacccaggagccagctgagctgcggcgcagcacccggcgctggggacccgccacggctcgcctacagcaccgccgcgggcgggggcccccggagaccggccgcgcgggccgctatgaggtccgaggggttgcccctgccgcctctctccgcgaacccatcaccatccgggaacctggggagcgagaggcggccgcccccttccgcggcccgcgcgcccggcagcagtcgcacttacacaatggctggtaggagccacagactggagatcgcaggctgcgggagctacggcgatcgaccgctcggcgctcggctgaggagccttggcgcgcggtcctcgctcgcaggttttagcccccgggacgcgaggtggccccgcccgcttccgggagccggaggcaagtgggagccgcgccctgtgctctgcgtccggcactacccacctcaagtctccaaggcttcgttttctgggctggttctgctagctgtagtactgctgccgggccctctgcactcagctttaacaaggaggccatttgcttcaaactaagtggcgaattccctatcacccatgcttgacctagcttccaagccaaacttactttccactgtgctgcttctagtcctgctaccggtgtcctccctgagccgtcgggttaaaagctttccttcctggccgggtgcggtgactcacgcctgtaatcccagcagtttgggaggccgaggcggacggatcatgaggtcagaagttcgagaccagcctggccagcatggtgaaacctcgtctctactaaaaatacaaaaaattagccgggcatggtggcgcgcgcctgtaggcccagctactcgggaggccgaggcaggagaatcgcttgaacccgggaggccggaggttgcagtgagccaagatcacaccagtgcactccagtctgggcgacaaagcgagactccatctcaaagaaaaaaaaaaagctttctttagggaacactccgttaagagctttccttactttgctttgtggaaacagaatgtttttgttggaagaaactttaagccacctatctgcagctgcagagcgtcactgttgcaatacaggcttttccaatagtgagcgaacctaatctccctctaccctcttaaggtttccacctgggcctaagaggttaaattgacttaagacagtttaacaggggaaaagcttacagctatgtgcatgggagtccacaagaaaagacccaaagaaggaggaagcctaaatgcttatatacgggtttagctacaacaaatttcaaaagtccatgtttaaatatgaccttaatgaacctaaaagacaattggggtacaaggaaactatctgcacatgtaatagacaagtggttgccatgtgtttatcctatgaagagctgttaccagttgatgtgtccaggttcttggcgtcttgaacaaagaattggacaaaacgcacaaagcaaggaaagaatgaagcaaaaacagagatttattgaagatgaaagtacaccccataggttgggagcgcccgaggataggggctcaagagtgccgttagagaatgttctggggtttaaatgccagctagaggtttccattggttacttggcttatgccctatgtaaatgaagaggatgaagtaaattttaaagtcatttactggatataagccctgtgtaaatggagaggatgtttcctgtcattgctgaagtactgcaatttgatttagttccaggaagtcagcatgaatcggccttaacattccctgcctccagaccctattctgcctcagaactacatgtccattagtaaaaggcaaaccagaaaaattatgaccaaggatataaacaggcaaggcaaattatagaaggtagtcaaatggcaaaaacacatcaccaatattcagaacgaaatcttgaacaatgaattcaatggcagattgtaaccaattttttaagcagtaataaaaatttacacttactgatcaattattatgttccagtcagtgttgaggtcttttatattttatttaattaccctaaaatgtaggctccaggaaaacaaggaccaaaatttagttgttggcccttgaatcctcactctagcacagtttacttgttaatgatttgtctccccctactagagagctagctctctaagggcaggagccttgtctatttccttccctgctatttctccagccacacagtgtgtctcaccaagataagttcagtaaatgtgaaataaattaacaaataatgggaaaaaaatggagaattatggtacttcataccaggaattacaggcatacctccttttattgtgtttagctttattgtgctttacagataccgcttttacaaattgaaagtttgtggcaagcctgcatcaagcaggtctatctgcaacatttttccgaaagcgtgtacctgcttcgtgtctctgcgtcatattttggtaattttcacaatacttcaaatatttccattaatatattcattacaatctgtgattagtgattcttaatgttactcttgtcattgttttggggtgccaccagccatgcccttataagacggcaaacttaatagatcaatgttgtgtgtttcttactgccccgggaccagtacattctcctgtttctctctccccgtgggcctccctattccctaagacacgacagtattgaaattaggccattttatattcctacaatggcctctaagtgtttaagtgaaaggaagaactgcatgtgtctcactttaaatcaaaagctagaaatgatcaagattagtgagaaagttttgtcaaaagaaagctaggctttttgtatcagttagccaagttgtgaatgcaaagcaaaagttctttaagaaaactgaaagtgctactccactaaacacatgaatgataagaaagataaacagccttattgctatgaagaaagtttgagtggtccgtgtagaagatccagttagccacaacatttccttgaaccaaagccagatccagagcaaggccctgattctgaattatcttaaagtctgggagaaatgagtaaactgcagaagaaaagtttgaagatagcagaggttcatgtggtttaaggaaagaagccatctccgtaacataaaagagcaaggtgaagttgcaagtactgatgaagaagctgtagcaagttgaccagaaaatctagctaagatcattgatgaaggtggccatttttcatggagatgaaacaaccttctattggaagaagatgacatctaagactttgatagctagagaggaaaagtcaatacttggcttcaaagtttcaaaggccaggctgactcacttgttaaggcctaatgtagctggtggttgtcagttggagccagtgcttgtttaccattttgaaaatcctagggcccttaagaattatgctaaatctggccaggcacggtggctcatgcagatcacgaggtcaggagttcgagaccagcctgaccaacatgatgaacccttgtctctactaaaaatacaaaaattagctgggcatagtggcaggtgcctgtaatctcagctactcaggaggctgaggcaggagaatcgcttcaacctgggaggtggaggtttcagtgagctgaaattgggcctgcactccagcctgggtgacagagagagactccgtctcaaaaaaaaaaaaaaaaaaaaaaaaagaattattctaaatctactctgcctgtatctagaaatggaacaacgaagcctgaatggcaacacatctgtttacaacatggtttactgaatattttaaacccactattttactgctcagaaaaaaaaaatcctttacaaatattactgttcattaatagtgcacctggtcacccaaaaactctgatggagattaatgatttcatgcctgctaacacatccattctgcagaccatggatcaaggagtgatttctactttcaagtcttatcatttaaaaaacacattttgtaatgctgtggtgccatagatagtgattcctctgatggatctgggtacagtacattggaaaccttctagaaagaatttgccattctagataccattaagaacattcatgattcatgggaggaggtcaaaatatccaaattaatagaagtttggaagaagttgattccaatcctcatggctgactttgagaggctcaagacttcagtagaggaaataactgcagatgtggtagaaatagcaagagaactagaattagaagtggcgcctgaagatggaactgaattgctgcaatctcatgatctttgctcacggcaacctctgcctcttaggttccagtgattctcatgcctcagcctcctgagtagctgggactacagatgtgtgccaacatgcctggctaacttttgtaattttagtagagatggggtttcaccatgttggccaggctggtctcaaactcctggcctcaagaaatccacccatgcctcccaaagtggtgagattacaggtgtgagccaccacacctggccaatataccatatattttgaacaccaccagtacaagaaaatgagggtagagccacagaatatttggtgaggaagacagaagagccttctttgtatcctggagaaaactatgtaacttactacttggagttccttcctactttgtggagtcatactgtggacctgtttaccatcagtattaacctttttgggatcatagaatcaattgaaaatttgtttgaagatttggaacctctcccctgaaaattgttccatgtatgtatgtatgcatgcatgcttatatttattctgctttccttggaagccccaaatatactaaaggttaacaataattgctcattaaatttcttttaatatacatttttataaacatcttaaacttctttaatatacttattgaaaaaatatgtattaatgtaataaaaaaagtacataaaataaaaattgatatcactctcaccctactggctcctacctactacacccctttttctcagaggtcattttaacaattcagtttctatgactttccaaatccattttctatgaatcatcaaaaacagaagtgagactattctaccatttacatttacaaaatttactctgttgtggacatttttccacatgatgccatatttatctagctcattctttttaatacagccatgacttggaaatactgtgggtttgattccagataccacaattaagtaagctgcacaaattttggggtttcctagtgcatataaaaattaccttagggcggccgggcatggtggctcacacctgaaatcccagcattttgggaggctgaggcaggtggatcacaaggtcaggagatcgagaccatcctggctaacaaagtgaaactccgtctctactaaaaatacaaaaaattagccgggcacggtggcaagcgcctgtagtcccagctactcaagaggctgaggcaggagaatggcgtgaacccgggaggcggagcttgcagtgagccgagattgcaccactgcactccagcctgggcgacagagcgagattccgtctcaaaaaataaaaaaattattttagggctgggcgcggtggctcacgtctgtaatcccagcaccgtgggaggccgaggagggcggatcatgaggtcaggagttcaagaccagtctggccaacatagtgaaaccctgtctctactaaaaatacaaaaaattagatgggtgtggtggtgtgcacctgtaatcccagctactcggtaggctgaggcaggagaatcacagtaccttaacactatcctgtagttgcccaggctagagtgcagtggcacaatcttggctcactgcaaccactgctgtccaggctcaagtgatcctcccacctcagcctcctgagtagctgggactacaggtgtgcactaccacacccagatcatttttgtattttttgtagagacagggtttcgccatgttgcccagctggcctcagatcgtgagctcaagcactccacccacctgggtactgtaatcccaaagtgctgggattacaggcatgggccactgcgcctagcccaagcagcttctttacttgcgttcctcagaagatgtttaaaagtgaataatgtgttataaaccccaaatgatattggtgatagtgtgcagtattttcaaaacttatttcactgcaaagcacttttattatagcattgtttggaataatattatatttttttttaatttttttttttttaatgacagggtctccaggctggagtgcagtggcgtgatcttgacaattaaggagatggctttattcaggctattgcaataagcagaacaccctaggccctaatgtcagagtgtcttggcagtgtgattttcctttagatctttttgtttgtttgtttgtttttagcatagaaacggcatctcactctgcctcccaggctggtctgcggtggcatgatccgagttcactgcagcctcaaattcctgggctcaagccatcttcctgcctcagcctcctgagtagctcgaattataggtgcatgccaccacacctggctcttttttttttttgtagagacagggccttgctatgttggccaggctcctcttgatctcatgccctcaaacaatcctgtcatctccacctgccaaagcactgagattacaggcatgagccactgtgcccagcccttcttagacttttataggaagtagtagacgtggggcgattgccatttggggttattttgcaatcaggggaagtcccggtcagttggcggaacaggaaatgtttatgtctgtgtttggctagtttcaaacagacaaactgttctaatctctgctaaatcatttatgagaccaacaacggggtcttggagtgttcatgactgaccttctcaacaggtcaggcaaaaacaaaggagtcatctgagggtattacagaagccaggagaaagagacacagagtcttatctacctcatgtgagaaagggtagttctctgaggtaattcattcctggaacacaaaaggcggggctagggatgggtttcaggaaacaaaagggtgaaggaatttctcagtcatcactgtttttcagtacagggctcaggcaatgttagaagcttcctgaaagtttcacactatacttttgcttaaaacaaattgtgacttgaacatatacatatatatatatataaatctgtgaaggattcattagccaccataaggtctacgtatcacacagcaatgtctactgtatcatagaataaatataaactaaatcagtactatcatttatttaatctatggataatatttagtacataaaactttggggacacctggtaatcactctgtgaactcccaggcatcaacaccctacaggctggaagtcactggcataatagaaagcatccttgttttaggagtcagcaacctagccctcagtaatgaagagaacaaactcctttcttgtttgttaaaccactcttctgtttgtgaaagttctatcttgtttaaaccactcttatttagttgggtttttctgaggggcgagggggcaagagttggttatatgatactcaccctttgtcctaattgatacatctattaacaaatgatggcaaattgatctagagtgaacagagtgaaaagatttggaaaatattttgggaccagaattgacattttggttatgcattaaatatatggtgtgagagatttgactcctaaatttttagcttttgcaacaaagcatgtagtagtttcatttactaagatgggggaagacaaaactagttaaaggggaggaaaataaattttaaatgaatactatatggtcaggtgtggtggctcacgcctgtaatcctagcactttgggaggccgaggctggcagatcacctgaggtcagaagttcgagaccagcctgaacaacatggtgaaaccccgtctctactaaaaatacaaaaattagccgggtggggcggtgggtgcctgtaatcccagctacttgggaggctgaggcgagagaattgcttgaacccaggaggcagaggtagcagtgagccgagattgtgccactgcactccagcctgggccacagaatgagactccatctcaaaaacaaaaaacaaaaacaaaatgaatgctataataaatttacttaaaaacctcacctaatttatggcaatcttgatgattatgtatatttcaatcaatagattttagaagttagcaaagcttacagaagtatatacccaaaggaagaaaaatcattctaccataaagacacatgctcatatatggtcatcacagcactattaacaatagcaaagacatgaatcagcctaaatgcccatcaatgatagactggataaagaaagtgtggtacatatatgtcacagaatactatgaagccataaaaaaagaataaggtcatgtactttgcagcaacatagatgaagatggaggccatcatcctcagtgaattaacgcgggaacagaaaaccaaatatcacatgttctcacttataagtgggaactaagcattgagtacatatggacccaaagaagagaacaaaagacacatgtgcctacttgaggatggatagtggagttgggtgaggattgaaaaacgacctattgggtactatgcttactatccaagtgatgaaataatctgtacaccaaccccccatgacacacaacttactggtataacaaacctgcacatgtaccccaaacctaaaataaataaaagtttaaaaaacatttctaatcccaccattagaaaaataaagtataaggcggggcgcagtggctcatgcctgtaatcccagcactttgggaggctgaggcaggaggatcatgaggtcaggagactgagaccatcctggctaacatggtgaaaccccgtctatcctagaaatacaaaaaattagccaggcatggtgttacgcgcctgtattcccagctactcgggaggctgaggtgaagaatcgcttgaacacgggaggagtaggttgcagtgagcctagatcacaccactgcactccagcctgggcaacagagtaagactctgtctcaaaaaaagaaataaataaattttaaaaataagaaaaagaaagtataatataaattggttcctttttaaaaaggcttttataaataaaaactcttcctattttcttaaatgagaagacttgtgatgttaaagaaacaataaaataaaaatccctgaccaggcatggtggctcacgcctgtagtcccagcactttgggaggccaaggcaggcagatcacgagatcaggagttcgagaccagcttggccaacatggtgaaaccccgtctctactaaagatacaaaaaattagctgggcacgatggcacgcacctgtaatcccagctactcgtaagactgaggcaggagaatcgcttgaacccaggaggcagaagttgcagtgagccgagatcatgccattgtatgccagcctgggtgacagggcgagactccatctcaaaaaaaaaaaaaagaaaaaaaatccccaagtaaatctaataaatgtaatacaatacttttcaaagtctcaaaaatatgtttcatggaaactttttcctgctatgtatagaaaaccatatattatcatgataattaaaactatgtagcattggcatagaaatagttatatagcttgatagaacaaaatagagttcagaaacaaagtaatatatgtgggaatttaatttatgataaaggtgacgttttaccatagagggaaaagtatagtggtgtatttaataaatattcttgatataattatctatacatggaagtgagcaaaagtcaatttctacttcatgccatacaagatacatttctaaaagctaaatataaaagtcaaatccaattattgaaaaaagatttttaagaaaatttgtatagtgaagagcttccacaataatcacaaaactcgtaagtcaactcagatttgactaaaaaatttaaacttctatagagtataaaacaaaattaagagagatgcaacacataagaaggaaatacatgccacataaatatataacaggcaaaatcctactatccagaacatcaaaagagcttctgcaaagcaataagaaaaagacaaagatcagatcatggaagaaaaaaaatacgaaatgccaataaatacatcaaagattctcaactctctaatcatcactggaaataaaaactaaaacaataaaaaattttaattaaagaataaaaaagattaataatatctaacgtctaa

SEQ ID NO: 372 - DNA, 61101 bp, Homo sapiens
ggctgatttaggcctaaatcttgtccttcaccctggagctagaggttggggaagccctaatcagatcgcaaagaccaaaagcagagaattccctgaaaaaaatcaggcctattgtcagagtacaggaagagaaactggggtgacaagaaacaatgtccattgcaattcagtaggactagagtgaggatattacacaagaaaccatataacatagcatataaaaatgcagttaaagaagagaagaaagaaaggccagcctgggtaacacagcaagaccctgtcactacaaaaaataaaaaaaaaatctggatgcggtgacaggtgcctgtagtcccagctactcaggaagctgagatgggaggatctcctgagcctggcaggtcaaggctgcagtgagctgtgattgcaccactgcactccagcctgggcaacagagtgagacccggactcaaaaaataaaagataaataaataaaagtatatctagggctatatgctgtggtaggtgtattttacataaatatgtaaaagaaataagtctcagtctttgggaaatttatactctgatgagggaggcagacatataaacaaatcaaataggctaagtgtcagagcatgggtgctgcagaggcccagacaaggcaccgacagctctgcctgagagctcaggaaaggtttcctagaatacatggcccctgagctgaatccttcccacctgtcctccaaactatcttccatgctgccatcagagccacctttctttctatttttttttttaaggagggatcttactctgttgccaaggctggagtgcagtgtcacgctcatggttcaccgtagcctcaacctcctgggctcaagtgatcttcccaccttagcatctgagtagctgggactacaggtgcaccatgcccacctaattaaaaaacaatttttgtagagatggagtcttactgtattgcccagggtgatctcaaactcctgggctcaagtgatcctcctgcctcagcttcccaaagcactgggatggcaggcatgagccaccgtgcctggccagagccttttttttctttttcttttctcttcttcattcttttttttttctttctttctctctctctttcttttcttttcttttttaattgagatggggtcttgctccattgcccaggctggtcttgaactcctgggtggaaggaatcctcctacctcagcctcccaaagtgctgggattacaggtgtgagccaccatgcccagcctacaggccatctttctaaaacacagtttggatcattttacttccctgcttagaactcttccgtggttcccaggagctaccaatagaaaatccagctttctccctttgtcacacagtgtttccattgacctctacctaaattcccaatctcatctttggtgctatgcaagccccaaacttcctttttttccagcaaaacaccaggcccactctctatctcaacgccatgtacttgcatccctcctcccatccccagatatcccttatttctcaaagctcaattcaggaatcacttcctttttttttttttttgagatggagtctcgtactgtcacccaggctggagtgcaatggcgtgatcttggctcactgcaaactccgcctcccgggttcaagcgattatcctgcttcagcctcccgagtagctagctgggattacaggcgcccaccaccacacccagctaatattttgtatttttagtagagacagggtttcacccaggctggtctcgaactcctaaccttgtgatccacctgccttggcctcccaaagtgctgggattacaagcatgagccactgtgcccagcgaagaatcacttccttcgacatttttctgattccttgaacctcaaccaaggaaaacagtatttcctcctcccaccaaggccccacagtgctcccctgcatgttaggtgttgacactgctgcctccttgaggctgtgtcttactcaatggagtagccttatcagcccacaggggcttagcaaataatgagcttttaataaatgcttttgagcagttgaatgaactgtacttgaatgggtttatattacaacccggtaaacactaagtttgttccaaggagaacttcctaccggttgctcctgctcacagctcttgaggccacgggcgtggccagagctgggtcagggacagggccactcctatgtaagagcagggcccaggcctccagcctgttgaggtccatcctgttcttctatgacagttgtgtggcatttggtgactcaggttctagtacaagaccactgagttcccagtaaactcagtaaattcagcatttctaaacatatagtcctttgactgggcgtggggggtcatgcctgtaatcccaacactttgggaggctgaggtgggcagatcaccttaggtcaggagttcaagaccagcctggccaacatgatgaaaccctgtctctactaaaaatacaaaaattagctcagtgtggtggcaggcacctgaagtcccagctacctgggaggctgaggcaggagaatcgcttgaacctgggaggtggaggttgcagcgagccaagatcacgccactgcactccagcctgggcgacagagtgagactctgtctcaaaaaaataagaaaaataaaaatacagtccttgggtgaggagattctttcctcagagaaagaaagtgctggttgggcgcggtggctcacgcctgtaatcccagcactttgggaggccgaggtgggtggatcacctgaggtcatgagttcgagaccagcctcaacatggagaaaccctgtctctactaaaaatacaaaattagctgggcgtggtggcgcatgcctataatcccagctactcgggaagctgaggcaggagaattgcttgaacctgggaggcggaggttgcagtgagccgagatcgtgccattgcactccagcctgggcaacaagagcgaaacactgtctcaaaaaaaaaaaaaaaaaaagagaaagaaagtgctttcctggccaatatagtttattatcaagcataggataaattggagaaaggcaggtttgtgacaaaactgatcagaggccgtttgcatagtgccaggtgttaaacatctattaactaatttcatgacactgtcttgtcacttctcacttttggtctgtgttttttaatattccaagaaaagttattagactagatgatctctaagatcacttcccattctatcattttattgtctggttcttacctaataccaatataatgtgtgtttgagatggtgaaggttcaggagttattggccacatttcacagatgggaaacagggcagcggggcacggggtttgcttcagatccgtgggtccttgctgagctctacttcattaagcgatcaatatttcctggctcctgagtggaactgcagttacatttccctttggaaaagctggtctgtttttaccaataggcctgcagaaaaaaaccaaggccggccaggcgcggtggctcatgcctgtaatcctagcactctgggaggccgaggcagggggatgacctgaggtcaggagttcgaggccagctgtcaacatggtgaaaccccgtctctactaaaaatacaaaaattagctgggcgtggtggcacatgcctgtaatcccagctactcagggggctcatgcaggagattcgcttgaacctgggatgcggaggttgcaatgagctgagatcttgccattgcattccagcctgggcaacagagcaagactctgtctcaaaaagaaaaaaagaaaaaaatcagggtcagagtattgttatgaaaaaacacaacaacaccacttattctactcccacagcctacctaggctttgaagcccacagtattgagagtaagaaaactcagaggtgctaggactgccaggaggcatgtaggaaagaggctagaggagaagaggaatagatttgaagccactaaggagaaatttcagtgatctgtggactaggatggcggagggggtggggacctgatcccaatggcacaatgacaaggtcagcctcatctcttctctctgttcttggcaacagccagtctagccagaaagagcaatctgtcaaatctaattaaagtagaagaaagtgaacaatgggcgcccagctctaaaatgacagcctggttcaatggggtggaggagctagggagggatgagtgctttgtgtgcttggaattagatccttcaaatggatcctttctgaatgcaaaactgtacatctctaactggattcttatttacttcaccaggactcttcagctccctgcgccttttaacacatgcacatccagcaaaagcagaggagaacctggctgtgattcaaaggtaaggctgtaatagtaatgtaatgtaaatagcttcatcatgcacggcttggacatggtactgtgtgcatgcaactgatatttgtgaatttgctcctatttattgtttcatgtttaattatattggtggcattagtgtttatcttattatttctgcaatcctttttattataaggcttattattggaatattgaaatttcagagcagtctgaagttttattaggaccacaaatagacatattttcagatgcaaaacacattaattatatttttgtcttatactttaaatggcctccctgatttgaatattttagtttctgaatcaaaagtgggttgcacagggaagaggcatattttataaatggaatcaaatgagcatatcccttaaaatacatgcatgaatacaggctattgaagcctaaaaaccatgcatctgcagaatctaaagtctcaaattacaagaggcctgttatcagcaaatattatactaaagaatgatttattaattttactctactttagtgtgggatactcagacatcttaaaggtgtgaggaaaaacaattctgtgaagtgggagggagagaatgggaagagagtaggcgctaacacaatctgcaatttacaagtctctgttccccaggtttggatggcttttcctatgcgttatctcatttaatcctcagggcaccctgtgaagtgtgttactatcctctccactctgcagataaggaaactaaggctttgagaaaccagcccaaggttacagagaaaggcagtcgggccttgaacccaggtggtctgcttccaagtctattgaacttctcaggaatatatttctggtagacacaggagacattaaatttagaaaatcattaaagtattaataatgtcaacatgaggacactcctctaatctattggtcttccctggacatgaaggaggcggtggattttagcttggtgtatttgtatcactttccccactttactgcatgttgcgaacctttatcttttttgcgtgcgtgtgacagagtctcaccctgtcgcccaggctggagtgcagtggcataatctcggctcactgcaacctctgcctcctgggttcaagcaattctttgcctcagcctcccgaataactaggattacagctgtgcaccaccatgcccagctaatttttgtatttttagtagagacagggtttcaccatcttggccaggctgatcttgaactcctgacctcaggtgatccgcccgccttggcctcccaaagtgctggcattacaggcgtgagccaccacacccagtctattttttaacagcatcacttgtttcttttctgtcctttctttctttacataccccttatacgaataaattatcttgtaaaaagacaaaggaaaagtctgccggtactgctcacttcaccccaaacccagtcctctccccaaagaaacccctgttaacaatttgggggtgtaaccaactatttcttacctgtttgcatagaggtgtgtgtgtgtgtgtgtgtgtgcacatcacattgttttgtgtgactttttaagagataaatggtgccatgttgtgctttttattcttaacttgctttttttttctttttaaatttatttcattattttattttttgagatggagtcttgctctgtcgcccaggctgcaatggcacagtataggcttactacaacctctgcctcctgggttcaagcgattctcctgcctcagcctccctagtagctgggactataggcgtgtaccaccatacctggctaatttttgtatttttaatagagacaaggtttcaccatgttggccaggcaggtctcaaactcctgacttcgtgatctgcttgccttggcctcccaaagtgccgggattacaggcataagtcaacatcctggccttttttttttttttcttttttagaacagtctatgccttgtggagatctttacctggcagtatgcttaaatctaattcattctatttaactcttacatagcattccatgcataatgacttgtactgttttctcttgacctcatctgtgcttttgaaatggtttaatggcatacaagtcaacatttaaccatatttgtatttatggggcagggagagacaggtgcaagctttctggctggctggagtgttactaaaaacataggagaagaaggaaaggtgagacacgcccacgccagtactgtgagcccaagtgagaggcctggggcaggtacagtgttatcagtagattcgttccctctctgcctctgaatatttgagcatttacctttttcttgagcccagctgttctccagacatttattccttatatatgagataacaataacatcctccacagggtgccatggggattaaactagaaaatgcacaggagaagacatcaagcccaggcatactgcgacatgttccgttatgaattgtgcctgtgctgacccttttccctctccctctcaaatcatgtattgctttttaaattttatttgagctcgtttgctctgaaggactatccctctcacttcagatattaggttgcaaggctcaaagcagggtggttaataaatggagctatggaggtcatcatgagatgttctggtgcaggattttgcctgaaagcattggaaactgactgagagctggactcaagtcctgatgtggacacttactagcggtgtgacttgggtaatgttttgtcatctggaaaataagcgtaatcctaatagtaatacttaagtctgtggggtgtggtcagatataaatgagataatgtatgaaaagaacttagtatcgtttctggtatacaggaaggtcagctgctgtcattgttatttagaaaggttgcaccatctccacttctgttttctggctataaagtatcactgtctagcttcctcagaagtgacaataaaaacaggcttaatctcagagcacagctgtttgttgttccattagtccatcattattttttaattgttgttttttatagtcagggtctcattctattgcccaggctgtagtgcaatggtgcaattatagctcactacagccttaaactcctgggctcaagtgatcctcctgtctcaccctcccaaggagttgggactaactacgggcatgcaccaccactcccagctctaatttttaaaaaatttttgtagatataggatcttgtgttgcccagactggtctcatactcctgggctcaagcaatcctcccacctcagcctcccaaagtgctgggattacaggtgtgagccagcactaatttcttttttaagtattccgagtgaccactgcatgtgtaataccttgctgggcactgtgcgaaatataaaggaagtgcgaaacagggctcttgccctcaaagtgcttacaacttttaaatttaatctccttaacactggagagaacacggcgtagtattgtgaacgtatgtgccatggctatttttctttaaacttctgctacttaaaaaaaatagatgatagatagatagatagacagacagacagacagacagatagatagatagatagatggagtctcgctatgttgactaggctggtctcgaactcctggcctcaattgatcctcccatctcagcctcctgaagggctaggattacaggcatgcaccactgcgcctggccttctgttactttcagaggcatccataattcttggacacctgctcatatgttctgtgtctagcttcagaattattgtagaagcttgcctgaacgtcacctatagaacctgagccattagatcatctatccctaaacgctaatgctgggctgatttcctggctgggggtggctctcatttcctccagagggcctgacagaaggaggacaagagctgattgggaggagctgccctcagggccacccaacgcttgctttcacagtaacctgcagatagtcccttgttctggacacaacaggagtggatatttagcaagcagatgaaatccaaagagcagaaactgtctgaaagggcctgaggatgctgtgtgaagggaatgaagcaacctcatttttgcggataaattccccggaaataaacctatagtatttacaaaatgtccaccttgtccttctcagcacagtaagctttctctgacccacagaacccattttctgtttggatatgaactcattgcagcctgcccaacatgaaattccaactggacataaaagggcacttcagctgtcaagccacgtgtggatttcggtttaagaatcagcccaggcagcagatgctccaagtgcttggggagtggcacgcctattcctgatacagaagtcaggcaccctttgtcttgatcccccacttaaatcagggataggcaattctgaatttttaaaaaggcgctatgttaaatccttcttatgagaaaaaaatatcacttataatgtagaaagttgaggtttctcagagagctctcccttttactgctgaaggggcttctcagcaggcaaagatatctgctcagtaacttatacttctgtgaagaagagattcctaagtgtaagatgtatgacttgtcgttttggggttaagtacaatcccaaacactctgtctccaccaccttttttctggaggtgttctttttattttattttttcaaagtggggcacatttcagaaatttttgctgggaaactcagaatacaaacttaacggcatgttaaaattctaaaaatagtttgaccctgcatttcacagagttcagggcttcaaaactgtgctgtccaaacatgattggtgattaattgattttgaccccctgcaagaagtgaaagcagctggtttacgagacttgagagacagccgattttccaagggagaacaaagaaaaagtggccacccctccccgctgggagcgcgctttgctttgtctgagcggactctctccagggactgccgccggggaggctcaaagctgtgtccttgcgattagtttggtacacttggttcagcagcctggggaatgtggggagatgtgtgcctgcacagtatcaacgttatcagctgccctgttcatgtcgcctctccctgaaggacactttcataacacagtaacacttaggagaaggttcccctcctttacttctgtttctctgctgataaacaaatgtcaggcatcttcctggatccgggccctgattcactaagttactgtatatccattgcccttttttgtcctccaaacactgagctctcagtgctcttctggctggatccagattgtgaagattacagccccactggttcctttcaggacttgggggcccaacattccatctccagggcctcaaggagccttccattcctgatgggttcccaattaccgtgtttctggtgctaccagacaaaagagaaggccctgttttgacccagagccctatagctgtgccctgatgggagatgggaattttgatgtctgacaacctgatcaacagcgtgactcctagaccgagtgaaccgtggtccgtccacgagccttcatcactagaggaaaaacggagatgaatgattatgacgcttgaagcaacgaacctctgcaagtaggagggtccggaaggttattccggaatcactgggcaaggtgaagggcagggctgcgtaagcgaaagcgtctgctcagtgcagggcagcataaactctgcaacataaaaagagggaagctgagctctggcatcatcttgcgggttgcagttcccggcaacagggctggctccagagcagaagcgcaacccgtcatcttcctgcgggccgcagccataggtggagaaaggtggtaccacaaggctctcccactggatgacggtgacgcgcaataagcagatgattgcagaggctcctgtcaaatgggtgcagagaaaagggaagtggggagaggaggagggacctagaaatggcactgcaacgatcctggaataaaaacgaggggccacagtcagaaatgacaaacgcctccaccttgaaacgcaacccctagcccatttatccaatttgcctctgataactgcttttaatatgttgtaaatcccattaaagcaggagagaataaatgaaagcagtcccctaccaggttctaattttcattctcctttagcattgtcttaaataacaaggacaccctaaaaatcaagtccaccctgtttagctgtggcaagcgctaaaaaccgttaagttcgttgaaacactactctccaaaccagagtaggcttccaggtttctctgcagagcagaaaggaggctgtggttgtgtccatgactttgcttccttggttagtacggtgacgtgcagcgccagggcctgggcctgggctcgggctcccacccgcgtggcgccgcagtcctggcgagccccgagcgctctgtccccggtgaccagcaggcggcgctatctccaggccgcagccgccgccccgcccgccacgaaggccacttccgccgcggcccggcgagcgcgcccccgccacgccctgctgtttagaagcggcctttcttcacatatcgctgtccgcgaaagtttctgaactcttgtgacaattaatgctgtttgaaaacctccctcttgggtcttttggaagagtggacatcctaaaaaaaattttctttttggagacggagtattgcttttgttgcccaggctggagtgcactggcgcgatctcggctcactgcaacctccgcctcccagattcaagcgattctcctgcctcagactcccgagtatttgggattacaggcacccgccaccacgcccatctgatttttgtatttttagtagagacggggtttcaccatgttggtcaggctggtctcgaattcctgtcctcgtgatccgcccgcctcggcctcccaaagtgctgggattacaggcgtgagcgactgcgcccggccaaaaaaaaaaaaaaaattaatttgggattgcgtaatcaaaaagtcttttagacatctcaaatgcattgcaacttattcgaataaaaagggctcctgacacggacaaaaaggcagtataggttgaaaattagaatgcttaaaaaaaaaaaaaattccccttcctgttagttccagatttttctgcaagcttggaggacagctcgcgaaaattcagctggggcgccatctgctggacgcgccgcgccgctgcaaggccctttccggaaaggtgtcggggttgcaggtcagcgccccattttttgtccaggagagactcgctggcaccttggctggaccaggctgggcgcagtggctcacacctgtaatcccaacactttgggaggccgaggcaggtggatcacctgaggtcaggagtttgagaccagtctggccaacatggtgaaaccccgtctctactaaaaatacaaagagtagctgggcctggtggtgcgcgcctgtaattccagctactcgggaggctgaggcagaattgcttgaacctggcaggcgaaagttacagttcgcctgggaggcgaaagttgcactccagcctgggtgacagggtgagactcggtctcaaaaaaaaaaaaaaaaaaatcttacatagtttttaaaaaataaaaagagaccaggctgactctctgcaagaaagtggcctgtgttgaggagccctcgggcctcaatgagtcgtcatttgttacattgctggtctctgaggaaaacctgaggctcaactcatttaatttcctccaccggcccacgggcacagggctacaaactaaaactatgctttccatcagtgcacacagcgggtttcagggacagaaatcacaatgtgcttattctgaatgcttctgattttgctgaatgggaggagtttccaaggtgaagagggtgacagaaatgaaattaatctgggagtagggagatgttaaaatgtggccttgccacggtttgatataagatcatgaagccctgccaacattttccaaactcctcagtcagttctgattcagttgaagatttttctatttagaagacttcaggcccttttcacatgagggtctaaatgcattagcaaacacatttatacatatacttcagcatgagcctgcattccccggtattgcactttgttaaagtccataatcagaaaacgttgggagaactggtagaaagcagaatattagagcagattgcagttggcccacccacccggaaaaatatggtatgagggatagaaagcatttgtaatggaaacatgttatcaagcatagttctgacccggcaaaccttgatagttactttccaacaaaactgaatgttgtattcagagatgagcttatgatgattttcctgaaagagatgaagtagctttatcaacagtatagcctactgaagcctcactgattatgtagtccttggggtccatgtcatgtgacttccatataagtcatgtgtcatttaatgactgatactttctgagaaatgcatccttaggcaatttcatcactgtgcaaacatagagtgcacatacacaaacctaggtggtagtgtcttctacactcctaggctatataacacagcctattgctcctaggcttcaaaactatatagcatgtaactgtactgaatactgtaggcaattataacaccatgataagtattcctgtatctaaacatagctaaacagaaaaggaacagtatttgatacagtccggattatgatattataatcttacggaaccaccatcattaatgaggtccaccattgactgaaacatcattatgcaaagcatgactgtatagtcaatatgttataaggacatcctttggtacttcaataactaagccctcgtgaatgagacctgctgattctaccatgatactgatcatagagaaaatgttaactttctatatgggtgcttgaagaagatactcagacaactaacaaaacgagatgagaaataagataaaaatccgggccaggcatcgtggctcacacctgtagtcccaacactttgggaggctgaggcaggtggatcatctgaggccaggagttcaagaccagcctgaccaacatggagaaaccccatctctactaaaaatacaaaattagccgggagtggtggcgcgtacctgtaatcccagctactcgggaggctgaggcaggagaattgcttgaacctgggagcggaggttgcggtgagccgagatcgtgccattgccctccagcctgggcaatgagtgaaactccgtctcaaaaaaaaaaggaaaaaagaaaaataagataaaaatctaccctgggctggatgtggtggctcacacctgtaatcccaacactttgggaggctgaggcaggaggatcacttgagcccaggagttcaagaccagcctgggcaacacagtgagacccctgtctctattaaaagttttcaaaattagccacatgtggtggcatgtgcctgcagtcccagctacttgggaggccaaggtaagagtatcccttgagcctaggagttcgagggtgcagtgagtatgatcgcgccactgcactctggcctgggtgacagagaccctgtcaaaaaaaaaaaagagagagagagaaagaggggtggggaggcagggaggaaggaaaggaaaaaggaaagggaatggaggggaagggaagaaaccaggtgcagtggctcacacctgtaatcccggcactttgggaggctgaagcaggtggattacttgaggtcacgagtttgagactagcctggccaactttgggaaaactcgtctctactaaaaatcctaaaattagctgggcatggtggtgggcgcctgtaatcccagctactcaggaggctgaggcaggagaatagcttgaacctgggaggcagaggttgcagtgagccaagattgttccactgcactccagcctgggtgacaagagcgagattccgcctcaaaaaaaaaaaaaaagttcactccggcaatgcatgagtgaactgtatcagaaaactagtaagacgaagttattgggtatcgaactgtgactagaataggaaatactgatggctagtgccacatctattgtatcccacaattctgctaatgtgaaaatatataagaaaaaactaatttagtttctcctgtgctgtcactcaacaatcaacacagaatacttctgtgacctctggtcaccaaaatttgtgtggggatttttccccaccaacaatcaatcagttcttttctgcaatggatagtagctgggtgttctctaattcaattctcacactacctggagagcctcggatcccacgaggactgagtcccatgagactgagccccgcttaggatgctgattgcgagccccaggtggtttttactggctataaatgagggttcccacaacctcctccttgggatcaattaatttgctagaatggctcacacaactcaaggaagcacttatttttgtttaccggtttattacaaaagatattcattttaaaatttttttgcttatttttatatttaaaaaatttgtttacagacaaggtctcactgtgttacccaggctaattttgaactcctgggctcaagcatgagccaccacacctggctacaaaggatattttcaaggatgcaaataaacaaccagatagagagatgcatagggcgaggtacggaggaaggggcaccaagcgtccacgccgtccctgggcacaccactctccaggaacctctacgtgttcagccatccagaagctctctgaaccctgcccttttgggtttttactgaggcttcattacataggaatgattgattaaaccattggccatttgatggtcagcttaaccttcagcccctctcccctccctggaagttccagccctctgggaatgtggctggttcccctggcaaccggatccccatccactgtagccatcctgattttcgcctcattaatgtaaactcaggtgtcttgaagagtttggtaaaaataacaaaagattgtctgtcttccacctttattactcaagcttttcctgagctgcttcaagactcaggacaaaaggcctttaacaaaagatattgctctagtcacttaggaaatgacaaggcttacaggagctgagagccaggaatagtggaggaaaaccaaaatatatacatcataacgtcacataatgtattaatatttgtagagttggccgcgtggggtggctcatacctataatcccagcactttgggaggccgaagcgggcggatcacctgaggtcagcagtttgagaccagcctggccaacatggtgaaaccccatctctactaaaaatacaaaaattagccaggtgtggtggcatgtgcctgtagtcccagctactcaggaggctgaggcaagagaattacttgaacccatgaggtggaggtcgcagcgaactgagatttcaccactgcactccatcctgggcgacagagtaagactctgtctcaaaaagaaaaaaaaaaaaaagaaataaattgcgtgaagctgggtgcagctgcgtactcctgtagtcccagctactcgggaggctgagtcgggaggatcgtgtgagcccaggagttgggagtccagccctggcaacagagagatggtatttctaaataaataaatagcttgataacaaatcagcactgaatattggcattaagtagagagtctagcatctctcagcaaaggttttttcagggcctctggcttgggacaggaccaggacgggaggtagagcagtgggatattccacttgtgtggcacaagtcagtcccttgaaactgttttctcttgttgttctgcttatttcagttgcttgtttgctaggagggtgcctccaccctcagagcacagacacacacacacacacacacacacacacacacacacacacaccctgcctttttcctcacagacatcccaagagcattctctgagcattatttttggggacgccaatataaaaaggctgcccactcccctggcagttgaactcaggattcaaatatttatgtttggcaaaaagcaaggggaaaacttttctggagatgacctctcccttgactttcagcttgttctataattgggcttttgagaatatgtgaccattctctgaaaaaaaaaaaaaaaaaaagaaagaaacactaaattcagtagtttctatctggaccctagagttaagtgtgtccctcacattgaaatcctgattccacagaggaactgccttaaaaatatcaattcaactcatttttgtgttttcagtatagatcagtcctcttctctcctctccccacaaaatatcaggcttatcagagggtcttggctttctggccacttcctggacccccacagggtgcccctgctgtgagttggcagcacctccaagttccccattgtggctcttttatctacttatttatttttgggacagggtctctctctgtcacccatgctcgagtgcagtggtgcgaacactgctcagtgcaacttcgacctcccgggctcaagtggtccttctgcctcagccttccgagtagctggcactacaggcgtgcaccaccacactggactaattttttttattattatttttttgtagagatggactctcactacattgtccaggctgttcttgaactcctgggttcaagcggttctcccacctcagcctcacaaagtgttgggattacaggcattagccactgcccccagcccatcatagctctttttttctttttgagatggagtctcactctgtcacccaggctggagggcagtggcgagatctcagcttactgtaatctctgcctcctgggttcaagcgattctcccgcctcagcctcccaagtagctaggactataggagtgcaccaccacggccagcaaatttttgtatttttagtcgagacagggtttcaccatgttggccaggctggtcttgaactcctgacctcaggtgaaccgcccgcctcggcctcccaaagtgctaggattacaggcttgagccaccatgcctggtcccatcttagctcttataataccatatataatatgatttatctgtgtcttccataccagacacttaaattttatgagaatggggccaagattatcatgttcattttgcacccccagtgcctaactagtgcctcagaccaggcaaatgttaggtaggattcaacactgagatgggagggaaaggtgtttccattggaggaactggcaggaccacatacaaaggtatagacctggaagagtgacaaggagcatgaatgtggtttgcttcagcctgaagggactgacaggaggtaagatggggtgattatgatgtgagtgtgagtttaaggcagtggtcatcagaacttgaaatagttacaattcatgcaatttctggtgtatgataaatgctttacacatattttcctcccctccctccctccctccctgccttccttcctcccttcctttcttccttccttccttccttttttgagagtctcgctctgcccccaggctggagtgcaatggcgcgatctcagctcactgcaacctctgcctcccggattcaagcaattctcctgcctcagcctcccaagtagctgggactacaggcgcacgccgacacgcccggctaattttttgtattttagtagagattgggttttactatgttgcccaggctggtcacgaactcctgagcttgggcaatccgctcacctcagcctcccaaagtgctaggattacaggtgtgagccactgtgcccagcctttatacatattttcatcaaaacttagagccttctttctttctttttttttttttttgagacagaatttcattcttgttgcccaggctggagtgcagtggcgtgatctcagcccactgcagcctccgcctcctggattcaagtgattctcctgcctcagcctcccgagtaactgggattacaggtgcccgccaccacacctggctaattttttgtatttttggtagagatggggtttcaccatgttggccaggctggttttgtactcctggcctcaagcaattcacctgtcttggcctcccaaagttctgggattacaggtgtgagccactgcacccggccaaaagtttacagccttcttagacaaggtggcatgaggaaaaaaatgtggtttggagccacagatctagctccttccatttgtagaaaatattacttaactagcaaaaccagtccccatggccaaaccaatcagtcaaatggagttattttgtttttttgttttgtgttgtgtgtgtttttgttttgttttgtgttgagatggggtcttgctctgtcactcaggctggagtgcagtggcacaatcctagctcactgcagcctcaaatccccaggttcaagcaatcctcccacctcagcctcccgagtagctgggactgaaggtgcacaccaccacacccagctaatttccagctaatttttttgttgttgttgttatttatacagacagggtctccctgtgttgcccaggctgttctcaaactcctagtctcaagcaatcctcctgcctcggcctcccaaagtgctgggaatacaggtatgagctaccgcgcctggctcatctgtgacttctaattctgttgttgttgttttgagacagggtcttactctgttgcccaagctgcagtgcaatggtgtgatctcagctcactgcaacctctgcctcccaggctcaagctgatcctcccaccttagtggcctgagtagctgggactacaggcgcatgcaccaccacacccagctaatttttgtatttttaatagagacagggtttttgacatgttgctcgggctggtctcgaacttctaggctcaagtaatctgcctgcctcagcctctggaagtgctgggattacaggtgtgaaccaccgtgcccggtcgtgacttccaattctaagaagcttgccgtgaatttgttaagatgaaataaggtgcaggctggttgcggtggctcatgcctgtaatcctagcactttgggaggacaaggtgggcggatcacctgaggtcaggagttcaagaccagcctggccaacatggagaaaaccccatctctactaaaaatacaaaaaatagctggtggcgcgcgcctggagtcccagctactagccaagctaaggcgggagaattggttgaatctgggagacagaggttgcagtgagccaagattgcaccactgccctacagcctgggtgacagtgtgagactccatctccagaaaaaaaaagaaatcaggtgctaccctgtgagtgcttcttacttggctctcaggagctcctccgtcagtcatgatgcttctccaattatccctttgcttgggaacatcgcacatagcatagttcaggatggctaagggatagctttttgtttttgatttttattattttatctatttatttattttgagacagagtcttgctctatcgcccaggctggagtgcagtggtgcaatcatggttcactacagcctcaatctttttgctgtgaaggctaagaggacttgggaaggggaggctggaaaagaaaaatcagctcattgcaaaccattctcaggcagttccctttaaggaaagggtacatttggtggtttagaacctggaaattgagacttgtaatactatctcattaaaagaaaaactttaggccaggcatggtggctcgtgcctataatcccagtgctttgggagaccaaggtgggaggatctcttgctgtcaggatgtcaagaccagtctgggccacacagcgagatcccgtatctacaaataatttaaaaattacctgggtgtggtggcgggcacctgtaatcccagctactcgggaggctgaggcacgataatcacttgaacccaggaggtggaggttgcagtgagccgagattgtgccactgcactccagccttggtgacagagtgagactctgtctcaaaaaaaaaaaaaaaagaaaaaaaaatctgctttaaaacatgtattgcctgcagaaacagctgaattttcagcaaggccctaaatggggctctaaatggcctcaccactcaccacagtattttcattttcaaattccacacattgtttggtcatgtttctccttctccatcttttaccacaaaatggatgtttcccttctgatttgggagactatgtcttcttagaagaaacatctaaaaatgggaaagcttgtgattaagaagaatttacatctatagtcgtggtcttttgaagatatctacggtatcttcaaaatgttcaaatgtccagggaagaaggaagttaagggaagtaatttgagtagcttccctatttttagaaattctattatgaccaaattttcccagagaggtatttttttttttcttttgagatggagtttcattcttgttgcccaggctggagttcaatggcatgatcccagagaggggattctttagagttcacaaagtacatcataataaggcataataataccttatagttgtgtctaatggatataatatcaaagagttttcatgatcttatccctgcattcccaccagtcatgtctccactgtgtgtaaggatggaaaatgagattgaaggccatcccagactcacagtctgaacaggagctcagacctcctgacaaatactatgttgggaaaggactctgaagcatcctcccagatgcttgctcagaccacaccttccttataataactttataataacaccccaggtattattttagctatttaacagaaaaaaaacaagacttggagaagataaatatactcatcaagtacacagtgactaagtggcagagctataattcagcccaggcctgtcttactcagagcctgttttagtgcctgggaagtaaatgataatttttgataagacagtttcagtacagtggtcaagacagaacacaaattacaaggggtttattcacttattcatcacttgtttattgaggagggtgaaacgtccagctatggcagtgtgaagaggtgggcaaattctttccctaaaaaaaattacaaaggtggaaaaaattgacaaaaatgaccatttctggcactctgaaaattgaccaaaggcatgtaataatctgagaaacagccaggcacggtggctcacacctgtaatcccagcactttgggaggccaaggtgggaggatcacttgaggccaggagtctgagaccagcctgggcaacatagtgagactcccatcttcacaaaaaataaaaataaaaaaattaaccaggtagtggtggcacatgcctgtagtcacagctactcaggaggctgaggtagaaggattacttgaggctaggaatttgaagctgaattgagctctgatcactgcaccccaacctggatgaaaaaaacctgagaagcgtttatgtttgagtaactgctgaacttttgtaataacagtgggaatctgtggcatcttgcctggggacactcccattctcagctgtcccttcagctccgtcagcaagaggattttgccagggtggggactgctgtaacaaccagccttgcaactatactcaaagtgggcctactttgtttggagcagggcaggaccaaaggttctaacctgaggttacagttctggctggggcaagcatcttcctgtctaaacttctacacatttacagcagataacagagggcctaagattgccacatacttcttcttttttttcttttctgagatggaatctcactctgttgcccaggctggagtgcagtggcacgatctcggctacctgcaacctcagcgtcccaagttcaagcaattctcctgcctcagcctcccaagtagctgggactacaggcatgcgccaccacgcccacctaatttttgtattttttagtagagaccgggtttcaccatgttagccaggctggtctcaaattcctgatctcaagtgatctgcccgcctcagcctcccaaagtgataagattacaggcgtgagccactgcatctggcctaattgccacatacttctgcctgcctcagcctcccaaagtgataagattacaggcgtgagccactgcatctggcctaattgccacatacttctgcctgaccctggggcagcctgcctagagaaaatgtgatggaagaacccaacagagaataaaagtaaaagcccagatagaattgaaaatggcctgaacttggccgggcgcggtggctcacgcctgtaatcccagcactttgggaggccgaggcgggcggatcacgaggtcaggagatccagatcatcctggctaacacggtgaaaccccgtctctactaaaaatacaattagccgggtgtggtggcgggcgcctatagtcccagctacttgggaggctgaggcaggagaatggcatgaacccgggaggcggagcttgcagtgagcggagatcgcaccactgcactctagcctgggcgaagagcccgtctcaaaaaaaaaagagaaaatggcctgaactttgaattgtgtgcttcctaaaacatgcagaaatgcattatcagaagacagaaggccaactggcttatggcatttcaggacaatttctgccccatcattggtcaaccaggaggctactcagacacagggggcaacccctaggaagccagacttaaaaagtaaaacaaggccgggcacagtggctcacagtgacccagcactttgggaggccgaggtgggtggatcatctgaggtcaggagctcgagaccagcctgaccaatatggtgaaactccatctctactaaaaatacaaaaattagccaggcttggtggcaggtacctgtaatctcagctacttgggaggctgacacaggagaattgcatgaacccaggagatggaggttacagtgaactgcgatcatgtcactgcactccaccctaggcgatagagcaagactccatctcaaaaaaaaaaaagaaagaaaaaaaaagtaaaacaagagaaaagaaactaagcagagagatcagcagctacaaacctcagaggggagacagagctcatagatttagcccaggcaagtcactaaacaaagacaaacccgccggacttggtggctcatgcctgtaatcccagcactttgggaggctgaggtgggtggatcacctgaggtcaggagttcaagaccagcctgaccaatatggtgaaaccccatttctactgaaaatacaaaaattagctgaacatggtggcatgcacctgtaatcccagctactcaggaggctgattgcttctcagccttttggctaagatcagatgtactcaggaggctgacacaggagagttgcttgaacctgggaggcggaggttgcagtgagccgagattgcaccactgcactctagcctgggcaacagagcgagactctgtctcaaaacaaacaaacaagacaaacccacaaacaaagcaaaaaacaggctttagaaagtaaaatcggctgggcatggtggcttacgcctgtaatcccagcactttgggaggccaaggcaggcggatcacgaggttaggagttcaagaccagcttggccagcatggtgaaaccccgtctctactaaaaatacaaaaaaattagccaggcatggtggcatgcacctgtaatcccagctactcaggaggctgaagtaggagaattgcttgaccgcaggaggcagaagttgcagtgagccgagatcctgacactacactccagcctgggcgatagaacgagattccgtctcaaaaaaaaaaaaaaaagagagaaagaaagaaagaaaagtaaaatcagagccaggtgcggtggctcacacctgtaatcccagcagtttgggaggctgaggcaggcagatcacgaggtcaggagatcgagaccatcctggccaacatggtgaaaccccatctctactaaagtacaaaaaattagccaggcgtggtggcacacgcctgtagtcccagctacccaggaggctgaggcaggagaactgcttgaacctgggaggcggaggttgcagtgagccaagatagagccactacactccagcctggtgacagagcaagactccgtctcaaaagtaaaaaaaaagaaaaagaaagtggctcacacccataagcccagcactttgggagactgaggctggtggatcacctgaggtcaggagttcaaaaccagcctggccaacaaggtgaaacccgtctctacaaaaaatacaaaaattagctgggcgcggtggcggcgcctatagtcccagctactcaggaggctgaggcaggagaatcacttgaacctgggaggcggagattacagtgagctgagaccgggttgttgcctgggcaacaacagcgaaactctgtctcagaaaaaaaaaaaaagaaaagggccgggcacggtggcccacgtctgtaatctcagcactttgggaggccgaggcgggcggatcacgaggtcaggagatcgagaccatcctggctaacacagtgaaactccgtctctactaaaaattcaaaaaaaataattagccgggcgtggtggcaggcgcctgtagtcccagctactcgggaggctgaggcaggagaatggcgtgaacccgggaggcggagcttgcagtgagccaagatcgcgccactgcactccagcctgggtgacagagcgagactccctctcaaaaaaaaaaaaaaaaaaaaaagttagaaatcaacaacagaaagagatctgggaaatccctatgtatttggaaataaaacagacttctaaatagcacataggtcaaaagccacttcacaagggaaatcttaaaatattttgaactgagtaaaaatgaaaatacaacatatcaaaatttatgggaagcagctagaagtgcttagaggaaaacatatatataagaagaaaagaaaggtctcaaatcaaattaagcttctatcttaagaaaataaaaagaaggccgggcgcggtggctcatgcctgtaatcccagcactttgggaggccgagtcgggctgatcccctgaggtcgggagtttgagaccagcctgaccaacatagacaaaccccgtctccactaaaaatacaaaattagccgggtgtggtggcgcatgcctgtaatcccaggtactcgggaggtggaggcaggagaatcacttgaacccgggaggcggaggttgtggtgagctgagatggcgccactgcactccagcctggtcgacaagagtgaaactccgtctctaaataaataaataaataaacaaaagatcaaactaaacccaaggtaagcaaaaaagaggaaataaagattagagcagaaatcaatgaaacagaaaacagcaatatagaaaatcaacgaacaaaaagttgtttctttgaaaaaataacaatgactggtcgtggtggctcacacctataatcctagcactttgggaagcagaggcaggtggatcacttgagcccaggagttggagaccagcctaggtaacatggtgaacaccgtctcttccaaataaatacaaaaattagccagtcatggtggcacgtgcctgtagtcccagttactcgggtggggatgctcatgagatagaattgcttgagcctgagaggttgaggctgcagtgagctgaggtcacgccactgcactcaagcaggcaatagagcaaaacattgtctccaataataataataataataagattagccaagcgaaaaaaatttttaaaaaggccagacatggtggcttatgcctgtaattccaacactttgggaggccgaggcaggtggatcacttgaggtcaggagtttgagaccagcctggcccaacgtggtgaaaccccatctctactaaaaatacaaaaattagccaggtgtggtggcgggtgcctgtaatcccagttactcaggaggctgaggcaggagaatcgcttgaacctgggaggtggaaggttgcagtgagctgagatcgtgccactgcactgcaacctgggcgacagagtgagactccatctcaaaaaataataataataaatttgttttaaaaaagagaagacactggctgggcgtggtggcttgcgcctgtaatcccagcactttgggaggcccaggcaggcggatcacgaggtcaggaaatcgagaccatcctggctaacacgatgaaaccccgtctctactaaaaatacaaaaaattagtcgggcatggtggcgggcacctgtagtcccagctacttgggaggctgagtcaggagaatagcgtgaacctgggaggcggagcttgcagtgagccgagatcgcgccactgcactctagcctgggtgacagagtgagactccgtctcaaaaaaaaaaaaaaaaaagagaagacacaaattaccagtatctagaatgaaagagaggacatcaatctctgccctacaaaaattaaaattataaaagtatattatggggccaggcatggtggctcatgactatgatcccaacactttgggaggctgaggtgggcagattacttgagcccaggagttccagaacagcctgggtaacagtgaaaccccatctctaccatacacacacaaaaagtataatgtgaacaactttataccagtacattaggcaatttaatgaaatgaaaaattcctagaaaggcataaagtatcaagaccaactcaagaagaaataggatatccaaacatacctatatcaagtggttaaaaaaaatgaatttaaaaaacaatcttccagctgggcatggtggctcacacctgtaatcccagcactttgggaggccaaggcaggtacatcacttgaggtcgggagttcaagaccagcctgggcattatggtgaaacccgtctcaaccaaaatgtacaaaaattacccaggtggggtggcacatacctatagacccagctacttgggaggctgaggtgggacaataacttgaaccagggaggtggaggtgtcagtgagctgagattgtaccactgcactccagcctggggcaacagagtgagaccctgtctcaagaacaaacaaaaacaatctaacaatcttcccacaagagcccagcccagatggcttcattggtaaattccattaaatatttaaagaaccaataatacaaatattgaacaaattatttcagaaattagaggaggaacacttcccaatttattctataaattcaatattactctgatactaaaaccaggtaaagacactgtaagaaaagtatatatcgatatccttataaatattgatacaaaagtcgtctgcaaaccaaattcagcaacatataagagagattataggctgggcctggtgactcaccttgtaatcctagcactttgggaggccgagatggatgggtcacttgaggtcagcagttcaagactagcctggctaacattgtgaaacccctgtctctactaaaaatgtaaaaatcagctgggtggtggcaggcacctttaatcacagctactttggaggctggggcaggagaatcgcttgagcccaagaggtggaggttgtagtgagctgagatggcaccactgcagtccagcttgggcgacagagcgagactcggtatttaaaaaaaaaaaaaaaaagattatacaacacgaccaagttgtatttattccaaggatgcatggttggtttaaattctaaaataaattaatgtaatatacaatattaataaaggacaaaagctacatgatcatctcaatcgatgcagaaaaaacatttgacaaaatccaacccattcatgataaaaactcaacgaactaggaatagaagggaatatccttaaccagataaggggcttctaagaaaaaccaacagcaaacattctgagtctgtcagctggtgaatgggtaaataaaatatgctacatccatacaatgcaatactgttcagcagtaagaaggaatgaaggatgaatgcatgctaccatatagattaaactccagaatatgatgctaggtggcagaaaccagatgcacaggttaggatgtttttgctctgtaaggcattaaccagttttgtatctatctataaattttattctaataaaattttaagtgtctttcctaataaaatatgtaaattcctgctcttcaagtgctcttttcaccagcttgaccattttactgcttcctttagttaataaaacttgatgtttattctatatttgtatgacagtcataatcttaactttttcaaaattatattttaacatggaagacatagcagtaggggcttgtggacattcttttctgactgcttctattttctcagtgaataagggtgaaaagtcatgaactgagagtgagaatagggagaagctttgggggaagttgagggcagtgaagaagatattacaaaaagacttttagagcctggccaacatggcgaaaccccatctctactaaaaatacaaaaattggctgggcacggtggctcacacctgtaatcccagcactttgggaggccgaggcgggtggatcacgaggtcaggagatcgagaccatcctcactaacatggtgaaaccccgtctctactgaaaaaatacaaaagattagccaggcatggtggcgggcgcctgtagtcccagctactcgggaggctgaggcaggagaatcacttgaacccgggaggcggaggttgcggtgagccgagatcatgccattgcactccagcctggggcaacaagagggagactccatcacaaaacagaaacaaaaacaaaaattagtcaagtgtggtaggcctctgtaatcccagccacttggggaggctgaggcaggagaattccttgaacccgggaggtggaggttgcagtgagccaagattgcagcaccactgcactccagcctgggtagcagagccagaccctatcttaaaaaaaaaaaaaaaaaaaaagactttcaggagagtgggaaagtgaaaaattaagggaaattccggatgactgctgagcaatataaacccgctggaggttagtagtcatgaactttaaatggaactctcggcataccacagccatgcctgcaggcatggagtaggcagagttagatttaatcaggttattcggttttgctaagtgagcacaaacaagaaaataaagcatgagagttggtaggtgtaagctacggtggaagctatggaaggagacctgaggatgtagcggaatagaggacagtgcacacgtgggcgtgtcaatgtcttgtaagtcccagttaggtagaagggttgtgggtactggtttcgtagagctaaaaagtgggaggttgtggttggacggtgggatgcttaaaattgaaatcatgaagggagggggcgtggggaggggatactcattttatttttgagagagggtttcactcttgcccaggctggagtgcagtggcaccaacatggctaacttgagctcttgggctcaagcgatcctcccacctcagcctccccagtagctgggactacaggcatgtaccaccacaccatgctaattttaaatttttttgtagggacagggtctcactatgtcgtccaagctggtcttgaattcctggactcaagcgatcttcctgcttctgcctcccaaagtggcctataattttatttgaacagtaactcaaactggtactgaaactagagttcagtcccaatttgtctaaacaaaagaaagtgaagggtcaagaaaaagggttaaattatgaagcaagatcccagagactgtgagcaggaatacagaactggggcacaggtggataggactagtattaataaaatcagggacggggagccctacagagatagaagacaggataaaagcaggaaggggagccgggtgcggtgacttacgcctgtaatcccagcagtttgggaggccgaggcaggcggatcacctgaggtcgggatttcgagaccagcctgaccaacacggagaaaccccgtctctactaaaaataccaaattagccgggcgtggtggcgcatgcctgtaatcccagctactcgggaggctgaggcaggagaatcgcttgaacccgggagctggaggttgcggtgagccaagatcatgccattgcactctagcctgggcaacaagagtgaaactccatctcaagaagagaaaagaaaaaattagccgagtgtcgtggtgcacgcctgtaatcccagctactcaggaggctgaggcagagaatcacttgaacttgggaagtggaagctgcatcattgaaccgagatcatgccactgcactccagcctgggcaacagagcgaggctccatctaaacaaaaaaaaaaaaaaaaaaaaaaaacgggaaatgaattgtcaaatgaggatatatatagggtgaggtatggaaggctcctgagtgcagcagcttctgtcctttgagtgtagtggagctggggtgcacaaccctcctgcaagtggatatgttcttgtttaccagtttggaactctgggaacccggtagtttagggatttttatggaggcttcatcacgtaggcatgatcagtttttaactcaatccctagtccttctcccctccctggaggatgggggatgtggctaaattttcaagcttctagtcatgactttgtctttctggtgaccagaccctatcctgaagctatccagcaagacaccaagagaccctcattagtacaaaagatgctcccatcacccaggaagttccaaggatttaggagctctgtgtcaggaacttggtgcagaggcaaaacacatatattttttttttattttttaagtagaaacggggtccctctgtgttgcccagggtggtctcaaactcctgagctcaagtgatcctaccacttcagcctcccaaattgctgggattacaggcttgagccactgcacctgacctcaggctgttttagagcaagtcttatcctcacaccaaatgcagatggagaaactcacccaaaatacaactacggaccttgccaaggttactctatttaatcacactataagccagaattcctagtaattataatggctctgagagtttacagtgaatagtctaattcagtattttgttattctaatctttactttccttactctgcagtgcttttccctttgtattttatcttgtccttgtctttaaaggtcaaaatgattctgttgcttgctaagaaaccaactaccactttccccagcagctgaacttatctttaaaaaatatatatatatatatatatatatatttctctgatagaggtcttgctatgttgctcaggctggtctcaaacctctggactcatgtgatccacccacttggtcttccaaagtgctggaattacagtcatgaaccactctacctggtagattcgtcttttctttttgtttttcgagactgagtctcattctatcacccatgctggagtgcagtggcgcaatctcagctcactgcaacctccacctcccaggttcaagcgattctccattcttgtgactcagcctctggagtagctgggattacaggcgtctgccaccacgcctggctaatttttatatttttattagagacagggtttcaccatgttggccaggctggtctggaactcctgacatcacgtgatccgccggcctcagtctcccaaagtgctgggattacaggcgtgagccaccacgcccagccagatttatctttttaggcttccatagcaatgtgcttgaggctagggcgtggtggctgacatctgtattcccagcatttggggaggctgaggccagtgggtgtggtggcacgtgcctgtagtcccagctacttgggaggcccaggtgggaggatcacctgagcctgggacgttgaggctgcagtgagctacagtggtgccactgcactccagcctgggtgagagagtgaaaccctgtctcaaaaacaaacaaacgaacaacactaaaagaaactagtgtgcttggggttaggccctcctggccttgaccaaaggccatgaaacccccaatgcaactgagcaagtgagcatcagcgaaacaggctgtgtagcttgtcaggtgatctctgttccaggataatttttttttcctctgaaacaactttggtttattatcagtcatttcgtgcagagtaaagagaaagaacagcgtgaatttaaaatttgtttctttgttttgaacaaaaattatttcttctttttcttttccacagtgtgtgaacccagctctgtcccttgggttccgtacatataaatggagcagctgagggaactggataagaagtcgattttgtagttacaggctgttccgtatcacccatttacaaggtcagtggggactgaaactgaccaaaacagagaactatgtactttaaaatgaggaaatctttatctatcagaaacacacaaagaactttcaggggttctaaagggcttatattcctgactccattggaacaaaatatgctggagggtaaggaaaaaggtatatggactagaggatcaaaaacagcaaagtgttgtaaaaacagaggcctgcaagtgcagaccctcatctgttagaaccctgttccagcctccttccttcactgaatctcctgaggggtttggggacattgcagattttgatgatttggggaaataaacatgtaattaaagttgtagatataaaagtggttctatattaatgttcttggagagaagacagtaatttaggccaggagcggtggttcacgcctgtaatcctaacactttgggaggctgaggcgggtggattacctgagatcaggagtttgagaccagcctggccaacatgatgaaaccccgtctctactaaaaatacaaaaattagctcggcatggtggtgggcgcctataatcccagctacttgggagtctgcggcaagagaatcacttgaacccagggggcagaggttgcagtgagtccagatcaagccactccatctcaaaaaaaaaaaaaaaaagaagacagtggtttagaaatgaaggccttaaagccaacctcctgagggaagggttgggattccaaagaaggctggactgaaggcaacatgcgctgctgtgtgacctcagggcagttcccaaagccaggcagcctccatttcctctcctgtaaaatggaggtaacaatagtgtctacctcataggattatcgtgaagaataaataagttaaagcatttaaaatcctcagtccagggatgaacacctagcatgcagatactggtactagcagtggaggggctgaggaatgggggcaggaagaggcatttattttttttttaattttacgtttgcaggccaggcgaggtggctcaagcttgtaattccagcactttgggaggccaaggtgggaggattacttgaggccaggagtttgagacagtctggacaacagcaagaccctctcgctacaaaaaatacaaaaaattagccaagcatggtggcgcacacggtaacctcagctattcaggaagctaaggcgagaggattgcttgagcccaggaagttgaggctgcagtgagtcgtgatcatgccagcgcaccccagcctgggtgacagagggagaccctgtttcaaaaaaaatgttgtacagctgtacaatgtgttttaagctgtgttattacaagagacaaaaagtttaaaaaaaaaaagtttacaatttttttttttttttgagcagagtctcactctactgcccaggctggagtgcagtggtacaatcttggctcactgcagcctccgccttccgggttccagtgatcctcctgcctcagcctcccaagtagctgagattacaggtatgtgccaccacatccggctaattttttctatgtttagtagaggtgaggtctcaccatgttggccaggctgattgtgaactcctgacctcaagtgatccgcccacctcagcctcccaaagtgctaggattacaggcatgagccacagcacctggccttacaaatttttaaagctacagtaagctaaagttaatttatcattgaagaaggaaacatgttttcaagtttaatgtagcctaagtgtcagtgtttataaagtctacagtagtatacaataatgtcctaggtcagctgggtgcagtggctcccacctgtaatcccagcactttgggaggcccaggagggagcatcacttgagcccaggagtttgtgagcagcctgggcaacagagtgagaccttgtttttataaaaattatttatgttttgttttttgtttttctttttgagacagtctcgctctattgcccaggctggagtgaactggtgtgatctgggctcactgcaacctccacctccctatttcaagcgattctcctgcttcagcctcccaagtagctgggattacaggtgtgcatcacaacgcctggctaatttttgtgtttttagtagagatggggtttcgccatgttggtcaggctgctctcgaacccctgacctcaggtgatcagcccgccttggcctcccaaagtgctaggattacaggcatgagctatcatgcccggctataagtaaataaataaataattcaaaaatgaaatttttttttttttgagacggagttttgctcttggtgcccaggctggagtgcaatggcacactctcggctcactgcaacctccaccttccaggttcaaacaattttcttgcctcagcctcccgagtagctgggattacaggcatgtgccaccacgcctggctaacttttttgtatttttagtagagacggggtttctccgtgttggtcaggctagtctcgaactcctgacctcaggtgatccacctgcctcggcctcccaaagtgctgggattacaggtgtgagccaccgcacccggccaaaaatgaaaaatttttttaaatgtcctaggccttcacattcacttaccactgactcactaagcaacttccagtcctgcaagttccattcatggtaagtgccctatataggtgtgccatcttttatcttttataccatatttttaccataagttttctatgtttagatacaaatactttcttttttttttttgagacggagtctcactgtgtcgcccaggctggaatgcagtgtgcgatctcggctcactgcaacctctgcctcccgggttcaagcgattcttgagcctcagcctcctgtgtagctggcacacactaccatgcctggctaatttttgtatttttaatagagttgggttttcaccatgtaggccaggctggtctcaaacgcctgacctcaagtgatctgcctgcctcaacctcccaaaatgctgggattataggcatgagccaccacgcccaacctagatacaaataccatctagttacaatcgcctaagtattcagtacagtaacaggctgcacaagtttctagctttggagcaataagctaggtttgcatatgtacactctgtgatgttcccacaatgaagaaattgcctaggatgcatttcttagaacagatcttggttgttaagtgacacatggctgtacatgagtaagaagagaccggtttcacctctaagtttcctaactataatttatgcactgatattctctctagtattcagattccatgctttaattatgtacgaaaaaacattacttagtgtacttgataatggctggctgtgtgtcctgggagcaggaggaggcaggtggagatgcagaaaagtaaaaaggaaaagattatcctgagattcacagtccctaagcaaattccccattgttttgcttggttgcaagaagttagtcgcagggaaagaaaaccttcaggggccttctactttgggctgcctgagtgctttttcagtacatgaataaatttattaaataaatgttactataaatagaaaagttttccaggctctatgatatagtccttttattagagtaatactgtagacaattgaagaatatgagtagttccttttacttttcctccaagagaattttatctgtgtatcctaaaggaatgggggaagggggcaagggaatggtagttaattccagaaaagattagcaagagcttgagtaagaagtcttgggtgtagggatacagggtgggaatacaggtcaaaggaaccggttcagttgtttcagttagtcaccgaggaagtgatgccacagcactgtatttttaggaaatataaagcagatcagaacaagccaaatctcagtggaaagaaaatgtgtaatttcagagatgaaagtcaatcttctatggtaatctcccagaatggagctagcatttcacatactaagccctgccaaaggggaagtcgtccaaaacacagctcaaatcagggaggaagagaacttctaaagaatttgtaggaacttttaaagactgcaaacatttgtgggataaaagagaaataaataaaagttaaaggatccaaggactgtttttcccataaaataaaataacatgttacctagaaagtaatgtcctgctattctgtacatacaaggcataaaaaaggagaaaaaacaaactgccttgaaatacataattttatttcttttgggtggaacagggtctgttttccccccaggctggagtgcagttgcatgatcttggcgtactgcagcctcagcctcccaggctcaagtgatcctcccactaaagccttccgagtagctggccgacaggcacacaccaccatgtccagctaattttttttttaattttcatagagacagggtttcgccatgttgccccaggctggtctcgaactcctggacttaagcaatctgcccaccctggcctcccaaagtgttgagattacagaaatgagccacctcacctggctgaaatgcataaatcttaaaaaatgcttattgtaggctgggcgcaggggctcatgcctgtaatcccagctctttgggaggccgaggcaggcagatcacctgaggtcaggagtttgagaccagcctggggctcagtggcgctgagccaagatagcgccattgcactccagcctgggcaacacagcgagacaccgtctcaaaaaaaaaaaaatgcttattgtaaagaaggttgttcaactgcagagtcctagctgtcctttggggttgttaaaagtagggtaaattttttttcttgttacattagtaaccttaccataggactacaaattcaataaatgacttttctaggacttccctttccctgttaactagagccaataacaggctgaggaagaacctagaataaaagagacaactgtcattgtaggtatttaatctgactcctatctcttgtggtttggggtaaattatttcaagtctcaggactttattttccacagttccataataaatacctttgtaaaaactcatttataaaaactctaccaaggcactattgcagtagaaaacattttgttataaatttctacataagcacaaaatattcctacatcattaattgtatcatgtaatttgtaactgaacacaaacaaatacttcagcattactagtatctcagcaaagaaaacaggagttaggctgaaaaaaaataaggttcagttttatctgaattcttttctctttactaatgttttgtgatgttttgtgaacatgctatatggtcatttaaagcccaagaaagctgcagtaggtatgcaacgcttatttccctaaagcattgtaagattacaacgaaagccccatctgtaattatttatctaatgttctggtgattcttcagtcaagatgttgactgaggaagcatgttttctcctttgctcatatttgtagagctcacatgaaccccacaaactttgagtcacacatcacagaatgttagggctgtaagggccttacagaggatcctgtccaatctcctcatattgcacattcaaaacctggaccctgaggaggggaaatgtccatccaaagttatatattagccaggcgtggtggctcacacctgtgattccagcactttgggaggccaaggcaggaggattgcttgagcctaggagttcaaaaccagcctgggaaatatagtgggacttcatctttacaaaaaaaaaaaaaagattagccaggcatggtagcacacacctgtagtcccaggtacttgggaggctgaggcaagaggattgcttgagcccaaaaagtcgaggctgcaccactgcactccatccagggtgacagagtgagaccctgtgtaaaaaaaaaaaaaaaaaaaaaaagttttatagcaaaaaaaaaaaaaaaggctgatcactgaaccgtgtcttctgtcaccctattaataatttagcatagtctgggcaaactggctcatgcctgtaatcgcagcattttgggaggctgagcctggtggatcacctgaggtcaggagtttgaaaccagtctgaccaacatggtgaaaccccatctctactaaaaatacaaaaattagctgggcatggtggcacatgcctgtaaccccagctacttgggaggctgagacaggagaattgcttgaacctgggaggtggaggttgcagtgagctgacatcatgccattgcactccagcctgggcaacagagcgagactccatgtcaaaataataataataatttagcatatttttggtgaattctggaaactgtcaactgaaaagtaagtccagtttctgcctctccttacactgtaatttttagactcataaagatctgttaacataaaggttaaatgtttaactgtctacccaggaaatttttccccaaaaaattccagcagagggcagcaaatctaaatatggatcccaatgcttaaaattaatttaaagtacaagagaattactcttttttttttttttttttttctgagacagagtctctgtcactcaggctggagtacagtggcacgatctctgctcactgcaacctccacctcccaggttcaagtaattctgcctcagcctcccgagtagttgggattacaggtgtgcaccaccatgctcgactaattttcacattttttggtagacatggggtttcaccgtgttagccaggctggtctcaaacttttgacctcaagtgatccgcccgcctcccaaagtgccagaattacagacttgagccactgcgccaggcctgttggttgtttttcttccctatcccactcccacttccctatcttccctattccctctccatgaggcagagccatcagttttgctcacaaacatattccctaagcatctcggatactgtgctaaatatatctggggaatgaatgaaaaagttgaaaagctctactaagactaaaatctctacacatatgttccacaagggccattttgtatgtgtgagttgaagtatatcttgaactcctgacctcaagtgacctgcctgcctcggcctcccaaagtgctggacttacaggcatgagccaccgtgcccggccagaaaattcacttttgttccctcaatatttccataaactctgtatctcccagagatggtcaaggaattcatgagctaagataacatgatagagttgcagagaaacaaaaacaacagaaataaaaggcgcttctgagaaaccttggcagagatggtcagagaggcacatttagtatgacgcagtacaagttagtgttgaagggtttaattcctcggagctctactttcctcatctgtaaactagggataataattcatagagtttgtcatatggatgaaatgtgatcatgtgatatgaaaagccaactactcggccaggcgcggtggctcacgcctgtattcccagcactttgggaggccgaggcgggcggatcacgaggtcaagagatcgagaccatcctagctaacactgtgaaaccccgtctctactaaaaatacaaaaatttagccaggtgtggtggcacgcgcctgtagtctcggctactcaggaggctgaggcaggagaatcgcttgaacccgggaggcagaggttgcagtgagctgagatcgcgccactgcactccagcctgggtgacagaacgagactccgtctcaaaaaaaaaaaaaaagccaactactctgcatagttagcaatcaaaaaatgtaagctattcattatcctaatgaactgaaaaaactgcttttgcgcctatcgggaggagactgttagaagccaaaggctcatttaaagaggacgtaaggaaaagcaaccaaaaaggtgggaatagagtttaaggcgcgttcgtggtgattcagacctagagtggggagcaagccctctctctggacagccctcagcggcgaggggagcgggcgcccgcgggcccagccggggtgcccggcagccaggactccgaggcggaacccgcagcctggtcccggcgtcggcgcctccccggcggcgtagggagcgcagccgcggggaccgggggcgaggccggggcggtgcagtaagggcttccctcctgggcgcggtcgccctcttacctggagcttcccctcgctggggttttgcccacctgacgcccccgcacccaccggggacggggcagacgtccggcctgctccctcctcccagtggacacctctgtccctgtcccggcccattctccagccccagagcccttcctgcccttcctccccttcctccccttcctccccttcctccccttcctccccttcctccccttcctccccttcctcctcttcctgctcctggctccttccgacgagtttggtttgaacttttgaatccgccaatcagcgccgcgcgcccccactccgcgggtgcggccgggcgcaggccagggctcgaaggtggggccgcagcggcacggggcggggtctggggcccgccctcccgacacgtggccggggaccgggtatataaggcccttcggggccggccaccctttcactacttctcccccggactccttggtagtctgttagtgggagatccttgttgccgtcccttcgcctccttcaccgccgcagaccccttcaagttctagtcatggtgagtggggttccctcggggctggggaagagtgcgcgtcccaggggacggcgggcccggaaactactgcctgcacctcgggccgcgcccaggacagctccagactaccccgggcccctccggttaacctggcttgtggcggccgggctggaaggtcgagttcacttggcagacaccagttcgggccggaaaacctggcccgggtgcggccatcagtggaaatggaaagccctcttgatcctagtgagggctttccccgcagggcccgctactgccctagggaggaaggtcagggagcctgctcattggcctccaagaacttaaactaaaaatccctccccacgttttctcaagcgacctctccttcctactgccttacaaactgggccccggaggccctcgtgcgctcccgcaccgacggtgcagcacttcctggctccccctctccagcgcccagtgactcgctgctgagtcacctgtggccctgccctggggagagcttccaactgcgccagtccacttgagaatggaggcaggcacctccttggaagggaataattaactttcacgttgcctaatcctgcatttctggtgttaatctagtggtaggtttatagctgaagctttctacttaagccgggtttaaaaacacgtccacaaaaggatattttcttataaaaccagagttggcccggcgcagtggctcacgcctgtaatcccagcacttgttcgagacaaacctggcgaacatggtgaaaccccgtctctactttaaaaaaaaaaaaaaacaaaaaaaaacgctgggcgtggtggcgcgcgccggtaatcccagctactcgggaggctgaggcaggaaaatcgcttgaacccaggaggcgtaggtttccctgagccgagatcgcgctactgcactccagtctggacgacagagcgaaactgtctcaaaaaaacgcaaacccggcccggcgcggtggctcacgcctgtaatcccagcactttgggaggctgaggctggtggatcacgagatcaggaaatcgagaccatcctggctaacacggtgaaaccccgtctctactaaaaaaaaaaaaaaaaaaattagctgggcgtggtggcaggcgcttgtagtctcagctactcgggaggctgaggcaggagaatggcgtgaacccgggaggcggagcttgcagtgagccgagatcgcgccactgcactccagcctgggcgacagagcaagactccgtccaaaaacaaaaaaaaacccgcaaaccccagagtaaactagtaccacgtgttcttagttcagttttcaagaaacgtgaaattatacgtaacttgagtgttttctataaagcttccagaagtattgaaaacaactatcttaggccgggcgcgatggcttatggttgtaatcccagcactttgggagtccgaggcgggaggaccgcttgagctcaggaggtcgagaccagcctgggcaacacggtgaaactccgtctatactaaaaatacaaaaattatctgggcgtcgtggtgcgtgcctgtagtcccagcttctcgggaggcaggggtgggaggatcttttgatcccgggaggtggaagctgcagtgagcccagatcgcaccactgcactccagcgagaccttatctcaaaaatacgtacatgaatttaaatataaaaatcaaatgtaaatacatgtatatgtcgcactgtaacaacttattgcttcttttcaagcagtaccaaaaagatactggtaaaagtgggattcacaaagtagtgagaccctttaaaaagcaggagagcggcagcggactggtttaggtgaacactggttaaattttcttgttttttaacgagaggtaagagctgcttatccagttaacactagaccaattgactccacctgtgcctcactttctcccacgtggccaggggagagtggagggtaagtcagtggccgctgactgcctgctaagcttcaagaaggcagtttagactgagcaatgaaagaaaaattgcgggcgcaaaatagaaacggcatttaaacagaagaagcatttgttagaatgagtggatcttctcagatactttatctccttgggcctgggggccatcatgatcaggtatctggttatctccagctttttggggcttgggcgtttccaaagtccagttaaaggtaaacatgatgccgggcgtggtggctcccgcctataatcccagcactttgggaggccgaggtgagtagatcacccgaggtcaggagttcaagaccagcctggccaacatggtgaaaccccatctctactaaaaatacgaaaataaggcaggcatggtggtgggcacctgtaatcccagctacttgggaggctgaggcaggaaaatcgcttgaacctggaaggcggagtttccactgcactccagcctgggcgacagagcgagactttttctcaaaaaggtaaacatgatgcaatggtaaatagtcatgggctaattagaacaaactactcctgttctcccacacccctggagctgggtgagtagacccaggtgatactgagcttgctgatgtggttaagagaccttgattgtttcatggggagtgtaggtgggaaggaggtcaaaggttgtgagtaattagggtttttattatctcttggcttatgagaccaggtcctttgagaacttagtgctctgccagtctccaaagtggctaatctgacttatgatgaaatgccaaacaccctttttgttttcctgttaagtctgtgtgtacagattctatgtttattcccttattttacttagcaggtgtgggtttggtaatttctaaccatattctgctttggcccctctggcctttctaaattaacttggtccacctcataaatatatatctatgagagagagacacacacacacagacacagacacagagtcttgcctctgttgcccaggctggagtgcagtggcgagatctctgcaaccgccacctcctgggtttgggttcaagtgattctcatgcctcagtcttccgagtagctgggactacaggcgcgcaccaccatgcctggctaattcttgtatttttagtagagatggggtttcagcatattggccaggctgttcttgaactcctgacctcagatgatccacccacctcggtctcccaaagtcctgggattacaggcatgagccactgtgctctaccataattttttttttttttgtatttttaatagagacagtttcaccatgttggccaggctgatttcaaactcctgacctcaagtgatctgctcaccttggcctcccaaagtgctgggattacaggtgtgagccagaaacaactaatttcttaacctatcagtaaagtcttggtaacatttctagcctttattattatggtcttccctcttccggagatgttttgacggtgaaggaaaaacgttcttcctatagattagattcttccacttggttaaaaagctgcctctgaccacagtttttaaaatacagctaactgctgcttatccagcattttcttcatgagtcatggctatagtttgctggtttaagctggttttaaaggagggagagagaagcttttgtctcctaaagaataggattaaagcgggaccagaatgagctcagtagttacacaatcattcagagaatgaatcagagctggaaaggggaattttgccttagtttaaggaatcatatctactgtggctacaaagcaactgtctggtcttgccgagtagttcatgaacacatctttggttttccaaggcacttttgctgaattaggtcttcaaagatttttgcttttgaaattatagtccctgagcaggagtggcctgctgaaagatggttatctttttttgtttgagatggaatatcttgtcactcaggctggagggcagtggtgtgatctcagctcactgcaacctccacctcctgagttcaagtgattctcctccctcagcctcccaagtagctgggactacaggtgtgcgccatcatgcctggctaattttttttgtatttttagtagagatgcagttttgccatgttggccaagcagatctcaaactcctgacctcaggtgatccacctgcctcagcctcccaaagtactgggattacaggtgtgagtcactgcgcccagccagttatctgtcttgaaggttaatcagtcattaggtgtgaatcattcctaaatgtcccatctgatgtattataccctgacattttcctttcttcctcccacagcgtgagtgcatctccatccacgttggccaggctggtgtccagattggcaatgcctgctgggagctctactgcctggaacacggcatccagcccgatggccagatgccaagtgacaagaccattgggggaggagatgattccttcaacaccttcttcagtgaaacgggtgctggcaagcatgtgccccgggcagtgtttgtagacttggaacccacagtcattggtgagttgacctcagtaacccaagtgagatcccagggtgctgggacaggaggtctgtcctgggggggctccgctggtcactcacccactctccctccccgctccttgtccctcctcctcctcccccatcatgttctccagatgaagttcgcactggcacttaccgccagctcttccaccctgagcaactcatcacaggcaaggaagatgctgccaataactatgcccgagggcactacaccattggcaaggagatcattgacctcgtgttggaccgaattcgcaagctggtaagtatagtactttaaataaagtgggatgagagtttcttttgcagttctgagaccaaactacagaaatcattctttgcaactaaaatgagactatttgcattgcaactaaaatgtatctgttcactaaattaattggatttctgaaccagatgatcttggatttatgggacaactatggggtagaagtaagtgctctttagcctattttgcttcaagctgagacaccccttttgaggtcatcttagtcatactgagtgagtaggtagctgacttctacatgtaactaattgatcagagtcattttttaaaaatctgggatggttccttcatgtcaatacagaaagttcagagaacaagaagccagtgtcacactgacaagaaacagccaatactggaaacttccagtactgctgaaagtggagtcgggagcttccttatgaagtgtgctgtttggatcactttaattaagagcctggcaatcagatgactctttgctccttaggcatgtgggcagcttgtaagtaattaaccagagatcaagcatgatggtctgggcagagtaacttgtcaagaaaatcacattgtattaagcccagccatgactgctccattctaaaatagaatagcctcatcattcatggcttcatactttctcagatgtttacgtagtcttcccagcaaaactggactgatgtttccgatgcttaaaaactaagctttaggctgggcacggtggctgacatctgtaatcccagcactgggaggccaaggtgggcggatcatgaggtcaggagatcgagaccatcctggctaacatggtgaaaccctctctactaaaaatacaaaaaaattagccgggcgtggtggtgggcgcctgtagtcctagctactagggaggctgaggcaggagaatggcgtgaacacgggaggcggagcttgcagtgagccgagatcgtgccactgcactccagcctgggcgacagagtgagactccatctcaaaaaaacaaacaaacaaaaaaaaccctaagctttagttataagcactgacttggaaaatcagggacctgcctttaggacaaataaacctagtagctatttagggttctggaacgtgaggtttattgcctaccaaaacaattgcatttgtccttgtcattactgtgctcacaggaggcttaactggtgtaattggtaggcgagagtctgccctgtgcattgatctcatgtagttgatggacccacaggctataagggagctgagtagagaatgttcacaaatctgaggcccatcacttggagaagcaagagtttacaacagaatactttatttggaaggtcaaaatcattccttcgtaaagtagcagtttgctaaccaaaatagcccagttaggtggaggaaatccccaacaacctgaggtctcatggaattgtggttgtgtcactttacccaaaataaatgggcttcttggtacctagtgtcatatattggcttactgggccaatactgtgcttactgtgccaagcactatgctgagtacttacttaattctcaacctaaggtgattactattctcacttaatcagtggaagaactgagaaatgaatgtggtcatacagtaaggaactggtacagccggatcctgacacagcctgactccagtaccagggtgttagaactttggctattctgttgttccacctcagaaagcagctgccaaatctttacaagacatccactgtaccaggctggtggtcctgggcctgccccttaggacctctccaactaagaaactgccctgttctgtggccacagcaagagaaccagaggctgccttcccagttaccaaaacttgagccctgtatgcaagcccaggccttgtgattcctctgcctaaggcaatagttcatcttaaaatagtcttagcaaaggtttttctgctcaaggacttgattgtgaaaagttgttctgaatcacttagcacttaaaagcttttttttttttttggagacagggtctgctctgtcatccaggctggagtgcagtggcctgatcatcagtcttgaacccctgggctcaaatgcaaatggtcctcccaccttggacccccaaagtgttgattacaggcgtgagccactgcgcctggcccagaagagttttaaaattgcaattggagtagccatagatttatagaagtcctctgtaggtttcaccaaatgtgaacactaaatgaaactttcgcaacactaaaatgaaacttttttattttgcaggctgaccagtgcaccggtcttcagggcttcttggttttccacagctttggtgggggaactggttctgggttcacctcgctgctcatggaacgtctctcagttgattatggcaagaagtccaagctggagttctccatttacccggcgccccaggtttccacagctgtagttgagccctacaactccatcctcaccacccacaccaccctggagcactctgattgtgccttcatggtagacaatgaggccatctatgacatctgtcgtagaaacctcgatatcgagcgcccaacctacactaaccttaaccgccttattagccagattgtgtcctccatcactgcttccctgagatttgatggagccctgaatgttgacctgacagaattccagaccaacctggtgccctacccccgcatccacttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaacctgtgtgctgtacttttacactcctttgtcttggaactgtcttatttttgttctgtaaatgtctattgccgtaaattgttaataaaattgaagtttccattttaaatgtcgagctgacttaaatacttgatccagttaaagttggatgtatgaggctggtagatgaaaccacctgagtcgagggtcttgctctgtcacccaggctggagtgcagtggcatgataatacatagctcattgcagcctcgagctcctggactcatgtgattctcctgcttcagcctcctaagtagctggggactgcaggtgcacaccaccatgcccagctatttttatttcttgtagagatggggccttgctatgctgcccagggtggtcttcaactggcttcaagtgatcctcctgcctcaacctctcaaagttttgattataggcatgagccactgcccagcttcttggtttatctgtttaatttgggcctgaattaagtggttatagaatcattttgtaagtgaggaaacgggttcagattgagccagtgcttctctaactaaaatggatgtgaatcacctgtagatattaaaatgcaggtttggggtcaacctggtggctcatgcacttcgggaggccaagttgggtggatcacgagcccaggaattcgagaccagcctgggcaacatggtgaaaacccatctctaccaaaacaaaaatttgcatgctgtgatggcacctgcctataggtgggaggaccacctgagcccaaggaggttgaggtagtgagccatgattgcaccactgcattccagcctgggtgacggagacccctgactctcaaatttaaaaacaaaatgcaggttctaattctataggcttgaggtgaggcttcagacacgtcttaaattttttttctttgagatggtctctttcccaggctgcagtgcaatggcaccatcatagctcacccccaccttgacctgggctaagccatcctcccacctcagcctcccaagtagccaggactacaggtgtgttccaccatgcctggctgattcttgtaatttttttttttttttttttttttttttttggtagagatggggttttgccatgttgcttaggctggccttgaactcctgggctcaggcaatcctgcctcagcctcccaaagtgctgggattacaggagtgagccactacacctggcccctagatacgttttttaataacctcccaaatgatgctgttggtctgatgtgaccacatgtacagtagcaaagggttagataacagtaactgctggagccaaaattcaagtgcccagccacactgccagaactattgctgtcagtctttaataaagtattagtcacacgagaagggcttggaatcctgatttattccatacttagctaagacctacagtggcaaagatggttcgtactaaaggggttattgtttagagaaagtggaaatgtcagacaaaataacagtcaccggtttttctggtattggcatttgacccaattgtatgtcatggagattatttgaagtaggagtaatatgtatgtgtaggaaagattggagaggggtgagttctctgatttggacttttttccaagcacctgttggaggaccgtggttcttgggggcagacgggtgaaggggcatgagtgttatacgtagctggagagcttggtgcctggtactcagttgaactaagcaatgggaaaggacaatgaccaaaaggtgaagcttcatgcagaagggaggaatcagttttggtgcttgggtgcttgcctgagtgggaatgcctaatgagtggtagcagatgggccctgggggcagagttgcaggcatactcacctctcctccgtgacttactttattctgatgtgtacccagttaccatctctttcccaaaggtgttttgtatcccttacccattgctcactttagcccctttgctctgagaattgcatctgaaagatgtgcatgtttaaggccagcgctggggttcacagctgcagtcccagcactctgggaggccaaggtgagaggattgcttaaacccaagagtctgagaccagtgcctgggcaagagggtgagaccctgtctattttgagcatttttttggccgggtaccatggctcacgcctgtaatcccggcactttgggaggctgaagcaggtggatcacttgagcttaggagttcaagaccagcctgggcaatatggtgaaaccccatctctactaaaaatacaaacaattagctgggcatggtggtgcacgtctgtggtcccagctgcttgagaggctgaagtgggaggattgcttgagcctgggaggtggaggtagcagtgagctgagatcgtgccactgccctccagcctaagggacaaaaaatttttttcccttaaatttttttttatgtctcaaatttttttaaatgtatatattatacctgcgtgcatagcacagcatgcttttgcagcctgagatgcctcaactatgtgctctggatggttttatatagcatttgtcgagagcaaccatagttttatgtccttcggggcaaggtaagaccccagcacaaattcagccactgctacttctcagatgagccaggttcttcctgcagcctgggcaggggagcggggtgggatgcctgaaatgaaggtgaaccttgaagacgctggctagcctgccagaggggattttgagaccttcccaggccaggagatctgctgattgccatagtgcaagcactggaggaaatgggaatgggacacccgtgtatgaaaaggagcagataaatcacaaagcttaggcgagtgtgacaccccatgacaccagcatttcccaagcagggtgccctgagaataggattcagggtgcccatataggatcccttcggcttttagaatgacatggtggaaactggagagcctgactcacccatcctccctggggccagtcaccctggccaggagtagccccctccatttacctctgtacaccttacagatgaattattttctacatgtgccaagatgtgaaaaaggttggaaagctttaagcagccacagaggtctggggtgaaagaaggtgagagaaaagtttagctgagaagaaatattccagtagaataaagcctggggaattggaagagcaaagtgccagtggttgggggggcatttgtccttgtaaagatgatttccccctcctgcgttggagggagagtgaatagaagttagcctgcagcaagaacaaatataccccaaggtctaggtcactgctttgtggctgacaatcatctgatctgcccttgagcacgaatggaaagtctggacccagagctgcgactgatgctgatgctgaggccgctgaagcttgatgggaataaatgcacacagcctaagaggattcgggctcctgaggctggcggcagccccaggtccggctgtgtggacagagggcttagtctgccctcacctaacctggccagaggagcaacctgcttccccccacagaggccgctgaccactgagaggttagcatgtctgggcagaggtgttttgggcagggatgagaagggggataatgactttgaggggctaagggcctgcctgtccacctgtcattctgtgtttgggaagcagctggcaagtgactcttctccagcaggaatctgtcaggccagaggatggccaagtgggttatgcaattacaaatcagtcttcaggcctctgctggaaggtggtgtggcagtcctgggtgaggctgaaggaggtcaggggaggcgctgtcagggtgggaggaaaaggtgccttcacagtttccacagtaccctgggaggtgatgttattatacccacttccatagctcacagagattgaatatctagcctaaggctacagaatgagtggcagaactgaaattttaccgcagagctctggctctaaagcctaggctgactccactctgtcgtccagccatcgaggagctccagaggaaatcggctctgcacctggcagcctttccagtcctggggggatagtgccacctcccaggacccttggggcatgaggtcaacaagggccagccctcacatgagcactggatggagctgtagtcacagagagatctcattatgccagtgattgtcagaaaacctcccaagagccccgttcctgggcccaggtggcagcccattgaccttaaatagcaaagccagctggtccccatgtccaggctgtagcttccctagtgagggggcatttttgtccaggcctccctctgaactcagttctcaggtcacggggagatacagtgcccttgcaggatggctgctgccacctgcctggtctcctgccaacagggacaccagctgaggcacaggcaggacagtgtacacctggagcctcgctcctctatgctccagggccagagtggtcagtgcccgtcagctgaggcggcaaggtgaagctggcagagatgacccaggcagatggctccaggagcccaatgccagggcgactatctaggagacacaaggcagcagaagctgaagagaaaatagacccttgggtgtgggggctgtggagcaggagtgggccctcgccccgtgaaataggtcccctttgctgacatctcattagcctgtcactgcccctttcatgccaagaacctagtgcccctgaatttgtcattgtcagccccaagcaggttttgggaaaacagttctttcctcctctacactccctccgagtctacagcaggagagcaatagtcagaatcaatgaaccttccagaactagagacatgtctgctttagtcataatacaaaaaatgcttttaaacagtcgtctccctactggacttttttttctctctctctcttatttatttatttatttattatttttgagacagtctgtctctgtcgccaggctggagtgcagtggtgtgatctcagctcactgcaacctccgcctcccgggttgaagtgattctcctgcctcaggctcccaagtagctgggactacaggcatgtactaccacgcccagctaatttttgtagttttggtagagacagggtttcatcatgttggccatctcctgaccttgtgatccgcccgccttggcctcccaaagtgttgggattacaggcgtgagccaccgcgcctggccttttttttttttaattggaacagactataaaggttttacagaatataaagatttcctaattacacaaagattttgtctacagaaattagtttaactcatggaagagggtgggtataaattcaaccccactctctctcccttcaccctctctgcacacttctctattttttttttttttttttttttttttttgagacggagtctctctctgtcgcccaggctggagtgcagtggcgggatctcggctcactgcaagctccgcctcccaggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcctaaagtgctgggattacaggcgtgagccaccgcgcccggccacacttctctatttttatcaaatatctcatttggcttccaagagatgtctagtccaagagtaaacaaatactgaaatgcccttggcaaaggtaatccaattatactattctggcaatcatctccagttttttgtttgtttttctttctttctttttttttttccaatacagagtcttgctctgtcacccaggctggagtgcagtggtgccatctcagctcactgcaagctccgcctctcgggttcaagcagttctcctgcctcagcctcctgagtagctgggattacaggtacccgccaccactcctggctaatttttgtattcttagtagagctgagggttcaccatgttggccaggctggtctcgaactcttgaccttgtgatccgcctgccttggcctcccaaagtgctgggattacaggcgtgagccaccgcacctggccgttcttctttctttctttctttctttcttttttttaaattaagcctgatacttgctaagtttatttttttagagactgagtcttactatgttgcccaggctggccttgaactcctgggctcaaacactcctcccacttcagcctcctgtgtagctgagacaacagcacaccgcactgggcttcattttcaactttcaagttttattcgttcattatttttgcaacacctgtttggtgcaagtcactgtgctgggtactataggaaatatatttagctttttgcttctcagattgtagagacagaccacacatgcataatcccaattcgaggcagcatatgccacatgtcacagaagaggctgtcacaggcagtagccactgttgcatagctacttcaaagccattcccagcttgttccacctgccaacacaacgcagctctgtcctggtgtgggacacccatgtgcattggaggggctgggcttcactaccagggtgaaccttcccctaagccaatcaaggtaattccagttgtttcgccagggcctggttaaggaaccagcatgtgatgtaattatggaaatgagaggtgaggtaatgtctgccggttgggggttggaaggaagatattcttgcaaaaatttccttgctcttaaaaaagaactcagggaaaggattttcctcttgcagccctgggcattactgcgtgagcacattgtgcttgtgcttgtgcttgtgcctggtgcttgaggttgctgcagccgtcttgtgaccagaatgggacaaacacgaggacaaaagctaccgctcaatagcaaggcaacacagaaagctgaaaagagcatgggccccgatagagtgttgagcccctgaattaaccaaccttgacaccaaaccttgctctgcctccgaagtttttacaagatttttagtccccttattgtttaggacattttgatttgggtcttctattttttcctgccaaaagcattctaactaacattaaagccttatgtaattgttaatagatttttttttccttattttctgccgggcgtggtggctcatgtctgtgatcccagcactttcagaggctgagatgggtagaccacttgaggtcaggagttcgagaccagcctgggcagcatagcaaaaccctgtctctacaaaaataaaataaaataaagtagaagaagctgggcatagtggtgtgtgcctgtggtcccagctactccgggggctgaggtgaaagggtttgagctgagcccaggaggcagtgagctgtgaccgcaccattgcactccagtctgggcgacagagcaagaccctgtctccaaaaaaaaaaaaagaatttttttctgtattttcttcttcctcctcccctcttcttcctcctcctcctcctcctcttcctccttctcttcctccttcttcttttgtaatagaaacagggttttggcagggcacggtggctcacgcctgtaatcccagcaatttgggaggccaaggtgggcagatcacttgaggtcaggagtttgagaccagcctggccaatatggtgaagccccatctctaccaggtgtggtggcacacgcctgtaatcccagctactcaggtggctgaggcaggagaatcacttgaacccaggaggtggaggttgcaatgagtggagattgcaccattgcactccagcctgggctacagagcaagactctgtctcaaaaaaaaaaaaaaaaaaagaaatggggtttcaccgtgttgcctaggctggtctcaaactcctggactcaagaaattcacattcctcagactcccaaagcgctgggattacaggtatgagccactgtgcttggccagaaatttgtggtaaaattattaataataaaaatatgaaggccctgctttcattcaggccaaaaaatattaaggcccttttgaatttgcagaacccctttgccagtgcaaaccttgccttgggcgagtgaagatcctgtcccctctttctttcctcatatgttgccttcttccacctgcagttcctagtccaccaaatggatctgctttttccttccagtcttcccaggtgccttggccaaactcaaaccataaataaaaggaacacagacaccaggcatggtggcttctgctgtaataccaacactttgtgaggctgaggaggaaggattgcttaaggctaggaattcgagaccagcctggcaacatagtgagaccctgtctctacacaaaatgtaaaaattaccctggtgctgtggcacggacctatagtcccagctattcgggatgatgaggtaggaggattgattgagcctgggagatcaaggctacagtgagccgtgttcatgccactgcactgcagcctaggtgacagagcaagaccctgtcccaagggggaaaaaaaaaggatagaacatctgcaagtccaaacagtgtgccatattcttccttttttttttttttgagacagagtttcgctcttgttgcccaggttagagtgcagtggtgcaatctcagctcaccgcaacctctgcctcccgggttcaagcgattctcctgcctcagcctcccaagtaggtgggattacaggcgcctgccaccatgcccagctaattttgtattttttattagagatggggtttctccatgttggtgaggctgatctcaaactcccaacctcagtcaatccgcccacctcggcctctcaaagtgctgggattacaggcatgagccaccgtgctcggcctcatcttcttcctttttacttgcagctatgagtggggcctgtggcctgatgtgagggggtagagaagagcaagaaggccccaacctgaaggaatgcccccctcctaggtacctatcaaaatgagcctgaccctagggcaatgccacagcttccagagcctcccatgctatttcagaccaaggatcttgtagacaaggagtggtgcagggtgacgcggatgagacccagaccagactctgagggctctgggatgtgaatggggttagctgactggttgctccccgtgtggaggctctggggcctgtgagaggaaaaaacccaagttcccatttctggcccattgttttcctctattcttcctccctcctcccctctttccaccacccctcacctccatttcccttctcctctcccctcctctcttccccctccatttcccccttccctctctctcccattcagttctcccgtttcctgtctccatctcctctgccactgccctcccctccagccaggggccagcacagatagccgtgtactatagaaagaatccaactagagagtgagagaatgttcttcttttgttgtttttgttttctgagataggagctcacttggtcactcaggcgggagtgcggtggcataatcatagctcactgcagcctcaacctcctgggctcaagcaattctcccacctcagcctcccaggtagctgggactacaggtttgcaccaccatgcccagctaattttaaattttttgtagagacagggtcttcctatgttgcccaggcttgtcctgaactcccaggctcaggcaatcctcctgccttgacctcacaaaatgctgggtttacaggcatgagtcgctgtgactggccaagagaatttctttttttttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaactctgagtggacacagcacatgtttcagagagcacagggttgggggtaaggtcacatatcaacaggatcccaaggcagaagaatttttcttagtacagaacaaaatgaaaagtctcccatgtctacttctttctacacagacacggcaaccatccgatttctcaatcttttccccacctttcccccctttctattccacaaaaccgccactgtcatcatggcccgttctcaatgagccgctgggcacacctcccagacggggtggtggccgggcagaggggctcctcacttcccagtaggggcggccgggcagaggcgcccctcacctcccggatggggcggctggcccggcggggggctgacccccccacctccctcccggacggggcggctggctggccaagagattgcccatcaggtcactgtgggtgtgacagccactggctccagaagctcagtcctggcggcagctgtcaaaccaacacccacatagcctgcaagcagagggcaggcggggcagtttgtagggcttcagaccctgtgaatttttctgttcagctgtcacccaacctctccctgcaagaggtagggtgagacggatggcagagtgtcatgactgaagaagagcctccgacgactggcctgatgggcacgggcccctgccctgtcgcatgtcaggcacacacatgtgctccagccactgcctggggaaaagagcataaccatgtgccagggtgagatctctccccggctcacagaattgcaagtactgctcccctctcagcatcttcagcaagaaacagggggttgggggtgaggggctgtgcctggtgatcccagttttcctccttctcatcatcttccagggttccaggctgaggagctcagaggttgtgtggaggagggaggggaataacagatgggcccgcatcagggctgcgcctcctcttggacagtcccagaactgagagttggcggcggtgaggaggatcgctgccctccttggacaccccgactgtgatctactctaaaaatcctcccttcacctgaggagaagattgcaggcatgttccacctccagcacggtcctgagatgagttgtccccatttccccctgccctttccttcctcagtaaagggattactgttcattcccacccagaggatcttggagcatccccctgagaaggaagagcttaggactccttccccgctccacaaagagcagttacaaaataaaaaataaattaaaaacacaaacaaaggctactctgggcacactgcctacggggtagccttgctccacagggggcagttaaaaaaagcaaaacaacaataacaacaaaaaacaaaaagaactactgggggcagtggtctgagacccacccctctctttaataaatgcctatttcattttatttttacttttaagacagagtctcactctgtcgcccaggctggagagcagtggcgcgatcatattttaccagtgaggaaagcaaggcccagtgactggcccagacctgggaccatatccttcctggtttttggttagctgcactttccttgcaacatgagacatctcaagtgtaaacacctctgcccagctttcccaccttctataaac

SEQ ID NO: 373 - DNA, 43914 bp, Homo sapiens
gtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaactgaagacctgttaagagtattctgtaagtcaacccaatgatacacatcatgttcctgtccacatactggttttccccaaatcagctgataaattcagtgtaattccaatgagattgaaactttggaattgacagttctaaagtgcatttgggagagtgaatgtgtgagaacactaagaccactctgaacgatgataatgagttggggggtggactgctcgggggtgatcctgccagattcccagaggattctcacgccaccattacctcactcagtgtgacctggagggggtcagacagacgggagagtccagaaacagacccagggctacaggaatttagtatatggtaagagggatgttttaagtggggaaaaaggtggattatttaataaacagcacttttagacaactagctatcaaagctagatctcagctgggtgcgatggctcacgcctgtaatcccggcactttgggaggccaaggtgggtggatcacttgaggtcaggagttcgagaccagcctggccaagatggcgaaaccctgtgtctactaaaaatacaaaaactagccaggaatggtggcgcgcgcctgtaatcccagttacttaggaggctgaggcaggagaatcacatcaacctgggaggcggaggttgcagtgagcttagatcatgccaccatgccactgcactccagcctgggtgacacagccaaaaaaaaaaccactaagttagatctctacctcacagtgtccatacaaattagttccagagggaagatataccacaaaattactcaaaaatttttatacctctggtgtgggacggtcttttctaaactttaacatgagacttaaaagatataataagggaaaagataagcagatttcgcaaccaaaaaatatcgaaagtctctgtgtgatggaaaacatcaaggttaaaacacaaatgacagatatggaagaaaatatttgcagcacataaaaaaatcaacgagtacaattactttaggagaaaagcttgcttcagggtccttagagaaagtcactggggcctgccaagctgccacctaaagacaagagtgagagggctgagttcttccaggtcatcagagttgttgctgcccgtattaggccacacagtggaaccccatttatatcatagcagaagaaataggattatcaatgtgaactgcttagcatggtgcctggtatatacgagagctccacaaatgtgagctataatcctactagtaaaggatgctaagcagttccactgtggcaggtgtcatttgctagtagaatttgtaatcaaacaataggaggggaatctgtgaacgcctagaaaatgagcagaataaaggatattatctttggaagtcttagatgtgcaatgaaattatttgtctgacagaaacgaatgctgaattctatttacttaagcctttaaaatgacttaaggcagtccgggcacggtggctcatgactgtaatcccagcaccttgggaggccaaggtgggtggaccacctgagctcaggagttggagaccagcctggacaacatggcgaaaccccatctctaccaaaaaaatacaaaaatgagccgggcgtggtggtgtgtgcctgtaatcccagctactcggtaggctgaggcaggagaatcacttgaacctaggaggcagaggttgctgtgagccaagattgcgccattgtactccagcctgggtgacagagcgagactctgtctcaaaaacaaaaaaacaaaaaaaaaaaacataaaatgacttaaggcagcatggctcaaggtgtgattcagaatcaccagaactgccattgaaagtacaggtttctgttctgactagggcttcttcagcctggaggctgcagtgcagatgcgtagggcagagccacagctgccctgagactgctgtgtcataggagataggagcaagaaacaaaagctgacttcagtgcacagggggataaaggcagattcctgggtacaacctttgaactggtttctgggagtagaggccaaataatttgcatttttaacaagctcccaggtgattcttgtgcatgcataatttggaaatggcccaacttttaaagcaagcagcaaccctttaccacagagctgtggtactgaggcctcacggtttgtttgtttgttttttttttttttgagacagagtcttgccttgttgcccaggatagagtgcagtggcacaatctcggctcactgcaacctccgcctcctgggttcaagcaattctcatgcctcagcctcccaagtagctgggactataggcgtgcaccaccatgcctggctaatttttgtatttttagtagagacaggttttcaccatgttggccagactggtcttgaactcctgacctcaagtgatccgcctgtctcggcctcccaaagtgctgggattacaggcgtgagccactgcgcccggccagcctcacagttctgagggttaccatcaaaatgaaccaggacatgacagaagccatttcaaccactggagacggatcggattctattcctacatttacttggaaccatccagctttcatgaagaaggaagggctgtatggccagttggaaccacagagagaaaggctccagttgaaccacttaagagctggtcctcccatgcagggcgagccagcccagacagtgtcctcatatggcttgcctcagggtaggtaaaacataaaacctcgaccacttgtgcagagagagcagcatctttaatttgacctgaacctgacttgcttaccttgctctgtcactggggcatctgtgcactcacggagggggaaaatcagtctaggatggtgggaatgaggcttaccatccacaatagagatctctgaacaaaatctttgttcttccctaacaaaaaagtgtgtgaaggacaaacacttcaagggctcattctcattctcattctcatagtgagaagagataagacagagaccagatccttcgcaacaaccctcaattttacttagggtcagtgagaaatcaattcagatggtaacagtacccaggaccagctgggtctgcagttggctcctgactcctgacattctggctcctgactttggacctccctagttgagaataaacctgaactaaaaatccatgtagttaggtagtctgggcacaggaaaccaaagtggggttggagatgcggactctgtcattctgaatgtgacagagttgaagatttgagacacagcattgagtgtggagacctagagaaggcccctcagtggagtaggaaggactggggtttcccagtcagcatgcctcccgcaagtttgaatatttgtgtccctctcaaattcatactgaaacttaacctccaatgcagcatattaagaggtggggcctttagaaggtgattaggtcatgagagcttctccctcgtgaataggattaaggccctaatgaaagaggcttcacacagcctgccttttttactgtgtgaggatgcagtgaccaccttggaagcaaaaagcagccctcgctagacaccgaacctgccagcaccttcatcttggacttcctgcttctagaactgtgagaaaacgaatttctgttctttataaattacccagtctcaggtatttttgtcataacagcacagactaacatacctagagacttgcattccaactagaggcgcaagcacacctataattctgccctctcaactcctaatgccagagattgctaaataaatactaaaaatgtaaaaacaggccgggcacagcccagcactttgggaggccgaggcaggcagatcacctgaggtcaggagttccagaccagccagaccaccatggcgaaaccccatctctactaaaaaatacaaaaattagccgggtgtggtggtgggcgcctgtaatcccagctacttgggaggctgaggcacgagaatcacttgaacccaggaggcagaggttgcagtgagctgagatcttgccattgcactccagcctgggcaacagagcaagactccatctcaaaaaaaaaaaaaaaaaaaaaaaaaagaaagcaaaaactgtcaaactcaaaataaaggaaatcttctttgacaaagaatggagagaataatacagccattagcagaggctgaggctatacagcttgagagaagtagagactagttcaggatggtaggtgctgggacttcaaagtccacgtgggacaggtaaccaagtgtaacctaggaacgtcaagggaccagaaccagactctgagaggtacacaggcaggaaaaatgtaagttgcaaacaaaaacaggatgacatgcaagcaatctaaaaaaatactttaaaaaatatatatgtgcaatcaccaaagagctaaagatattcagtcttgcaatgagaaactgactgaaaagaagcaaataagattttacaaattatacatgctggaaatgtaaaaatacaattattgaaatatactctatgtatggtataagccctagactggaggcagatgacataaaaatttagcaggtctggaaaacaactgaggaatcacccagaatgcaccacagtgataaaagaaatataaaaaagaagctaagacagatggaggatagactgagaagctttggcataatgtttcatagcagttttagaaaaaaagactagtgagaatacagggatgagaaaacaaagacggtgaatttttcagaactgaagaaagatgtgagatctcagaatcaaagagctcattaagttccaagaaaggtacatttaaaaaaaaaggccaggccgggtgcggtggctcatgcctgtaatcccagcactttgggaggccgaggcgggtggaacatgaggtcaggagatcgagaccatcctggctaacatggtgagatcccgtcactactaaaaaaatacaaaaaaattagctgggccaggtggcaggcgcctgtagtcccagctactcaggaggctgaggcaggagaatggcgagaacccaggaggcagaggttgcagtgagccgagatcgcaccactgcactccagcctgggtgacagagcaagactccatctcaaaaaaaatagatagctgggcgcggtggctcacccctgtaatcccagcactttgggaggccgaggcgggcggatcatggggtcaggagatcgagaccatcctggctaacatggtgaaaccttgtctctactaaaagtacaaaaaattagccgggcatggtggcgggcgcctgtagtctcagctacttgggaggctgaggcaggagaatggcatgaacccggaggcagaggttttagtgagccgagatcgcgccactgcactccagcctgggcgacagagtgagactccgtctcaaaacaacaacaacaacaacaaacaaacaaataaataaataaacaggccaggtgcagtggctcatgtctataatcccagtactttgggaggccaacgtgggcagatcacttgaggtcaggagtttgagactagcctggccaacgtggtgaaaccctgtctctactaaaaatacaaaaaaacccaaaaaccagaaaaatcaaaatgtagcggggcatgctggtgtgtgcctatagcctgtaatcccagctacttggaaggctgaggcagaagaatcgcttgaacctgggagatggaggttgcaaatagccaagatcatgccactgcacttcatcctgagcgacagagcacgactccgtctcaaaaaaattaaaacaatttaaaaaacctcgtgtagatatattgcaaattacgtaagataaaacctaaaggccaggcacggtggctcacgcctgtaattccagcactttgggaggccaaggtgggtggatcacctgaggtcaggagtttgagatcggcctggcccacatggcaaaaccctgtctgtactaaaaatacaaaaattagctgggctggtggcatgcgcctgtagtcaaagctactcaggaggctgaggcagaagaatagcttaaaccagggaggtggaggttgcagttagctgagatcatgccactgcactccagccttggcaatagagtgagtgggattcactctcaaaagagaaaggcaaatataagaacttattgagaaactgcaggaatgaatataacctgttgtacaaccatggtttaactgtagatttttagcctagcttttttttttttttttttttttttgagacggagtctagctctgtcgcccaagctggagtgcagtggcgtgatctcggctcactgcaacctctgcctcccaggttcaagtgattctcctgcctcagcctcccaagtagctgggactaaaggcgcccgccaccacgcctggctaattttttgtagttttagtagagacagggtttcaccgtgttagccaggatggtcttgatctcctgacctcatgatccacccgcctcggcctcccaaagtgttgggattacaggcgtgagccaccacactggcctttttttttttttttttttttgagacggagtcttgctctgtctcccaggctggagtgcagtggcatgaccttggctcactgcaacctccgcctcctgggttcaagtgattctcctgcctcagcctcccgagtagctgggactacaggtgcccgccaccatgcccggctaatttttttgtatttttagtagagacggggtttcaccatgttagccaggatggtctcgatctcctgacttcgtgatccacccgcctgggcctcccaaattgctgggattacaggcgtgagcctctgcacccagcctgcctagtgtgtttctttggaacttatcaaaatgtctctggaggccgggcacgatggcttcatgcctgtaatcccagcactttgggaggccaaggcaggcggataacttgaggtcaggagtttgagaccagcctggccagcatggtgaaaccctgtctctactagaaatacaaaaattagccgggcgtggtggcacacatctgtaatcccagctactagggaggctgtggcataagaatcgcttgaacccaggaggcagaggttgcagtgagccgagattgcgccactgtactccagcctgggtgacagagcgagaatccatcttaaaaaaaaaaaaaggctctggaacatttcatttcctgttttgttactgacctgtgactctgtaaaagtctactttcgcaatttggattaataattttatgaatgcaaattggagatgctgttcaaaaaaaaaaaaatagaaaagtcttacaaaggaaagacaatcacagtgatagcagacatctagttagctacagtagacacctggagtccattcaaacctagagaaaactcagccttgaatttgctatcagctacaccattcaagagcacgggggaaatgaagacattttcagacatgcaaagactcaacagtttgcaatgtacaaaactttagtggaagaaagtaggtgtacttaagcaaaaagagaatttgtctaggggcataaactaatgagagggagggtacacctaaatactggctataaatgtaatactagtttatagtttaaaaagaggcaggaactaaaattctagaaagcaatattgtgaagagttattcaaggctgggcacagtggctcacgcctgtaatcccagcactttgggaggctgaggtgggcagatcacctgaggtcaggagttcgagaccagtgtggccaacttagtggaacgccatctctactaaaaaataaaaaataaaaaaatccaaaaacaggtactaagaggacagaccttgcatcaaatggtgctaggaaaactggacatccacaagcaaaaccatacatcatatattttgtatatggtgtatatacaaaaaaattacaccatatacaaaaattaacccaaaatgttcttgccacaaaaacaacaaaaaattgggtaactacgtgaaatgatggatgtgttaatttgcttcactatagtaacctttttactacctgtatgtagcctcataacatcatgtataccttataccaaattaaattgatttaaaaagaaatttaacccaaaatggatcaaaaactttacttgtaagagctaaaacgataactttgggaggccaaggcgggtggatcacctgaagtcaggagttaaagaccagcctgggcagcaaggataaatcccgtcactactaaaaatacaacaattagccatgcgtggtggcgcacgcctgttatcccagctactcgggagactgaggcaggagaatagcttgaacccgggaagcggaggttatggtgagcagagatggcaccattgcactccagcctgggcaacaagagtgaaactccgtctcaaaaaaaaaagctaaaacgaaagctcctagaagaaaacaggaaaagcttcatggcattagatttggcaacgatttcttagatatgacactaaaaacacaggcaacaaaatatataaagtggactacaacaaagtcatcttttcttaaaaaaatctcgttatcttactcccgcaaaactatttaaaaaaattaagttcaaagttctccaaaatgtaccataccctggggattactctgaactttgttcatttgttttcttttaattcggcttttttggttgcctttcacctactttttcgcagagccctccgctggggccttcacttgggcaaacaactatcgtagtcgaacagctttgacctaacaatttcctcgtacccaagatgatcgcttttccagacaacttaataaactttggctttaatggatgactggatgcagaataaaatacataaaaataaacctcagctgctcagcaacgactgaaaaaccaccaccgggcaatccctccccatggccaccgagcaaagttccaccgcctcccctacgccgaccgccgggctcccggggtcggacagccccgggccacttccgggccttcccggaagtccctgtcacttaacaaccgaagtaacccgcaatgcggaagggcgaggggattgcgagtcaccgagtttcccgcgcggcttgaggtactggggaaccggaatcccccaccggcccaatcatgttgctgctggggtctctccggtgcccagcagtggttgtcagtaagcgggcggcactcccttccgatacgtcttttcttttttcatttttgagacggagtctcgctgtgtcacccaagctggagtgcagtggcgcgatctcggctcagtacaaactccgcctcccgggttcaagcgagtctcctgcctcagcctcctgagtagctgggattacaggcgcgagccactgcgcccggctaatttttttttgtatttttagtagagacggggcctcgccatgctggccaggctggtcttgaactcctgacctcaagtgatccgcccgcctcggtctcccagagtgctgggattacaggcgagagacaccgcgcctggcccccttccaactttcttaacgggaaaggctgctaccatttcttgagcacctatgtgtcaggctccatcaggcacgtcacagtctaacctgataattacacaacccatgtcactgacaaggaagccaggttcggaggggttgaggcccgcaacctgagggaggtgactccgggacacacaattagtcctgctttgctgaaggaaagatatgcagcccaccagtcggaggctggagaaggagcagcagcagcttaaaccttaacccagagttatttttattttccagaacgtgttaggaactagtacttaaataatctcaagtccctgaggggccagagatcccaccatgcaaaatagcaaacagacccaagacttggggagaggcggtgagtgcatcagaaatggatgggtacatctgattcccaccacgcggggctcagcttagttagcaggagaccttcagactgagaaaaaatgcaagtctttttttggcctctaatatctgggaaggatggagggagctcaggagacacagaaaagatggcgtatgaatcctgtccggcctgaacgaggctggagttgtgcctctggatagcttcaagcactgatcagattgtcagcccccgctgcttgaacagatgctttagagcctcttccagttgccggtttgttccctgaagccccttcaccacctgcgctgcccactcgaagtattcctggactcgatgttctgaccatcctgcataagagtcgacagaaacttgctagcgtgatgtcaaggaaagcactgccttttccccacttcctggcaagcttggttcaaggccatgagttcctgatggaatgagctgtcctgaaaacttccccttggcccagctattgtatttttactgtatgaaagaagatcaaagagtggtccagtaggattaatttgggaattaagaatgcccagggtttttcaggggaactgaccaacatgtgtcttcagaaggcggcatccccctcccttttcccttacagcccatacgaaagcgtaccctctggggtgcagcgattcaggtccctcagattgtacagcttgtctgccagcttcaccagtttggccccggggctactgtggggcgcttgctccacctgcagcctctttctctccagcttgggcagagtcttgtcatctgttacctcctccaccaggcgccgcacttgtgccccaaagtgtagctccacctcatccagggtggtgtctgtgtcctccaccgtgtcatggagcagggccgcctggggacaagttcccactcagccctgagatgtcagccaagggttgcccattgctgaatggggcccctaatccccatcccaggctcctggcagagaagggggaaagttacctgtaacaccacaatgtcagtgattcccgcctcgtgggtcaggatccgtgccacacctgacggggaggggcaaagcaggaagtcaggtcggaggtagtcccaaggcggtgtgttgtgggttttggagagccagatgtggccccttgtggactctgactagctgggtgaccttggtcaagtaccttaccctctgggagccaaccgacaaagggaacgatcatgcctaccgttccaattgttatgaggcttaaacggtatatcgcactaagcttgggacaaaacaggtgctcaatgaggtgcacgccccccacgtttccttcccagtccccaccacccaggtgccgcagccggcgctccgcggccgacgcgcccaccgatggggtggttgatgtagggggtcccctcggggtccttccgccgctgctgccggtgcttgcgagccgcgaagtcggcagcctccagcagctgcgccgcctcagagcccatcgcgcggatggggccgacgactgcggccgcaggggcagggacggaacgtttacagcgccccctggcgccggggaggcccggggatcgtggaggctaattcagcgggccgagttgggcctgccccagatgaattcctctggagctgaccggcccgcgcagagagcaagtgatgtggacagctgccttcagcatcgcagcccccagctcagtgtgctctgttgggggtgcaagaagaacataagcctggctctttgggagcccacagtctgtggaaaagaggaagacagacaagaaataaggcagtggcctcacagtgctctgaatccagggtggccaaggctcaggggactatgggagcgggaagaaagaacaatccccacaccctcagagtcagagacagcttctcccagaagctccccccaagaaccatcttcaacctgtaaaagctctgaaaattctccaagtgttctaaaaatagttctccctgtagggatgggccaggttctgtgggcaggggagtctacctttggaccctccaggagaccctagggcctgacctgaaaaatcagagccttccctgggagccctgcctaattgcttcagacttaggctcccaggtagctgtgacgtttctgcaggaactgcctttgtttgtcctcagtgttgcagatgaaatttgccttgtcttcttatgctatgagagctcctatttcagtctctaggcatcttctgtgggcccctggggtgatgagtgttgtcactgctgtcctgggagcatgatgttgtcaggcctgggtaggcactggaataacacttaattctgctggctggtggccttctggagaaattccctgccttaggggcagctgaggggtaagagagacctggtgatccccatagaacttctctgtgagagggggttccctattagctaagtatactctaatcagacatgtagcttttgtgttctggctggtagctggggcagataaggctcaggggaaaggctaatgaaaggagtcacccttggttttcagctagtcttggtggttgccacgtagcagaggttagggagggaagccccacatgctggaactgaggtctctgggacctgaaataggagggtcagaattcccagagcttccatggcagcctggaagttggagaatgggtagaaacatatttggctgtaaatgcttgtttgttcttcatactaatggctcagctgctctctcatccctcattctgtcctctagtcctttgagccttctctccttcagcagtttggcaatgcaggccccacgttttccaacaggagacagaaacccagtccctgtcatctctctctaaaagcctgtgatagagaagcttcaggctcgtattaatggtgcccaagggccttggggctttgacttttatttccttattgtctgcagtcacggcctagaaagagagatgttggggttcccaggaccaggacagaggtggtagtgaactctcatgggcatccagagaaggtcaggccccttgctgacaggcctatctgtggggctactgctgctcttcagctgggtgacccttgtccagccaacctctctctcaggtacagcacttacccctgtggcccacctgcctctggtgctatgggctattcctgggaactggaactgatggggatgggtggaagggcatcttttcttctggtaggggctgatctcttttactctccagtaggggtggagtgagctgtggaaaggcccctcctgcttgtctctagcacccccacctctctcttcagctctggtccaccaccctcacttgtgccagaccacccgggatgtccatggccgtcactaccctggtttcttttgccctcgtctgtctgattctccagaggaagcctactgctgccacctgcaggctgcagggggctcctgctgcacccgggctgaatttgaggccctgtaccaagtcaatctgtccgctcttccgcccccgcccatcctcaggtgagatctccaaccccagagccactggaacatcgacagggtgttccagtatctggggctctgttcctaaattatggggtggtaggcttgtaacttacagactagtgaagggacagaccgcaacagaaaatcatgtagatcatgattacaattacaaaggagaagttcagggggctgtgcaagctggtaatggggagccatcctgaatctgcccatgggtggctctaggatgagctcctaaattcgtatgcaaatgtgtgtatgtaagacgacacttatttggggagggagtcctgagctttctccggactcccagggattctgtaccccccacagagcgcagcagcgagagcgcggtcggggccgggatccagatactttttctctcccgcaggggcccaggcccgctcctagtgctgggcctctacaacctactggttgtgaccctgatgaccgtagacctcgtgcacttctgctgcggtcggggccggagtctgggctggagccaccgcaggcctccctctgggtcctccgccgcgagctccctgcaggtctctgcggggacagcttaggtgcgcccggagcttgcctgcacctgcgatccagagccaagcgccccgcccctgcccgggcgcgctccctccttagccctgcccctctctgaccccacctccgacgcaagagtggggcggggcagctgccggtggcgtcccgaacccagactcgccccgccccagagactgcgcctgcgcgggcacgagacaacctctccgcgatgactgtgagtggtccagggacccccgagccccggccggccacccccggggtgcgtacccaacccccgcgccatcaccccttcgcacccgccctgaccatccctggcctccttctccccatccatgaggctcgccccgatccctcctctcctctccccttagctcccgggctctgccccgaaccccctccgacgtttccgccccctttctctctacaggccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggtgagggagcctggcgctcttcccctcgcccgcccgggccccggttcgcccatctaagctgatgcttgggccccagctggacattcacgctcccaggccatccccgcttgccagatgttttttgcacctcagggtggtgggggatcgggtgaccttggagagcgagagtacccctgctgcctggttagtgccccgagagggagatgaccattccttcaggctcctgtctttctcttacaggaagattacgacaaagcagaaacagaggcatccaaaggtaggggaatggtgggccctggtgtggagctgtagggcttctgtggtgggcaaggactctgggaccgctgcaccgtcacattctcctcctttggccccagagacacatctgccttctttctttcccactgcctcgggcctttccttttctgcagctaccctcaccttttctgaggctgaagcaccgagccccacattcgtcccccccaccttcttctggcctttcctcgagatctttccctactgctcttgcctggagacagtggcctcatgggtgctgacagcgctcctgtttgtgctcagccattgaaaaggatggtggggatgtcaaagcactctaccggcggagccaagccctagagaagctgggccgcctggaccaggctgtccttgacctgcagagatgtgtgagcttggagcccaagaacaaagttttccaggaggccttgcggaacatcgggggccagattcaggagaaggtatgtgagtgacccagagaggtggaagcattgactggtggtgaaggggtctgggccaggggtgtagacacagttctccagacgagatcccggtggcaagtgaaccttgcctgtggccagggaaaagcaaattaagatgacagcacattactgttgatttggaggtctgtctggcagatatttaaaagtttgtacacttttcgagaaggagagaggcagacacatcagtggtgaggctgggggccaagggctctctgatgactgctggaggggtataaattggtacagctcttttcgagagtactttagcatatctattcaatttcaaatgagcgtatcttgtgatcccatatgtttacttcttgctgtttctctcagagaaaccttgtccacgtgcacaagtagacatgtgtatgtttatttcagccttttttgtagtaagaaaaacttggaacttgcctgaatgcccagccatagaggaatggctgaataaatgggtaatgtccttactacagactcttatatagttactgagaataggtagatacacacatattgaaatgggaagctctgggacacttgttgaatgaacaaagcaaaataggcagggcatggtggttcatgcctgtaatcccagtgcttttggaggccaagatgggatgatcactggaggccaggagtttgagaccagcctgggcaacatagtgagaccctgttgctaccaaaacctaaaaagttagctgggtgtggtggcacacccttgtagtcccagctacctgtgaggctgaggcaggagagtcctttgagccctggattttgcagttacagtgagctatgatcgtgccactgcactccagcctggctgacagagtgaggccctgtctctttcaaaaaagaaaagaagaagaaaaatatacaataacacatatagtataatatcatttatgttaatgatcccctacatagcaaaacaatgctatattttttctgtgggtacacttgggtatgtaaatacaaaggaaaataattgttttttttttttttgagacggagtcttgctctgtcgcccacactggagtgcagtggtgcgaacttggctcactgcaacctctgcctcccaggttcaagtgagtctcctgcctcagtcccccaggtagctgggactacaggggcctgccaccacgcccggctaattttttgtatttttagtagagatgcggtttcactgtgttggccaggatggtctggagctcctgaccttgtgatctgcctgcctcggcctcccaaagtgctgggattacatgtgtgagccactgcacccagccgaaaatattttattttttaaatttatttttatttttatttatttatgtattttgagacggggtctcactctgtcacccatgctggagtacaacctcttcctcccgggctcaagcagtcctcccacttcagcctcccaagtagctgggacaaatgcatgtcaccacgctcgcctaatttttatattttttgtagagacagggttttactgtgttgcccaggtggctggtcttgaactcctaggctcaagggatctactcacctcagcctcccaactggctgggataacaggcgtgagccatggcactgggccaaatatgcatttttgtttctttattttttcaggaaaatattttaaaagatatacatcaaaatgataacacggtgacccctggggaaaggaatgggattgagagggctttccaaaggagactgcatcacctgttcatatttttttaataaagagaaattgtgtaaaatacgtatatttttaaattaggagaaaagaatctaaagaccattatgagctacaaccaagctcaaattcgccagataatttgacgttaaaatgctgacacagtggaagcagataacatgatggcagacacctcactgaaatgttgaagcctgggaaagcaaataggtttcctctctcaatgccaactctgattggcagtggctgcccagagtcctatgttgagaagaattaggaagcagattgcctgagccaagcaggggaacgtgccatgactggttagtcatggctgccatggatgcaagagaggaaggcgggtggtccacatgctaggcttgtgccaccatctatgcccaggactctggggggtgggggagtaggcctaggatgatcttccccattcagattatttatttatttatttatttgtttgttttgagacagtcttatcctgtcacccaggctggagtgcagtggatctctgctgactgcaacctccacctcccagattcaagcgattctcctgcttcagcctcccgagtagctgggattacaggcacccgccaccacacctggctaatttttatatttttagtagagacggggtttcaccatgttggccaggctggtctcaaactcctgacctcaggtgatctgcccacctcggcctcccaaagtgttgggattacaggcgtgagccaccgtgcctggcttcagattttatttatttatttttttgagacagagtttcacagttattgcccaggttagagtgcagtggcgtgatctcggctcactgcaacttccgcatcttgggttcaagtgattctcctgcctcagcctcccgagtagctgggattaccggcatctgccaccacgcccggctaattttttgtatttttagtagagatggggtttcaccttgttggccaggctagtcttgaactcctgacctcaggtgatccacctgccttggcctcctaaagttttgggattacaggcgggagccactgcgcccagctcagattatttttaaaacagtgaaaagagaattctggagctaaaggaagtgttagcaactacctcacgatctgccagctccctggcaggaggtataaatgctgagttcagtgccatgggaagcccattcacgctgccacaatgtagatggcaccactgggagtgggttgcctcgtagctgacaggatacctcccctccgaaaaggcactccagcatcggcgcagcccctgctgcccaagcaggaaatagctcagaaagaaaaacaggtgcgggaaatttaggaggcactgccaggcaagtctcttcctgcccagggtagctaggtgctagccctgagcctggacatctttactgtgcctcccagagtgaggagctggagacaaatgaatagggagtgtgatgtctctggccaagagccgtgatttgttccatgctttgttggtttgtctaggtgcgatacatgtcctcgacggatgccaaagtggaacagatgtttcagatactgttggacccagaagagaagggcactgagaaaaagcaaaaggtataggccctgggctgagtcagtgagtgagctcccactagagccacccatccataggcccccgaagccactgctgccttgctctgccgctcctccaatcgtgcagctgggctcacggggcctggatgggagctctgagggtctggggctttagcgtgaaccaaggaaagagaaccagtgttcacagagtaccttgttggccacgccctgtgccaggaactgggtgtacagaggtaactgaggcactgtcccagcccctcaggctctgctggggactcatttgctctaaccatcaatcccgagagaaggctcttccctctatttacagaggaagctaaacttcaaagaggttattttttggccgtggtcactcaactgtgaagtggaagcagagaggtccagggctcggggcccctgctcaccagtgctgcatcctatgccgtgtgcagtgtcaacattataatgtgcttcctttgacgcaggcttctcagaacctggtggtgctggccagggaggatgctggagcggagaagatcttccggagtaatggggttcagctcttgcaacgtttactggacatgggagagactgacctcatgctggcggctctgcgtacgctggttggcatttgctctgagcatcagtcacgggtaggtggagtggagaggctggttacagcttcagtccctttgtctgtctgtccatccattcctccatccacccatctgtccatccgcccatctgcccgtccatccatccatccactcttccaccctctaccccttaccttattctaaaaagaacttaggtaggttatggtgcctcacacctgtaatcccagcactttggggggctgaggcaggtggatcacttgaggtcaggagttcaagaccagcctggccaacaaggcgaaaccctgtctctactaaaaataaaaaaattagccgggcatggtagtgcacgcctgtaatcccagctactcaggaggctgaggcacgagacttgcttgaacccaggaggtggaggttgtggtgagctgagatcgcgccactgcactccagcctgggtgacagagcgagactatctcagaaacaaaacaaaacaaaacaacaaaaaaagaaaaggcagagtacaaggagatacatgtaacaagagagaaaaaataaaaatggcgtgaaaaagaccaacataaattaggatgaagtggggtagaaagagcaaaaacagccttggggtaccccaagcacttgctttgtagggggcttacaagtgtgagccccagctttcctgcagccaactcacaaaaacacattggtcactgactccttcaatgtccatatggcacaagcaagctcatggcccagaatgtgcctggccaccacagcatctaccatcgagacagtgaccggacacgtagggcttgatcccgacatgattctcagcatggatggtggtggcccagcatggacagtgcagcaataacagtcctgctcctgggccagtgtggtgaagtccatgcccccagctcttacctgagctggcttgctccaggggagaggggaccaaagactaggcccttggttgcttttagaggagcccacaattcctagataggggtgaaactgtgaaatagtcaatgaaatctctttaggctaagcttgggctgcattctgggtctcccaaggctaagactgttaaaagcatgtgcattctgttccctcctgccttccggtccattccagttcacagtcttggccaaggacacttagctgctaagtggaagcagtcaggatttgggctcagtggaccaagcaggccttctagggttctccagcttagaaacagggtggagagggcccggcgcggtggctcatgcctgtaatcccagcactttggaaggccgaggcgggcagatcacgaggtcaggagattgagacaatcctggctaacacggtgaaaccccgtctctactaaaaatacaaaaaattagccgggtgcggtggcgggcgcctgtaatcccagttactcaggaggctgaggcagggaaatggcgtgaacctgggaggtggagcttgcagtgagcccagatcgcgctactgcactccagcctgggcgacagagcaagactccgtctcaaaaaaaaaaaaaaaaaagaaaaaagaaagaaactgggtggagaggtctcacgggcccattccgtgtacgtgacgtccacatccccagggtgtggaaagaacctcagggtttagactggggaagaactagaccattaagcctggtggtcaggtagcttcgtctaggtataggtctttttcttggggaggcatgagctaaggcagctgctcccagggctgcagtatactatgtcttctctggcaccaaggagaggtagtagggcattgccgtgtaatgtctcctttaggaaatctttctaacaaaattatcctgccattaccctgggtcatgccatccattctgtgttgttttcacctggagctgggccttccacccaattctctccttctggccgtatcctctaactcacagttagggatctctgtggctgcccttcaacaactggaagcttccttctgtttacctctcccaccccagacagtggcaaccctgagcatactgggaactcggcgagtagtctccatcctgggcgtggaaagccaggctgtgtccctggctgcctgccacctgctgcaggttatgtttgatgccctcaaggaaggtgtcaaaaaaggcttccgaggcaaagaaggtgccatcattgtgggtgagtggaagcaggtctggggtcttttggacgttactgtcatggaagggatggggctgagccagccaggccagttttttggggaccagacttgcagctgcaggttgtttggaatacggtttggtgacattattttactctagattctcagcaaccaaggtgcctcaggacaaagctggagctcagtctggagcctgggatgcggatccccccttccctgtgtctccctggtttgttggagaagttgaagggtcaaactgggctgggctgctgtggagcccactgatgtcttcttgttgttgccagatcctgcccgggagctgaaggtcctcatcagtaacctcttagatctgctgacagaggtgggggtctctggccaaggccgagacaatgccctgaccctcctgattaaagcggtgccccggaagtctctcaaggaccccaacaacagcctcaccctctgggtcatcgaccaaggtaggtgatatagttcacaaaaacttgcttcagcagctgaagtttgtttattcttaggagtaataagaaaagttgtgagtggggccaggcatggtggatgacacactttgagaggcagggggtcacttgaagccgggagtttgagatcagcctgggcaacatagcgagaccctgtctctatgaaaaattaaaaaaaattagctgggcatggtggtgtgcatcggcagtcctagctactccagaggctgaggtgggagaattacttaaccctgggaagtcaagtcttcagtgagctgtgattgtaccactgcactacagactgggcaacagagggagactgtctcaaaaaaaaaaaaaaaaaaaagaaagaaaagttgtgattatctccagccacgtgtctgcactgaagtgcgtcctgtggcccaggaggatgctggagctgagaagatcttccagagcaatgggattcagctcttacaacaccttctagacacaagagctacccttagggggctcaaagttagactcttctatcatatgcgtgtgcacatacatgcacattgagcgggcctgcaagcaggttagcagagaggctggattagctttctgtatttttttttttttgagacagagtctcactctgtcgcccaggctggagtgcagtggcgcgatctcagctcactgcagcctccgtttcccgggttcaagcaaatctcctgctttagcctcccgagtagctgggattataggcacgcatcagtatgcccggctaattcttgtagttgtagtagagatagaatctcaccatgttggccaggctggtctcgaactcctgacctcaaacaatgcacccaccttggtctcccaaagtgttgggattaccgtcatgagccattgtgccctgtttttttttttttttttttttttttgtttgagtgagcatgtattacttctatactcagaggaaaaaataacggtagatatatcaattcatctctcttttcccctaaaagataaataagagctgggcgtggtgcctcacgcctataatcccagcactttgggaggccgaggtgggcagaccacaagatcaggagtttgagaccagcctggccgacatggtgaaaccccgtctctactaaaagatacaaaaaattagccaggcatgctggcatgcacctgtaatcccagctattctggaggctgaggcaggagaatcacttgaactcaggaggcggaggctgcagtgagccgagatcgcgccattgctctccagcctgggcaacagggcgactctgtcttaaaaaaaaaaaagataaataagaaaagctttgcaaaggccttgcatgagcagggcctttcacaatggtcctatgaggtgtggatatcgtgttcacagtggtcccacgaggtgtgggtatcgtgttcacagtggtcccacgaggtgtgtctattgtgttcacagtggtcctacgaggtgtgggtatcgtgttcacaatggtcctatgaggtgtggatattcttttccccttagttttacagatgaggaacctcaaaagctccagagcgtttggccccaggggcagggctggcatgcaggcctcacttctgaggtccttcccgatcctacagccgcctcccttaggtagcagatcagctaagcagattctccgggctgccctggacacagttgtcagaactctgtagccttcttgtcttgcttttctccacatctcctaggaagcctgtttcttttacttgtaggggttggaactagtgttctactgtctaagcggggtgtctttacaggtctgaaaaagattttggaagtggggggctctctacaggaccctcctggggagctcgcagtgaccgcaaacagccgcatgagcgcctctattctcctcagcaagctctttgatgacctcaagtgtgatgcggagagggagaatttccacagactttgtgaaaactacatcaagtaaggaagtctgtttcacctcccgttgccagggattctagcgaaaaagttctgactccttgaggaggggcagaaatgaaaggtttccagcagaaacagtaatcttggggaggactagttggaggctgaacaaagggaaagtggccccaaggcccacttcctgctccaaagtggcctccgcagggaggttctttctcaagtcaatgttccaataatgcaacaaacgccatcaagcacgtactgggtttaccaaacacttcctacgcttctgttcccacacagatgaaacatgacagtcctttttttttttttcttgagacagagtttcactcttgttgctcaggctggagtgcaatggcatgatctcaggtcaccacaaccttcgcctctagggttcaagcgattctcctgcttcagcctcctgagtagctgggatcacaggcatgcaccaccacacccagctaattttgtatttttagtagagacggggtttctccatattggtcaggctggtctcgaactcccgacctcaggtgatccgcctgccttggcttcccaaagtgctgggattttttttttttttttgagatggagtttcgctcttgttgcccaggctggagtacaatggtatgatcttggctcattgcaacctccaccctcccaggttcaagcaattctcctgcctcagcttcccaagtagctgggataataggcacccaccaccacgcctggctaatttttgtatttttagtagagatggggtttcaccatgttggccaggctggtctcgaactcctgacctcacacctgaggtgatctgcccgccttggcctcctaaagtgctgggattacaggcatgaggaccgcgtccaggcgacagtccttgttcttaaaggagattataggccaggtgtggtggcttacacctgtaatcccagcactttgggaggtggaggcaggtgggtgatcaccttaggtcaggagttcgagaccagcctggccaacatggtgaaaccccatctctactaaaaatacagaaaattagccaggtgtggtggtgggtgcctgtaatcccagctacttgggaggctgaggcaggagaatcgcttgaatccaggaggtggaggttgcagtgagccgagatcacgccattgcactccagccttggggacagagtgagactctgtctcaaaaaaaaaaaaaaaaaagaaagaaaaaaaattaaaggagcttacagctgttggggagaaaactgatgataaattatgaaataagccgaatcatttcagagcttaagtccaggaagggacatcactggtggtatgggagtaacctgtattagatactatgtcagggaaggcttgagtgaaagtcgataaagaaaatcagccattattgtccaggtggaaacgtcctagtcctcccattggcagctttcctgctgtttctgcccaagtagtgcaggtgcctggccagtggaggggaagggagggaagaagagtccctttatgttggccttggtgtgacggctgtcaccctgtgcccctcaggagctggtttgagggccaagggctggccgggaagctacgggccatccagacggtgtcctgcctcctgcagggcccatgtgacgctggcaaccgggccttggagctgagcggtgtcatggagagtgtgattgctctgtgtgcctctgagcaggaggaggagcagctggtggccgtggaggctctgatccatgcagccggcaaggctaagcgggcctcattcatcactgccaatggtgtctcgctgctgaaggacctatataagtgcagcgagaaggacagcatccgcatccgggcgctagtggtgagacggtgggcctggggtgggtgggcaggcagccaggcaggggtcctggtccagccggtgttgcagggtgtggccccagcacactccagatgaaaataaggaatactgtaatgccaaaaaaattagctaggcttggtggtgcatgcctataggtccagctacttgggaggctgaggcaggaggatcacttgagctcaggaggttgaggctgtggtgagtcacgcatgtcactgcactcctgcctgggcaacacagcaagaccctctctaaaataaatggatgaatgaacgagattctgggctttcttgtggtgagagacatcggcatggctcctccctccatggggcttaagactgggcctgcaggggtcatgcagtgttcctgggagctggtggtttgggggtttggggactacctggccctccatgagcctgttgtggctgtgcaccctgtggaagctggtcttcctccctggggcactcagtcctggatttctccatcccataaggatttggctgtggctgaagcacctgtcctctccccacatgcctctcaactccacctgcagagggcttctttgtgcgacatggaaggaaacagagccattctcagtgtggcctgggaaggggtggggcccacgactgtccagcggccagcgcatcagtgtctgcagatgctgtgtcatgcggccaccccagtagctgattttcttgccacatgctctaggtggtggtctggagggagagggtgctgatttgtctgtgtagcttccagggggccatggcagagtgccagggagggagtccaagccaggtgtggaggagctcagctcctgcctccttccccagaggccaactggtcttgccctcttcctccagggactctgtaagctcggttcggctggagggactgacttcagcatgaagcagtttgctgaaggctccactctcaaactggctaagcagtgtcgaaagtgagtcatctggccttgctgtggttccccacctgtggggtagatctcaagacacaggggtctgggtgggggttggggcctcctccgtcctgctctctggctcaggcaggggctgcagtctggatcctggtacgtgaactgcttctgtacattgaggggatgcccaaacccttggtttttcccccttggccttggtgtacccctccgtacccccaatcctgagggtcgtccactatcctgcgtgtccccaggtggctgtgcaatgaccagatcgacgcaggcactcggcgctgggcagtggagggcctggcttacctgacctttgatgccgacgtgaaggaagagtttgtggaggatgcggctgctctgaaagctctgttccagctcagcagggtagctctgtggttcctgccgtcagcctggggacactgtctaggattagaccttaccaggctttctcggcagggcttggccaatggggtcttttgaccccagggaagagggctggtggctgagtggctgctctgtgtagtgtgggcatgttggccagcaccagtggtgttagcaaggacgttcttcttggaggagctggggaggtcaagtttgtaagctcccaaagtctggggcctgggagtttcccgaattcatcctgtacccaagggtcccagctgagggtggaattgggggcctgggcctgggcagcatttatctgagtactgctctgccccgggatgcccatgtgaattcctctgtgtcctggcagttggaggagaggtcagtgctctttgcggtggcctcagcgctggtgaactgcaccaacagctatgactacgaggagcccgaccccaagatggtggagctggccaagtatgccaagcagcatgtgcccgagcagcaccccaaggtgaggggccgccagaggggctagagggttccccaccatggggacagctaacccagggcatccacagcagaacaacctccctttttttttttttttttttttgagatggagtctcactgtctcccaggctggagtgcagtgatgcgatctcggctcactgcaagctccgcctcccgggttcatgccattctcctgcctcagcctcccgagtagctgggactacaggtgcccgccaccatgcctggctaattttttgtatttttagtggagacagtgtttcaccgtgttagccaggatgatctcgatctcctgacctcgtgatccgcctgcctcagcctcccaaagtgctgggattacaggtgtgagccaccgtgcccagccaacagcctcccttttaagccagtttgtttccttttgtctggctgttttatttcccagttcctcaattactgctgtgagaagggtccccctttctctgtgagtcagcctaggcccctctcctaagctgcctcctcccccaggacaagccaagcttcgtgcgggctcgggtgaagaagctgctggcagcgggtgtggtgtcggccatggtgtgcatggtgaagacggagagccctgtgctgaccagttcctgcagagagctgctctccaggtgagccagccttggtaggagccaacctttcccaactcctgagcctcagggctgcagatgtggctccagagggtgcaggttccagtgctgtgggcctcttagagcgacgggggctgcctgcgtggctgccgtctttgctgagcctaggagtgcagcgtctgcctgccagagtcccagagctgcctgcccaccaccgccttctccccacagggtcttcttggctttagtggaagaggtagaggaccgaggcactgtggttgcccagggaggcggcagggtaagctggtttacacaccccttcctgatggctgagccatcagcctataaaacatgactcagcagctgccacgccagagctgggtgttagatatggaacagaaaaacattaatggccagaggaacaccgtcccgctgagagagtgacgcggaagcaggcaagctccttggcccctccacactggtgcctgtgaaggtcctaggctctactgttcctttgtctcatttacccccatggccctggtgctcagcacaatccatgtccagcccttattaggtgtttcaggaagtgtttggatgcagagggtctgcacagggagtcaagcctggggagagggaggaaggtgagggtggcacggtcagggctggggagcccgatggtcggggtcttactcccagggatgtcctgagcagtgacgggcttgttcctacaggcgctgatcccgctggccctggaaggcacggacgtggggcagacaaaggcagcccaggcccttgccaagctcaccatcacctccaacccggagatgaccttccctggcgagcgggtacgtgtcttcctgccccggcctttccactccctctgtccctgatggcctgtgggctgggctgtagctcccctttgggaccagcaggaagtttcagctttgtcaaggcctggggcagggaggacagcctgagacagcagtactctcttgggggtgggcttctccctgcagggttggtggggcttgtgggggctgcggcaagtacccctgacaggtggggtgcacattgcagatctatgaggtggtccggcccctcgtctccctgttgcacctcaactgctcaggcctgcagaacttcgaggcgctcatggccctaacaaacctggctgggatcagcgagaggctccggtaaggtcccttgggattgcggggcctggaccaggcatcgggattcggaatatcccccacagcagtttacacattgggaaacactccttggtcatgggcttctgtgagcctcacagtgactgctccgcatcattagagaggaggcgacaggccaagaggcagcacggcacggcagactctagagtcagactgcctcgcttccctgattgcaaatgggcaacctcaagcaagttacttaactgctctgtctcagtttctccctctgtgaaatgggatgattatagtacctacctcatggcatagtgatgaggagaataaaatgagaaaatacacctaaaagtacttactacatgggtacctggcccctagcattgtgccatatcagtatattttagtttttttttttctttgagacggagtcttgctctgtcacccagcctagagggcagtggcatgatctcagctcaccgcaacctctgcctcccaggttcaagcgattctcctgcctcagcctcctgagtagctgggattataggcacgtgctaccgcgcctggctaatttttgtatttttgtagagatggcgctttaccatgttggtcaggctggtctagatctcctgacctcgtgatccgcccacctcagcctcccaaagtgctgggattacaggtgtgagccactgcagctggccagcatgttttagttttattactaactgtgactttgaacatattactcattacttagcccgtttcctattctgcaaaacagtagtgatgatgatcacacttgcacctttagtatagggccatggtgagaattaagtaagatgatccaggtgcctggtcagggtaaatactcaaatgaggccgggcgtggtggctcacacctgtaatcctggcaatttgggaggatgaggcaggaggatcactggagcccagaagttcaggccagcctgagcagtgtagcaatacctcgtccctatttaaaaaagaaattaaagagaatatcaggaagaatagctaatgcatgctgggcttaatacctgggtgatgggatgatctgtgcggtaaaccacaacggcacatggttacctgtgtaacaaacctgcacgtcctgcacatgtacccctgaacttaacagttggaaaaaaaatttgcaaggtgtggtggcgtgcacctgtagtcccagctactcgagaggctgaggcaggaggatcacttgagcctgggggggtcaaggctacagcagtgagctgtgatcatgccactttactccagcctaggtgacagagtgagatcctgcctcaaaaaaacacagaaacaaaaaccctcaaatgttaggtgttagcctcaccatcacgaccaccctggtcttctacatcctaattttgagcatttcccacaatcctatgctatttcctaggcctggttagaaggctaagaagcactgtagttcatacctggtgcaagagggtccttggacattgccaagggaaatcctcagcccaggacttgattgcatgagggtgtgggtgcaggggtggagcagatgtagaaactctgatgatgctgccggtgttagtctgttcttgcattgctgtaaaggaatacctgagactgggtaatttataaagaaaagagatttaattgcttcctggctctacaggctgtgtaagcatggcattggcatttgctcagcttctggggaggcctcagagagcttttactcatagtagaaggcaaagcaggagcaggcacatcacatggtgaaagtaggagcaagagacagtcgggggaggtgccacacactttttttttttttgaaatggagtctccctctgttgcccaggctggagtgcagtggcgcaatcttggctcactgcaaccttcacctcctgggttcaatcgcttctcctgcctcagcctccctgagtagctgggactacaggcgcgcaccagcatacccagctaatttttttttgtctttttagtagagacaaggtttcaccatgttggccaggctggtctcgaactcttgacctcaagtcatctgcctgcctcggccttccagagtgctgggattacaggcgtgagcctccacgcccggccgagatgccacgcacttttaaataaccagatctcacgagaacttactatcacgaggatagcaccaagccatgagggacccatcccatgacccagtcacctcccaccaggccctacctccaacattggggattatagttcaacatgagggttagaagggaaaacatccaaaccgtatccctgctgcttcctcctgtggccctgcaggcagaagatcctgaaggagaaggctgtgcccatgatagaaggctacatgtttgaggagcatgagatgatccgccgggcagccacggagtgcatgtgtaacttggccatgagcaaggaggtgagggttggtctgggtgctcatgacaggcggggatgcagaggtacctgtgccctggctgggctttacacccaactgacttggtccactcctcacatctggccacaggtgcaggacctcttcgaagcccagggcaatgaccgactgaagctgctggtgctgtacagtggagaggatgatgagctgctacagcgggcagctgccgggggcttggccatgcttacctccatgcggcccacgctctgcagccgcattccccaagtggtcagtgcctcttctcagtgggggaggagggacggaccaggaactcccagcagcagctgaagggggcagtcctagggtgtgtgggtgtgtcccttgccaaggttgagcctgttgcccaggggtcatatctaccctgtttttctcacagaccacacactggctggagatcctgcaggccctgcttctgagctccaaccaggagctgcagcaccggggtgctgtggtggtgctgaacatggtggaggcctcgagggagattgccagcaccctgatggagagtgagatgatggagatcttgtcagtgctagctaagggtgaccacagccctgtcacaagggctgctgcagcctgcctggacaaagcagtggaatatgggcttatccaacccaaccaagatggagagtgagggggttgtccctgggcccaaggctcatgcacacgctacctattgtggcacggagagtaaggacggaagcagctttggctggtggtggctggcatgcccaatactcttgcccatcctcgcttgctgccctaggatgtcctctgttctgagtcagcggccacgttcagtcacacagccctgcttggccagcactgcctgcagcctcactcagaggggccctttttctgtactactgtagtcagctgggaatggggaaggtgcatcccaacacagcctgtggatcctggggcatctggaagggcgcacacatcagcagcctcaccagctgtgagcctgctatcaggcctgcccctccaataaaagtgtgtagaactccactgtgtgccctgtccttgggcagggagggctgctgtgagtgggagtctctgagtgggtgagtgtgggtgagtatgggtgtgagctgggcgtgggtgagtgtgcaacggagcttcacagtggcagacccacctccatggaaggaatccaatggattccccaaccagggcccactgagttgcttcttaatcctactggagggacaaagggtaagcctaggaagctaatcaataagaaactcaccaggtgcggtgcctcaagcttgtaatcccagcgctttgggaggctgaggcaggtggatcacttgaagtcaggggttcgagaccagcctgggcaacaagcaaaactctttctctataaaaataccaaaaaaaaaaaaaaaaaaaaaaaaagagcagagtgtggcggcatgcacctgtaatcccagctactcggtaggcgaaggttgcagtgagcccagagcgcagcctcccaaagtgtcgcctgggcgacacagcgagaccctatctcaaaaaatattaaactatcccaagaaataagtcgtttagggtagagactcccatatgctgggccttcagtacgtttgtctttatattgggagtcctctgtggcctccgctgagggcgctggggcgggggttggggttggtggccagctgagcctggttgaagggcggcttgggccccgcccaccaccccagcacgttcgaggagggctaagcccagcgtgaggctcgttggctcgacagaggcacgtgacgggtcctgagccaatccgtggaaggtaaaagctgcttcctgttggggcatgagtccggcgcgtgtcgggttttgagctgccgcggtcccgggactgaggtgggtggcggggtccgcccgtcttgggcgtcactcctcgccaaacctttagctcaagtcttaatgaatgtcctctctgtggttctaatccgagctccagccccacgggttcctgcaggggcgggaccacctggcccaacctctgccttggtccaacgcccccggtttcctccagggccttggtccaacgcccctcggaggtttcagcccatttcacagaccgggccgcagggccccggcgtaggcctcgggaccggagaggccctcaaggggagttgaacagggctgcggccgccgcgccccgggcggcgacgtcaccgcccttgctggtgattggccgcctcgcgccgcgcgcccttcaaaccttttctccccgtggctgtcggcgcccgctgggcgggaggcctttccggaggcggccgctctgcgcctcggcgtttcctccaaggctgcccaccagaaggacctgcccgagagggtagagggcatagggtcaagatcaaggtcagaggcccccttgggttgggagaggacacggaaggggttaggagcccaggaactggggtctcaggagagacccaggatctgacttaagaggcctgaaaatgcccatgcaattctgcttcagcccgggtgcagcggctcacgcctgtaatcccaacgctttgggaggccgaggcgggcggatcactcgagcccaggaatttgagaccagcctgggcagcatagcgagacccctgtctctattatattaaaaaaaaaaaaaaacaaacccgctccagccgaatctgcttgaagttggcgttgctgttgtaaccaccagactgtttgtctccccatttaacggttagctccttgggagcagacagctgtcctcactggcagaggaggagcgctcagtaaatgctcgctggacgaataaatggctagataaggtacagttgaaattctgtctgtataagtttctcaaaaccagtaagatgtccagggataatttttttgtcaacactaaatactggattcagtaagctaatactgtgtgtttatcatggcatgtactcgcaccaaaccctttatttgcatttattacaattctgtgaggaaggttcaaacagcaccgcccccacctccctttgtaaactgaagaaacgcagttggactcaggtggattggctgcggtcccaaggccccgctgagttgcagaggcactgcctcccaaacgctcttctgcgttccgctgtggggagaggggcagagcactgtgtgtggagttggtgggacctgatttcagcgctctgcccctctctgtctggctgtatgagtgtgtaagggttactttgtctcagaatctcctctgtaaaacgaccattttggttcccaagattacatgggataaagtgccagatgctgggaagctgcgggacggggtgggggtgtcgggggcgctcggatcctagtccaatgcctaaaggacaggccacttcgtacccactttgtggcacgctgagcttgagccaaaagggaggacagggaaagtgcctctaaatatttgagcatctttgtaaatccggtagggcattagtcagggcgcctgctcagcgaaccttcgtggcacggactctgcctttgtggtcgggagaatgatagtttctccattttacagataaggcagctccagcccctggaaggccagagacttgccagtgtcccactagcgggctcttcgcaagaatccccccgggcccgccgcagccaggcggcggccggcagagggcgctgctcgggcatggcggaggagcggccgggggcctggttcggcttcggtttctgcggcttcgggcaggagctgggctccggacgcgggcgccaggtgcacagccccagtccgctgcgggcgggcgtcgacatctgccgcgtgagcgcgagctggagctacaccgctttcgtgacccgtgagcactccccgccccgtccccacttattccagccgcgctccccagtcgcctccccgcaccgctgtggccagtccagtttgtctcccccgttcaggccgccagccccacattctgggttggtccccaattcgaccccttcccaggaacaccccgctccccccatccccgccgcctccattctggccaccctgctccaatccgccccgcaggtggaggccgcttggagctgtcgggctcagccagcggcgcggcgggccgctgcaaggacgcgtgggcctcggaggggctcctcgcggtgctgcgcgccgggccggggccggaggcgttactgcaggtctgggcggccgaatcggcgctgcgtggggagccattgtgggcccagaatgtggtgcccgaggccgaaggggaagacgatccggccggtgaggcccaggctgggaggctacccctgctgccctgcgcccgtgcctacgtgagcccgcgggcgcccttctaccggcctctggctccggagctgcgggcacgccagctggagctgggcgccgagcacgcgttgctgctggacgctgctggccaggtgttctcctggggcgggggcaggtgagcggaggcgggggcaggtgagggctgctgattggagaagcaagcggagcgggaccccttaatgcgactgtagctgacgacggtctcccttgctcaggcatggacagctgggccatgggaccctggaggcagagctggagccacggctgttggaggcgttgcagggcctagtcatggctgaggtggccgcggggggctggcattctgtgtgtgtgagtggtgagtgacttagtgcttctccagacgagctcatgatcttgtgcaaaccttcctcctcgttttccagtttgggtgggggcctacccaggcctccttccaaattcatccatccatcgcccagtcagttatgactcctaaatgcctctcaccctcggcctcctctgcctgcaccatggcccactcacgcctggactctggcatttgttcctagcttctctgttactggtctcactgcccctcccctcctctccccacctgctcccagccaggactgtctcttaacagtgctgccgagggagtatggagtgtgagggggcagctgagccaaggaaaacgcagaaacgctgcagttgcctagggggccatgatgtgtggcacagggtggacactggggtgcccaccaggcaccaggatggtgatgagtgtgtccctgtggtggtgccacagctggccagagtgaggagtttcacttggtgatccaggtgtagctccttcctaggctgttagagcccatgcagagagggtgaggctgggaacagatgatctttgtctgtgtctggggctctcattctggctgctacgtagatcacctggaagcttaaaaaattaccaatgccagggggccgggcgtagtggctcatgcctgtaatcccagcactttgggaggccgaggtgagtggatcacgaggtcaggagttcgagatcagcctgaccaacatggtgaaaccccgtctctaaaaaaaaatacaaaaattagctgggtgcagtggtgtgcgcctgtagtcctggctactcgggaggctgaggcaggagaatcgtttgaacctgagaagcagaggttgcagtgagccgagatcgtgccactgcactccagcctgggcgacagagcgagactcagtctcaaaaaaaaaaaaaaaaaaaaaagaaaagctaccagtgccttcctccacaccatattctcatggaatgggcctgggctggttgccaagctcaggaaaccctgggctgagcctcgccaacgtggcaaaacctcgtctttgtacaaaaaatataaaaatgagctgggcgtggcggctcgtgcctgtggtcccagctactcgggaggctgaggctggaggatcacttgagccacgcgtgagtggaggttgcagtgagccaagatcacaccactgcactccagtctgagtgacagagtgagactctgtctgtctaaaaaaaaaaaaaaaacaaaaaaaaaaaaccccaaccttgggctggagagaccagagggctggaaacagcccagtgggacgccctgcactcaaggtccagaaggagtttgaggccttaagtttagtgtagaggctgaagcacggacacatcccaccagacttcctagtttcagatcattgctcgggccctgggacctcgggcctggtacttaaccccctctgtgcctcagttgtgaataaaatagggatcctgcgtaaatggtgatattgtcataaaaccacctgtagggctattgtgagaattaagtgattatatttgaaaagcatgtgaaacatcagcatggattaagcacttcataaagcagctattgttagaaatttttagaattaggcagctgttccaaccaaaaagctccagtgttgtgggaggccaggaaggggagagctgcacgtggctttcatcaggaccggctgtgggtgcagttgaaaaaggggcacaggccggcccagtggttgttttatttacttatttagagacagggattttgccatattgctgaggctagtctcgaacttttgagctcaagtgatctacccatctcagcctcccaaagtgctgggttacaggcatgaaccaatgcacctggccctggcccagtggttttgaaagggagaccactgcggtacttctagggatacatttctgaaatgaggggctatttggcagcataagaatggaagtagaaggtccagtaagggacttaaagggtgatctgaaggcattgaggggatgtgaacctaagacaagcccctggggcccgaggggaagcgccttggcctggagtgctaccttgggcagggcaggctttagttgtccccaggagcggatgcgatggggaggagagtttggatggatgcaggggcttcacagtctgtttcatgtgtccccttgatctctttcagagactggggatatttatatctggggctggaatgaatcagggcagctggccctgcccaccaggaacctggcagaggatggagagactgtcgcaagggaaggtgagggtcatctcggctcccacagccgtctccccaggatgtggctgtcattcctaactcctggctgtatgctggcctcagagctacactgctcagatggagcatgtgagccccttatgggagggagcattggcaaggctgatgccggtcttggcacaacacacttgtgcagcagtgccagccctgcctgcagaatgtaggggttgggagcaccagctttggagctaggcagtcgtgtacctcagagctgttgtggcaataagtgactgcatgaataagatttagctcagggctcagttggtgttcacatcattattatcattctgaagccacagaactgaatgaagatggttctcaggtgaagagaacgggtggggctgaggatggagcccctgcccccttcatagctgtccagcccttcccggcattactggatctccccatgggctcagatgcagtcaaggccagctgtggatcccggcacacagctgtggtgacacgtgagtggggctgggaggcactctgctccactcgagctggtgcctacggaagggggtgtggtcgacggaaaaacttctgtcttaaggcttctgtggctcatacagagcagctaccttgctcagtggataagccccaacccccttgttgtttcacagtagttccccagcctgtcaggcccagaagtttcttccttctggtgggaggctgatgctttctgtcctccctgcacggccacagacacattccctgcccgccgccgcctctgacagcagggactgtccagtctggcatggaagactgcggcgctcggtagcatggcacacaggaagatccgccactttttccctcgggatcctctgccatgccacgtgtgatcagccagttgttaagagaatatgttgttccatgccaggcagatctcatgaggattgtaatatgctagctgtgggctgtgccaagctgggctggacagatgccttgccaaagaaccgtagtgacaactatcgattgtccttttgctttcaggaacaggggagctctacacctggggctggggtaagtaaaaggattgtttttgtgaccctgaaaccaaggagaagaaagacctgggagtacagggcaggtgacaaagccaacaagactggaggaagcaggggcctcggccaggtcactgggaggaacaggactgctccctccctggggttggaacagacataggcgcgctcagtccgaggccagacaggggagacatggagaggatatcggtaccacccgcctacctctctgaaagactgtcttaagggagtatccaaccagcacttacaaagcagctttttgtggatgtgacactgggtggagaaaaagattcgatggaagtgtgtgctctgaacatcttagcttggatagcagggaagtctggaggagcgtcttgcctggagtggctggtcgccactagcctcttggggatccccaaggttgcctggctctgggtctcttggattcacagagcagtggggcataatcccagcacttcatttgatagtctgggccccttcctggagggaaagcagcagcaagacccagtggagacgatggcaaaggggctgatttcactttaggtaaatatggacagctgggccacgaggacaccaccagcttggatcggcctcgccgtgtggaatactttgtagataagcaactccaagtaaaggctgtcacctgtgggccgtggaacacctacgtgtatgctgtggagaaagggaagagctgacatgtgtacgtatatgtatatgcaacacctgtgagacccccattcaggtcaaggaaaaccattgcctgcaccccaagggccccatatttgcccctccccatcacagtcctgcccttcaccctcaagcacggtcctaaacttgtctgcactttagaaacacctggagagcattgaaaactctgctgcctaaggtcagcatcaatcaaaacaatgaaatcaatgaaacaatgaaaccagagcttctaggtgtgtggcctggatagtggtagattcaaagctccacccacctcatcccaggtacatttgatgtgcagctgagattggggcacattccaggtcatcgtcttctgtcagtcatttccctgctttcgtttgaattttaccattcttgtatgcagccttatacgacatagttgtgtttgcttttgagtgttagataaatggaatcctgtgtatgtgcttttgtgtcgtttttgtcactcagcattgtataatccatccttgttgggtcctggagttcatttttaatgctatatggtgttctgttgtatgaataatacctcaagtgatacagccttgttgatggtcatttttattgtttctgattttggtcattccacataattctttgtgcagtcttctgcacatgtgcacaagttcctttgcagaacattgagttgaattgctaagtcaggagatacctttaattttactagataactgttgcccccagcagggtggggtctactgtggctaaaatgtcaggtagatgcacactggttttaattggcatttccctggatactgatgaggttgagtagcttttcatttgttttggatggctgggcatggtggctcacacctgtagtcccagcactttgggaggctaagcagggagattgcttgaggcgaagagttcatatgtttattggccacttggagtttttctgttgtcaagtgcctgttcaagttttctggccttttaaaatgttctgtattttccttagtgatttttcttttggatatttcagatacaagtcttttgagagttagtattcagagtatcttctgctacaatgtagtttgtttcagtctctcttggtattaccaattttaatacttaggtgatgcttactccatgccaggtaaggctcaaagtgctttacaagtatcaacttattttgataaaataagcttatcagtagttttctttatagttaaattctatttgtgcatgtgtgtgtctgtggtttagcaaatgtttcccacccatggggtcttttttattgtggtaaaatatactgaacataaaatttatgttcaataaaaaacaaaaattgtttttaaccattttaagtacatagttcagtgacattatatgcattcactgttgtgcaaccgtcacccctatgcatttccagaactttttcatcattctatgctgaaactctgtgcattaaacacttaactcgtcagtctccccttccccagccccaggcaaccacagtcctaaccttctgttcctatgatactgtaagtgcctcatgtaagtgaaatcccatagtatttgtctttttatgactggcttatctcacttagcagcatgtcctccaagttcatccatgatgtagcttatgtatctagacttcctgccttttaaaggctaagattctgttgtatgtatacactgcgttttattcatccgtgcattggtggatatctgagttgttcactacagtcaataatgttgctgggaacatgggtgtacaactctcttgagtctctgctttcagttcttttggatatatacccagagtggaattgctggattgtgtggtaattctaaatttttttgaggaactgccctgtttcccacagaggctgcatcattttacatccccactggaagtgcacacaaatcctaatttctccacatccgcgtccacacttgttttctatttctggttaacagccatcctaatgggtgtgaagtggtatttcattgtgggtttttttttttttttttggacagggtctctctgttgtccaggctggagtacagcctccaccttctgggcttaagccatcctcccgggtagctggggctacaggcacgtgccaccacatctggctagttttttgtatttttagtagagatggggttgttgcatattgcccaggctggtctcaaactgctgggctgaagcgatccacttgccttagcctcccaaagtactaggattataggcatgagccatcatgcctggccaagccattttttaaaatggacaaaagtcaacaaagacgacagaaggatagcaagt

SEQ ID NO: 374 - DNA, 250390 bp, Homo sapiens
ggagggctgacgccagaaccctcttggctgccccagctggtgtctcagtatgttgcatgctcccctgccccctgccccacgagtccactgtctctgggcctagttcagcactgggactcacctaagagttgcagtccttatgttgaagacctagattacctctcaagtttacttgcagacacaaacccagtgtctcttcaaatattgcttcttatccattctacttcctcatccattttactttcttcttctggaatttgtctaaattatatgtacattggaacttctccttccatctccgtcttcattagtttcatctctgcatcgtcaaggatgtcattagaactattttccagttcaccgattctttcttgtccaatccaaggttaaacccatacattatgatgtaaatatctgtggtacaaaagggctgcttgaccctgagagctcactgtgataaacagcgagacaccaagggccattttccttctctcagagaggctgctccaaaatccagcttcccccaggaccaagaacttccttctgttagcaaagggagctacaagttcccctgcactccaaggtcctagggggctgggcagcaggcattctctgaaagctcccagaagccactggaacccaagtcgtttcctgtttcctccacctgacaagccattttctcatgtttgcgctataagaaggtagtcatggggtggaggcgacagtgtctttctctggaatgcaaacccactgtgtgtctaacagtggcattggccttcctgcacgcctagtaaatgtccccccaactgcacctcttccttgggccacaccatgcgatgtggcatccattccaaatccaatttcctgccagttccaaccgagattttgcagcactagaagttctgcttgatcttttcccaaccgacttggttattttcagagtttcttgctctttacacgtatttccaatcctttctattctgcatcacacacaactattttgtattctacttctgtggatctgattctgcaccccgtggtttttgctgccactgtgcggtgcatcttgtttccttggatgatctatgctttttgacagttaatgtgtatttcttagaacattacctctggggattatttgaggctgaaagtggatttgcatttcctttttccaggcacccaggagagccaaaaatccccgtattctactttaaactcttagctccaggtttttcgaaccaaaggaagtgtaatttcaggctggaaccttcttaggtgtcaaatcagagttgcacatcgtattactggtgcagtacaaagtaccacacactccatggctggaacaacaatttgttgtctcatagttctggaggcccaaagtccaagatatgagtgtcggcagggttggttccttctggaggctctaggggagaatctgttccatgcctctcccttagtgcctggtggttgctggcaatctttgatgttccttagcttgtagatatgtcatcccaatctctgtctccatcttcacacagtgttctctctgtgtgcaggtctctctctgtgtccaagttccccctttctacaaggaccccggtaagactggattagggtctgccctaatgacctcatcttaaattgattacatctgtaaagaccctatttccaaatacgatcacatttacaggtattgagagctaagagtttcaagatggggggtggggcacaatgcaatctgtaacacgtgctctcaggttagttctctttccacccactgtcaataaggaaggagaccactactacttctgctgccctcctcccccaactttgcctagttcacaagacaggaggaaagagagaaagcaaaaaattagaaataaacagaagtaagataaatagccagacaaccttggcaccaccacccggccctaggagttaaaaaaaagtaataataataatatcaacccctaacctaaactacttgtgttatctgtaaattccagacattgtatgaaaaagcattgcaaaactttgttctgttcgctgatgcatgcaggccccagtcacgtttcccatgcttgttcgatttatcacgaccttttcacgtggaccccttagagctagctataagcctttaaaaaggccaagaatttctttttcagggagctcggctcttaagacgcaagtctgctgatgctcccggctgaataaacctcttccttctttaattcggtgtctgaggagttttgtctgcggctcatcctgctacatcaaggtacaagaaagagaatttcctgtgctacatcaaggtacaagaaagagaatttcctttgcaatcccttggtggtggtggtggcagcagtgtgtgtatggaggtgggtatttctactcttcctgatgttgggggtgaggcctgttggggtcccggctttaaagaggggcttgccttgggtgggccctgggttttgtctcgctcgcacgcccagccaggtgataaagattggcccttaagctcacccagttgggcaaacacccataaggaggaagccagcccccccgtctggattcctgcctttacttcggcatgtgtttttctttatcaccagctcattgatggaattacaaatatgttcccagtgtttttgttgtcttatcagaagggttgatcaggatatgtaacctactgcaaaagacagaataatggcccccccgaaagatatccatgttccagactacgtcacagtctggaacctgtcaatgtgttacctttcactgcaaaagagactttgaagatgtgatccagggagattgtcctggatcatctgagtgaatctaatcatatgagtcctgaaaagtggagaccccttcccagctgtaacccgagggagacagctgtgactttggaagaggggccagagagatgccactatgctggctttgaagatggagcatggcgccatgattcaacagatgcagcagcttctagaagccggaaaagggaaggcaatggtttccccctggggcctccaggaaggaacgtaactctgctgacacctccatttcagcccagcgagacctaggctgggcttctatgacctacagaaccatgagataataaatgtgttgtgttaagcccccacgtgtgtaatttgtgacacagcgatagaaaaatgaatgcacacactgctggaggcagaaggcaagcctctggagacaacacgcattgctccttccctggccggaaactgtattactatttttttatcttcctcacccttcctttctctcatcttcatccaactttaattcattatctttcttggtgtttgtatttgtgccgtgaagtctacttatgcctccatcactcgattttccaggtaaaagtcaagaaatatcattgaagcccgacaaacggaggaaaccagtgcctctgtcctccccaacccgctcctctttcccttccccactgtctttatctctttttgtcttgttttcctctaatttagtcttgaggcctctctctggagaggtcatatccatgtcatccaccttccaggagaggctggacccagaggagagtgaggctggggcgtgtggctcaggtggacacagaggaggcagcggcacaggacacatggaatcagagcagcgcactccttccagatccagagagagagggctgtgcctcttggggctgataagaggggatagtccagaacacacatgctaaaccaccagtggggagagggagagggagaaagagggagggtgggggagagagggaaagggagagagggagacagggagagagagggagagagggggagagggggagagggggagagagagggagacagggagagagagagagggtgagtgagaaagatggagagggagaaagggagagagagacacctgtgggccaaagtctttattggggtccagggtgttacccaagcagctttcccacaagggttctgattggtggggttaggacaggcagcctcaaggtctctggttgccgactgactgagaggccatcactgtggcctgcctgcatggccacacagtgggtgggtcggtccagcaggctgttccagctgttccacagcgaggtggtcaccaggaggcggtggcacaagacagatgtctggatcgaccacactgaggaactgggggagtgctgcaggcacagaactataaactgtggccgggcgcggcggctcacacctgtaaccctgacactttgggaggctgaggcaggtggatcaccagatgtcaggagttcgagaccagcctggccaacatggtgaaaccccatctctactaaaaatacaaaaattagctgggcgtggtggcggacgcctgtaatcccagccacttgggaggctgagacaggagaatcgcttgaacccaggaggcggaggttgcattgagccgagatcgtgccgctgcactccagcctggcaacagagcaagactccgtctcaaaaacggaaacgaaaacaacaataaaaaaactgtaaactgtgtcgagggtgacgagccctgcttctggtgtgagagagttaaacttatattcaaaatggacatcaaagcaacaggtataagaactcactatacttctttacattcgtgattgccttctgcagggcttaccacagctgcctagcagcagcacctctcccaccgcgttgaagacttgtttctgtgctttctccaatttctttctttcaaatctggtattgaagacatggaatgctcagatacacagacgaggctgcacaggcccattcaagaaccagagcgtccagaagcaattcacatgctgtaaaccggcttttcctttcttccctttgacttttttctccttttctatttgaagtcttttattttcacgagagtcttgcagggtagaagtaatctaaatacctatgtgtccggaaaacataatctttttttttataaaaataaatattctgcacaatttataaaaggctaatttctgaaattttaaaatcttcaggttatacttcttaagctattccgagctgtctgttttcgaggttttggagtactgctatgatgttttggagtactttcgaggttttggagcactactagaagtttggaaaactactatgatggccgggggtggtggctcacgcctgtaatcccagcacttttggaggccgaggcggtcggatcatgaggttaggagttcaagaccagcctggccaagatggtgaaaccccgtctctactaaaaatacaaaaattagccaggcgtggtggcgggtgcctgtaatcccagctactcaggaggctgagggaagagaatcacttgaacccgggaggcggaggctgcagtgaactgaggttgtgccactgcactccagcctgggcaacagagcgagactctgtctcaaagaaaaaaaaggaaactattatgacatgcacttttctaatcattgtacatttcccagagtagacaaaaatgtttgacaaagccttcacttttaaggaacgcaaaaaacttagaaatctcttttgtttgattaaaacaaataaaaaaaagacttgtttccagagattccggttccacactctgccccaatccttggggcagctttccagtcatccagccggagtttgcccctggtcattgttctaacaagtgctccctgagtaacagcccctgagtcttttttttttttttttttttcagatggagtctcactctgtcgcccaggctggagtgcagtggtgcaatctcagctcactgcaacctccacctcccgggttcaatcgattctcctgccttggcctcagagtagctgggattacaggcgcccaccaccatgcctggctaatttttgtatttttagtagagaaggggttttgccatgttggccacgctggcctcgaactcctgacctcaagtgattcacctgcctcggcctcccaaagtgctgggattacaggcgtgagctaccccgccgggccgcccctgagtctttacatgtggcaatgcgttagttgctgcctgacaaatgagcaactatttgagcatcaaactcttgggtctctcttgccatgaagaccttgtgtgaattgttcattgccttctagcattgagcgttactggggtaatgtcgagtgttactggagtaatgtctaaagcaaacctgattggttttttttctcttaagagacttgttctttctgcttggatgcccagtggattactttttatctttgaactccaaggttaaccattcttggttcatttggcgtggggtatggtgtgcctttttattctatttctgtaacctttaaaaaatattttaaaacatttatccttctccgtgattttggctttgttttccagacactctcaactatccatgcgtgtcagtctcctctgcacaatggggattctctgagatgcttaactttatgcagggggcccagtgctggcttctggcctcgggggatctgcaactgtggctcccaatgccaggagagtgttggaaccggtcccaggcccagagaggccaagaccctggagactgccccggggttagctcccaatatctcctcgggcttcgatttctctttttctggaatgggcccttctttccagctcagctatgccttctgcatgttttttttcaaggatttctgtgttggcagtggaggaagagaggcctccatgttagctcagcctgatatgccactagaaactggctgagaccttgttggtcttgttcaacattggatctcaggtaaggaatcaatacaaattgattggataaatgagaaaaatcaagcacaagcacaaaattcgtattttttgcaacacttaatagataaaagaaaacacctaggctgggtgcgacggctcacacctataatcttggttttttgggaggccaaggtgggaaaatcatttgaggccaggagttcaagaccagcctgggtgaagtagcaagaccccatctctacaaaaaattaaaaaaaaaaattagctgggcagggtggcacgtgcctgtagtctcagctacttgggaggctaaggcaggaggattgcttgagtccaggaccgtgaggctgcagtgagctaggactgggccactgcactccagcctgggtgacagagtgagaccttatctcttaaaaaaaagaaagaaaagaaaacacccaaagtgggtcaagtagggattgtatgagtcccgtagaaaactgcaacacattcagggaaagagggggagagggacaagcagggggagagagaaaaggagcagaaagaaaaacaatccagagcttcctcaattctccccccacccctccccactccctgcatatcagcttccccggcggcggcttttccatttggtttcttcccgggcatcgaaaaggcacagagtgggccctcgctaggactgtggagtgagtggaagtgattcttgctgcaaagccatcgtggagaacttgccgcaaatgtgactctgagaaggactcggaagaggtgacacgaggtcctgagggtaggccctaatccaagaggacggggtccccatgagaggagggagagacctctgagatgagcatgcagaggcctcaggaggaaccaacgccctcccttactgcatctccaacttccagcctcagaaccgtaagaaaggagatttcagagttgaggcagccgggtctggggcctgagccacagcggtcacggcagcctgagccaaccaggacagggcgagggcaggggcggagcgagggggaggggcggagcgagggggaggggcggagcgaggggaggggcggagcgagggggagggacggagcggggcagggacggaacaccgggaggaatggagctaggggagggactgagctaggggagggtggagcgaggggagggatggagggagggcagggacagagggagggcaaggacggaggaaggggagggatgtgctcgcccagagcccccatgcctggtagaagaaaacactcagtaaatgggagctattttattttctctcagaacgcaaggccccatcacttctccttgattcacccttctgatcaccagcctgggacacccactccacggtcagctgtccaggggtcgccctgcacccacacctgcctgccacccccagggggccaggagcagcagggagggctgcgtgaggagggtggggccggccctgggaaggggtccctcctggagactcggctgacgtaccagtgaatgggggcgagggcaggtcagatgggcatggtccagcctgcacatctgggagaaggcttggcccaagggagaggttcctggggttggaagctcctggagaagggggcattttcactctgcccatcgggttcgcctcccagcagcctcagtggggcgaaggctggccagggtccagtctgcaggaagggtgggagacccaggggctggcctgagaggcagaaaagtcatcgcttaggaactgggtgctgcccaaacagaaacgtggactctggcatcagaccgagctgtgcaagggccacgtgtgaccttggatgagtcacttcacatatctcagcctcagtttccacttctagaaaatgggctgtttcctggccagagctgtaaggggatctctgttctctctcatggccctgtggcaggagctccagcagccaccgtggaccacgaggcagccacaaggagggaagggcatgctaaggacgggagatcagggaggaggagcctctgaggatgagggatcaggaaggaggagcttctgagaatgggggatcagggagaaggagcccctgagaatgggggatcaggaaggagcagccattgaggatgcaggatcagagagggaggagcctctgaggacggaggatcaggaaggaggagcctctgaggacgggagatcgggaaagaggagtctctgaggatgggggatcaggaagcaggagcctctgaggacgagggatcaggaaggaggagcctctgaggacggcggatcaggaaggaggagcctctgaggacgaaggatcgggaaggaggagcctctgaggacggcggatcgggaaaggaggagcctctgaagatgggagattgggaaggaggagcctctgaggatggggaatcaggaaagaggagcccccctgagaccaggggatcagggaggggggagccagggttcctgatggctctgggaccagggcaaggcaaaggagctgctgcctctggatggtcctccatgaggggaaggagaaataaatctctcattttctattttggttttctctatcatacaccacagaacccaccaaaatggagaggttttttttttttttgttctgttttgttttgttttttttagattcatggtcttgctctgttgtccagtctggagtacagtggtgcaatcacagctcactgcagcctcgacctcctggactcaagcgaccctcccacctcaccctcccgagaagctgggaccacagatgtgcaccaccatatgcccaactattaaaaaaaaaatgttgtagagacagggtctcgccatgttgcccaggcgggtctcaacttcctgggctcaagccatcctcccacctcagcctcctacctcagcctcccaaagtgctaaaatgacaggtgtgtgccactgcactgaggctatttttatcttcaatatacatgtaaagaaacaggggctcaagaggtacccaagtgatggggcaggaattagaatcccatttgtatgcccgatgccacctggagaattccagggcaccgcatgggaaacccagggtgctgtgccagccgggaggtggccatggcaccattacctccgtatctctcagaccctgctgcggttgggccaccctgagatccaagcaccccagtcagacagaccctgctggacttaggcggaagaatccagccattccctcctcccctggtacgaaaggctgaccactcctgcagaaaagaactcaggtttatttgcaagtaaaaaccatggtctgaaaaaaacccattggcaaatgtacagtttgtgtccatttggggttcccgccagctgggggggcccccagatccctgacccacatgcatcgggctcccacatgttcacagctaatctcaggcccctgcagtttagccccctgcaggggacaccccgtctcctgctgaaaaccatcggactcccaggctgcacccagccctccaaccctcctgccttagtgcagtgcaaaaaccaaaccaaacacaaatctcaaaacaaagaaacacaaaacaaaaaaattcacaaaaaccagggttctaaattattttttctcagtgtccttcgtgatcatgatgacttatttgtcaacaaactaaaatatacatcattttcttgctattataaaatctcttattattcacagatatataacgggagatttggatgaaataattacaaacttttttccccttaaaaaacaaacaagccaaacaaaacacaaacaaaacaaaaaccccaaaaccaaaacacaagacctttctgacgacagtaaacacaggggctgctggcttcctccccgccatcctccgcgcctgctgggccgcaggtcgcaaagtgctgggtgtaccccgacacggaggccccagggtgctctctccaaggctgactcttcgcttcccctgccctgcctccacctcccctcatttcccaagcctttgtcgagggcccctctctccccctgccgctccccatccccatgactcctcccgcctcttccctacaccccagaggcatacagcccagaggccacaaggccaacctcagaaggagcccctaggtccccagcgccacccacagcagggaccagcttcccccacacccagcctgggccgggcacctcccacaggctgtgcagctggccagagggagaaggggctacaagaagcccaggtctcaacagaggctttggcaaggagctgggagggagacactgttaccaggtctcatgcaacatcagggtagagaaaccagggtctggctaacccagccagaagtcgaaggccaggagttgtggctgggggaggtaatggggtagagccacccccaagagcacttattttgagtcgcccgaggcccagtttgtaggctgcaggggcccttggaaggaagccctgccaggggctggaaccaacctctcgtgccaaggctgggcagaccctcagggaccacccttcaggagagcagaggggcctcctggagagggacctggcagggatctagagaggggaaatccctgttttcttccctgcccatttcagggtttttacaaaagatgtactgatctggcagcgcggccaggcagacaccttcccaggactccagaaagggcctctcagagagagggcaggaaacggtaccgctgaccgggcagcagggttggaatttcatcattccaaaggcccctcccaagagaggggcctgccgtgtggggtccgggtgtgcccctggcaaggaggggagtgggggagtcagggaagtcttgggagccagagtggctgcagagggcgaccacagtgctctctcctcccgcgccctagcacagtggggcaagtgggcccacagtgaacagcctggctctggtcccgtctgcctcccgaggtctgacacctccccctgggagcagcaggaaaagacaggcaaggctgagtccaggggctgagcagagggtgtgggggcaggtcccctccgatgtccctagcccttcctgggacagcatctgctgttcaaacctaggctcctgaaggccatctcagttggacaggggcaggcgatgggcctctggcctcagccactacccagagcctggctcgcagcgctgtcggtgccccctcctctgcgctctgggtggggctagcccaggtttcctctatgtacaatagcatacccagtgatgggtcgccgagggcaggctgacagtgaaacggttcgagtttaggattctcaacaccctccctatccctgtgggcagtggaagactgggaggttggtatttcccctctgagtcacagaggagctagagacagacttcagggctggagtgactctcccaagaaaatctgcgagtcttgtccacgttcctgccgtcactggatgccctcctcttctacgtacgttgaaggaaaccagccaatctgaaaaagatggtaagatcgtgtctgtgtgtgtgtgtgtgtgtgtaagcaggtgtgtgcatgtctatgttggggtgagggcaagtagaggctcatgaagatggggggcccttcggaagtccagagttctcagaaggacctggtggaaccattgcctgggagtaagagcaacccagaaaaacaccacccttggccagtttaagatgatctgcccaccctccagctgccagtcagaaaaaaaataaaccctcctgaggaaaagaacatcacccagaacaactacagctttttcttaatacacaagcttggcattcagtcaggaccaaatgacaaaaaccaatagaaaaagcagacagtagaaatcaacccacaggtattgaggtcatctgtcaggggagattaataactctaattcatacgtttaagaaaacggatgaaaaggcagacaattttaccagagaacctaaatcggaaatcaaatagaaatcctagaactgaaacatacgatgaatgaaatgaagaatccaatagagggatttagacaaagcagaagagaagacaaactgtaagacaggtcaccagaaagtgactagatagaaaaccagagagaaaaaaggatgaaaaacacataaaattgtggaaataatatgaggccatggtaaaaagttctaacatccttgtgaatgaagtcctacaaggagaaaagagagaaaatggaacagacacacagtctgcagatactatgctggctgagaaatttccaaaagtgatggacatcaagccacaggttcaaaaaaatctctgcaaatcctaagcagaataaataaaaagaaaatcacacctaggcagattatagtaaaatgaactcaaaacttcaaatgaacttcaaaatgaactcaaaacaactcctcacaaaaaggaactaggtctccttggaaaaatgactgattcctgggggacgatgaataagtacaggagaaaagaaagttttccttacagtagaatgccaactaatatctatagatagtcaaaaaatcactatttttcagccataatagaaataatagaatagataaaattcatcaagggaagataaaactagtacatgaaagtttgaagagaaacaggatatttacctaacctcaaagtattaccctgcaaattacttgctaattacagtcaacagtaacttcacagtagaacatagcaaatataatcttaaacacatgatcaaagttaatgtcacaaataatgagacaaactggcataattcatgtcctaacaggacactacggcactgagaaagtgccaacgtccccattgtggtgttcccaatggaacctcaatctaatcatgaagaaacatcagacaaacctaaattgagagatatcctataaaaatagctggctcaaactcttcaaaagtgtaaaagtcatgtaaggcagagaaagactgaggaatattccagattaaagagagttaaggatcacagcaagtcaatgcaattcatgatcctggactggatccaggaccaggagagaagagctagagaagacatgattgggatgactggtaagatttgaatatggacagtggattagataattgtattatatcaaaggggaatgtccttggtcttaggaaatacttaggggtaaagaaatatgatttctgcaatttactctcaagtgagttagagagaaatagacaaacacacacacacacagtgcaaatgataaagcaaatggggcaaaacattcacaattggtaaatctgggcaggttactgacacttttaagttgaaattttgaaattgtacgtttgaaattttgtttcaaaattatgttacaaacattttacaatgtgaatatttaaaaagaaagtgaaataaggatggttttagattcaaaagaaactgagaattcattaatagcagatatgctttaaaaaatatgaaagagaagggatgtcaggcagcaggaaatggtgttgggtggaaatacaataatgcaggaggaaatggggagccctgggaaaggtaaacacggggtaaatctaaataagcacaacagcctaaaacaaaaacaatgtcaaatggtatttctagttctagatccctgaggaattcccacactgtcttccacaatggttgaactagtttacagtcccatcaacagtgtaaaagtgttcctctttctccacatcctctccaatgtatgtttattgcagcactactcacaacagcaaagacttggaacgaacccaaatgtccaacaatgatagaatggattaagaaaatgtggcacatatacaccacggaatactatgcagccataaaaaatgatgagttcatgtcctttgtagggacatggatgaagctggaaaccatcattctcagcaaactatcacaaggacaaaaaaccaaacaccgcatgttctctctcataggtgggaactgaacaatgagaacacttggacacaggaaggggaacatcacactggagggggagggggagggatagcattaggagacatacctaatgtaaattaggttagttaatgggtgcagcacaccaacatggcacatgtatacatatgtaacaaacctgcacattgtgcacatgtaccctagaacttaaagtataaataaatatatatatatatatatatatatatatcccaaaaacaaaaaaacaaaaacaatgtcttctaaggtttgaatatatatagaattaagatacatgagaacgcttgcacaaaagttgggaggaaaatggatgcaatcaaaagtcgcaaggtccttccttgcattgtctgggaaatagtaaaaaagtactcatttaaggtaacctctagtctaaggttaccacttaagaaaaaaagtgtgtaactaacaaaccaatgtagggcaggggaagtagaattaaaaatatattgattaattcaaaagtaggcaggaaagaagaaaaaaggagtagatgtgacaactagaaaataaagttagataatttaaacccaaacagctcagtaattacattaaatgtaaatgggctatatatgcctattaaaagccaaagactgtcagaccagactggcttccccaactatttataagaaatccattttaaatataaggaaatagaaaagtttaagtagtatgagagaaaataatatgccacacaaagcagtaatcccaagaaagctggtgtcacaaaagcagatcaaggagactacagcaagaataaatgccagagaaaagaaaagacgtttcataatggtaacagggtcaaattgacaggaattatccagtaatactcaaactagttgttctaaaacttaatgctgtatagaaaatacctggatctgggaaagagcccaggtatgtgcttattaaattacagcttcaggcacttttaatgccaatcacacaaggaccactttgagaaccagtggtcccagccccctaggtgggctacctaagcctcagtagccttgacacttctatagggcagttgggtaaaaaatgggtcagacttgagggcctccaaggggcagactgataggtgaaggcagagctgctccggccactggacaatggaagggtcagcactgggagccaaggttaactggccctctgaagccccatccacctgccctgtgcagcttgcagctcacagagaaagctgggcattttctaattggtggcacagggagctctggtgcttggatggataggtactgagagacatgggtcaaagctagaggtccagatggggtgttgggatgaagaggccacagacatatgcagaatcttagggtggccagggcactcttaggcccacctggcacttgggaaagtgtgaagggattggggacacactgtgtccctactgcctcaccagggcatagatagggccttagaaaatggcaggaggagcccagcaaggacaccgtgtcctcctcagtcctgtgacctcccttcccgcaaacagagcttggggacttgcaagtaatttggcgagtgcagctatgagggcagcccagaataaaaatggaacagggtcggggggttcctaggagcctggatccgcatcagacctctgtagccgatttctggctgtgtgaccttgggttcgtggtaaacatctggagcctcggtttccccctgtgaatgccaaccttctgggctgctgtgaggatgagggagattgcagagggtgtctggaacagggcctggggtgtggacataggtgtggtgctagtctgcctgagcccgaccaggtaggggctgcagcgaggccagccccacaccctcagggtggggccactcacccgtccgttggtctcgcccttccaccagccctggtctccgccgatgcggctgtagatcctcaccacgtcaccctcccgcagcgaaagctccctcatatctcgggcggcaaagttatacctggccacagctgtgccgatgacgcggggcgtgaacactgttgagggagatgggcagcatcacacagctgcaggaggagcccaaccagtgatccaggaggcccttgggccaagctgggtctctcccctggtgcccagaaccctgctctgtacccagagaggaaggatgtcaagcagaaaggctctggagggacacactggcctccaatcccagggccccttgccctctgggtctggggacacagcacatccaagtccctgcaatgaggatgttcttagggacaagagcaggtgcccaggctttgaccatcatcattccagtggtcccccaaatccaaccagaaacccagtggaaccagcttggcccagatgcagaatcctgatagacaggtgacaatgaccatggctgagggcgaaacacacacagctgctgggaagggactttgactctggcagccgaaagccatgaggtcaaggctgactgaaaacccctcctccctgcacccaagtcccacagctcctcctcgtggccacctgctttctgctaccagaggcaaagctcttgatgaacaaggaggaatgacagtggacggggctgggaaagtggccatcagggtgggcgtgtccacagggggtgggtggtgacaatggcagggccaagcctgacgtgtcctcaggtgctcgcagcagcctctgcccggcctccccagcccctttctcccctccacccagtgccagactgcggacaactgtggccacgtcaggcagggctgtggggccagtgggcagctccgtgctgggtctcccaaggcagctgccacaggcccggtccccccacgccctggggagcagcggtacctgaccagaagggagcggaggggccctgagaagcaaagctgaggccctgaggactgagaaaagaaaagttgtaggaagcacaggaagctgcaaagaggcgagagagaacgtgaggcgggcagcagggcatccacgcacagtcacggtgggcacagctacaggccggggggcatggggtggggcaggccctttggcaggagaggccctacaggggggcaaaggaggcagggggcagcacgggttgtcaagccccacccaggcacaggtgccactcggccacacctgagctaccctggaaccactctatgcacccgtgtactcgagagcaaattgggaccacctcctctcatgccctcgcctggcacatagcaggtgctcactaaggccagctgttcctctcctgtccagctcggcctgtgtgagacccatggccctgcaggaccctgcaggctggaggacgtggggtgactctggagagagtcctgagcgggaagccgcatgctcggggcctgcccctgcccctgattccgtgtggccttccctgttctgagctgtggagtccaacctgcaaacaggctgcctctcacagaggaggcccaggggctgggcacagggagggatctgggaacaggtgggcctgcccttttctctcccacctgtgacagctccatgcgcaggggtctctgcctggacctggcccctccaacccccactggtctctgggtgaagaagccaagacacagagtagcaattctgagcaggtgcagagtccccgcctgtcacatggcccaggagatgccacatgacagcatctgcgatggctgggggaggggcgggggctgtgttccccagggtgggactcctggtctgggtctgtgagggcaggatctgagccctgggaagtgggccagggcagacccctccgaggagtgctggtgtgccggctgggccggggcgttacctggggaccggctggaggccctggaggccgaacgttcccgggacttgtaggggtacttgagtgtggtgtccagctgcttgaagctctccttcagtgagtggcactggtagtactccaccaactcctgcagggcgtacacactcactgacagctgctgccacctccaggaagtcctcccccagtgacctggcctccctctcccacctcttggttcatgtgggggagactagcttcctggactcctcagaactccccacatcccgccagcccatggtgggtggtcagtacctcgaaggtaccagcaactcccccaaatgtttctagaaaaaataatctgcaaaagatgccaagactgaccagcacggacactgactgcaacagcctttataaaggaaagaatggaaacactctgtacccagcacttggggtaagcttctagaaataacaggatctccaagtgacagagagccatgcggccatcagccaggggaagattcattaatggtgaatgtttgtggccttgaaaagtcgcctaaaaatcagctggggcattgccagcattattatttatataatagaaaccagacccaagctgtgtgtagagaggtcctgaggactcactgagatgccaacgctggtttccgcttttgtttttttggaggtggggatgggattatggattttctttttttttttttttttttgagacagagtcttactctgtcacccaggctggagtgcaagggcgcaatctcggctcactgcaatctccgcctcctgggtacaaacaattctcgtgcctcagcctcccaagtaggggggactacaggcgtgtgccaccatgcccggctaatttttgtattttttgtagacatggggttttgccatgttggccaggctggtctcgaactcctgacctcaagtgattcacccacctcggcctcccagagtgctgggattacaggcatgagccactacgctcagcccgagattatggatttctgcttgaccttgtgcttttctgtggccatagcggggaagctaagagcctgggggctctaatcaggagttctcaatatatacaacttttgtaattaagaaaagaaaatgtaggcataactttaaaatcatttcaaggactatgcctctaactgcattctggctgggacagagggtgggggtgagtcggagaagaagctgtttgaagccatacatgtgtaatggggctacccggccaggccccagctggaagccccactgggcgtcagtttctgctctcgcaggaggatgggcatgagaggaatctggggctgctggtggcctgggctgcccctaccccacccctgcactgtttaccagggtcaaccaccttgctcaggctttgggggtcagaagtcccaattcaggaggctgggacatagctctagctgtcctagtgccttaaaaaccaattccctaaatcttggccacactgggaagaatcaatcctcacagaaaacatggccactcgctcagggccgggaggaagcacctgtcccctgtggctggggtgggagccggccggagccagaagtcacctaccaggaggctgtcgaatttcttggcctctgtgatgtggatccagttgtccttctccaccaccttgatgtgcttcacctcatcattgaacctgagcaaacacacggccccggcggtcaccgcgtgagggccacacggccccggcccccttggcagccaggctcattctgtgtttgctgcagcaaagcccctcgtccctggcccccagggccactccctgtcagccctgtcctaccccagcccttcgggccaccagccccagacagctcctgccacctgcctgcctgccctccttgctcgtttggggcccggaacccctggctgctcagctccccgcctctcctggcctctagccctgctgaggcctcctgtcctgggcttctgctcatttgcttttcagtaccaggagcctctcctcctccctgtggagcagccgggcccagccctgacatctcctgacatccttccctgcatgtccacttggccggccaggcctcgggcctgctcctcagaggtgccgagcgcaagcctgtctgggcctcggcaccggctgctgcccctgccagacactaacctccttctgtcctcaaggcccccttatgtcctcacgtctcaattcaaatgtgaccttacagaggagcccccatatccctcccctgaatgccacccacccccttgccagacacagacatcacaagaaaactacagcccaatgtccctaatgactatggatgcagaaatccttagcaagcagctggcagaccaaatctctctcccatacagtcaggcggcgtttaaccagggagacctgtcctgagagatgcaggcaggtgcttccatcactgtacgaacgccacggagtgcatttatataagtctggatggcattgcctactgcacaccccacacctaggctggacagcagagcctactgcacaccccacatgtaggctggacggcagagcctaccacacaccctatacctaagctgaatgatggagcctactgcacgccccacaactaggctggacggcagagcctactgcacaccccacacctaggctggacggcagagcctactgcacaccccacacctaggctggacggcagagcctactgcacaccccacagctaggctggacggcagagcctactgcacaccccacacctaggctggacagcagagcctactgcacaccccacacctaggctggacggcagagcctactgcacaccccacacctaggctggacggcaaagcctattgctcccgggctacagacctactgaatactgtaggcagttgtaacatgaggtcagcctagaaaaggtatggtaaaaacacagtagaaaagataaaaaacaggacagctgtatggggtgcttatcatgactggagcttgcaggactggaagttgctctgggtgagctggagagtggtgagtaaatgtgaaggcctaggacattgctgtgcaccactgtagactttatcaacgctggacactgaggctacactacatttatttttaaaacattctttcttcaatcgtaaattaactttataaacttcttaatttttgttaactttttgaagcttgggtaataatacttagcttaaaacacaaacatattacacagctgtacaaagatattttattctttgtatccttattctataagctttcctgttttttttctttgttgttgttgtttttactcctaagacaacaatgccttcttctagaatgtctcctgaaggacgtgcctgaggctgttttacaattaagtatttttttgctgagtagaaggagtatgctctaaaataaaaagcactgtatagtgaatccataaaccagtaacacattcatgtattacgatgatcacatactatgtatgtgcagaattgtttgtcctatgcttctatatgactggcagcactgtaggtttgtttacaccagcataaccacactcacatgagtaatgggctgcgctatgatgtcaccaggccatgggaacatttcagctccattataatcttacgggaccaccaccacatatggggtccctcacagactggaatgtcattatgtggccgatgactgtatttatctacataaaccagacacatagcaaggactccacaccacaacccagtgggacattccaggaatgcaaggttggtttaacatctggaaatcagctaatgtaataaacagtcattaaacaaatggtggcctggctgcctggtcctctgtgaggccttcatacagcacccatcttgtttctccctggatttaatgtgcaccatgagtgtgtgcgccctacccccagctcctggtcggcaaggcccatcttagcctcctgcaggccaggcacacagaaggctttctgagaatttctttcaggtgggcaatgtcccaccagctcagtgcttggtgggctccagcccatcagggtcggtctcctggagagttaactgcagccccacaaggaggcggctcccagggagagggcatagggcaggaggatgcccagactgtgccaaagccgcaaggcagcagtagtcacaggagacaccctcctaggcccctggctgcctcagagcagcacgacaggtccactctctcaacctgtggggctgctgggaaatccctgagctcacacaggatctcacccacccacttgtacctgagcttatctggttcccatgacccagaaatgtccaacccagcccacagggcagccaggagtgatgtaagcatggaccatctgtgcatgccaggggttcaggccctgcccagcacacctgtagagaccccctgacccctcagcaccgctttcatctcaataatgtcctcacttggcaacagatgacatgtccaccccaaccccacgagctcaggacgtggagaggatggtgctctccacttcagaacggcattgggggatgggtctcctcgagcccagagccgccacttacttgatgcttattgcaaagcgctcagcctcggcaggccgctccctgatcaggtaggtcccgctggcgtgggacttgagcaggttgtccgtctgctgcctctccatgttacctgcaaacctacaggagggggccgggaggaaacgagagccgcagtgaggacagtgtctgaggggtgcccagccctccgtgcgtggcaggccacatgaagtactctgcagtcctcatctgagagctcatctcctaatgaacccaagagaacaggctgggtccctatgagcggggcaccactgtggatggggtctggcatctgacccttcctacagtgggatacagtgaggctcaggacagatcttgagaggggttaaatagaggggtgactgtggccaccagccagtcccacatgctgtcttctgctctacagaccccaagggcctgccagaggagttcagcgtattcagtagatccaatttctttcctaaaatatattttcactatttcaaaagcagtaaaggcataactgcttatgtggatttttttggtaacacattggagattgccaacatccatgtcagttgaattttgaacagattttgaaacgaagctcttcctgccacctgtactgcaatgaagcccaccctgagagggcaaggcaagctctctcccaaaatctgctgccacactgtcaggacagttgggacttctgtgatttcaaacagcctcactgttcccaccaagcaactgtattgtcagtaagtggattacacctgtgacctcaaatataccacttttatatagtgcagataaaattcaaaaagggtttaattccctgaaatatctgagccagttgagctgttttagagagggttaacagctgcctacaggagaaggactcccccaggctcctggagagttataggccaggagggagaaggcatttgggagccactgggctcagtgccctggagatggcaacaggcagcctggggcctccaccctgctgggccgctcacaggcaccacccagacccggcgggcatgcccccataacaaagaggccaccagatgcccatgtctgcagcccacgatccactcaccaggggtatgcagtgtagtcgatctcccgggatggcggccggctgatgggcggctggtggcagagcacaagagtgttaacggccccccagggccactcacagagcagggctcagagggggtcattgtcagtgactgccctgtccccacattggctgccctggaggggactgtctgtggacttagccccagcgcccctggcctgggaggtgcccaagggtcgtggccaggacaacctcatctctgagtagatgccccgtgggtctgatggaacagatgtcggcatagccaccagctaacactgacttgatcccctgggacagcaaggaccgaaggtgcgggaagttttcagccagtggatgtgagacacccacagccaagctccctgctccagaggtctggaaaccccggggtgggggtctggtggtggccacactcaggcaggtgctgccgctccagtgagcaggtagggctccctccctggctacagccccccaccctggcctcactgggccacaggctgggcacagcctcagagactacctcttccctcgcaccctattcaccatgcagatggggaaactgaggcctggggaagggaaggaacctgccccaggccacctagtgagtttgtgacccttgtcctcccctgccgcctggtccccttggtcacgcaaagtgccctaagtgctgagcacctgccctttcagcagaggtagcacacaggcggacgggactggggctggggtcggggagcaccggggctgccgcagtggggttgggaacccacccctgcaccttcagaggttccacgctctcactctgagctgtcctttcggggtggaggtggggtaactcatttactcaaggctgcctgctgcctttcatcacagagccgagaattcgctccatatccctcagatgaaagaaataccatattgcctctgttttaaatagcataaagtctagctttgaatccttatgtttgaggggagcctttttttctctctaaggctgcgcaatagtccaagagatcttatagagtccccgaaatctggtgaaaggcagctggctggtcttcaccccattacagctgctgcagaaatgcctgttttggtgtttctaaaaccacaacgaaacgacacccgatcggctgagccctttaaacagaggagagcgtgctgccccacagccccccacccatcttctctctgggctccagctccaggaagcagctcacagcagcctaaatttagcaaggatgtcctgaacaagccaaaaatgtccacgtgaggaggcagctcccagaaccctcagcacccaggccaccgtgctccagaagcttctgtgggaaaggactcacccttccatccacagggcagggcttcacagatgagctggggaaataccctgacttcctggtttgtaccagacgaccctggcagaggaaagagatggttaggacaagggggccgagcctggcctatgggagtgtggggccatttagacggactcagcgtatgccaatcccgctcctggagggtgggagagccaatgtcttctttcccaacctcagctgacccggcagccagttagggcagggaggtgcagggcctcccaccctagacatgagagcactaaggcctggcacagcaccaaagcacctccacaaggcccccccaagaagctggcagccctggtcatacccggggagggacagagcaggactgatactctgcacagctcagatggccttttgcaccctctgaacctcctgttacatgaatgtagggtctggtacaagaaatccatcaccgagtatggactgataatgaccatgacaaaatgaccacagcatcattgtaacctgaacattaacaaacattcggctctaatgtcagctcccgcgggaagctaccttgctgggctaagtgccctcgaggccccgtggcgctctgctgacctgtgggtcttggggctcccttgagcactggggcttggtagaggggccgaggactgggggtctgagtccttggctcagacgcccgggtgccagcatgctcaacgacatggggtctcagcgtgtcaagagaagggcaaatgtgcccagaaccctttacagcccagccatctgctgaaggtggggatgaacgcccacaaaggtccccgggatgaacgcccacaaaggtccccactctgtgggccttggaaacagagcagcacattcctggctcagaaccataaacgacatcacgatgacaacatctgtgcccacctggggaaggagcgaacctgcccgctcaccccacgatcatgcgaaggttgctggcctgaactgaggtaggggtggggaggagggtgggcatggcatggccagggcagaagcctgagggcctatgagacacaacagaggcaggaaggacagaggacaatggagaaaggccttgggtgccagggcaggagggcctctcctgggaagggacgctgcatcgcctaccatgtcaaagcaaacacccggggagcccaagctaaggttcccaagaacacatgccatggcgcagaacggggcactgaggcaggagaggccttgctaggccccctgtgcctcctcctccctggtggtctctcacctctctgcctctgcctggggatgtgcaggactttatgcttctgccccagggagcagggaggagctggagccggggaccctcgaccctcccgggccccaggacccacctcccaccacggagactcagggtcgcccctcagcagctcaagcacgtcgcccgtctggaaggtcagcacaggcttcccgggaggggctgggttgccatggtaattctgcatggccaccatcttgggacctgcaaaggataggacagctcactcagtgactcagcagctcactcggtgactgacttggccccggcccgcagcccaccccatcaccaagctcggcctcccccagcacacacagccttgcgcctgcatctcccttccctaaatccttcccataagcctcatgtctttttgataaatatcataattatttatgcaatagacagattcaggggtcatcatggaacagcaacttattttcagatggcactttgtgttttcttccaaacacccttcagatctgtggcccacaggcagctgtgcggggcagaagacgggggatccctcgtgtcagagacgggcgacgggtcagcaggcccagcagcttgcccaaggccacagagctcacagaggtgctctgggcctgaaatgggggtcctggctgtgcctccagggaatgtggaggctgctcttagacaagccttgctctgacccagccctgcctgtagctctcaaggagcccatggctctcccagcccagctcccgcctggcccagcagcagcagcagcatttttcatcttttgtcctctgccgatgagggtgaggctgtactgagcactgcctggactgcactcaagtttgcagagaacacgatgctttttacgctgtgtctagaagcacgtttccattaagcaacccgcagcaaggcaggaaggggatggagaacgtggtgggagaacagcagcgccttttgatctcaggtctctggctgcagttcggtggccctccctggctagaaggcccttgctcctctgcaggctgggtcctgtccctacagcctggtgctgccttatcagaaacagagccacctcccaaggaggtgccatagaggccagagaggcaagagggagggggcccagatggcagcatccaggagcctggagcgtctggtggctgggcagacctggccatcaccacacctaggccctggctcagctcccaggtgatggctgacatgggtgatagcagagggcccaggtccagaagactcacctggtcccgctccggaggcgtcctgtgaggacaaggacagaacacagagatgagggaaggctgctctttgactgtggcccatgcatcaacgcaccccgccctccctgtccccactagttcctagatagaggggtcaaggcaggagcaggggaggagagggacactgttccctatgggacgcccccaccctggcaatatatttcacctctgtgcacctccactcctggaaggtctgtgcccttctctctcccactccttaccacgggcccccacctcctccaggaagcctgccctgaccacctgctctgagcctgggctttgtggtgtccatctgggacacacagtgccaaatacgactaagtttccatcctccatggaggctggttcatgtggaccccatagctcgaggggcacacgaagcccctggaagtgactccatccccacatcagctaaacagagggctctgagccaactgggggactcgggggcaggagggctggtgcaggtcccagagctgtacccatagccgcgagcagccactgggcaagggaatgaggcgggcagctgggatcggaagacaccgctggggcccctaggaggactctaatgacacccaccaaggaaagcagaggcatcttgtgaccaaaagtggctcatccaagccggtgtggccccatgagtggtgaaaggcagacaattgggtctttctggctctgcgcacacagggatgtggcgggggtggggcagagggaggggaaacactctggggacttaccagatctgcaggagaagctggaaaggaagcaggtcaggtgttagaggggaggccaccgacgccaaggccccgtgcagctctcactcacaccgccccgagcctctgggccgagcttaagatggtaagtgagccaagctacaaagtggtctgttttggacatggatcatggacacacaggtccgagctcatggctgtgaaagcctctcagttacttctggcagcaaattctgagctctggctttagggggcccatgggagaacttggactgggtaatagacctgagctggcaaaaaggttatcccgcctgggccacctcttttgaatggcggcagctgcctggatcatggggtggtacctggcactcaaaggggagatttccacaatcgcttagtgatgcctgctggggcacgtgatgaggaagcattggtatgcatgctacctgccacaaccgcttagtgatgcctgctggggcaagtgatgaggaggcattggtacgcatgctacctgcttgccatcctcagctcagacacccaggtgccaacacgctcaaggacacaagaccttaggtgccaggagagccaatgttcccaaggccctttagggcccagccatctgccaaggtggctgccacctaccaccagaggaggcaaggaggaaaaggagcccaacagctcacacacatcgctgacgtgacctccacaccacccagcactcacagtgcagacagctctgggcagacagaggtatccacagacaccacagaacaggttccagctcagtgggcaggggtcaggggtggggggcagctggacggcagcaatgactgtgcctgatgggggcttcccacaggaaaggctctcaggagaggccagcatctctccgggacatctcggcccccatgggcagcaaacagctaaaccagcctcggcagagcccaggggtgaaggctacaatggtcaaaggagcactttccagagccaaaccccagagcaaaggtagaagcctggatcagagggaaggcagcttggacactgttaagggaaaaatggctacaagtggcaaggacggcgtcccccagcagagggatgaggaggggggcaaggacacaggcccctggggagaatggagctggtgccagccagggcgctgccaggacatgggagaatgcagacagcaatgctggcttccaaaagacctgcagttccaactacacatactaagaaaaattcaaaaccatacagagatggggtgggcgggtgtgcgcgtctgcagaaagcaggacagtgcttggggcctcgtggcagctggctttgcctggggataggaggagtagtttttctctcctcctttacacttctctacattttccaaattttctacggaaaatcagtaattaataatccggcgggggcggggcgggggaggaacagaaagattacaaaaaaagaaaacttggaaggaaatataccgaaacattgcctttcatcatttctaggtaagttcacgggtgatactttctttaaaatttcatttctttttttttcctccaaatttttgataagtaaacattacctttagaatcagagaaagcaaaaaaagattctaagtagctgcagccatcgtctggggacatgcgaccacgagagggcagtattgatgggcacagctgaaaagctgcgttcaggccacaggctgcctgcggaatcctccagcactaactccaggggctgcgggatcctgtgcacagctagggggctgcattgggcctgtgatggggacaagggggtctgggctgaccttctggccctctccccaggttagggtactgggctggcactcacagtaaatggtgaattaaccattgatctaaaatcacagctcaaaatgtattctgggcaatggcgtctctgggtgacaatctctgggtgacaagctggcctgacttgtttttctgccttaagacaccttcaggaggctcaaggagacaagacccagagactcggcctggggccaccgggggctctttgttgaatagaagctctgctaataagtgtagacaaattgctgaaagtttcaagcctcagtttctggggctgatgatggaggtgacatcctgatgtctgaaacctctcaggagagaactgtctcaggctttgcactgctgtccagctgccctgagcagggcacaaccccaaaggtatgcccccgacccaaggtgcttcagaggagcctccagggcgcatccctgcctctgcccactgccagcctggctcaatcctctcccctccctgagcctcaagcttccctaaatgggcatgaacagaagggaaccactgtaagtgccatgtgtgtatgcgtgcatgtgtgtgtgtgtctgaaccatttactaacatggctatagctactgatggccaggcctcacccgccgggagaacccagggtgaccggtgtttctgtgatgagaaacctccatgcacctgttgagaatgttctgtgccgtgtttgggggtggagattctagaagcttcctcctggagtggggcaggggatgcaggagatggggaggggtcctcaagtacccattaggagagagggcttggaatggaattcatcccggctgtgtctcctgttaagtgtgtgacgtgcggcaggcgtctggtgtctgctctggggcacgtgagcactggtgccctcatctggtcgctgccccgtgggagatggtgcccgaggcccgtacccaggtggtagggggcagaagtgagcaggcgtggccagggactggggtgggggggtgaggggggtactcactgaacttgcagggaggtatcacttccaggcactccttgtgtgccccgacgccacacttggtacacatgtatccctggtagaaggtgcccctgcacaggggagggcaggaggtgaggtcgaggctggggtcggctcctcatgcctctctgccaaggtcaaggcccttgtccccacccaggctcacctggctggctgtctcccagcacacacatccctcatagccctgagtatccaggaccctcccttaccaggcagcctgacacctgctttcccctacctccaccagcctgcctccctgccccacacagcatcccgggcacccaggaacaatcacctcccggctagatctgaaactctaagggcttggctgggccgttttttttttttttttttttggagacagggtctcactctgtcacccaggctggagtgcagtggcgacatcacagctcactggaggctcaatctccaggacttattcaattctcccacatcagcctcccgagtagctggggccacaggagcaggccaacacgcctggctgactttggtattttttgtacagacagagttttgccacgttgccaggctggtcctgaactactgggctcaagcgattcgcctgcctcagcctcccaaagtgctgagacttgagccaccatgcctggcacgggcctgactcttgtggggtatactcccttaacccctcagggcctcccacagggaacatgggacagatagaacactaagctctctcaggggcctgggctgggcgtggagcgaggtgagggctgtagcagggggtttcccacacctgaggaacattttgcaggctttgcagttggtggtcttgtcaaacgtgtacatctggaaactgtggtggttggcattggctttgtctggcttgatgtttgacctggcaggagggaaagagagcagatgctacacccactggattccccgagccccaccatgtggccatcctgggaaccagctgggctccggacccaggctgtgcagaatccgagagggcctggactccaagcctggctctgcccgcaacatggggcagactcagggcccagactccctgctcgtagaaggcaggtcagagaagaagctttaacactgctgcactggcctgagagaaccttccaggtggggacggtggtctaaggtcctgactgggcttggatgtgggcaggtgtgggtatttgttaaaactcagaaaacatatacttaagatttgtttgcctcattggatataagcttgaaatttcagaagctaaacaaatattgggccccctgaggtactcaggggggctgcactggtgtgcaattcactttgacacagacccgctgttggatggctggggtggggtggggtgacgcggatggcggcagcgtggtgagaagacggctattcaccatcacgtcgcttcagcttccatgaacgcttgaacttttgcacaataggatgttggggagaaaattacaggccatggaaagcgagtggccgaagagaagatgccccaggcctcccccacagagcctgggtgcaaaccagctggctgcatctattctcacgagccaggccctggccctgctgtgtccaatggttccctttcgatcctcccaaaaaggccagaacacaggccttcccctctccatttcaccagaagaaacggtcagagaggcgagtgcacctgcctgcaggccccagctcacctgcccgcagagctcaagcacagacaaccctgctggccctccagggtccgtgttccgggaacccgttcatcatctttctctgtttcacatatctaggatatgagtcctcttggatctcatggaaaaatagttctgtggcttcaaaaacaggtgacaagccgccagcccgtaagaccctgaagactggggtcaccaggaatcctctggcatcatggccactcccagccggtcactgctctgtgggccgggcgtgccaggctcagcctcaagggtgggatggctcattccagcaggacagcggagcctgcctgggacaggctgtggcagagggagagccctctcactctggactgattgttaaagaggatgtcactgcttgaggctggcgtcccaggggtgatggaggttgtctgtgtccctgacgttccaactttgcctcccaccgcccctggtctgagaggaaccacagacacaatccacctgggcttccaccccccatacaactcatctgccagggacctgggggctgccgccctggaactcacatggccatctcaaactgctccatccacttcctcttcatatcttctgttttgcagaaaaactggaagccctgctttccttgaaggtgaattaggtagaagccgtaggaccactgcaggggggagaggggccatgcttgcaatagacacggcttcagacatcctggcacatgtccacgtgtactctcgcctgtgcagcatgtgcacgtgtgtatatgcatatgtgcacaggtgcctgtgcctgtgtgaacacatgttctcacgtgtgtacctgctctcttgcccatgctgtacgtgcacacgtgcctctgtatgcatgcatgtatagctgtgtgcccataccctcacgtgagaatacatatgcgcttgtgccttcacctctgcatgcatactagtgtgctcctgcgtgcatgggtgtgcatctgtgcctgcacgcgtgtctatgcgtgtgcacctgtgcatgagtgtgcccagtgctcctgtgagcatgtgcacacacacacttgtatctgtccctgcaggtacacacatgtactaacacgtatgatgcacatgcacccatgctgtgtgagctctcctgtgggtgctctcctgtgtgtgctctcctgtgggtgctctcctgtgggtgcacacacacatgcctgggcaggtctgcactcctgcctgcgcccatgtgcgaggatgctccaccgagtgcatatgtagatgcatgttaagcgggggcaggatcccaggaaggatgagcgcagggccccacccagggcccctccacgaggcctgaccacccactttcacttcctaaatgtgatgctaaaaaaacctcacttctctgaagtagaacagtaacaacaaaaaggcagggaacagccatgggcctggggcaccccccgtgaagccatccccgactgagcaacccacaactgcccccttccctgcctccccttcggccaccccacaggcctcgccatctctccgagctctcggacaaagggctttcaaagtggtccagaaaaaagagtttggcaaataggagcctactgggttagaaaagatggcgggaaagaggaacgaagggagggatggagaggggaagcgtggagcggggatgggaggaggaaagaaacaaggaaagagagaggaaaaggggagaaagagggagggaggagggagagaacacagaaaaacaaaaaggatgatggagagctgaagagagaccaagaaaccccagcctctgaccccgagctccagggactgaggatcacggagttttcctttcacactgtcttagcgggcaagcctttcatcatgaatacaaatcatttcatcatcgggaaagggagtggaggacgaaggaccaagaaaaccctgagcccagcccctcaggcccctgggtcccctggctccgggcagaagtgccagcaccaggctgggatgattgaggcaggtgggaggacctgggcgctaggtgcttaccattttcccgtgagactaggaagcatggagaggagaggaaggggaagacggtcagtgagaggctaagcccggccctgtggtgggtgccgcagtgtggaggcgccaggagccctggcaggtggaacaccccccagtgcccaggctgggggtggggtgatcagtggggaaaggaatttcttcccagagtgttgggtgctggtggcaggactgcctcatgggccccagttacttgttttgggcatgagggcagggagggtcaccctcaacagctcatccagtctgcacttgctgggtctggacgagggctacactgccagccctggaggccagggactggactttcagaacaagggctcctgacccccgccccccaccccaccagggctgcacacggtagctgctcaagtgccatgggcagaagcctcagctgaagcaggactgaaccagacagccagccagcaatagccctatagccatggtcctgccccacagcagcttcggccccgtccctgtagccctggccccacccgctggcagccacaggcccacctctgcagtcctggccccgccccagcagccacaggccccacccctgcagccctggccccaccccagcagccacaggccccagccagctacatgtagagtctcggacaagccacagccagacctacccacagccctcctccaagcaccgcagggtgggacgggagaggaaagcctgcttgctacaagggacaacatgggctagagtcaggctggccagatggaaagccaaggttgaaagtcccaccctcactagaggccttggggtggcctctcccctctgcctcagtcgcctcactggggagtgggattctggtcttgcccacctttctggggggcgctgggcccggcgaggagcaggcctgctatgagcagtggtcacgacggcgaggcagtgactcagagaggagccttcctgcagagcggagacgcccaccccaacccacccggccagcatcagcggctgacttcgagtccccttcccctggggtctggaacccagtgcctctctccaggccacccccacgttcctgggtagcaggggggacccggaaggccccaccttcttgacgtccttgttgttcatggggtcgtcggtcatcttgtggaacagcagctcgatgatctccttgagctcgtagctgtagcccttccgcttgcagacgatgaccaccttgtcaaacaggaacaagtacctgggccaggcagcgcagcgggggatcagcaccccagcactgtgtgctctgctccgaggaggcggcaggagctgagcctgaggctctggcacgcggctccctctccgggcgagccctgccctcacctggctcaccaggctaatgctgagcctcggtcaggtctcggctgttcccacactgcttctccaggaagccttccttggctccctacccccgtgactgaggctgtgccaggagcccttcaaggggctcctgcatcccccacgctggcctcccatgcagcactgacccccgacggctactcccagttgatcccgcgctggactgggagcctcaagagggtgggacccagatctgctgtgacccctgccccagcacacagtaggtgcacaaggagggccctggacaagcctgggccaccgtgcgcctggacactctccggcagtcatttggcaaagagcccatccgaccactctgggcctgtcttgggttcctggaggctgagcattggcagtgaggggcctggccctcatctttggctgccccagcccagcctggtgcccgccacaggcacaaaagccccactgctgtggcgcccgctcgctgacgagaaggaaggaagcaattaaaactgaacaacacaaagccaccgccaggcagctctttccacaggaaggcctggcttccagagccacttaggagtggctccctgggagggagagccagaccctggcgggacgccacccagcccacaacacgcgccctgctcacctgtcctgcttggtgtggttgactatggaccggactttcagttccccgtcaatctttggtcttccaaattcctccagtttcacttgctgggaagaaggagaggggccgtcagccggggctggagcagccccagttctcctgaccgcacgggcagggcagactgtcgtgcacccaagggaactccccacaggcagcagaggcgggacgaagggaaacagcccctgtggctcccagctggtgctcaggatggacgagggagggtgcagaagaccgggaagggactgggcctggcagcttctctccctttcctggccagccctgccaaggggctcccttcagctctggggacaaagggcgattgacggtgccggttgtgttcacagaggccgccgctgtgtggagccccaagcgggacccggtcggaaaagccagaagcccaagccccacgttcaggagagaacaaacagcgcctatctgctgcagggcgggtggggccggggtcctgccaagggtgaggcttcgactcagacccctgtgtggttcgctgaggttcattttcgttgtctgtctggttttgtctctgtgactcttctgattcagagagagcttctcttgacatgttccctgcgtggctttcaaagtgtccacacagacaggaaaaggtggaggaaaatgcttcaagacacgaacagggccctgcctgggaggtgctcgaggcacaggctcagtgtctccttccaaggtctcagccccagaggctgcaaggacagctttggtgtcacatagtcccagtcaacttgctccaggcctctgatctcagctctcaccaccttccctgtggcaatgggattcagagccaggactgggtacagggcctggctcatggggatgctcgacgcctgctggccatgctgttttattcttgttgttgtcgtttttgagatagtctcactacgtcacccaggctggagtgcagtggcgcaatcgtggctcactgcaacctctgcctcccgggttcaagagattctcctgcctcagcctcccaagtagctgcgattataggcacccgccagcacgcctggctaatttttgtatttttagtagagacagggttttaccacatttgccaggttggtctcgaactcctgacctcaagtgatccttccacctcagcctcccagagtgctgggattacaggcatgaccaccgcgcccagcctgttcttgctgtttaatgaacaagtattacttctatgtaaaaacttaaaaaacaaaacaaaacgaacttttctcctcacgtcctgctcactgtacgcatttgtgaccgcctcgcgcaggagctcacggcagcacggacccgccaggtgctgatggtgcagggtgcggccgtccttggcctcctctgcacccacacattttaatttctttctaaaatgaaagatgaagggggcagtatcataatgcccttcagaagcttattttttttttctttcatcgccgacgtatcgcaggtgcttttccgtgccccacgttcgcggagggcattctctttgtgctgctggcaccgggtgggtgtggcctggccatcggggaccttcccctgccagcttcatgtcagtgaaatcaccagggtgaaaatgtttgtgattcaccaccaggggtaattttgccacccaaaggaccctctggtaatgtccagaggcatatctggttggcattacttgagggggtgggggtgctactggtgtctggtgggtggcaggcaggtacactgctccacatcctgtaacgcacaggggcaggtcccacaaccaagaatgatccagccccagacgtcagcagtgctgaggtggagaagcccaggttagaaccagcagatcctcgggaagtcggctccggtcagcacagaccagggagtttgcttcctggggtggcgcatcccctctccccaggcaggacgaggtgactgactcggtagcccaagcctggcctctgcagggccagactctggggagccccaggaggtggcagccctgcctgatggggtccgaggagcagaggcgactgccggccccaccgagcctgggcccaaaccctgtccattgcccctggaggggagagtcaaggtgagggtgggccaggggtccacgaaccagggggcgtctcctgcccctgggagacacagttctcctcttggacttgaaggggtcttctgtctaggcttgggggagaaggggggctgggcaatgaatacagtccctcccctgtcccctcccctccccgtccccctccccccgagcacaggcagtcttcagtgcacagggcacttgggttggctgtcgtgggcaaggaagcgtggatgctgggggtctgagatcaaactcagaagttgccgggcaccagcctctcaacaggcagccatggtgtggctgcccatggagctcactcaatactggggctgtgaacgtgactttataggtacgtcctcatcgaccttccctagcctgaagagtcagtctcactcaccaaattttctatagaactctgaaattcgctgattttcctcaaggtctccttgtcccgtttaacttcattgatgtacatcgccaagtccttgaaaacaagaggcagaggtgagcgggctgtgctgggtggggtgtgtgtgactgtgtgtgtaagcaggctgtactgggtggggtgtgtgtgcatgtgagcgggctgtgctgggtggggggtgtgtgactgtgtgtgaatgagctgtgctgggtggggtgtgtgtgtgtgagcatgtgtgagcggactgtgctgtggtgtgtgtgtgtgagacagcatgtgtgtgtgagcgggctgtactgtgtggggtgtgtgtgagcgggttgtgctgggtggggtgtgtgtgactgtgtgtgtgtaagcgggctgtactgggtggggtgtgtgtgactgtgtgtgtgagctggttgtgctggttggggtgtgtgtgactgtgtgtataagcgggctgtactgggtggggtgtgtggtatgtgagcgagctgtgctgggtggggtatgtgtgtgtgattgtgtgtatgtgtgagtgagctgtgctgggtggggtgcatgtgtgtgtgtgtgtgagcgggctgtgctgtggtgtgtatgtgtatgagtgattgtgtgagaacatgtgtgtctgagtgggctgtactgggtagggtgtgtgtgattgtgtgtgtgattgtgtgagcaggttatgctgagtggggtgcgtgtgattgggtgtgtgttattgtgtgtgtgtatgtgagcaggttgtgccgggtggggtgtgtctgactgtgtggttgtgtgtgtgagcaagctgtgctgtgcagggtgtgtgtgtgtgagcgtgtgtgtgcatgcacgcacatacatgcaggagctcagcccccaagggacccccccccccaccccccacccagcatccaggcaccgggcgtttctggaccttcttcctccatcctgccggggaggccgccctcgagacaggagggctgaaaaacatcacctctgcatgacagatgaggaaactgaggcaggaaagggaacacactgaccgagagccacacctcgtcagtgatgatgccaagagccccaaactcctggctggtgccacttctttctaccccatcacgtggtccctcttaaacatcctaatagagggaagcagccctgtgtgtgggagccacatcaggccacataagagccacctagacttgggctgacctatgtccctgttcttgggaagcttccccctccccagcctctctaagccacagcctccccttggagcctggacagaatgaggggtcaggaagtccctctctccacgggtctggccacccccactccggcgcctgcctgccgtgctgcaatcctcgtgctggccaccagagagcagtgcccacttcagtccagaaaacgcagtgtccagacctggcccacagcggaacccaagggagccggccacgtgggcggtcctggccctgccccccgagagcagcgggtggaattccccaaaatgcaagtgaccagccagggccagagccagagccagagccaggtcttcagcaggttcccatccctcccgcccttcctcgttcctagaagacctcaccattggctccccacccaccccgcaggagggaacttcctggggaggctgcagcacgctgtctgaaaggggtgttccgttttcttgtcgttgtccacttgcctttaaaataaggaataaattcccagagacaaggaccccagtagcaagtctggagctcaggaccacccccctcccaaaggcagaaacattacaactgtgaccaccgcggcccctgcgtgcacctggcccaatgcctggcatgaaataggaacagatggaagttgcccgaatgaatgagcaggtgagggaaatgtctgtactttgatacagaggcaggactgcagtcagctcatggagcttggacctaaaaccgcaattcccttggagacaaacctcaggcccacagcggcacgggggctgattctcaaagacgctgccgtacaaggagtgagccctcagtccctaggggaaatcaagcccaggtacagcgacgactcccatagtggctgcatgaatgacttcctatataaattgggaatggatcaaaagacttctaaaatccccccagccctgaagtttcatgatgaggttcggtggctctcagaaaggcagacgcacacccgcaagtcaccgagtactttgtgcagcaccgtgagctacactcctgggaaaccatcccgtcgaggggctcagagccactcgccagccagacaccgagtgctgagagtatgaaacgcaagaccacactcagggcccgggtgcacggcccactgcacctgctgtcactgtctcagagcccccgaggacgcatccacgctggctcacacaccgtggctcacagcagacaggccagagcaggtgttggagaggggcggcttgggggctgcagagctgacaccgagaaagttctgtcagcccgtcatggcaggaggctttcctggagcattcctcagggtgctcgctgcccagtgcagccgagcgggaatctgaaggtctctgggaccacctcccgtgcccacacacgagtgcccacaggatttggagtaaatttctccccgagcacaagccctgctcagagaacctcttagcaccggcggccaagcactggccccactcccgtcccagcccaacagcagctatagacagagacagattacagcccctcccccacccagagggagctccttaaatgaggtacctgggaaaggaaaagggggcccaaagcccaggggggctgcccagagggcaggggccaggtgtcagagggcaggactgcagccctgaggggggctggcagaggtgtcctgtgctcccgacgagggagatgtggggggggtcgtcatccctccacccagatgcagctggaggggacctaccacatgccaggtgctgtgcctggcctggggacacaggtgactatggctgacacatgcctggctgggaaggagatggcacgaacaagtgtgtccaggaggaagagtgccacccacgaggaagccagttccctgaggacagaacccagtggggggcgatcctccctggaaaacgttctgtccacagtgaaggcaggatgagcaggacgtggccaggtgacgaggaggagggtgcacctgagccaacacccggagccggggaagtgcagggcacgtgcaggagcctgggagggatcaaacctgcctggaactgtgctgaacacagctgcgacatcaggggcaagtatcctgcagaaggccgggagtgccagagtgaggagcccatgcctgcttcatgggcagagggagccacggaaggtttctgagcaagggagtggcatgagctgagctcacccggacaaggggagagagggaggcatggctggctgggggccctcgaaacagccaggagcgaaggagctccccaggcaggtagctgagagatggcaccggaggtggcattttagaagcagaagcctcagtgctgggagtgagaagcactgggccagaaagcccagaatggaggccaatgcctgggggaaaagcagggggaggggaggctcaagggaggtcttgttggacaggtgaggttaggactcgggacacctgagggggcacctgacctgcagtgccctccacccgtcacctctacctcctgtgggtctcacccactgccctgccctgccctgccccaactcctgctgtcccaggaaactgtccacagtcaaaactgaggctcgttaatgagcccaattccagtccaagaacacgggctaagccagacggtggcttctcccctgcctcagtttacccacacacctgcatggcttccagtgcttctttgagctgctgcctctcaggccgttccgcagaatggctcagaagctcctggaagggtgagaagagtgtcatgtgttaccactcgggggttctggcctctgccctggcccctacctggggcaggaggtgtgcacagaaccaagtcctcagaagaaagccacccccacccgccagccaggctgggtttggctgcccgacaccaaaggacagagagtgactcctccacaggggataccccacttcttggcaggggcgctcccaaaccttgtggataagggaagggagtgaccgtgagaagggccatgaaggcagcaaaaagcaaggcgctgtgccagcattccacgggaaaagggcctcgcaaggtgccgggcagaaaccaccgccttccctcccaggtctggctttcctgaagcccttccatgtccatttctgccatggccaccaggaagctcagagaccaaccacagtagctttcttattcctggtgtgaggacgcttttctgtctctttcagttttctgacctctttagtgattggactcatcattttcctctgtgtatttactgtgataatcggccatcacatgcattgagcggtgattatgagctaagcatgaactgacttgtctatattcaacttaatctgtctgtgggctgcaacctataccccctggaagctgccagccctcatctgactccagcagtgatgaccccgcaggcacccggggcccagagcctcaccttcaagagcaggtggtatttgagcaccctctgcatggggaccaccagcaggtcttgcagcttaaattttccatcctggaccttcagtgtgcactcctgggagggcgacagggcgatgggagagccctccccgaggaaagcctgaacccacccacctgtacccccgcccacagagaggggagacctaagcccagaactcaggcccagacgtttggcccttctctagccaggctcccggaaccagtccatgcaccaggtgtgtgcagaggggggggcttcacaacacatggctcccaccctgccgtgtctgcactggccacactgggacgcagtgagacacgtgcgatgctacggaaaccctctcggggcgcctgctgggcctgtctggatgtggccttgactcttccgccaggccaggtcctttggagaaggtcctttggagaaggggcagcaggccatcccccattcaccaacccctctctggtctggcctctgggagaagcaaggtggggcaccaacttgcactgagctgtggggccactcccaggaaccagggcattcccccattcattgactggacttggggggcatcgtgcatctctactggggggccacgctgcctccaccactgctagagccagggggctcttcaccaggctccacgcagaaaccagggtgtactaaccagatggagcctggaaactccagctgggaacaggaggggctgggaggggctcacgtgagaaacactagatgttgacagagacttgccctgggcctggggtgaggatggatgaggggtgggtggccccacagttcccagcaaatgttacccgggactccctggggtcagcggaggccaggatcaggggtcagtcagagcccccagttgatagagactcgccctgggcctggggtgaggatggatgaggggtgggtggtcccacagttcccagcaaatggcacctggggctccctggagtcagcagaggccaggatcaggggtcagccagagcccccagctgagtcagattcagtcccaaggacgtttctccatggggagtctcactgtgtcctggcctgggatggtgacctccacccaacccactccccaacccaacacaatgcaaaaaagaaaaatctacaaaaaaccattacgtcatcacccccatcaccaccttcccaacaaatgggcaagagagaggctggtacctaacgagctctggcctgcaagctgcaaccttggagccagggccagggccaacgcctggcaggacttacctcgactttctgcctgaagtcctcccggctggccaggagctggttcagtgtgttctgggcgtgctccatgtggctgcagtactccccgtagatcagaagcctggacggtgcacacacacgcacacacgcacacagatttaatgagcagctcggggctgcagtgagcccgtccatttttcccagcaggctgtaggtgcgcaaccaacaggcccctcccctgacagctccctgcacgtggacacattcaacggccaggaggctgctctccccttcccgaagctaccgggccgcaggagggctgccggcgtgctgggagagggggtgcccctgctcttcctgagtcccaggtggttctaggtcaggtcccggctgggatgcaggctggagctctcaacctcccatcccacccccaaaaagggccaacactggaggaaagagaagcccctgacatccccccaggaaagaagaccccaggagggctcagaatcttgcccccaggccctgagcaccgaggcctgcactggctcagggctcaccctcatgctgtgccaggtggggaacccctaagggtcacccttgttgcttccacatggtgtctggattccacaagcaggggacaacagcagtgacagccccgtcttcagggatgcaggcagccaggtggcccccggacctgggaggacgcccaggaagccagccctcgtgtcctgcccaccgcctcctcctggccccagcatcgctctctcccggccactctgattcccccttcagtgccttgtgctggtctctttagccacgacaccttctccctctccctgcactgggcccacatctctacaaactggaacccagggttcccggcctctggagcctcagggtcttaggttaccagcctgaaacttcatctttaaaaccccataaccccaccgacagggcagtcccaaagaagaaccacaccaggtgacaatgttggtgacaacaaggatgacaagagccaccactcgctgaggcagctgctgccaggtgctctgccgacaagccttatgacttttttgcccatttgtaaagatgggggtgattagccccactcttcaggcagggagactgaggcctccgtgaacttgctaggagctgacagtctggcctgcaaggctgggccggacccagcgtcctggtgatatgctctctggcagggctgtgtgttggtgtctggaggctcccctggcccgggaagcccagggcaggctcttgggaccaggtcaccatggcctctgggccatttctctttccatcatgagagctgctttgccgtagggcacccggcctggggctcggggcgggcagctgggcctgtagcctggcttctgcggagggtggccctcggggagaagcgtcctgatggtggggtcttgatgcagggacaggtttccatccaagtggctctgccacatgggagaacagaacagtggctgggaacacattttctgcctagggagcatgtccctttggagctggctcaggcacagggacgggcatcttgacacacttcctactcccaacaaatgctcatgaggctgtcctcaccacggccagggccgccagaggccctgacaccctcccagcgctgcgcgtggggtccagtgactggtacttcctcaggccgcccgagaatcctccctcacaagcctgcagggacacctctggcatgcgaggctgacagtccacgactctgataaaggacctgaatctgctcgaagctcacctgacccagccacagtcaagcaaagcacccatggccggtcccacatggcctgcaggggtgtgtccccatggggggatcccgtgtccacagacctgggaggtctgcatggaggcatcaccatcattgcaaagggcctgcctcctgcctggtgcttgggctgtgtgttgactgggagccactttaaatgggaacctgccccctggttaccacctaaatgagtctgttattacactgatcattttcatataaaagttggtgaaaacctatcatctctggaagcaatcgagaaaaagggttttccccttttaaaaaaaaatgaacaaaagcttcagaagcccccggtagagtaggagaggagagaaggaacagagggacatttaagagaccaccggacagcccgaaagtgagcggacaagacactgactcccggcggccgcctgcacctgccccgctccggatcggtgttttctccaccctgagagaatggtcagagccatgcgcagaagacacgccacacacactgggcatcacttggtgccaggacctgggctggaagctctgggaccgtgactgtcgccgttctacccatggggacactgaggctcagagagccccgtagctgagaagggaatcacaccaacagtcaccgaccccaaagcccagttcctggggctgtcctagggctgcactgctctgcctcctggctgtgcctcctatctgatgatgacaccagaccagaagcaaggcaggaggtccaggggcaccccaaaccctaaggcccccagcccacccctgtggcccctttgaaaagtgcccctgacctggcctgaggactctaggtggggaagccagggcaggtggtgaacctcaaggctttcagagcttcccaagaccgcctggaggcgggaggacgagtctgggctggggagaaggaaagacagagtccccagcgaggggtcctgcccgcatggagccatgtctgctgctgctggggctggggccacgctcgggcccgagggacaccacactgcctgacttcccaccaggccccgcaccactgcggactcggcttcaagcatttcaggtgagctgggcccagtgatggccccagtccctccctgtcgaggcaagtcttcatgtaggtggaaaaagctcccaactgaagcccagcggataacatgcctggtgccagcagctctagtgtggccaaaccagctttgtgagctccgcctttcaatttcacaccaagtcaccttggcccgaggtttaggtggacgaggggctggagtgcagatcccagccttactctcctcacaccatgctctaccgggaacacccacatcagccacagcacagctgagctggcagccttctccacctggcaaacttctactcgtctgtcaaaactcttccctatcattgccccttcttcacttcaacccctgcaccagcagggccagagggaaaagcaaggagataggtcaaagggcagcaggtagaggcctgtccaaggtcagtgggagcccaaagaggagactgccccgggtgacccccacccaccagctctgagctcctgcaatgggtctcactcatccccataccccagcacccagcccggagcctgcctgcaccaggcactcacacacggctgtgagtggccacagccacaagcctggacacaggtccttctatccatttgataagaggatgcaggaggttgggggtggggggaatggcaggcacttgaagcaaacaggagaactctggggaaagacagacctccatgaagagcctgaaagggccctggccgtgggacgggcttcacacccgggctcactgcatcctcacagaaacaccactgtcaccacaggggccctgaggctcagagacgtgacgtgacttctgaggtcgcccaagaaggggaacagggccagattccaaagcgaatgcacatggctctcaaccctggccctcagggccccagggtgacgcctctgcagagggacactctctctccgtggagtccagaaggacactcgaggggcccgcgccctctctcacctgacccaggggcagagcagatgccagcacctgcacacccctagccccactgagcaagggcagctggtgatggagagggcctcggaccagaactcggctgcagtgggtccactagagcctcacactgtgaccttatttggtcatgatgcagatgtaatgaaggtaaggactgagatgaggccatgctgaaggaaggtggccctgactccaatgagagtggcctcagaaaaggacacagagacgcggggaggccatgtggagatggggacagagaacgaagcagccccagccaggaacacccggggcctccagcagctgcaggacgtaggaaggatccccctgaagcctctgcaggaagcatgacccgggcacacctggactttggctcagtgagactaggagtctggcctccagaacagagacatctctgttgtttcaagccaccatgtttgcggtcattgttacagccaagccaggtcactcacacagacgccttcaccctccgtccacaccacaggactctgagcacctgccacataccaggcagcatgggccacagagtccccagggggcacagtttgacttttccccgaaaaatggagagaaaatgacagtgactccaagcctattggaggaagtcagttaaggaggcaaaagtttacaggccttaattctaaccacatttactactgttaagaaaaaggagccaaaacttggaataacacacacgggcacacatgtatgcacacacacacacatgcatgtgcacacaaacacacaagcacgcgtgtacacacacacacacacacacacacacacacacgacttcatgcattcctggtctggttggagcacctcccaggggcagcctccccctcccccgccccactccggctgactcctcccctggagaaagttgttcaggcgcaaatgatttctgtcctgatagaggacatggccccaaaggtctcagtgtggtcaccttgcaaggcacggcccgccgtgtccagcatcctgcccgacctcccctctctgctgacaaggtatgtggttcccttgctcgtgagttgacagacccgtggcccgagctccgtgggtatttgtgtgaggatcatgttttttaactttctgagtacgtcaaattctgaacccaccacacggtgcacaaatgcctcctccagagatgcctctcctctgcccattttcctcatggtatcacctctgcctccagtccacacagccccaacctctcaagatgcccagggacaggccagcgtggattgaggaccacaggccatgggctcaggtatggaccaaggatgcaggaacaagcaaggtgcacggctgagctgccagctctggcctccgtttccccatctgggaaatgggggttagacagagcgggagctgaggcttcttgacttcagaggttcccaaaggcagccctgccagagcaggtggccaagccaacccctactggggtttttgaggtggaccatgaccggggactctccctgcaggccgtaccctggaaccacccagccttgggcttcgggtaggaaccatccacagggcagcctcactcgttccaggattccgagtggaagtctcggtgcaccaaagcgctcacctgtctcggatccttcatctccacatacgcagggagatcccacccagccctgggggaggagggcgtggccttcgtctcgttctgttctgcattcctcccaaaagcgctcgtgcaaagctccacagagagctcctcttgaaagccagttcgtggccttcctgcagggctgccagctccccgaggtcgttccctttctagctctcctgcccccacgtccccgtatgcccccactccccgcagcatgactcactgccccactcaaggaagccaccaggagctggactccaggcccagcctggccagacccagccacagagaaaaaccacacggctttgtcttatgtccacagctgcagaatgcaagctccttcccaaggcccagtgtccctctgggtgggagatgcccccttttaggcccacagggcaaggctaagaggagctcctgccttgtctgaggacgaaggctgcattcatgaaagtataacctcaaaaagagggaggtgactgtctcctgccactcagtgccgatcatgccacaccggaatgctactccacccttcacccccgacgagctgccaggaccctgtcacaaagcccttcagcagcttcctcgtgccctcgcttaataaaagaaaaattctaaatccttcctttggcctggaagcccctgcaggaccctccagcccttccctggagaaccgccccttttctactgggctcatgcctctcaccttcccctaagcttctgctccccaacccgcctcgccccacccctgcaggactgtgctcagggggacacgtcctccgctgtgcagccctcacgggtctcctgggctctccagcaacgccgcagctccccccggagcttctctatcttgtcttggttctcatccatcccacccagcgagaggccagtagctctgttcactgcgtgtcctcagtccagagctcaggagccatacagagcaggcaccctataaaagcttcaggactcagccagcaagcaagaaccaggaccttggggccgaatccgaaatgagaggaaaggggcaaaaaagctggatgctgggacagaaccacgatgatttggtgatgagctctgatgaaacgctgacagccccttccccaaacagaccccgactgacggatctcgccacacgcctcgctgccagggacggagctgcccgtccacagagctcttgggctgggcctgtgactggacgtgctgcccgcactgcagtggcgctccaaggcagagatgcccgctgttcctcagcgggaaccacccatgcaaggtcctgctggtgggacagggccaggggtgtcgccgggcagcctgactgtggagggaggctcctgggagaggacaggttatccaccctgtcactctaccacacagccagccattcctcctccagggcttcagcctttgacggacctcgaagcaaaccacgcctcatccgtggctccctcccttcctggccgagggacagcatgaacaaggcgctgaaaaggaccactgtaccccacacctgctgaggactggggcgacagccagtgtgacctgccagccgggcactatcagctcacccacagatgaagggaacaccttgctgagggcaggttagggagctgtcctcccccgatccctgcccactcttaaccctctggggctggccagtgtgctcacacctgctgggcctcgtcagctctcctggtcccctctgccactggaccacaagcactgcctgctccctcgtgtctccgggaaccctccaagccatggcccctggagagcaggctccaggaccctcctcacagggaaggggggagcgcctttcctgaagctacagagcacacagggaagcacctgcagggcttcccaggcaacgtgcctgagaatccagccctgggcctgtccccggctgcctggacagggaggggtgtgagctgtgctgacggccacctggcgggtgatgcaggggaccctcctagagatgagggagagatggacccgggcgcccaatgcctaggctcagggccgcgtggtaagatgcacctgtggggtcttctacaactccccaggccccagagcagacccagacccttccaagagtggaccccggacatggtatttgtaacaagctccccagtggctctagtgagcagccaagttcaggaagcattagcatagaccccttcgggctcctccaaaggatccccgagggacagagagcttggcaccgtcccctgatggggctctctcgagacttccgtggctggaaacgccatctccccagcctctgacagcctgggcattgtctaacccccagaaacgccatctccccagcctccgacagcctgggcattgtctaacccccagaaacgccgcctccccaacctccaacagcctgggcatcgtctaagctccagaaatgccacctccccagcctccggcagcctgggcgtcatctaagccccagaaacgccacctccccagcctccgacagcctgggcatcatttaagctccacgtgccacctcttttcatccttgtccacatcctaactttaaagaaccggccacaagggtgcagaagggagaagtgggggcccgagatctccgctgggacagccgagccacttggatggccacacctctcacagccagttagaaacatccagaaccccaatcctgcccctgccgagctcccacaggacaggaggctccacaccctctccatcaaccaggctgcggctcggggtgggtggcatcctcaacaagggaggacggggtccagagggggcggcccctgcctcgggacaccccaagagtcccacttacacaagagttccacttgtgtaaactctcccgcagacagggaggggccaaggagccccaggagccggcagccactcacctttccttgaaatcgaggaagaccttggccagcgtgctgccccccaccatcacggacacgtcgatggccctcaggaagctgtgatgcaccttgatcaggtcctgggttgaaaaccagccgtgagtgcctggccaggcccacccaaggctagacgggagcgccgcccttaaagtgcccttgttgttctgtagttccctcaaggaggggaggggcccgggtgctgggcctgcaccccacatctctgtgcatgccagggtgtgattcaggtagaaggttctatggcgatggtgcaacagaagagccagtacgtgtgggagggaagccgcccacagcccgcaccagcccatcagacacgcagcggccgactcggggcgggctctgcagacagcgtggggcggcacagcgcagtactcctgtgctcaggccacaccccgggacccccatccccaccccgggacccccatccccgccccaggcctctttctgtctgtgctcctccatcctggccacagctcaaggacagatgaactctaggtcagaggcacagactataggaagctctggggtccaagccagcctcatccagggcagcgtgaccagagctcacccttgcagctaatgagacggccagggaggcaggacacagccaccgcacgggctgctggcacctgtggccgccaggccaggaggaagggccaggagcagcatgtccccggaggaagcccacccatgcacggctgccggagcctggtgccagcgccctgctctgctaaccacgtctaggtgactctttgcatggggaactgcctttctatgactgagttcagacacccgcagggcaggcgagggggtccgctcaaaggggtggagggacacgtttctctctggccgctgacaaaaacttcatttacattctcagcgtcatccgtgcctccagccacgcacgtcagtgctgccctcacccgcagacaagcggagcccagaaacctgctaccctggctcctaaatccaaagaccctggagagagcggtgggggctcctccttccggccagcacgagccaccacggagccacaggggtgcagctctccaaggccctgaggacagcaggacatgtgtggccagtgccgagttagggccccgagcctggcatgagcgatgggggccgggacccttacctccaggttaatgaagacagctgccatgtccgccgggctcagcaccagccgcagggggctcatgtagttctggaagagagaagtccacctctgccaccctgctgctgttgcccaccctctcaaggtcacagctgccaggggagggtcccagggcagctccgaggcaggcactggggtgctccatgcttactggggtagcctgtgttctggccacatcgggctccattctttggaggtgagtgcagggcaggaaggtgcgggggtaaagattctaacgctcccagcgtgacgggggcagagtcctgtggtggccactcacacacagggtggacttgggcactatggctgccctgaggtgggcgttggggttgtggcttgcggtgaggggctgagacccaggaggcagggccatcacccgtggggactctctggatggacagggccatggtccccacccagcactcaaacactgagcttgtgctcctgagcatgaccccaaaactgtcatcaaaagggatgctctccaccccgaggagtgccggtggtggggcaggctgtggacgagagtcctccagctccagcctcaggcgggatgtgaagtgaacatgaggacgtgtgaggctgctgaccctgctctggaggcccggccaccctctcctctcctgctccccgagtggctcctggtcagggcagccagccgctctgcaggcatcctctgggcccagctgctgcaccgctccttggtcaccacgtggcacagagagcatcgcccaagcaaacacgcccgggtggcggccccaggctgggtggagacagacctcaggagccctcctgctttctgcagcagcatttagccatggagggatacagaggccagcagggccctggcagaggctgacctcagagccaggattctcagaagccagggcatgggcagggcttcgagggaactggaaggacctgggccagggtgtacagatgtgcgtgcagaaaggccgctggccaaggaccagagggtggggcagcaggagggggcccggccggagcaaggccagcctgggcccaagggggcagcccaggtctcccggctggaggcatcacggccaccctggttggtttttctccccagtaaacactggcagttggcaatgaagactcagaagtgctagggaaatgtcccagggccaggttgaccaggtgcctacaggaggcccaggtggggtaggggaggtgaaggctgatcctcagcactctaggagctcagcaggccagcaggagagaggactcagatgcacaagagtggaagagctgggcaaggagcttggagtctgcagctctggtcactaggccgggccatgccttgtgcaggacactcccagccccccatggaagctttgttccattttacagatggggaggctgagtgtggagaggctggggagcagctctaggtggggtggggggaatacgcgaggagctagctcagtgcctgccttagagcaatgttcaggagctgaagccgtaatcccaccccgattaagctcagaggaggagcagggacaggcgcaggccgggacttcaggggcttcagaggaaaggagagggcaccctccttttgggtagggggtacctggaggcagagctgggagggccaccaagtctccttcgcctgtcagagaggccctatggccctgcctccggaatgcactcccaggagataggtggccctgcagtgaccacagtggccgctgccattttccagtggccgccatctgccctcaccttctcaatgtcctccagggtgcggtagtacttggcctcggtctcctggatctccagcaggcagcagttcctcttgtcatcttcagtcatgcccattttctagaggagggaagggggagtcagcaggaccccatgggcccggccacctgccacctgcacatctgcaccgcgacacccggacacctccacaaaagaggactccttgggtttggccacgaggtcactgagtgtgcagtgctgcagccagatgggtgacagagagggccaaccccttcccattcattttgcagatgaagaaactgacgcacggggaggggatgtgacgtggggacagtgccaaggaaggcttggaggcagagccttctagaatcccaggctcctactcctctgattctgaatctcgattcttcaccagactggggtgagggcctcagaagctaccccctccagcacaggagcaggagtgacttgctaaaacacctactgtgtgcataagtcctctctacgtggcagactgtgtgctcggctccatgcagaccacatccaccattgcacatgtcagtacagccacctgcaggctggactcttcccctgagtgtccactggtttctagccagggggcctgagatgaccccccaccgccagcagggtccctggagcctcctccagagcagggcctgcccccacctctggtggaatgtggccgggacaggattagagattgcctggcccatggtccagggtgaggtgacaggtggggtcactgtggggcagtgatggattttcccaacactgtctttaaggttctgttaggctgggtaaaccccacctgtcagaaggctctggagaaatggtgctgtgacccacagcgctcgtgtcggccctaagaccatcatcatcctccaagaaatccccaagggtccgcttgggtctgccaggctgcaggtctctaaggcaacgtgcaagatggggctgtgggtacaggaccacgggggtgccgagggtctctgatgcctgaagtcatgtgtgcctgaccatgtcttcctgggggcagggtcccgagttttctcagagaggtctgagacctccctgaaaggtcaagaagacggcgcaggcaggacgtccccagcctccccttccgggccactcacctgcatgtatctaatctgcaagcgtggagaaagaaccagaaacagcgccggttagcagggcccacactgtcctggcaagctgggcctgggacatcaggaacgccaccccacaaccagccaacagacccaaagccacatcacggcccctcgtgctgcccagctgggcagggcgatggctcatgggccagagctcccatagcagccccctacccaggctcaggaaatggcatctgccatcctctggcttcttcttcctttggggaagtcaccatctctattaccttccactggggctgttcagagagctccagacatgacagggaaggacatggagcagctgttttatctcagaggaccctggcaggaagcaggaactgccccttgcccccagcccctgcctggatggactggacagctcgagaccagcgggaccagcgctgggcatgaggacactgtgcagagcgggacataggcagcgctgttccccagcctggcaggttctgtggacactccatgtcctttcacatgcgttttctcaaagaggtctgagaccttcagaaccagggacagcagcgggctccagggagcacccactctcaccaggcatggatgggggtctcgagaaagagagcctgcaggatccagggccaggatcccccacacaacctcacaggcaacgcagccacctgctgaagtttacctgcaggacgcccagctttcaaacaacttggggagtgaactggccttgaccagtcagagctcattcccaagtccagacggctcgccggccgcctcgggacctctcaggccagctccggggaggcgaggggagcccccagcagcagggccatggctcagtcttccagccctaacagctacccagccaggctccccgggaaggcaaactggaggccctgctgcctccacaaagggccaccatccctcgggggagaccccccggttatggcggggaacaaaactcagtcgagacccttcgaggacaagcagagaaacctgctcttaacagtcagtttgggggctgtgagacccccagccctgcacctgcctgtctctcccagcaggatgccagcagagtgggcaaggcctctttagggatttgtttccccagctttctgcttctccaccaccagctggttactcccacactaaaggaaaacactgaaatcagctttctgagaaatttcctatttctttgggggaagccaatggcatcaaaagcctccacggttggcaagtggcatctcacccactcttgggagcctgggggtctgagggcctgtgacctgccctaccaggtccctgtctcctcattccagctccgctggatccccaccttccacatagcagctgctggcaataaacccacgcggagcaaactggcgtccgagagattattcgccagtgcctgcttggaaataaacatcctccaaacataaaagacgcacagctggctaattgggccaatattggtctcatcattctccacacaaagggggaaaatgacgcgtgctgttagaccatgcgccaagttactatcttaaggctccctgggcaggaacaactgaggggcctgcaagcccttggaaggagaatcccatggcaacacgggcgggggtcatgaccgtggtggtgtcatctctgggcacctgagaacatctccatagagaggaagggcacagagtggaccaggagtcagccagggtttccaaggatgctcctcagaggagctccgtggggactgggaaggaccaaggggtgcacctctggacgtccccctgcacccagagcagctccccttcggtggctcagacatggggacagctcggtattgtgttaagcaagggccaggctgctctgcgagggaagggaggggaagggagggaggagcggggcagggctcaccatgggctgctgcacctccaccttgatgatgtcctcgtagatgtcgtcccctccatcctcacacgggacgcagtcgtagatgtcctcccccaggtcatgctcgctgcacaggaggaggcgggttagaggggaggggaggctcccgccaccctgaccggggagccgcagagcacgagggtccacgagggacgcaggcggctggggccacagcgaggtcacctgcccgggcctcagtctacaaagtggggtgggccccgcctgcagggcgtctgtgggtgcgaactgggcagcgtaaggcgcatcctccagtgctctgcctgctgcctccactaggtgcatttcagagggatctgccaggacaaagaacccacttctccagccctttggtaaatgctggggacgtaggccagaggtccaggggcgggacccctgccttcaccagaatcttcccacccctacctgacaggagcccccagctcctgcctccagaacagaagcctctctcccctggcccaaggctgtgacctggagacctgagtgcttccggctcagccctggctcttgcagtccttggatccaaggtgcaaagtttccgggtacatggagggtgacccggagtttgtcatttgccttctgaaaccagagccaaagaaattcctaccaaaatctaatacaataaagctttgttttagctcatggtcctactccaacaagccacccctctgcctgcaggactcagctcacgggccacctcctccaagacacccaccaggatccccacttggtctgtgatctggactcttgcagacgctcgtgtactcgatgcagctccttggctacatttccagtgactctgtgagtggcagcggatgagcctggcccctccccacactgggcttcctcagccctcctgatgctccacacctgacctgctggggctcagcaagtctttcactgaatcagcaactgagccaatccaaccaccccctgttcccacaggccccgttgggggctcactgcacctgggggtggaggggcaggagctaccccaggcccagacaggttgtgtattcagtcctgcaagccctcacccctgcacaaggacacatctcacatcccgggctcaaagtgggtggcaaagttcactgctagaaggacggaaataaatgcagagcacccccttccatggccagcacgcagggaggcgaggcagggacagaagccggggcaggagcaatccctgcggtactcaggaacgggttccccagccacgctgtgtgccacggcctcatcccaaacctcgcctttgaatatcagctgtcgccttttaaggcttgggttggggaggaccattcaaggtctacttgagagagggagggcccgtgtgcattcgaggaaggccctcagcaccttccctggaggacacgctgcaatgcacaagccacacggcgtccgtctgtgggcaaagcatctgtgcctctctagaggggaagccgggggtgagcccagctcctgccttgtggagcctcccgcaggcaggcgggcaaaggaggcggaggaagctgttgctccgggtacttcattttctgcaccactacagtcgtgagtgaggtggatgaaagccggtcagaggagcaaagttggcagagggcagatggccctgggacagaccagactgatcgaaccctccaaccagcattcaaagagccaccgacccatgggcaagcccctctgtgtgccagcgcctgtagaaaaacagttattctcttgggcctcacagaatccttggcggtaacagcactgtggccattgtgcagattaaaacaaacaaactgaggttaaacagccagcaaggggcagggctgtggccctcgctcactatcctctcctctctccccacccgccctccaccatgagaggtccatctgggtgtcgctcagccgtgcgggagaactgaagccggggtaaaggcagccgtcagacgggttgggcccacattctggtgacagaggctcccctgggaacagacatgaaggcaggaagggtgtttgtgagctcacaggttttcttactaacccatctcaaaggtccatccccagccaggtccggcgactgccttagaaactgccaccagcgatgacacaaatcacctcccctgcctctccagatgctgtccccaaggacacagcccccacctctctgcccgccaggctaccagggatgcaggcaagtgactgcaggggttgttctcagcggctgccagccaccccacgtttccgtcacgtggcagagcgaggctggcggcaaagcctctgtcgaaaactcttgacagctggaggcgaggcgagacagggaagcttccaggctgctgaacgagacaactcgagggcagatgaggccactcagactgtctagagacagacgtcagcttttctccaacaggccaggtggaaggaggggggttggccgttaaatgctgcaagagctgatgacatggatcaaaaacggctgcaagccggacctggacaggggcctggagatcgtcccgtgcagggatggcaaacggccacactgtggggtgtcccaacagagcccagggctctcccccaccactcaggagcctgttcataaaggcccccatgccgcccccatcacaggtcgaccagaaccggttgctgacgacatgcaacgtctttcctctcccccaggagccccaggcttgtcacagtgcagatgggaaagcccagcccgggctgctgcaggtctctcagatgccatggacacacatccttcactcgtgcctcccaccgcagtggccttgcactgccatttactgaggactctacgacgtgcccggctctgacaaggcctgaacgtattccgggaaatacaggatacgatccactgatcccgggatggaagaggcacgagctccatctggagcccaaacatattaaggagggagagaatagggaaggctgggatggtcagagtcttcctgaacagatgagactcgaaggatgctttgaagcccgggtggacctagaaaaggggtgtggaaggcagagtcccccgcccgcctccctcttccctggccccatcttgaagacagaactgtcacgcccggatctaggtacaagtccacgtctgtgtagcacccgctgcgtctgaagcttggtgagaaatgccaagcatagggttctcataatatttttgctaagctttttaaggatcaaaatacgcccttagtggtacctttctgacaagtggctacacctgtgtcactcatgccctcccacaccatagagtattttcatctcaccggagctcctgcccttccccatcagtctccttcccgccccgagcaaccacccttctgactgttcttcaccacagacgagccttgtctgtagaatgtcaacggtgttgtgcgttagatttgtttttgtgcctggcttcttcccctcaacattggatcttgtttgagacacatccattctgacttgcccacatttgcagctcattcctgtttactgctgagtactaatccacggcatgaacaacaacgtgctacccatcttccttctttatggacatttgggttgcctccaagttgttgcttattgtgaataaaagctgctatatgagcattcaagttgtgtgtgtgcgtgtgtatgcacgcacgcctgtgtggtgggtggggggttacacaggctttcttttcctttggaaacaaaattccactaggactggaactcctggtcaaaggggaggtctagactcaacctcataagcagctgacaaatgcttttctaaagtgggtgcattctacacccccagccagcagcgctcaccagccccagctgcgccacatcctcatcagcttctgctgttgccggtctttttccattcagcccccagagtgcgtgtggagtgaaacagaactgtggttctatttggcactttcctgatggctaacgctgctgaggggtctcctgcgtccttactgtataccttcctttgtgaagagtctgttcaagacttttgtccatttctaaaaattggttgtctgtcttcttattgaattcggtgagttcttcacatattctggatactagtcagatatgttttgtgattcttcccccagtctctagcttggctattcactttcttaatgatattcaagcattcacctttaatttaataaagcctaatttatcacctttccttagtcgcatcctggctctgtcctgtgtcctaagaaatccttgtgccttgtctaagaaatctttgctgtctttcaatcacaatatattttcttatcggaacttcatagttttagccactctgtttaggtctctgatttcatctcaagttaatttatgtgcgtggtatgaagtagcagggttcacttttttcccataggaatatccacatgttccagaacaatttctcaaaacgcctctttttcgagcagggcatggtggctcatgcctgtcgtcccagctactaaggaggctgaggaaggaggattgctggagtccaggagtttgaggctgcaataagttatgatcgtgccactgcactccaacctgggcgacagagtgagaccctgactcttagaaaacaaacaaacaaacaaaaaccttaccattggattgcttggatctctgtcagaaaccaattgaccaaataagggtgagtctattttggaataactactctattccatccatctatttgtctatctttacactaacacttctgtgtcttgatacatttcatagaaactcttgaaatcacgtaatgtaaatctagctttgttcttctacaagactgattaagccattccaaggtcctctgcatctccatgtaaactttacaaccgtcttgtcaatttttttaaaaatgtctgctgggatcatggtagacactgcattgagtctacagtgtaatttggggagaactgccatcttaacgataacatcttccaatccataaacatagtatatactttatttaagtcttccttaatttctctcagaaacattttgtagtattacgacagaggctttggaatttaggaagaattgggccttttctttttcaatgtttattctgcttccttcattcttcctcttctgagagactgcaataatacccgtgttagacgtcctgacatcatcccacacgtctcaggctctgtcccttctttccaggcttctttcctccctgttatttgaagtgtgtaacttccagcctggcgtggtggcgcacgcctgtaatcccagcactttgggaggccgaggtgggtggatcacctgaggtcaggagttcgaggccagcctggccaatatggtgaaaccccatctctactaaaaatactcgggagactgagacaggagaattgtttgagcctgggaggtggagcttgcagtgagctgagattgcaccactgcactccagcctgggagacaagagtgaaactctgtctcgaaaaaataaaaaataaaataataaagtgcgtaacttccaccgtactatcttcaagttcaacgacttttccctctgccgtgtgcaactttttaatcaagctgatccagcgagtagagtgttcatttcagatatcgtgcttttcagttttagcatttccatttgccacttttcagtagtttctatttccctgctgaggctcttcatccgctcattcatttgtcgtacgttttcctctaagtccgtgaccgtatttataatagctgctgtgatggctgattttgtatgtgaatttgactgggctaaggactacccagagagctggtgaagcgttatttctaggtgtgtctgtgagggggtttccagaagagattgacatttgaatcagaagaccaagtaaagatttaccctcaccagtgcggacaggtgtcatccaatccattgagggcccacgtagaacaaaaaaggcagagggcggccgggcgcggcggctcacgcctgtaatctcagcactttggggggccgaggtgggcagatcacgaggtcaggagatcgagaccatcctgtctaacatgatgaaaacccgtctctactaaaaaaatacaaaaaattagccaggcatggtggcgggcacctgaagtcccagctactcaagaggctgaggcaggagaatggcgtgaacctgggaggcagagcttgcagtgaggtgagatcgcgccactgcactccagcctgggtgacaaagcaagactccatctcaaaaaaaaaaaaaaaaaaatgggtggacttgctctcttctgaagttgagacatccaccgtctcctgccctcagacatcggaactcctcctgggtgtcagatcttcagactccagaacacacaccagcacctgcccatcccacaccaggactcaggcctttggccttgggctgacacatcactggctccctggttctctgacctttggactcagacttaagttaaatcactggctttcctgggtctccagcttgcaggcagcatatggcgggactttctggcctccataattgcataagccaattcccataataaatccccccagccatctacagagatcccactggttatgcttcttggaagccactaattgcaacatctgggtcatctgagggttggcttctattgactcttcttttctgagcatgactcactttctcctgtttcttgcgtttggtgatttctttcttggacccgagatgctatgaacgatactcagcctcccgagtagctgggattacaggcactcaccatgatgcccagctaattgttttatttttcctggagacggggtttcaccatattggccaggctggtctcgaactcctggcctcaagcaatgtgcctgccttggcctcccaaagtgctgggattacaggcatgagccactgtgcccagccacgcctgtgttgtttttctttctttaatccatgactacgaggaacattccttcacacgggctcattcttcatgcaccacttcccattaacctcttgtcattcgcccggggcaccgaggttaaaagtgagcaacctcacacctgtaatcccagcactttgggaggccgaggtgggcggatcacgaggtcaggagatcgagaccatcctggctaacacagtgaaaccccgtctctactaaaaaatacaaaaaaaaaattagccgggcgtggtggcgggtgcctgtagtcccagctacttgggaggctgaggcaggagaatggcgtgaacccaggaggtggagtttgcagagagccgagatcgcgtcactgcactccagcctgggcgacagagcgaggctccgtctcaaaaaaaaaaaaagagtgagcaaccaaaaacactagaggagaagctgtgtttgggaatctgtctctgggacagaatcatcttaaacacgcagacaacatcccttctctcccttccatccaatgtcagttatccgagcctgttgatactgggggggcggaatctggggtcacccggttctgcctgccacacccttaggctcccttcctaccgggccctccttgtggagcccagagcactgaccatcagcctggccacacggatggcacttttcattcgtccaaagcgctctcccaaccatctggattctggtcaatgaacactgggagagatgggttcctctgtgtcatttgaaattctaaaacagtggaactgaaatttcatgacacacatattctaaatgatgagagagggagaaataaagggaacggtaaagaagtggtttttcaaaaaataaaattaaattaggaaaataaaatcaaacgtatttgataaaacaatgttaataatataaacttagtaattaagataaaaacctaccagatgtaatgggtttaaccagtatttctcctatgaccgattctgcatcagaaatatgttgggtccttgggacacaggggacaatggccatctgtcccaatgacctcacagtccaagtggggagactgactaggcagcagctgcatctgaatcctggcaccaggaaatctcccaggtacggaacagatcctagaggcagacactactgtggtgtcacttggggaaacaagctctgctccctaatagctcctttcctttggccatcaccgacgtggaaatgccactgctacctggcttcttggcaaagatgccatctccataaacaagtttctttttctttttcttttttttttttttgagacggagtctcgctgtcgcccaggctgaagtgcagtggcactatctcggctcactgcaggctctgcctccggggttcacgcctttctcctgcctcagcctcccaagtagctgggactacaggtgcccagcaccacgcccggctaattttttttgtatttttagtagagacagggtttcactgtgttagccaggatggtctcaatctcctgacctcgtgatccgcccgcctcggcctcccaaagtgctgggattacaggcgtgagccaccgcgcccggcctccataaacaagtttcttgcacagggaggtgacacacggccagtctcagtcacctggaaggcaggttcacttacgtcatgaccagcaggcccagtgtacctgagggccacagctgtccactgggaggaagagggaaccctcaggggctgggctggaggaggggtatactatgagacccactgaggggtctgaagtctcctgggagtacagggcagtgacagggcaggagggtcccattgtgcaaggaccctcacctcagcgttctcactagacatgagcttgacgagaactcagcgaagacgcggcacacggaaccagagcgccagccccacatggccctccacgcaatcccacaggggaggggccgggctgtcgtgccttccctctggacccagcccactctcccccagtccttgaaaagcacctcaaggccctgccacgtctgcaagtggctctggaatctccgtggcacaattacatcactctcctgtggctctgtggcaggctgctgtgtcacacactgatccttttcacatcagtgtctcggctagaaagaagcgtgtggaggctccgtgtcatcagaggctatacttcgtggaaaaactccacacccatgccacaccagtgtctggtccacagagcaggccagtcctcatcacttcggaacaggcgggccgcagtgggtctcttgttggcaggaacttgactgtcgctcctgagcccctggaggggaggcagcgagggaaactagggttgtctttgtagcccttcctgtttctagctctgtaactgcaaccaggataacctaagcttcggtttcccatctgcaacaggagagtgacagttccaaggatcagccatcatgtacaagaccagtagaggctgagcatacagtaggtgctcaataagtgggagcatggcctatcaccccagagggcgaaaggaggggctcattcaatgagacggcatttagcacaggggccggtctcaacacatagtgtggtcagcattaaaaatgacagattttttaaaacctaggagactaaaaagttggatgggggttggtgctgcgttagttcctgctcagctgtgttgcttttgtgggtttcagggatcattcttctctgtccagtggtccatgaggaggcccgagatggccaggcaggaatgtggaagcccagacgtgaatgggcctccacggccagacctgggccccagcccagctccctccaccccaggccagtgaccacccctccttccttcctgccccgtctcatcctttcactcctgctgttttctgggagtcagctgcgctgacagatgctaaatcccgaccattatttttgtcctcacaatagcttgaaatcttccaggaggggccccgagcacggctgtagctctccagggacggcaaaacctgccaccttcaccttctgcccgagaccctgaggccccagcccaacaacctcgcccacctgccccgattctgttacagaaaggcagctgctcagaggccattgcccccgccgcccacagaaaatcaaaagaaaaccaacaaactctgctttctgcccctggtgagcctgtgtgtttacggcggacataaaatagtgttgctgacaggctgggatgcgccgcactggccccgggctgtctgatgctgccaagcagggtaccaagctgccattagtgtgttactaggaaaccgagtcggatgtttcctgacctccgtccacacctcagggtgcttcatccccaggggactggggtgggggcagcagagagaaggcgcatcgagcctctgaagaagccggctgggaactggatggtgtgcatgtggggaaggacggacggagagatagacagacagacagacaagaaccgctttacacatcagggagcttgttctcacacgccctggcagaccctcaccacgacccatgagggagggaggccttgctttttctacaggtggggaaaccagggctcagagagggcatgagagtcacccagctcgccaagccacataggcgggtacctgcacaggccccagctaccagattcccggaaggagacccgtccaccggactgtccctcctggccgtaactccctctttttgggggcttctttctaagcagtaaaagagcctcccaccatctaaaaatattcaggaaccaaaaaagaacagcccctgggccaggtcacaaggactaggcccaggggaatgtcccgggccacagcacagggtttcatttccccctctgctatgtgaggcatgctgtgtgacctccggcaagtcacctaccctctctgagccttaatttgtgcaactgcaaaatgggggctggagcacccaccttgcagagttgtgagggctgagatgaagcggcaaagcccagggcctggctctcaggggacaggagcagggattgtcgaacagcgtatggacctatggctcagatcctccagtatgggaatcgtgaatgctctcgggacctcattatccccagcccttcctcctaccacagtgaaccaggcccaggcctagttaggtgtcctctctgtgctctgctcctttatgaatgacccttatggagcgtttatctcagcagtgagaaacagaagcaggaagacaagggaaagttggtggcagagactgtcctgctgtcctttctaagcatctggtgaaggtgaacttcaattcagcctggtagggttgggggctgcctcttagagaaggtgacctgtgggttgggttttgtagaatgaataggagttgggcaatcgatataggagatactacgtacgtgatgggacttctacaataaaacccagcatgtgacgcttgttcattttagagcaatatttcttaagtgccactgtgtgtcagtcagatctacgctgaatacaagggaaataacgtcaaaagggagaagtcttcctcttcctggagttccagaacagcacgaggagggcgatttagagggggagggaccttcatcagacacagcacagccctctcattcgggccgaagcccagctgcctactccttcctggaaaatggcaagatgaatgcgtatgtctttaaagctgcccttctgcgccggtcccctccctctgcagagactgcattaaatgagaccagagagttgctgtgaccgaatcagtcctgaaagcactcgagtttaacgaggtattaaaaatgaaaacccctggaagtcccaggccatacctgctcacacacacacgggaatgcggagcgggcagggtggtcacgcgcacctgctctgcgtgcgtcagagggttcccctgcgatctcccactgagaaggaacaaacggcctctccctcagtggtgggggtgggggagcagggtttcgaggtcactgaagcccccagccacgtggcagcagggcctctggagacagctggggcccactgtggtgccagagtaccaaggggcccacaagatgtccgaggggggcagggagggtccctgaaagtgtggggctctcatcccaacgagctgcggtctccacagccagccccacagggaagtgctgatggctctgttaacagggaaggtgcggacagggagctcccgcccagcagtcccacagccacctcccgacggggactgggcttgtctagaccacaggagcgagaaaggctggactgcctacagaggatccccaccgagccaggtccaccagccctcagttcccgagaacagacacagcagagaccaggaccctcctaaaaccccagcccaaaacggccctcagttcccgagaacagacatagaagagacccagccaggacactcttaaaaccccagcccaaaacaaggtagtgactggcctggcacagggggtaagagcaggtttcctaaatcacactttggcaaatcctacgcactcttcaaaatgaacacctcctccaggaaggcttcctgccctcctggcttgtcagggtctgcccccagaggctgctgcctggacagcacatgtgggaggtagaggaacctcgagtgagaagtgcaggggcccacaacggggtcccaggtcccaggtctgtggggcagggagggctcctttagccacccctggggttagggaggggtggtctgacaatgacccttggagagacagagctgggctcaaattgcagctctgccccctagttctgtacgactctgaccaggtgccttcctctctcagagccccgtctccttcctgtccagcgagagggctcagggcccggcctgcagcgctcagggagatgcaactggaagcgtcttgacagagggaccctccggggacgctggcttcattcactccattctgccagtccccacagaggcctggcctcacagagtcacaccgaggagcaagagacccttggcagcatttgagggagccacatgcggccaaggagaagcccaggtggggccgagcacgcagtcttaaagggtctgttgtgcaaatgaggcaccacggccagtggggaggcagctccaaggagacaatgccacggtccagccaggtgtccttgtcgatgaaggacctggggtgggggggcgggggacaaaggcctttctgtcccggccatcacccgccttaagaaacgccccgtcttccgtctctccagtctcccctccatccccacacgagcctcgggccaccagggagggacggggggatgcctgtcaacacctcctctggggaagggggcttcattccggcctccttcagaccagggcaggctttgcatgtgcctggggccgggggctgtctaacagggctggattcatttgcttgtttctcgtggggccgttttcgtggagtctgctttcaaacttgtcccctttggaaaaacaatcctctggggtgaacataaggtgtcccaaacccagcctctcccagctcaactcgggctccacactcaggcgtcctccacaacgcggacctcccagagtgaagatgaacatacatgagctcaggagatggtatctaaacaaacttcctctgggagaggtgggcagggtgaggacaacggcggggagggtgggccatagaggacagcggtttgttcctcactccttgtacccctgcagacaaagggcacagcacagagtggccaaggccccagggcaggatccaatgggagaagcacggcctctcccctcccaggtcgccgccagcaggcagctcccactcactccccatgtagaaagaagacgtccaaacctcctcgacaccagaaactccttctacattttatgcaccctaaaaaattatcccaatgatgctaacatgacacatttaaagctgcacagtcattttatgatgcaataaagcatgcagctctacattcgcggatacattacattccctgccgtgtcacgatcacatttgtttaagcctgaaaatcacttcaactcccaggaaagtgaaaccagtgttatgcaaagcaggctcctaaatcataaaattgtggattcctcaagctcagtgggattcacagaccatctgggcagatgctttcgtttcagagactgggaaactgaggccctgtgtggcatttaacttgcccagagaagcagccccttgaaaggaaaggaaaggccagctagaccttgggccctggtgacccgccacactaaagcagccagcagctgcagcctcacatccaagccctcgcccagagccctggccccagaatctccctccccgctcgcactcaggggcagctctcccttcaaggatgctcctgctcagatgctctctggggagaagccaggaggacacgcggttcctgacagagcctggctgtgtctaggatcactccctcctcatgcagccaccggagtggcggggtgccttcccacagcagcctgtgaggttgcaggaccctgctctgcagacaaggatgctcctggtggggcatgtttaccagctggctgtcagacatctagcagcacactctgggaagaggctccaggtccaaccacccctcccccagccacctaggatgaagcggtggctaaataaagcttggtctcatgtccatgtccttcctttggcctctcttctgccctgagtgggagctttcaaatttctcccgtgtcccttcaattcccctaagaattctcggggacctctgacctgccggcaccacgggagggagggcagaggcaggcggcctggccctgctggggactggggtgtgcagcctacttcacagacaggcaagggcaaccctgccacagcggcaccagtgtcctcgcaagacgcactcatcacggcgctctgtggcacccaatccgggtgccctttccaaatcctcctccatcaaggcctggaagcattcccagggccccccacagactgcagcggaccacgcccagcctcagtgaacagaaaatgggaactaggaacgctggctgcagtgccaggagggggacagagggccccaggactccaggccagagcaatcagagagatgcttcttgaagctggaaggaagaagccaatgtgccacctaccgctgcgcccactggggctgaccactgagcatgggcatcgccagctactgctgtgcccactggggctgaccactgagcgggggcatcaccacctaccgctgcgcccactgaggctgaccactgagtgggggcatcgccagctactgctgtgcccactggggctgaccactgagcgggggcatcaccacctaccgctgcgcccactggggctgaccactgagcacgggcatcgccagctactgctgtgcccactgaggctgaccactgagtgggggcatcaccacctaccgctgcgcccactgaggctgaccactgagtgggggcatcgccagctactgctgtgcccactggggctgaccactgagcacgggcatcgccagctaccgctgcgcccactggggctgaccactgagcacgggcatcgccagctactgctgtgcccactgaggctgaccactgagtgggggcatcaccacctaccgctgcgcccactggggctgaccactgagcacgggcatcgccagctaccgctgcgcccactggggctgaccactgagcacgggcatcaccacctaccgctgcgcccactggggctgaccactgagcacgggcatcaccacctaccgctgcgcccactggggctgaccactgagtgggggcatcaccacctaccgctgcgcccactgaggctgaccactgagtgggggcatcgccagctactgctgtgcccactggggctgaccactgagcgggggcatcaccacctaccgctgcgcccactggggctgaccactgagcacgggcatcaccacctaccgctgcgcccactggggctgaccactgagtgggggcatcaccacctaccgctgcgcccactgaggctgaccactgagtgggggcatcgccagctactgctgtgcccactggggctgaccactgagcgggggcatcaccacctaccgctgcgcccactgaggctgaccactgagcacgggcatcgccagctactgctgtgcccactgaggctgaccactgagtgggggcatcaccacctaccgctgcgcccactggggctgaccactgagcacgggcatcgccagctaccgctgcgcccactggggctgaccactgagtgggggcatcaccacctaccgctgcgcccactggggctgaccactgagcacgggcatcaccacctaccgctgcgcccactggggctgaccactgagtgggggcatcaccacctaccgctgcgcccactggggctgaccactgaccacgggcatcgccagctaccgctgcgcccactggggctgaccactgagcacgggcatcgccggcatgcggccaccttcctggacacccagcagtgctgccccctgcagccagcacaggctgacccaaggtgtccttctaccgtgcggagaaacactgtcactgcagtgccaccaagttggggtcacagcaggcatttcgacgtgggccctgtgccttcctgagggagaggtgatcctccctgtgagtccccggggaacttccacaattctgattcgttacaaacaccaagccttgtcccacaatagcacaatacgctggacttgcgctggaacaaccctcagccacacctccagatggggagccccaccttgccctccagcctcgccttccacaccctgcacaactcctcctgctgggatagtgccccggtcttcagcaaactcctccttgggtgctgaggcccagctgtcacctcttctgaggaggcccggctgtcacctcttctgagaagctttccttgctttctgacccagcactccgccagccccactctgctcccacagccaaccatcttgtgcatgtcactcttctgtgtacaaacctgcctctggaccccaggctgggagccccccagtgcaggcatctagccctgggcccccaagagttgggcaggaacgaaaagggaagcgcagtgcctgccaaggaaaagccattatgcaaatgcaaggtactgattattagagcaatttaaaaacaggccctccatttgggcttattttgcttgataaagcatttttaagtggcaatattttgtgttaattttttcaaccagctgctcttattatttgattatgcattattcaaagctctcaaaagcgagcttagagcacttgagaaaataacttcagtgttatacgtgcccacacaggggactggctccagctcccagaaagatgttctggatctaagacctgtgctacccggcacagagccactggccacgtgtggctgtccggctcacaacatgacaagctgcagtgacctgcgcccaagtgcgagctccataagccagatcagaggactcagcgcaagcaccacaaaacgtaggctgcccaaggatgatctgtgacactgatcacaaggtgacccagataatattttgaatatgctgggttaactataacatacatttttttttttaagagatgaggtcttgctctgtcgctcaggctggagtgcagtgacaggatctatgttgcccaggctggtctcgaacttctggcctcaagcaatcccaaagtgaagtgctgggattacaggtgtaagccactatgcccagcctataaaatacattcttatgattaatttcgtttgtcccttcttattttttgacgtggctccgctgtaatcccaccacactgccctgaaactgtccttcggcttccacactccccatggggcctgggtcttgggaggcaggaaatgtgtcttcatcttaatatgtttccagctcctggttccaagcctgacacacagagagtgtttaggaaccagctgacgatggaatgaacgatgatcgtgtgaatgaatgaaagcacacaggcactcacacggtgcccctcgctggtgtcctaaaaccacatttgcaggttccctgggagacaagctgcatctgtgagccagtctttgactttccccaaacagctgcagagtgtctggggtctgggcagtcagcggagtcctttagacattcaaggtgaccttcatgttgggcatctggctatgggcccaaagcaaagaacaggtgcgttctgctccaaatgtcccttccttctcctcactcctgtgcctggtgatatggtctggctgtgtccccacccaaatctcatcttgaactgtagttcccataatccccatgtgctgtgggagggacctggaaggaggtcattgaatcatggaggcggtgaccctcgtatcgctcataccattctcatgatagtgagtgagttctcacgagatctgatggttttataaggggctttcctccttttgctctgcccttcttgctgctgccatgtgaagaaaagcgtgtttgcttccccttccaccatgactataagtttcctggggcctccccagtccggtggaactgagtcaactaaacctctttcctttacaattcaagcaatctttaaactgtaatactaatagacctggcttctgattagaccatttccccagctccagctttgaaaattcacaactacattacctccccaagtaggatccaggtaagaaatggcatgcgcttgtgtcttgtaaattgccataatggctaaatatccacaccaagtccacagagaaaggataggaaatcttgcctttcagtgaaaggaggagggggaaaaacaacataaaaaatttattaaacttgagccactgggaccaaattgcaagttaaagattcaaatgcattccccttccttagaactgatgatttacgtttgcaataactgcagtcataaagagctcgttggattaaggaggctcagtcttaatgtcagggaataacattattggacagtgcaaagccacaggttccccagagctgcttttctgggtgagaggaattccaccttgcattttggttcaagagatcagtcacaatcaggacgggcagagaaagatggaaaatgggcaactggccgggcacggtggctcacgcctgtaatctcagcactatgggaggccgaggcaggtggatcacctgaggtcaggagcccaagaccagcctggccaacacggtgaaaccttgtctctactaaaaatacaaaaattagccgggcgtggtggtgcatgcctgtaatcccagctactggggaggctgaggcaggaaaatcacttgaaccctggaggtggaggttgcagtgagctgagatcgcgccactgcactccagcctgggtgacaagagcaaaactccatctcaaaaaaagaaaaaaaaaaaatgaaaaagaaaatgggcaacctgggatctagcctgactctccaggcagaaatcctctaaactgaatgtgcactataaaccagcaggggcaggcctggccatgtgggggctgtagttcaggaagtgtcctgggctgaacacccaggaggctcctacggagtgggcatttcatgtcagtccctggccacataaggccgatgtgggccccatcgtcccggagccctcctgtgctgactgtccagaaacgctgaggcatgtttctggagagcacagaatcccaacctcaggctggtaacttaggagaaatagcaggtcagaaacttgccctcacaccggccaggagctccccaggctctggggggcacaggctctgtgtggtggggggctagggttaaatcatggctctgccacttactagctgggtgacatgggccagtggtgtcccctctctggacctcagtttccttatctgtaaaatgaggacaaccacagaacagacctcacagagcaattgagggtgggggatttgagggaatgaagcccagcagtgcccagccccaaaaaagctcgtaagcaccgcccactgttgctgtcattgtcctgtgggtacaggcatcctaccatgtgcagaaggcttgccctgctagggctggaccaggagaggacaggaagaaggtgcagggtctgaccctctgataggcaggggacaggcatttaaccccctaatcaccgtgcaccccttgggcagcccagagacccaacagaggcatgggtgctgagggggcgctggccaggatggagcagcttcacacagtgggagacaccttggcctggatgtggcagagaaggatttccaaggcaaggaatgccaggaagggtacaggggggtatgttccaactctgagcatagcaagtagggtggctgcagactctgctgggggttggggccttatccctaagggacttccctctggccatgccaccagccagaagccctgccctctctgagcctcagtttcctccccccttacagggttgagatggacagtccctcagtcagtctcagaagcctgcatgctggagtgagctgtttttggaattttcttttttttttttaccccagacggagtttcactcttgtcgcccaggctggagtgcagtggcgcaatcttggctcactgtaacctccgcctcctgagttcaagtgattctcctgcctcagcctcccaagtagctgggattacaggtgcccaccattacatctggctaatttttgtatttttagtagagacagggtttcaccatgttggccagactggtctccgactcctgacctcaggtgatccgcccgcctcagcctccccaaaaaatgctgggattccaggagtgagcagtttttttttgaatttttgaagtctccctcagattcctgaggctggtcagggtggacagtggcctccaggtgggcgccccaggcctggctgtgacctgcatggcccctgtgcccatctctcccctttaagatgctctacaaccctcagacccacgtggggccgaccggatgtccagaggagctctgggagtctggccagtgggatttgccaaggaccccgtggccagcccagcatcaaagggatgggctggtggcagctactccagctggtgggtgaggaatttctttcacagaagtgcatgagactgggccgccagcgtggtgccacatgctgatatggggatgacttgaattgtgtatatacacagggatcctgcggaaagtattttcctgggccctgcaagctaaaggcagccctggatgtgggctgagcagtaagacagggacagccccagcatacacagcaggcactcccatacacgcagctccccctcttactcctctcccggttgtcattctcagtctgtgctctaaaacgaagggagagagaaacactaagagtcttccagaagaaaccgtagttgagctaagaacacacaagctgctgtcaaacagctccagaggcccccaggcagcaaggatgcccgaaggcaccatctcccggtggcctgggagggtggtggatgagccaggccgtgaggccccagcaaggatgctcggtctcagcccaggtccctcacctgcaggtgaggccccttcctcctaccctcctacctccctcctcctggagcgggccacgtgatcccaccctggtcacagattcccacggtcccgatggggccctggtgctgtggccaggcttgggcagcgcctgggtggagcagaggcctctcagagagaggaatgaggtggacacggagaagagcagaggcgggtccaccgaggcagggcagtgcctgccgggccacgtgttaaccccgagcccacacactcctgtgccctgaacctgcgctccaggcagcaccgctccctcctcacaacacggcatcccaggacccggcttggggagcatggccagccccctctctgccccacagcttcgcagagacaagccctcatggaggaccctgctagggcaatgggccaacacccgggccagccattagactggctgggcagccttctagaatgtacaagggatatgaagatctgctcatgtctgaggtctctcagatgcatgccttcccactcagcacggaagcccacaccatgacccatcatgaggagatgccccggtgggaagggccagggccagctctgcctgcactgtggccgccatgtttcctcctgactccctggacaccaccaggaacctccctgcccctccctcctctccatccctcctcccatccccccgccttactcggccagctcctccaggctgcggtagacgtcatcgtcattctctgtggtctcctctgagggaaaaggcctgcggaagagaaggcgagagggaggtgagcaggtcccggcactgccggccagtgggaccccagctggaccccacagcagagcccagtgtggcccagccaggagcaaaggggctcttgtccactctctggaaggacacagggtgcgcggacactgatcggagtcacaggacgagccaactgggccatagggcaagaggagacccatgcctacttgccagggggcaaggaatgtgtcacgcccactccgggctccgggtgtccagtgggaagacgagaggcccaggtcagggctgcagaaagcgttcatctgctgggcgacctgccttcccctttacccaccctcccacttccagggggttcacagtggagatgaggctcctcgcacacctcctggtgggcaggtgggagggctgccagctcagtccacgcaggagaggaagcaggaggggactccggaagggaggggtgacttctgaggcactgagggtaggggctcacccacgccacccaccagccactggcttgaggtcaggaagagagtcccgaaaatgaaaagccctcggaccttccgcctggatccacagcctcccctcctacaaagggagcagaagccccatggggtctccccagaaggaacgcggcggtgctcccccacactccgccctccagatgccccaaccctggtgcctttctgcagttcacgatggtatagaaatatatatatatatataacacataaactttaatcatctgggctcttcttgagtctcatttttgtggaactgtcatgcatatgtacataattataattgtttttctcctgctcatctgtcttatgtcaatttaattcataaaccagctcaagaacctggaggggtggaaggaagcgctttttcctcccccaggacccaaaacatcactctgctccatcctctgcagacagacagatgggtgtggccccgagtctacaggcctccctgcataaggcgagcccaggccagcacaggccaaccactcagagctgaaatgtcaggtcagcctcaggaagcggggagaggcggaagggagggaggggtggggagggaggagaggcaggagaggcagatcaaacacccagaagagggggctgcagctggctcaacgctatgggccaaatccactcatctctagaggagacacgaaaggccccttaattaaaccaaacagccccctgtagccccagggtgcgtgttctggtaggaaacctgtcactaaggatgggacgggagatcccagctggaggggctgcccgggcccagatgccagctgggattgcttccttgcctggggtcaggctgacatttgctcagcccgagatccagcagggacgcgcggtccgtcccggcagccccgccccaaccggaggccggggacctgtgctcctgcgggagggcaggggggagtccgctgatctgtgagctggaaacctgggtcctacctggctctgtcacagacctgcagggactgggccattggtcagcgtgcccctgtggcttcctggtaaaagcccgtgtccaagggcgcagcacggccaggcctgacctctgcatgggtgagctcagctctctcctcccagccactctccctccttccacccatcaccatacagcagcatcccccagttgaggtgtgtgtccctgggtcacaggcagagctgaggctgccacgacatcctcaccatcagggctccgttgctgagacagtgccatttacggccaagaagcccctcaaggaatccatctcctcccatgatatgcagagccccatgccgacacagatcccgcccaggtgatgggggtggggctgaggagccacaacctggaggggactggcccacacgcaggtgaccccagaaagcacaggagcacgtggggggccaggagccagggaggctctgccaggctgagatgtgacttcaggacccagagatggaggcttgaaaccccgctgccaggaccagccctgggctgtccccgctcccgcaccagcccctcgcttacatgcagccatccctgtctccaacctcgtcagtcatttctgctttttctaaattttcagtgatgattggtatgacttccataataaagaaaaatagaatcaaaattctcattatgaaaatgtgtcctcatcaaaagtaaaaaaattttaaaccccactcatctcctataaaagtatgttacatataaaatgacatcatggcaaagtattaatgtgctttctcacgtagaatgtagagagggaagagaaaataccaaactcctgaggttgtgatcttgttcaaatctgatcacagagtgtgggcgacagtttagggaaacagggcatcccatcgaaccctggattatcaacaggacggccattcggggactgtacttctagaacccgccctgctaagccgatcaagagatgcattcacactttgtaaggaaacccaccctaatggtgagtgagcacacacgcgtgcctctcactcttcctgtgcccaggcagacatcactcaccaatcaaagctctcctatccctgaagcccagcgcagggttcttaacacagggctctactcctccatcagtcctgggactcagacagaacccacctgccctgccaggagagctgagcccggggcagcgaaggagaggaaaggctttggagttgggcaaacccaggtgtgaaccctaggcccacagcctgctccctgtgactttggacaacctacttaacctctctgagtgtcagccttctcctcctggaaaatggaagtaatagtgccttctcagaggtctgctgggaagagcagctgtaggatagcagaatgctctgtacttaggggggcccaacagtggcagctgcgatttagtatttctagtatcattctcactcagggcactttccactgcccaagaaaactgccttctgatgcctcgttagggcctaagagccccactcgccatgatgattttggaatcttgtttcctaacacagaaagtgagtgcccactaaaataaggcacaacagtcatttcaaaaccttttgtcggccaggcgcggtggctcacacctgtaatcccaggactttgggaggcccgaggcgggcggatcacctgaggtcagaagttcgagaccaacctgaccaatacggtgaaaccccgtctctactaaaaatacaaaaaaattagccgggcgcggtggtgggcgcctgtaatcccagctactcgggaagctgaggcaggagaattgcttgaacccgggaggcggaggttgctgtgagccaagatcgtgccatttcactccagcctgggtcacagagtgagactccatctcaaaaaaaataaattaaaaaaaaaaaaaaaacctttttaaaaacctgaccttgagctatgattgtcgtaattttccctttcctgcatctcatttggtgtcttgttcaacccctactgtcatttcctttacctgcccaacccagaggagataaagcaggaatgttaaagtccaaagaattatactgctgcccgtaaaatctttactacttttattctaagatccctatttgaggccacaaatccccttgagaatggagctgcaaatccaattaatttctgccacagcccaacaaaagctctgccagaaggggaagagcaggagagggaggcagcctgtcagggaccgtgcacggcctcagcgcctggccgctggcgcaggaatatgcaggagaatagaggaggcttcaccaggccccagtcccctttcactccgctccccccacagccctccatgcccatgctacctctggcctttgtacctgctctgctctctgcctttagtcccccaccctcccaccattcacccaagtgctagcatccttcagggctgaatccaagccctactgcatgtgggaagacttgatcagtctctcagcttgggtctgcctctgcctagcacagtgcctggcgctagaaaggcatggatgagtacatggatggatgagtaggtggaggatagatggcggggggtggatggttggctggctggctgagtgggtgcatggatgtgtggatggatgaatggatgggtgggtaagtaggtgggtgggtgggtgggtggatgggtggatggatggatgggtgggtaagtgggtgggtgggtgggtagatggatggatgcatgcatgcatgcatgggtgggcgggtgggtgggtggctagatggatgaatgggtgggtggatggatggatgtatgggtgtatgggtaagtgggtaggtgaatgtatagatggatggatgggtggatggaaggacgaatggatggctgagtggctagctgggtgggtgggtggattgatggatgggtgggtggatgaatgggtgggtggatgaatggatgggtggatggagggataaatggatggctgagtgcatgagtgggtgggtagatggatgaatggataggttggtgagtgggttggtggatggatgaatgggtgggtgggtgggtggatggatagatgggtgggtgggtggatggatgaatgaatggatgtatggatgggtgggtggatgaatggatggatggggtgggtgggtaggtgggtgggtggatggatggatgaatggatggatgggtgggtagatggatggatgggtgggtaggtgggtggatggatgaaaagatgcatgaatggatggatgggcgagtggttggatgaatggctaggtgggtgcatggatggatggatggatgggtagctagatgggtaaatggctgggttggtgggatgggtggatgagtggtagatgggtgggtgggtaagtaggtaagtggaaggatagataaatgggttgtcgggtggctggattcatgggtgcatggatgcatgtctggaaggacagatggatgagagagtagttggactttgtgggctgacagacagatggatgagtggatggatgaacaaatgagtgggttggtgggtgggattagtgggtgcatggataagtggacagaaaggtgggtgtcagatattctcaggctgctcttaatcccctgaaatggcagcctcaaattagatacgaggaagtttttttttttttttttgagacggagtctcacactgtcacccgggctggagtgcaatggcatgatctcggctcactgcaacctctgcctcccgggttcaagtgattcccctgtctcagcctccaagtagctgggattacaggcgcccaccccgacgtccagctaattttttgtatttttagtagagacagggtttcactatggtggccatgctggtctcaaactcctgacctcgtgatccgcccgcctcagcctcccaaagtgctgggattacaggcgtgagccaccatgcccagcctacacgaggaggcattttcaaggagagcttgtaagagatcacacagaggtatttaagtcacccctcagtagggactttgtaaacactgacctcgattaaacagtgtgacacacatttgcacagagaatgtctgagcagagttcctggggccacatcccagctgtaacttaaagcccagtgggggtgggttgggtggagactctggtcattttgcaacaaggcctagctccaccccccactccccgcccccgaggccatcttcaggcaccagctgattttccttcccgcacttacccctagcgtcccctacccacaccttgccctgtggcgttgccttgctcgttaagagcagggaatgagaagcagagaaggccaaccacagcctatccagaagttgtcctgagagcagtcatcctggctccccaggggcggctgcatccctctcctcccaccagagccttcctgagcatgcatttcctcgtgcccggcttcgggaagcagagtttcccactgcaccgccgaggggacgaagcagatgtccgcacaggaagcagagaagccccaagtgctgagtgcagagaaatccccagcagagcccgcgttgggcagcagcccctcctcccaaacgacccatccaatcccactccccaagcttcctcagcacccactccccactcctgcccctgagccactgcttgctcaaggagctcccccagcccccaacaggccttccccatgagctcaattctgggcaggacaatcacagtcccagtgctacagccaaataagtcaccagccagaggacacagaccagaaaacagaacaccctacaggggtgcccaaacccaaaccccgaaggaagagcagaggaaacacagctcctgcttccaaagagctccttcactctcctcccgtccttccccggggaattacggggcacctgcgtggggctggcatgggcggccatttgtcactgattcagggagaaggaacagcttgaatctcgctttgggataataaatcaggctcctatccttgccctcaggacttctgtgaaaatctgctagaaacgatggcgtctgcagggcaccacctgtgccactcactgtgcctacagctgcatggtggccccacagtccagagggaggggcacattggacgcgcaggggtctccaagctgagggtagcaagcacaggtctgtcagtgcagaccctcaggatctcagctagagggacgacagcttgggtttgctttcttggagggccctgaggagccggcagccagatttggtttttaagacaaagaccagagtagcaaagagaggaccctaaacacagctgccctccttcccaggcaggtagcaggtgcctgggttctaggggacgagcccggacagctcacgccttactgtgcttccatgaggactgtggggcctcaaacgtggggttcaatggggagcacgaccgcttgttggtgctgatctaagatttcacaacagcagcagctacagggagagaaggctgggcccccacaccaccaccgccccaggatctggccaagtgcttcaaaaccatctcggatgcagcactgggcctggtgaccccatgtggcagcgaactcctctgcatattgagtggactccagggctccatcatgcagagctcgtggccactcctgcagccctggagtcctggccctgtttccctggggacaaccaccacctcagagcagggaagcccctcttgcctcttaaagagtgaatccacccagcaggtatgcagctcgtcctggagtgagtgtccacaaacagccctgcccagggccaacatgcagctcccaggctccgtccccaaacacccagagataacatcagggagaagccacagaacagaccccagcacctcaactgtgctcactggaggggagaccttgtggggagagctaagagcaaggcttctgcaggtaatgggtctgggttcaagccctggctctgcctgtctctgagcctcagtttccccaactgcagaatgggggccggtagtagcaattgctaagaccaagggagatggtgcataagcctcctagtgagcatcctgcatgtgccagcgtgggtctctccccttccgctttccaccagctcagcctgagcccactctgcctccagagccagccgcagtgggaccaattcctggatcacaattggaaaagcgcccctccccacagatggtccacccggccctgccatggctcaggcagggcaccccactgagcacttcctcccacagtacatctgaacaagaacgcagccctcaatgaacatttggattctggaaggtactgacgattgcagaaggtacagaaatcagtgcttggctcatccagccatcatgcacagagtctaggacagtttttgtttcccacactctgctggcatctcaggtgaaggatccagggcttgagacagtccctaatgcctccacttggccggtacagaaagaaagtggaacccgactcacagaagagaaggccccgcacggtgactgccaaggaccgtgttcaccagcagtgtatcagggaggctgctccacgtgaccctggtgctcctcgcccagccggagcactccgagagaacaggcagagcctcgagttacatcctggagggcgggactggctcacggccctaagggagcgccctcggcctctgaggccaggtgcggccagccctgacatctactgtccgggtttgcccaggacagggatttcttgggatgcgggacttttgatgctgtaactgggacaagttggccaccctagtcttgcagatggcagacaacagtgtttccatttatggtgctgacactatcggggggtggtgggggcctggctaagcctcagtttccaattctgaaaccagcttcaaaatcaggctttgggagggccaggtgctggcctggtactggaacaccaccaggtgcagtggcatctcacccaggcggaggccatagtgaggagaaagagaacagcgcgggcagaggggtggaggggccatgggaccccacgcccagggcatgggagccgggccctagcccttttggcactgtgtgccggggaaacagcagccaggcaaacttgaaaggcaccatcaggaagcgcagcgtggagggcccgccagacccgtttaattattgagggagtcacctgggtgccgccttctaattggcagggaggccttgaagcaccagggcttcgcttattagaaacggttctcctgctaaacagctccaactgtcaaaacaagcccagggatcacgtttctttcctcagcgcgccatcccacccagcccagcagggctatcacaatgggaggaggccaggtcgaacccggctttccacccatggccacacccggctcggggatggcagtgtcggagatgagcctgacacacccagcacgaaggcagcacagggccgaggggtgcagggagcacgcagagacagctcggggtggcagggagtctgaacctggggaaaccaggaagggcttctcgcaggtggcggcaagggagctggtgtgaagagtaaagtctaattttgagttcagagctctgactttgtttgggtttttttggtatttttttgtagagatggggtcttgctatactgtccaggctggtctcaaactcttggcctcacgcgatcctcccaccttggcctcccagtgttgggattacaggtgggaggcactgtacctggcccagagttccagctttgtataagacaggctagagtaggaaccctggccacaaactcctagctacaggcttgctaagggccctacaccccctggcctcagctcactcactgtaatatttggacaagccacctgcctcagatgtggtatgtgaaggaaggagggggaaggtgatgatggacatgggcatggtttaggggctggagcaggcagcccgggcagggggtagatgaagactcaagtgccaagtggggcaggagtctcacgggggtggagtcgagagtgaccaatgggctggcccggtgtggccaccagggtctgaaaccaaagtcaggatggaagtaggagggtctctgtcccatggagtggcgggttggaaggtgggggcactgaggcacaaccactgccatagccccggcagtgaccttgacatctgccatggcaggtccagcgaggtgggggtgtggccagctccaaggccaccaggggagatggtgaatacaccagagccccagaggagagaccccacgtgacccccaatccagcgaggctgtttctgcccctgtttccagaacctcggcaaggcagaggaagacacggatctcacaggcggaaagaaatgctcggtcccctgccccctctactttgtctgggagaggaaggggcctggcgtggctgctgattacagaggaatgtgacttctcagcagctgtaaggcataatatatatttttattttccaacacgcttctcgtaagggaacctcggctggcaccggtttggaaggaaatggccagtggtccacagggtgtccttccccggtgagcatgcagagcccccgaagctactctgcctttcactccatgccagccctcttcccagggaacacctgcccaggcttggcaggaaaccccctggacaaacacttaggatttgtccatcagagaacggggctgagggaggaggctctaggacaggggcgttgcggcccacaggccagcaggggctttccagggctgaggcctgcacccccagtccctggcacggctgctccacccagctgccaggtcaggcctctgtgcatctcacttctgcaaacccaaagctacacacactccctgcagacacaggacagggatcaggatgcttccaaactgggcactgatgggccagagcccccagctgtcctctggccttggcctggggaccctcggccgagctcagtcatgctgggcagagaaaggtggacagagtgactaatgaggactatggcacaggaacgcagacacgacaggtctgattcacgaggaggaaactgaggcaaggcttgggtctgcccaagcttccagactccaggcctgcaggtcagcactctctgtgcccgacggtgcccatgagggccccagacagctcccgggttcctcagcagccccaaccaggacagctctgagatcctcctgtgaacatggaacgctctgtcagctactggaaacaccgttccttttttttacctctccctgaacacagcagtttccttccctgggccagtggaggtctgttgcaggagggcagcacacaaacggcttcctgagcttcccccgctctcgcgtctggcacagtcgccggatcacacaagccaggctgggcagttttgggtgggcggacatgggccacagcggcttgtctgcacgtgtgtcccaccctggccagaggcagaagcgtggacgcgctgggccaggccggggactgaatccacgggctggatggcaggggctctggtctgagacccaggaggaacagcccgcatggcacgcccaaggcaacaagtttaaaatgcagaccttcctccagcaaacactcggaagctgggagctgcaggcaggatccctactcggagagctggggtgggagggccagaatggggggccgcactgggggttctctgcaaccaccaatctgctgtgtcacctcaggcgagatctctctcctctctaggctgccaagggggactgggtgacgcagcagctgaaggccctcttccccctccctgcacttcctgccgacttgtctgctgggaaatgaagggtcagctgggtggccgaggccttggcagtctccctagtgtgacggggcctcacgttggaggatcggctgtgacagggacagcaaccccagggcctgtctaggagcagccactacccttccatcccctgcccatggcaggcatcactagtcaatcacagtattctctctgagtccactgggatggacacactccaggtggctgatggatttatcagccctggtgagacagggatgccagtcccagcagagagcaggtttccaggagagccctggtcaaccctccattgtggcatcaattgaccgaggtggggccagtctcaggagtcccaggacagcctggtcaagctgctccacagacaccagcctctgtccattggtggagtcttggagcagggttgggggcacacccacccagctgaaagggcacagtggggccccaatctttcctctacattcacagagcaggggaaagggaaggcctcacaggacggaagctgtgctgaagctcccgatagccccacaagatggggttccgtctccatcccaaagaagacactgaggcccagagaggtgaagaaagctgcccaaggaggccagccagaaagtggcagaggtgggctgggagccaggacctcacaccacctggccatgcctcggagagcagccctgggtcatcgcaagggactgaccacaccaaagggcctgggtgtcacccctggcacctcctgtcggcacctcctgttggctaccagccccgctcaccctcttcctgctatcccgacccacaaccctccgccactcccacctgggcgtccacagcagcccctcggtggccctggcctccactctggagccccttgaggccaggcagggccagaggaagggtctggacaaaatctcagaggccactgccctgctggaacccccagggctcccctcacacgttgctccctcccctgtccagccctgtccctggctgccctggccccggccgctctctatccagggccgccaagcagttccccagggcttctgcctgggcctccctgtcccagacctccccatggccatcagggcccagccagggcatggcctcctcagtgaggcgcacagaccactgcatctgagggttcccacctcaccccatccctctgctgccaccctgagaccgtgtcccgggaactctgggccttggaggggctgcacacagtaggtgaacatgactggccgacgggcggcagggatgagagggagcgacttgtccgccccagtgatcgggtcaccaggccactgggcaggggctcccagcaagcgtgaagatgaggatggagccccactctcccacagtaaccccgaggggatgggcttggctgggctcctttgcagcagagaactgggctttgaccctgtgggtggtgccagccgtgggcctgaaggcggccctgggtgggatggggctgggcgagggccagctgtccaggcccccaactacccaccttggagcctcaggcctacagccttaagttccaatcagaactggccatgcctcacctctgccttcctgggatacctgttccatccaaaccctccctgctcccaaaatgccagatccccaacctggagcgacgtgcagggttcccatcctgcagctgccccctcccaccaagtgggtgctcagggaagggaggatccaagaacaaaattctccaaatagcagaaaacccaggaccccgcagccaccaaccctagccgggaccttgcaccgcgcctcagcgtgagcagccccacctccgggagggctgaaacctcggtgctggacaggggttgaggcctgcctcagtctccccaccagcaaccctaaaggggcagtggagcctctcctgtccccagggtcagcagatgacgcatgaggctggttttctcagctgtcagaggccagtcctaccaagaaccgaacgggaagagcccggacaccctgggccaggggctccatgcctagatgaatactgggcccggaaccctggccccctgactcccaggcagaccccacttgaggacgtcagataaagttccagccccacgctgcccaacgggttggccctgggctacaggtgacctctctgagcctcaacttcctcctctgcaaaatgggggcgaaaatctctgactcccaggatcaaggggaacatttaatgagctgacgcctgggaggtgctcagccctgtgcacgcctggtcgtggctgctatgatggtgggtggacggggcagctccagaagggccacagtgacagatgggacacagagtggcttgccaaaaaccgtgctgatcactaacagggagggaaagaagcaagtccaagagtccacttcaacagcaatgggtctcctcatgtaaagatccaaaacaatgggccagacgcggtagctcacgcctgtaatcccagcactttgggaggccgagacgggcggatcacgaggtcaggagatcgagaccatcctggctaccacggtgaaaccccgtctctactaaaaatacaaaaaaaaatcagctgggtgtagtggcgggcgcctgtagttccagctactcgggaggctgaggcaggagaatggcgtgaacccaggaggcggagcttgcagtgagccgagatcgcgccattgcactccagcctgggcgactgagtgagactccgtctcaaaaaaaaaaaaaaaaaaaaaaaaatccaaagcaatgaagatgaaacgaaacagtatttgaattttgataaaagggtaaaccccaaatttaggatggtggttacttcctggcaggcgctggagtagacgcagctcctttgtgtcctaagagttagaaacttccaagtttcttgttcttgggttgactggccagcttgtgagtgttcaaagtaattacaagttaaattaatgcatcaataaagataatagggaaagagcggaacaaaaggctggagaaagcaaccagcaagggcaccagatggccgatcccagggttccttcctctcttgtcgaaacgccgctaagcgctgccttcaaaaccaggccatgtgctggcaggcacgggcccctgggaacatgcctcacgtggagccgggcatctttggggaaagaaagccatgggctgggggtgaggcagacagctctgggcccaggcaggctcctgcgtcgttcaggctcccctgaactcctggcagcccatcccatggcagcctggcaccggctgtgcagtcacccaggcccgtgtttgggtttgtttccaccacaacctgaatgtatgaccacagtcccccaagacaccaccatgccaagacgtcatcttctgttccgggacattcttaatgatctcacgtctcatctgcttatgtataaatcccaccacaaaacatgatgtgtcttttcttctcagtctctgaaaatgagccgataatgttacccagctgcgcagatacatttttaatgctgacagttgctgaagaggcggccttggtttgttttgcttgttacagagtaaaaccatcttcgctccctaaagggaaggacaggagttggaaagggcttcacctcatgccaatgagcaggcacgggacattcctcccgccccgaacgcaccatgctattatacttgggacagggcactgggaaggaggaggccactgaccccgaaggctcacccctcatccctgctacctggaggggtgtccttgaaccccaaacctcccccaccagctgcgggcctcctcctgggccgggagttctcgtggatgccagggctacgttaagaagcactggttagggctcgtgaggatgctggtccggcctccagggagtgcaggcctccaccccacaggcaggctaggctgaggaggcgtggctgagggaccccctcctggaccctgcgtcccagagctggctgtgaagtgaaacccatgtccctgctgtgtttgtgtcctggggctgcgtaaccaagcaccatcgaatgggggcttaaaacaacagaaatttcttctctccagttctcccagttctggaggccagaagcctgagatccaggtgctgcagagctgtgctccctctggaggcactgggggagggtccttcctgcctcttccagctcaggtgggctccatgtgtttcctggcttatggctacatcattctaacctctgcctccctcttcacacgatcctctcctcttctccctgtgtctctcctctgcgtggttcttataaggacacttgtcattggatttagggcccaaccaggtaattcaggatgatctcatctagaggaccctactttaattacatttgcaaagactcctttatccaatacagtcccattcacaagttcggagggatacagcttttggggaacaccattcaccccatacacccccttctctcaggcttgtctgggatctagatggaaagccaggggacccggatgcatggtcctcaggccttactttgagaaccacctcttgcggctgtgcctcactggttgggtccctcaccaccagctctgcccatcaggcccacatgggcctccatttgtagatgagggaacaagctcagggctaaggaacctggtgagggtcacaccaggagcaaggatcccagccgggcctcgaacccaagtctctcaacctcaggccaggcccttaaccctgagcctccgggtctgggacccaccacgccctaccctgctctgccctgacccaggtacagctgcagtgtgttcacctgcacgtgaccagtggcccggtgtccactccccacatgaccaggcacatcccaaggctggccagctcctgctatgtcccagcacctggccccgggcccagcagaacaaggcaccaatagaatgaggaacgaatgagggaatgagggaacaaacaaataaagaaacaaatggacggctatggactccttgggctgagtatcaacatcatgagacctcaggaaagtgatgctttctgggcctcagtttccccatctgtaacgggagggaatgaaagatccttctggtatgaatgtgccaggctctaggagctgaacacagcctctgaaatgtgagccagcagggccccgtgagcccactggggtcacctggagacacctgccaggtcccaggacttgccctgaatccctttgtcttcccatctcactgccctgatgtgcctcagcccaggaggaagctcacaccctcaggctcttcctcaaacagagggttctctcatcttgacacaagtgacatttgtccacgaggatcagccaatggtgggcagggtaccaccctgctgtcgactggcacacctaggatgtcctcccccatcatggtgccatgaagaacaagcccaaattccaggcatctgagctgcccgagtaggcctagggcaggtgtgatgctctggagctgaaaactggagcagacacacaactgctgaggcacatttttctccagcatcttctaaaaccactttcatggacagtcatgcccctggggctctgcgggctttaggggattcctgagttccgctgcagatggtgccacatggcctccaccacgcactcaggagacaactttgcagccatgtgtcgcatggaaagtctggtcacacgacctcctttaacccttgcagccttccaggtgggtgccgggagatccccatttgcagaggaggaacctgaggcacagagtggcagctcctcctcctcctcctgactctcagcttttggacccactgtgtgccaggcactatactgagaactttacagacatcatcttttgaatcctcataacaatccagtaactccaaagggccggtgaggacactgaggttcagggtgtaagaaattgatccagcatctcatcagcacccgagtgaaccaagtcagctcattcatccacccacatcatattgttctgtgcctactatgtgcctgggagcagatgggtcctaacctcacaacagaggttgcagccttaatgattctagagtaccacactgagaccaatcgcgttatattcatgtgaaatagggcagagcgaaatggacagaagggtggatggatggatggatggatggatggatggatgagtggataaatgaatggatgaatagatgggtgaatgaatgggtggatgggtatattgggtggatgcatggatgggtgggtaaataaatggatgggtgaataaatggatggatggatggatggatggatggatggatgcacaaatgggtggatggatggatggataggtgggtgaataaatggatggatgcatggatggatggatggatgggtggatggatggatggatggatggatggatggatggatggatacatggatgtatggatggaaggatggatgaatggatggacagatggatacatggatggatggatgtgtggtggaaggatgtatggatggatggatgtatggatggatggataaatgagtgacagacgggctgatgagtggacagatggacaaactgaagaatggatgggtggatgggtggcttgatgggttgtagggtgcttgaatgatgggtgggtgggtagatgtagcgatgaggggacggatggacagactgatgaatagacagggagatgggtggcttggtgggtgcgtggatgggttgtagggtacctggatgggtggaaggatgaaagaatggacaggcagatgggtagatatatacgtggatagatgatgaatgaatggtagatgggtagataagtgagtagacagaagaataaaaagaaggaaggaaagaaggcagagcagaagggtggggggagtgcggggatgggaaggagggagtgagaggagaaaagcaataataaaatccattagatgagccagagaagtattctcagtgggcaaattggcagctcagcaagttcatctgacaatggctgtgatgatccgggagtggagcaaagagagaaactcagctgcattttgtcttttaaagacagacacaggcagatccctgccccactgcagaagctcaggctggctgttcacgcccccctgccaggctgccagccctgcttctcctgaccgtctccagcaagagggagctcatctacaccagccacgcagtaaacagccagttactgtatttctgaacaaatgtgtctcctttacaccatcatcctcatggtggcagccgcaaagaggacacaccagtgttccctagccctgccactcggctaggggtgcagggtgggggcacagcccctgctgacccattgggccccccctgccatttctgtgctacacatagactcaccccaggttgcactggccaatgtgcaccatgcacttcccgtgtgccaggcccagagagtcacccgattctctcactcagtccttatgaaaaccccacacacaagatgccatagtcaccctattcacagacgacatcccaggtctaggaggtggcaagactggattccagccgccagccactcggctgtcaggtaaaagccgtggcaggcccaggacagcaggaagaggttcaaagccttctccgtggggccaggtgcacactcctggtggccagtgggccaggttgtggctttagcacagcaaaggtcagtgttctgctgcccctgcagatgtggcctccctctaccccagggccactcattccttcccaagtgtgggtctccagtcagcaagcatggggagagggtcctcggccaagagagggtggaaggcttggtacagagctgcccccaggctgagcagcagcactggacactaggccaggtctagtgcatggaaaaggaatccctcaggcactggggaggccctgccccagcggcctctgctgacgcttgcttgtcccctctctgcaccatgagtcccacccaccagtggcaactcccacaggtgtggcaggttccatctgacaagcacccaaaaggctagagcggggcagggaacggccaagcggagtctgcatcaccctgcactacagccaacccacacatgccgcccccctttgctgcaccaaagcgcttccccacccagggccagctctgtcactagccttggctgccacatcagcattggcatccctaaaccaaaagaaaccaagccaggcctgagtgccctgggctctccctccccatgccaacactgcccagacaggacagccgagcaccctcccttcacctgtcctcaccatgaggagcaccagcccttgagaacctgcaaccaagccccagggaggatccaaaacactctgggtgcctgctgctcccgctggcatgatccctacattcagactcaactgtgggagatactgggatacagaatgagcaagatccaggcctgccgggagctcccagtgcagagatgggtgtgggcacatgagcatatatacacacacgtgtgcacacacacacacccatctgcacatacacacacactccatgaacctgcacacctgcacatacacccccatctgcacatgcacacacataccccttgcacctgcacacacacaccccttgcacctgcacacacacatctgcatatgcacacacaccccatgtacctgcacacacacaaatctgcaatgcacacacacacccatgtgcacctgcacacatacatgcactcatctgcacacacacacgcacatacccatatgcacacacacacacccatgtgcacctgcacacacacccccatgtgcacatgtacatacacacacgcgcacacccatacacacgcaccatctaacacagtttgttctgcctaaacttggaggccccagccatggctggacgaatgcaaaagaggagcagtggtgcgaatgaggcagtgaccatgccaggccagagaactggggctgcccactgctactcctcactgagttgcccttggcttgtgctactgaccagggcaacagaggcctggggtgtggaagaggtgccagactgatggagcaagccagctggtgactcgagcctacccttcagagagctggccgctgtgaccagaagcaggctggagggggccagaccccagcctcaaagcccagcaatccaaaggtggcctcttctgacctcccctccccaggaaggagtttaatgtcttccaattactcccctcccactccctatgcagaggaggttgaatccattattgtaacgaaaggaaagaaaaggaaaaaaaagactctccaattaggctggcccagggactcacatgtcatcctgtcccctcacagcagacccactgaggacaggtggccaggatgtttgatgtcaccaggtgggacaattaaacccatcttgctggcgggatgagctgctaagcatataatgactgccaccttccgtccccatctcctctcagcccaattacctggaattaagcaggcaacaccagatgggaaaagggacaccagcccagatggaagaaaaagggacaccagcccggatggaagagagtggagagagcaggggatgctgtgcccaagagagaaggctacaggagccacagcaatgtcttcaaacacagcaaagactcaggggagaagaggccgggactcgtggggcaggacaaggtgttggcgtgcggacccttcaccttggctcacagtgtgcagagaggatagcacattcgttcacggaggtgtgggaactgcagagtctgccaaggcccattcacggagcctccggctgagatgtctcacatgagaggtatttggtaccttgtaggtgatttgggaaggcaaaaccaggtttgggagtggaagtcaaggacgcagccctcaccactgcacaaacagactttctcattatcagggccagccagcaaggcacggggttccagtgctctcccggccactgcaggagcagaggctaaaaggaaagaactcagcaagaggctgtctctgcaagctgcctccgtatcccgggagggcacccggcctctccctgcacgagccgcatcttaggtctcgttgcccagtgctccgggataaagcctgccacccgccaccagctccccccgcacatgggaagaccaaaaggtgggtccttgaagccataaggaaatgcgaggtcactgcttccagttcctaatgctttgtcgtgcttagattcaatacgggtatgtctgatattctgagaattcacttcaaattgaagcaggaagttccagcttacttccatttctctcactccaacctcagcctgacccctgtcccctgccttgcagccgtcacagcaatgctagtcacaggagccaaaaggtggaaacaggccagagttcatcacgtgataaacggatacgcaaaatatggcctagccacacactggaatgttccacggccataaagaggaatgacgcaatgaccggctacggctgggtgaaccttgaaaacaagatgcggggtgggagaagccacgtgcgaaaggcacgcaccgtatgattccatggacatgaaacatccagaacaggcaaacagaaagcaggctgggggctgcctgaggctggggagggcggtgactgctcatggcgaccggtttcttcctggggtgtgaagatgttgtgaaagcagatagaggtggtggttgcacaacatggtgaaagtactaaatgccactgaattgcgtactttacaagggttacatttatgtgatatgaatgtatttcaatttttacaagtcagaaagcagaagagagggtggcagggctgggccaggatgagacaatcaaagccaggagcccagcccagtgaggagccagggttgagccccaaccgggtccccatgctggtatgtgccccccaccgggaccccatgctggtatgtgccccccaccgggaccccatgctggtatgtgccccccactgggaccccatgctgatatgtgcccagacacgccacatagctgggccttcagacagcctcccagccaatccagggggctctgctcctgctctaacaggtcaccagagagttggagagttggtggcttcaagcaacacagactcttacagttcagggggtcagaagtctgaagcgggtcttaggggctggcgtcaaggtatcgaggggctggtccctttcaggaggtgccggggagaatttgtcccttaccttttccagcttccgaagctgcctgcattcctgggcccacagccccatcgctctaactctgccgtcacatctcctttttctgactctgaccttcctgcgtccctcttaaaattatgtgtatttacatctgcgaaaacccttttcctcgtcacactctcagggtttgggggttaggacatccacctagcagccgcgggccttccacaaggaccaggtgctgcgctgcacgatgcacagacacagagcaaccccgcgaggcagagtcatgctcccagcctacagaagagacaaaggttccaagagcatccctgcccaaggtcatttggctgacagaagcttccttcatgggacctgacctcccagcctgaggacacctttcggtttccttctcaggaagtcctacccttcaccatctcctccctcccagccgttcagagctgtgatgaccccaaattagggcacccccaatctggagggctagctctggccacagcaagacccacatccccacacgcctcgctgggtgccttccacaaacccctctcccactctacaaccacaatcctcccccttgccccgcttccccaacacgtttgatcccccagccggcaccagggcgggattcttagattaagtctccaattcatcagcctctgagaagtataattggggcttttatggaaaatcagctcattatgcaaagtgcaagggttgtgaaaatgattttttgaaggagcacgttgggctcctacccagccatgaaatgagggagagattcttcagggctgtgggcttggcttgtgggttttcaagaaggaaagggttgtgttaaactagaaccttttgctaatcactaacactacaaaacgctcgaaatgaaatagtgtcttgtgaagtgctggtggctgcccccagaaggttcaattccccatggaaatcccagcccatccggagcaaggtgggacattgctcagacgcagccaccaagtggggctgcctgggagggttgcctgtcacctgtctcctgagctcccgggtgagcgtgtgaaccagtggaggtctgcgctcaaccccaagggctgcagagggaaaggacccaggaaaagtcccagagtggggctcagaggagggagggtggaggagaagggcaggaaagccaggccccggggaggagggcctgcagaggtcttcctgcaaagcctcgctctgcgcccaggaggcccttccctttggcctgcaaacacctccccttcgtctctcatgtctgcctatcctgtgtgcagaaaggggtaactgagcaggcttggggtgctcaacccctccacatgccgaagacaagactggctcttgctcagctcctaggagatgacctctaacctctaagccccgtagtgtctgccagataggccctccggataagagcgtctttgtatacctgaggcgttgggccacgcagcgtatgctcacaatgtggtttatggtggggctgtgggcatgcaggatcagtgtggcctctgcaggcgctggggatggagtaactaaggtcagcctcacaggcatgcccaaccccaccggccaccagtgaggacccgcactccagggcttgggtggcaatgttctgtggctgttgccacacatgccgactgtcacacaccattgctgggagaactgagcactatgcagaaggctctatggggaggggataaatggaaacccacgcccgatgtatcctggctccaccccggggccttttccatttgttgatttgactctagatctttctctgcaaccataatggcttctcctggtgaatctgagaacctgaggatggtcttggggaccccacacacaccctgctactgtcactgagtgtgtttactgagcccttctctgggccgagccctgagccctgggatttacaggtctcatctcaataaatccgagacgcccccagtgtttatcctcatcttgcagatgtaaaaagggaggctcggggagacatctccggcatgaggtccacagctaagcaggacacagacttcagagctgggtccaccgacatgcagccctggctcgtcacacctccactcgggtctcctgtggggtggcagccttcagggctggggtctacagtcccagtccagggggccactgtgcccacatgctgcctgggcagttccccgacctgagagggaagagggcaggtttccctgtacatctgccagccccaggaccagggccagcaagcagggccaaccgactgctctgcccatcctgggaggagcggcagcgtgaagcaccagcagcatcctcttgggttggctgggtggaggggccagagacgtgggggacggagggggtggcccggagggagggtgcccaccccgggcctcaaagggcctccccattcatcaatcagcaggacacacatgcaggacagatgcagggccagccctttccatggtcctcaccacccccgaagccaccaatgggctcccgttgccacctgtaaaccccaagggaaacaggccctcagagctgcagatggggcacctcagcctcaggagggcagcggcatcgagagcctgacacgggcacagctgggacccaggactgtgatcaaggactgtctgcggcaggagaggggatagggctgtgggcacctgtggcaggaccacgccaatgccaagccgggccaattgcctccccaggaacagaatcaggtcactcgtctgacgtggggtctgcggcaccaggcctccagtttggaagaatgtctaatggatttggagaagagatcaaaagtctagtattttgtgcaggagcaattaaaatgactgattttttgttgcatgaatctctttcctgcctaatatgtaaaaaaaacaaaacaaaacaaaacaaaaaaaaaacaggctggggagtataaccacgccactgacagtactgtattgtcatgggctggtggaaaggagaaggaaccatcatttctggaaacaaaaacaaacaaaaaacacatagtctttgtatccagaaatgatacttttaaaaacaattaaacatgttttaaacggtgcctattacagactttgcaccagctggaaaatagcctatgcacctggcggagggactggtggggcctcagaggcattagttatcctctagaaagtactcagggtgctgggcaccggggttttgactgctattctttatgccccaaatgtgttctaaatattcttttgtatgtgcttaatatttaattttaagagtctatccatggccgggcgaggtggctcacacctgtaatcccagcactttgggaggctgaggtgggcagatcaccagctcaggagatcgagaccatcctggctaacatggtgaaaccctttctctactgaaaatacaaaaaattagccgggcgtggtggtgcgtgcctgtaatcccagctactcaggaggctgaggcaggagaatggtgtgaacccgggagacggaggttgcagtgagccgagatcgcgccactgcactccagcctgagtgacagagtgagactccagctcaaaaaaaaaaaaaagtctatcctatatttcacattttttaaaaacctcaattcaaaggaatttctgtgtcctctgagaatccaacaacggaagtccccgtgggtttaggaacatttacccctgcccagtgcctctgtgaacctgagcaaatggcccccaccaaggggcaactgcgccacccaaaagctccagtaccatcgtcctgggacccctcagcctgtagtcatacacagcatcccccacggatcacatcagggtaaggccccttcccaaagtcagggcaccctcatgatgtcacctgtgcccagatgtgaccccatcctcgctgctctcaggccaggctctctctgccattccagcctctccttctcaccctgctggcccctgtcctcccaagggtctcccagacacacgtccccacccaatcaggaacctggtctccctgacctcaatctgtgggtcagaatccacagtgaccagttctcatctggggctgttctctcctctcacagacgcccaagtgccccatccaagtgtcagaagcaggaggccagatcacaggggtcatgggaccctctgaggctgaattttgcagtccaagcagaataaacggagagtggagaaattccttggcttggcttgtccagtgccctgcacagggacctgcagcccctaagccaggcaagtccaccatgctccggcgccatccctgcaaacagaccccagctacctcattctcggcacagcccccggttctgatgtgtggagagtgcatttaggtaggcaatgatctgtgaaaggattaatttgctgatcttattacctaaatcgaaagagattttgcagccgtcagtaacatgcttgcaagatttccccggtgtgagctgaagcctcccgccccccacaccccttcctgcagccgccaacgggttacgcgacaacacgctgcaaatgcatgataaagacacaggcagagggcatctgcttccaaccccagtatctgtgacaaggcacgctggtgtcgatggagatgaaaggacccggccttggcagcgcactccggagagctcacctgatccctttgttctgcgcgatgctgtgcagggagagcctcgacaccgcggagatgacctgggggagacaagaagagacgctcctgtaatttcacaagaaaccagaaaggcatcacagaactggggacgctgctttgcaggacgtcgagaactgttaactgagcacatcgcatctgggtaagaaacacggcatagcgttttgtaggctagacacttgttttgtatttgctgagcaaaacttgtcatttggatgtgctggtatttgcggggcactgctgcactcccggctcctgtggccatgctgctaacaactcccaagctgcttctcacccagaaagggtctgttttgtcaggggctgccagagggcttcaccgaggccacctttaaagggctcactcatcccatgctgctgttctgcaaggtaccatattactaagtacagctcgtgttcacagtaggtgccaacacatttcagagatgaggaaatgggagcccagagaggtcaagtgacctgcccaaagtcacccagcagccagggcaccacccacatgcaaatatcccagggtgctgcttgcttcccttcaagccctcccttgcatgacatttaaacagatgcctggctccatggagggctcgggatgcagaaggtcaagagctccaggtgcacagtggcatgacgggatctctccttgtctcccctggccggcagactggtcaagaggaaggtttggtgagaagcagtagccgctcctcctccctctgctccccctaaccggcctgccccgtgatgtgggcctcctctggataggcaggacccacctgtctcctggcattgaaagcccaacacagccactccacagatctccaaagggacaggtggctagcaggccggagacagagcaagaggctctgcagatgaatacggggaacccgcggtgggggacagggagctggctggcccaggggcacaggttgtcacacacatgagatgggcgggaagctgtcacaactcacggggtgaatggagctcctgagcgacagactcagtccctgaggaggcaggtgcggcctcgacattgaaatcgcaccaagtacatctgtgagtccatgtgtgtgacagctcgcgtgtgtggtcgtgtgtgcatgttgcttgtgcgtgctacaagtctgtgtgcactgcacggctgcgcagctgtatgtgcatgtgtgtacgtgtgtgtctgggggtgggcaacaagaaaaggcccacgacggccacgtgccgaattcatagacaccctccactgggtgctggcgtcataggaacggagcccagagggcgctctgtgtgccggacaccacaccagggaaccccacgaggccatcctgcgctgcacatttgctagacaggaaaaccgaggatcggtcacttgcccaaagctccccagccagatgcactccccaggcttcccttcagcctgttccgcttccagcagcaattttcaaaaggggaagaggaaagaaaatgaaccatagagacggcgggttcgaccaaggaggcggcggctgagtgctgccttcctgtacgtgctcgtgattcgggaccggcgctcagggaagctggggtcatggaaggacagggtccttctgtgcttcctcacacaagactcgatgggcccattatgcggccagcccagccgcactcccatgctgatgctacaaggggcctttcacaagtaatgaggaacttggctctggagtgtttttggcttttaagagctctaagcatttagggaaaacaaaaatgaaagcaatattgctgtacgtccttacagttatttggaagaatgttagatcccaaagggtttggcaactacagggcacccaagccccctctcacacacctcctgcggcagacgtggctgatcaatccctccgaggagccgggcgcaggcccagagccctcctccgtggagtctaaggaggcaccagcattcggtcagcgctgacacacaagaacctgtttgtcaacctggagtcagcgcaaaggccccaggtcgggtcgtacagatggaaccgggtcgtacagatggaaccggagacagagaggaggcgtggcgggcgagccagccaaggccagaacatggttctcctgcgtccatgcatctgtggcccctgtggacaatttctacagctgctatgaccacagcagcctcagccccaagcttggggcgctttgccccaggatgaacgtgtcacgagcagctgatgaagggctctggagggcctgcagcatcgatggggcagccccttccatgggttcagcatggccagctatgctggaggagccctggccctccatcggcctgaatttcaggcttcctagctggcactggggatggggggaagctcagaagtccaccacggggaaccacactccagtgacccaaaacccagggcaggggctgctggagcagacaccggacccctgagatagccatggggtcagatggggcaaagccggccccatgtgaaacccactggcctgaaaggttaggagcagaagtacctccctgcaggaggagggatgccctacagtagctccccagggcacctctggctgtgcccaccccactcccaggacagacagagagctgggtgtccccaggggcccggctctcaggcaatgatcaaacacctcttagcccacagccccagccgactcttccgatatcgcaaatgtcaaaggatgacattttccctacttttattacctcgtctgttccgagtcccagttaacaaacgaatgaagacgcacagctgcatttcccttcctgcctccctccctctcccgcagacagccgcggggcaggaggaaaggaatgtgtgtgtgctggggacgaggaacagggaggaaagacaagaggaatgatgtgccactcaaaacgaccaggcatgctggggagcccacctgcaccgccagctcccaaagcttcaggcctctgtgccattcaccaacgtccaggcctcaccaggccacgcttggtgagactcactgaggaacgaggtggggactggagagctcagaggacaggctgtggtggttgagtctggatcctggatggcagccctggctccatccccacccaaccatggcctgctctgacctcaggttccaagacaccggcagcccgtcagcctccacacagccacagcacaaccttttaaaggcggcactttaaaagacagaccctaggtcctacccccgccaccccacaggctctggggcctgggaatctgcatttatagttcagggcccatgtggctggatatgcagcccgctggggccctctgtcccctaaggactggccagacgggtaacgccacagactgggtcaaagcctgcgggaagccaggagcacgtcccaattgtccacttgtggactcctcgcagagccagggtccctgaagcccctccacaatggacagggaagcagagggttcaggaaggacacaggaaagggcatgcggtctgtgagctcctccggggtaggaacaaagttggctttgctgaatgatttatctccaatgtcttcaggttgtaggcccatcagctgtaactccacctgagaaacctttagatcacagtgactgtaaatgcaaagctctatgctgcaggttcagcagaggataggaagcctcagtgctcccagagcccaggcaccgaaaactccacgtgatgggtccttccgcaaaaacacttcggcatttttactttactgcaccaagtttccaaactgaggacagaggtgctgtgctcacagtatttgcaacttaaacatccacaatcaaaactcaagacagggccaggaagaaaaaggaaacgtagactgcggattcactgtaggacaatcacccaatcttgcatggccttctggaaagaacccagatgtctagctattcacatgtgacctcatcccagtctccactgccccttctgcactttccctctgcatcttctgcctcacttctttttcacacctcctgtaacttcattcctctgtgctgtattcttagtgacttcctcggttctgtcttctgattcattaattctcccttcggctccacctagactactgtttaagacacatactgagtttttcatttcaacaatctcaattttcattttgagaatttctatttagttcttttctcaaattccatctgttctttttgtcttgcttgtttgctcatcattttctcttcttttcttttgcattctgttccttttttccgagaatagaaattctctctcatcgactgcatctgctagccccctcccacatgctgatttgtttctttttgagcaccagctggctagtctggtaaacatacatatattcacagattatatgtattgtgtataaacacacgtatatattgttctatgctgtaagtgcatcctcagtgggaattgttttccatgggtggagggagcccccaggctctgagagacataactatgagggctctcctggtttcccctggctttcaggccccactccatgcctggtgccaaagcagggtgtatcctgccagagactgtttccctgcccagcctgggatggtcagctgcttctgtgtgccagggtacagctctctggtccccattccatggctctctcagccttcctggctcagctctctgcactgcctccattccatctccctcacctccaccatgatgcaacccccgctgttagggcccaagccctagggtgggcctggttccaggccccccagggggtgggtggggagccaagctggcctggctcctctttctgtctttgacatccctcttggtttctgacaattgaggatttccctttctagttctaagcctagtaatcatgttttagtttgcattatttcatttaaagagggattctacgtgttggggggaggggaggagcccacgctcactggaccactgtgttttgtagaaatccctacgccttctgcagagcaggaactcacaagaacctccaagcaaaacagccgtcaaatcaccatgagcctgcagcccatcggtgggagtgaggacacgcctactcaacatcagtcagtgtgggggcaactgcgctgcgatgattttaaagaggagcctggccaggcgcggtggctcacgcctgtaatcccagcactttgggagaccaaggtgggcagatcactcgaggtcaggagtttgagaccagcctggccaacatggtgaaaccccatctctattaggaatacaaaaaaattagccgggcgtggtggcacatgcctgtagttccagctacctgggaggctgaggcaggagaatggcttgaacccaggacgtggaggttccagtgggccgagattgcaccactgcactccaacctgggcaacagagcaagactccgtctcaaaaaaaaaaaaaaaaagaggagcctgccaattttgccattatgatgacagatgatggggtggtgtctgtttagcacatgtcacagggtggcagcgtggggcagtgacatggaagcgggaactccgggccgcacaagttcaggttcgaatgtcagcctccccctcggagctggggcaaactctcagcctccctgagcctgtttcctcaacagtaaaacacggtcctaacagaggtctcgtcacaaggctgctggggcctgcaggaggacacgcccctgcaggggacacaacaccgcccgtgagtgccgagtgaggacacggccatgggtctgctgagggtcccggcgctccctgcagagccggggcaggcgtctgtccacatagggtcctcagagcaggtctgcagctgggcaggccaaggccagcatcaaggctcaacacccagtgcccaccaggcctccctccaggaagcccatctcgccaggtggtgcgtgcgcaactctagctttctctttctggcgccttggagagatggaagccaaaaaagtgacccaatcaccctgcacttgagccagtgaagccactgagtgcccccatggtggggccgcctggggccctagggaagggtgccacgtgctctgaaaaggctcacaagtccccggcaccctgcaggcccctctctgaccctcgtcaagcctccaggagtactggctttgcttagagcctctggagggaatctccctttccaggaccccctggcagggccagccacaccctcctggccaccacctacagaccccaatgcaccaggtgaagacaagagtagcagcagccaatggctttcagtgccccgcaagccctgtgcagtgctagacctgagatgtcccacccagctctcgccacctggagctggaaaggacatgcaccttctcccaggaggagcaaggctctgtcgcatccagcgacccatccatggtcctctagctggacgactgaggatgctaacaactgccaggagaaatggtccagtgtggggcggtccacctggcgccggctcagctgagtgctgggctcacagcagcctccagcatcgtttcctgaaccaatggaaatgagccactcctcccacaccgcctacaggaattgctcagacagggatctgaggtctcgggaagagtcccggctgttctccacccaaggccccaagtgcacctcggacagacagaccaggagacttggagtgagagagccactggcttctccaatgattgttaactgtcttgttccatgtttaaaagtccccttcatcttgaggaaacttcccaaggtggccacaggaatcctcgctgccctccatgcttctcgatctgaagtaacggttgggtcctgactcaacccaactgctgtgagctacccggggctcgggtctgtgtggcaacacgaggggcaacctgcccacagcacagcaggcaccgcatccccatgaggtggggcgcggtggggagaaggaagagaaatgagtcttctggttctggccaggagatgctctgcgaatggggaagagcccagactgccctgggttcaaatccgcccttcccgggcaccgtgctgaggctccctgaggctcggttggctcatctgtgagatggggataacagtgtctacccgtgtggctgtaggtgaatgagacggagcctggcccaaagcagggactcgcgcacagcttgcggaaaggggactgtgcccgatcagaaggtccacggagggactcatggctgcactccatcctccacttgctcgaatgaagaaacaaaaacagagcaaagtactaggctcagggccagaagcgtgcatgtttgttatgactttagaagacactcagaacccctgaagggtcccgccatctcctgggaatgccgctctggcccgtcctatccctgcagccccacagcttcccctgctacttgggatgtgaacctgagcacgtggttcctccagccaaacctcagtcaagacactcaagccaggcaatagtgacccagaacaatgacccaggtggatgcaggtgtgccttacaaagggaaatcaagctgggtgcagtggctcatgcctgtaatcccagctacagcctcacttgagatgaggagttcgagaccagcctcggcaatatggtgagtccccatctatttattctttttttttttttttgagacagagtttcattcttgtcacccaggctggagtgcagtggcaccatctccgcccgctgcaacctctgcctcccgggctcaagcgattctcccgcctcagccgcctgagtagctggggattacaggcaagtgttaccacacctggctaatcttgtatttttagtagagatggggtttcagcatgttggccaggctagtctaacctcaggtgatccgcccacctcggcctcccaaagtgccgggattacaggcaggagccaccacacccagtcccatctcttaaacaacgacaacaacaaagtctttaaggccaggtgcagtggctcacacatgcaatctcagcactctgggaggctgagacgggaggattgctggaagccaggagtctgaggccagcctgagcaatacaacaaaactctatctctacaaaaaataaaaaaaaaaaataaccagatgtggtggcatgcacctgtggtcctggctactcgggaggctgaggtgggaggatcacttaagcccaggaggtcgaagctgcagtgagctagaatcatgccactgcactccagcctgggcgacacagtgaaaccctatctcaaaaataagtaaaaattaaaaagaaattggagccctgagccacactggcgaccatgtgatgagccatccgccgacccagcctgctctcagaggctctgccgatcagaagagctttctggccccgaccctccgactgtcattagcaatcagtaagcaggaactgcacagacctggccccagccgcagaccttccttatcagccattaccacacatctggaaacacacacgcacacgcagcccaacggagccaaatggcaagattatcaaactcatttgaatatgttgccccggaaactcacctatctgccttggaaatctacagctactattgctgcatattcagaagcaaatcattataaattactttctctaactcagcctgtgttatccttcatttttttttcttttttcttgtggaaagcacggacagaaaaatttggggtacttgccttcagaatgacaagcgaccatcgagtagtgataattacaaaacatgtgcaatcacagcttcacattcaggttttgccaccaggaggaggctggaaaaacaaaagcgagcaggaaaggcacttctcagccagtgcattgggcaatggcagggctgtggggcccaacatcaatatcagaagtttcttctagggggccggcagagtgcaggaagagaggtgggagccgcccccaggccccaagacagctgagcggcaaaatgaaaaatgccactcactcgagccaggcaactagcagcgactctgaaggggaatgcatgaaaggagggtctggttgtccttacaaagaagatcagggctcgaaagtcatttagaaggaaagaaaaaggtgagagcaacttctctgtaaatgaacagctcagaattggcccactcttcctggagctttcaacaggatgtaaaaatgatacccaaatatatacttcctcatctcagtgggtctggatcaacaccttcaaatgcaggagtctgagagaccacctgagccttggggaccagcagcccgaatctttgtgtcttacactctgtgggtgctccttgtctatgacatagatggataagtcggtgggtgggtggatggataagtgggtgggtgggtgaacagacggatggatcagcagatgagtggacaggtgggtggatggacagatggatggataagtgggtatgtgggtggataagtgggtgggtgggtggatggatggatagattgatgagtggatgggatgggcagatggatggataagtgggtaggtgggtgggtggatggatatgggtgagtgcgtgggtgggtgggtggatggatggatggatgagtggatggatgggcagatgggtagacgggtgggtgggtgggtagatggatggatggatggatggataagtgggtgggtgggtgaacagatggatggatggatgggcagacaggtggatagatgagtgggtgggtgaatgggtggataaatgcgtgggtgggtggatggatggatggataagtgggtgggtgaacagatggatggatggatgggcagatggatgggtgggcagatggatggatagatgagtgggtggatgaatggatggctggctggatggataagtgggtacgtaggtgggtgggcagatggatggatggatggacagatggatagataagtgagtgggtgggtggatggataagtgggtgggtggatggatgaattgggggtggatggatgaatggaggggcggatggacagatggtaaatgggtgggtggatggatggatggatgaatagatggacggacggatggatggatggatggacagatggatggattgattgatggatggatggatggatggagaagcggatggatggatggatggatggatggatggatggatggatggatggatggtgggtagatggatgccgactcagagagatccctttgccccagtcccttctgatgaagtaaggagagaagagagagaagatgagcccctgacggcagcctcatacctatctccctgagtccctaatacacccttgacaatttctgtacaaatgtcctccctaatggtggggggtcccaaccacccaccatggaggcaccactgaccctattttgccactgagaaaacccaagttcagagaggtaacatgactcgaccaaggtctcattgctgtgggaggctgaagcctgggtctgactcagagcccagctcctaacagtaaggtacctgagagccaccacctgcccaggggtgggggccagccctgccccttctgagcccccagcaggtggttcagggacacagcctccagctagaccctggctccatggggtcatcgctccacccttcctctgagtgtctgccccactgggaatgaaatgttgggattctagtctggaaggttctcccagctggaatcacatccaggactctcaggcactggcacagagggcagacctgaaaatccttgtgagctcctcaagggggtggctgagaagcccccagagatggcatagctgtgaacgggacactggccagggccagggatgtggggagactgatcgtatgtgaaccagggcgtcagtgacctggccgaccccaagagggaagagaagaaaggggcaggggcaggggccagccccaaagaaaactgcaagccctggcttcctccctgcatgctcggctcccagcacccacgtcctccatgtttccatggctgtgctgggtgggtgactgcgagtctaacttccccctcttctctgccatggtgtggccaggctagaggaaaagggctgatggcgtcctcactccgcgcaccgtcttttccccactgcagtcagctacactggcccagctgccccaaccagcatgtgggggcacagcctctcctcggcttgaagggtcggggtcctaggcccagttcccgacacctccagaggaaacccaaagcctggagcagaggcaggaaggctggcagggaagccccgggggtcagagtcgctttgtgcaccttgggacccggggagagaagaggctggaagggagaagtgggcccaggtggcctcctggagcacaggaggaggcgtaagctggtggagtatccggggcagcacgtcctctccaggcggccactccaaccatggggctctgggagcttcttgactaagacagagtctaccgctcaagaagcggggcagatgggtggacagaaaagcacacaagggggtggctcacgcctgtaatcctagcactctgggaggcagaggcaggcagatcacttgaagctagaagttctagaccagcctgggcaacgtggtgaaaccccatctctactaaaaatacaaaaattagccaggtgtggtggtgtgcacctgtaatctcagctacttgggaggctggggcagaagaattgcttgaacccaggaggcggaggttgcagtgagccaagcttgagccactgcactccagcctgggcgacagagggagggggcgggggggtgggggagggaggaaggaagacaggaaaacacacaacagcaactgggctcacatgttagctgagtgcctgctctgtgctgggcatgtgagggaagctgcaatttaatctgagatcctgagcaaaacagtacagaggctcagaccaggacattacgccagagctgggatcaagtcctaagcctgccacggacgatctcagccactcctctctgggcctcggtttccctgtgtgtggaataaggaaaccgcaagacatacagatggcaaagggcgtcctgccacactcccagtcccactgtgctcacggtggagtcactagctggtcaccatgcccctgctgaagacactggcctctgcagctgtctctgcacagtgctccgggcagacgctgcctgtgaaagcaatcagcacccaagacaggagcggcactgccctgggaaacgcctggaccaatagcctcaggtcccctgaacactgactgcccactgttcctaatgccagcacggaagccctgtgtcccagggctgggcaagctgcatgaggcagctgcatcaggcggcagctgctccccaccaggaaactctacaggaatcagtcgggggtcaggggctgttggggggaatttcccgtccttcatggaagcagcttagcagccatctggtccaaattctccaattttgagatgggaaacctaaaacccagctgggaagatgcaagagcttcacaagcccacccagcaacttccaggcagggcccagcctagaacgaggggttcctgtttggagcctgaggctcgtctctcccagacacggcgtcctccaggacagctaaccaccgtctaggcctcctgcctgccagatctttcccaggtttatttcattttattccctcaaaaccccccacgagatggttctgtggctctcccctttctgaggaggagtcaccggggctggggcagacagctggtgcctctggcagcagagcccggctctccacgccgccctgccctggagggccggctatccatcctggatttgaagctgagggacaaaccacagcctccaggcatgaaagcaaggtttctgagtgggggcctgcagcctgcaaggccagtaaacctgtcccagcaagactggctgggcaggctgggccactcactgtctgcgaatgctgctctctcattcccagagacactccccagcccctcctgggcatcactcagcgctgctgtggctgcaggagccaggcacagatggcgcctccctcccctgtccaccaggaaaaagcggggataaaggtgggttccagtgtgggaggcatcccagacccaggctgcagacgagccgcatcagtccctctttaatcagaggcaaggccggagaccatgacacagatctgctgcctagcgcgtgagtcactgcctccaaggtacaagaatcccacaggaagctcaaggtacccgcccagaccttgaggccaaggtggggttatgggaacagcacctcaagggcaggagggaggggttctggcctcccccacaccaccccactctctacacagatgtcttgccccctccaagaacctcctgcgctgcttcttccttggacccttccctcttcccagaggtggagacagtgaaccaaggggctggaacacaggcgtctacacaggcagattcccatgtgggaccctaggatccatctccctccccagcccacaactgcagactgtccaggcaggaagtggggcgtggaggcctcatggagccaggcgctgtgcatggtccgagctgcaagaggccttgggggaaacatgcgtccagaaccctcaccttacacacagagaagacgggtctagaaatgggtgcgtctcatccaaggccccatagccagtcggggcagagcagccccagaaagaacaagggtgggaatgaggacggtcaccataaaaacagaatcacaggctctcccgctgcagaccccagactgagcgcttcacgggatcacctgcgtttctttcactgcccccaagctctgaactctcaccacgctcaggtcacgtgtgtgcaagccggggctcaggaggtcactcagggtgggctgggaacccgggttcacagggccagagccgagtgccgaaccctccgtgccaaggccagacccagtccccagccactgcctggcctggcttcacagagccaactgcccccaccacacagcccagcgccacagccccggggagctatccacagctgatgggaacaggccacccttctgccggctaaggagctcatcaggcagagggcaggccctgagcaggcagagggggccccacagacaaaaggcaggctctgggcaacccagaattgtagtcagagagtctgagcagctcgaagtgagggctgcctggaggaggcgcaggcctatgataaagtagcaaagaaacaggcgatccccttggaggcacagactgcccggcactgcagcgcacggcaggactgaccctgccagtcccttcaaaagctcagctaccaactgccctgcgccaggacctgctgagaaacaccgcaggaacacacgcgaggcccccgctccagtcccctctagcacaagaggctatagaatgaattgacgtttgtgatggctaatgtggctaatgctacggcaccatcctgcctgggctaaggggtacccagagggcaggtaggacattacctccggagtggctgggcagcatttccagaggagaccagcatctgagtcggcagccgagtatagcagacgcctcccgtgccctcgggcctcacccaactgcgggggcccaaacaggtcatgatggcagacgaaggccttattcactcactgcccagcgggcacagccatcatctcctgccctcggacatcgacgctcgtcgttctcaggcctttgggctcagactgggactcacgccatcaggccccttgggtcttgggccttcggatcaggactggagctgcactaccagccttcctgacctccagcttcacagcagctggtttcaggacttctcagcccccaggatcgtgtgagccagtccctggtattaaatcttcctatctatccatatgctatcagcgctgctgttctggagaaccctgactaatacaatattggaaaggagcatgcatctcccctgggatggccccattcaggcacgccctgctcccacgcccagcaccactgaccgctgccagcagaggcgctgtggagacaagagtggtagggggcaagggacggggtgggtgtggagcaaagactattcccctaaggaaggcaggccccctgggactgagggagagcagccagtcagccaaggccaggagaacgtgcaggggcagagcccacgcacaggcccggagagcggccatggccacacaggggaccaaagagcggaggcctgtcggacacagggccaaggagctggcctcgcctggggcagtgggagtgcagggtcaggctggtgtttgagagatgcttcaggctgcaaagaggatactgggtggagggaaggcaggaccgcgggaggggggcggccccaaggagtcttctaaccaggccaggtgcacgatggcaggaaggcctgggcaggaggccacagggatggacacagccagagaggacacagccagaactgtttaaaaggctgatcaaggctgcctgggtgcaggggtgaggcagggaagagagaaaccatctctgtcctttctgccaggagacacagaaagggctggcctgaagaacggggacaatgggggaggctggccaccggggtctggacgcacagtggccagctacagaggggaaggcaggggatgccagggctggcgtctgggcaaggctgagcttaaacccttggtgtggccttcagcaagtcgctgcctgccccgagtctccctccccacccacctggggaaaggggaggctgagaggcacgtggttatctgagccaccaccaccccatttctgtttcccacagaacccccgcccggcctgctagacccccttctgccaccttcctctggcctcgggatgccctggctgtacgaggagaggctccctccgccctcaaacagttgccagcgcctttcttccccagcaggtaactggcacactccacactctgcacaacgatgccaagatgcagcccacaaagctgggacccacaccccagacacacagcaatccactggccaggcggacaagcccaaaatcagccactgcccacaagcagggtgggaccatcacactgccaggaaccttcttggaagagccagtgcttgtgttctgggtgacacgttcggctctgggctcaaaagttaccccactgcctccatgaatcctcaaccacccaatgaggtcaatgttactatgccccttgtcaaatgatgaaactgagggtcagagtggtcacctgcacacatcagctagatggtctgatgcaagctcttaaagggaaagcacccagaaggaaaggcctcagcctcccgactgagcctcaccccagaacccccctctcatggcctggtcatccactgcacgttcccagtctgctaatggggacaggtgacagtagccatcacctggaggggctgatgggtttccagtggcttcactggcctccctaattaatggccattttaatgggaaggggactaataactgtatctctaacactacggcaataactttccagtgtctacccttatctctgaagcgatgacttagtaactcggttattaagtgcaagcgttaacacaggacaggaaggtgcgtgaatctcctctgcgacgtcaactccacacctgctcctgctctgaactcccgcaggagtgcctggaagggcctgggaaagcacttggccccccgacaccccccactatttctcccctaggctgtctgacggtgaaggagggtgtggggcccacccaggcccttaggctcagcaggcgaagtctctttgccagtctcagcgtagggctgagctcagcactctccgccggcctgcgtctcacagatgctccgggtgtaccacggggcaggcacctctgctgacatgtggcagccaggggaggctcagaggccagggacaggttgctggcacctctgcggccgtaggagccacacaaggaaggcctcacacgaaccacacgcactacagagccaactgcgacccaagcacgatcgaggctgtgtgtttctgaaaggatctgaccgaactgagcactaagattgttcagaatctggccaacgcagctccccatccatccccagccaggtggcccatggtgagtgaggcagagtcttggtttcctcagctgtgagatgggggcagcggcacccgcaagagtaagggagacaacacactgcccacggctgccccgctgcagtcaccatcatcgttgctgcccctcctgcagatgcaagcccccacctccaccaccgccaagtcctctgtgcatgtctgtcacaggacagagcttaacctttgagaggccatccctgctgaccccacctgccgcccgtctcaggaggaggattcccaggaagtcacaaccgcagggggatcccccaagcagtggccacgtccccgccacccacaccagggggtcccgatccagccagtgggtttccaatgggtgtgcaaagctgtgggcagtgggggcaggggccagggacagcagctgagcactcggagtggaagcgccctcggcccgggcagcctggcctcctttgcacatatgccaggctcctccgcaggggcagaaaccttttccccagggtcgggtcgccccattcgagagatcaacaaatccagcctttgactccatggagcaggagcatggtggggcaggggcagggaggtgtctcctcaggatccccccgttccccaggcatcatccgcccccatcccaggcatcctgtgacatagtcttccagaggggaccgggccgggcttgtgctgctgaacctggctctggaccccgtctcagctgcagactcgcagcagtgccggagctctctgcgccccaggccctcctctgtaacgaggccctctgggggctcttgcttcctcactcaggtgtgcaatacactttgagcagctgctgcgtaccaagcactgtgctagggtgacctctggagctccaaggaaccagcagggtgtgatcaatgccgcagggtaaagaacagagcagctgggaagcaggggagtccagcagagtccctaatcaagcaaagcaaggggcaggagatgtccaggaatcagagaaggccctctggaggggctgctgtcaccttgaggcctgcaggatggacaagtgtgtgtcagaggctcaccataaatgtgggcaagcctcctataagaaggcatcgatcagtaggtggccccggggcactgccacagccttgagcacctgacattacagacccacagggcaaccaagtgcacatctgagtcctctgccaaatgcaaatctaagcaacaagccgcacacaccaggacgaacagcactgctggctcagatgaaccaccaagaacctgctctcccttccaaagcagaacctatccgagaatccctaccgccttgcgagctgcaagtccgatctgtgcaatgtgagcccctgcaggaaaaaagtctaaagtgatttttcctccccggtgctttgtgtttatggaaacagatggaaaccggccgcagacgaagctctggcatccagatttgcttccaagcggttttaccttgatgactgcttaatcctggcccatcaagggacttcccaaaatggccactttatggatttttcttttcctgtctaagggtaggattcaaaaatgcacttttcccagaaaagattttctaaaccatgagagtgaggacacggataaggacaaggccatctggaagtagaggagaaagaagagacgctgcatggggaagacaggccaaggaaggacccacctggacccacctgcgccgtctgcaggaagaggggctaggcatccctccaccagccccttgcccacttggcactcacgagcagccctggacaccagggtacaaggtgtgtccccaagaagctctgtgtgccccaccggaggaaagagccggcaggcagcacggggagggagagtgggcaggaagcagctgagctgagagggagcctctgaaccaggcaggtggtgagggacctgtcagccaggctcagggactcatgagatgataaaggcgggcagggaaggacaatggccttaggggcagccatggggaactcccaggtcagaaaaggctggatctgaccgatggttttataaaagatgccttttacacgaagcaccagggacagcttctccagtaggaatcttgtatatgaagaaggggtgggtgcggggggcactgccaatgccaccgcccaggggaccaagagatggccaagtgaatgtgatgtgcagtccctgatgggtcttgggacagaggacataaaggggaaactgaggaagccagagtcacttcagttagtgacaatgtgtccacactggttcattcattgtaaccaaagcaccaactactgtgaggtatggatgggggacccgggtgtggaatacaatcttcttttgcactagcttctcaattttgctaagtctaaaactgctctaaaatatctaggtaaagcaggggctgcccctttggcaggtcaggtgggcagcaggtcagcttctgcggtcggccctccaggacactggccgtggctcaggatggaggcaggtgaactgcaaggatccctgggcatgagcctaggtgctgccttcggtggctacagcacagtccccccactgtcaggtgctcccgggggcagcaacacccccctccatacaggggcaggttcagcaaggggccagcagcccagagctgggggccatggcccacccacgtcccagagaggctgggcagggagagaggccctgctggcacagggcccgaggtggtggagctaggactggccttcaggctgctgggcttcccaccatacgacccggagaacttgtccccagaaaagctgccttggagccatgggctccagacacagagagatgcggccttcccgcaggcatgatgctatctgcagatagcggagcgcagacgtgggacaaggccctctggaatgtgtctggacttgccccacaaggttcctcccagtgagacggggcttgtgaacaggactgagaaggaggagcgcccagctctcctgcatcccatcaggggcctgggtgacaggaggggaggccctgcatgaaggctgcaaaggagtctccaaggcaagctctgacggattcccaggcagctcgagcctccagcagaggcagcaggtggagacgaggaactgacgaggaacacagtccacagctgggaacacaaggaagggggaaggtgcagagaaaggcctgagatccatggtgggcctggcagccagccactggaaaccgccgaggtcccagacgtccttgagggtggcctacaagtggccgggaactttgagaggccctctcatgtgtctgataccaaatgtataatttaatattctatattttcagcccagacaggaattaattatttaatgtcctatcaaaaccaactccatccttcatactactccaggcagcgtgtgggggcggaagagttcagtggccccggctggcatcacggcaacactggggagggcgcagatcagacacgcagcaagtacgtgctgagaacctgccagggcgcctggcacaggatcccagcatgacgcctcctgcttgccaggtgcccagcgagtgtgcggggctacaaaggagggcgtcaaggtttcaacctagtctccactgactctccagaaggttcctctcccaagagatacagtgccgaaaacaaaagaggcaagaggcagccatccccagatagctgtgtggcaggccccaggctgtacgggacacagtggacagacaggcccagccatgccctgcagagctctcggagattccagggcaggaagcagactgtcaataaacagaaagcaaggcaaagaacatgctgggtccagactgaaccctgcagtgaagcaggtgaagcacgcaggccgccaagggcacagaccctgtccgctcagccttcacagccccaaaggggcggccctgctgtgcctggcccgaacatgctgccgtcacagccagccgacatctgtacggggctggagagcatcccctacggttcatgtccttcctggaacctcagaatgccaccttctttggaaataggatcacagcggatgtcatgagtgacgatgaggtcaccctggagtaaggtgggcccttaatccactgtgaccagggccctcaaaagaagagaaaagacatagggagaaaggggaggccatgtgaagtcagatccccacccccgcgacctctggaaggagcgtggccctgccgacaacaccttgagtttggaattctggcctccaggagagggcagaataaatcccccttgttttgcggcaccaggtccgtgatacttggctatggcagagagtggacgccagaaaaaggataaatgtcacaaacacagcgctcagcccttcagagcagacagactcagggatacaaatgtcataaggtgacccctggggcccctgaacccctgcagcagaggcagccagccactgagacaggacccccagggagcagggggcgacagctgagaggcccaggaggacaagagggactctgccatgccaagaagtcagggacggtgtgctgtgactgcagggacaggggttccaccttccccagaggcctctggcaccctgggttcgggatgtgggccccacacccaccccatgccaggcttggccccctaatggccctctttcccagggaacaacctccccaggctccatccctatgtccccaccccctgctgctctctctggatccttccctcctaattggcatggaaagtcaagtccctgagcctgcaaaagactcggctgtccccacacaccactcctggagcagatgggcccttcatcatttgctcatttcacgttcccctaatcatgcgaagagccctggtaattgacaacgattctctgcacaaatggcggacccacagaggagcgaaggcgcagagacccatccgttgagacagcctccctgccggggtgtgccaagtgagtgtggggctgacgggtgtgagccacagtgggcagtcagggccagggagaggaacagagccgagtcagctgctgacctgctgcagcagctcagccacttaaaaattcgtcggaacatgttgaaacaatgaggggatagaacaaccactcaccctgcagactcccaagtcatccccagccacggcaggcagacagcccagcagagactcccaagtcatccccagccacggcaggcaggcggcccagcagcaggcaggtttcagctcggccggagcaggccctcaggcactggacctggggaggcttccggtcacctgtgcaatgccaccagcagcttcttgcatgcttcccatgacagggagctcactacccaaggtggcggacgagaagccctcccgggatccagtgccactgtgaggctcaagtacaccccaaaactcacacttgaggtccacaggtgactagcaactttgcttaaattgattctagtaggcccggtgtggtggcttatacctgtaatcccagcactttgggaggctgaggcaggcagatcacaaggtcaggagatcaagaccatcttgatcaatatggtgaaaccccgtctctactaaaatacaaaaaaattagctgggcacggtggcgcacacctgtagtcccagctacttgggaggctgaggcaggggaatcacttgaacccgggaggcggaggttgcagcgaggcggaggttgcagtgagctgagattgcgccactgcattccagcctggcaacagccagactcagtctcaaccaaaaaaaaaaaatgattctagcaactcatgagcaaagagagggaatccaaaataaatggtaaccaacccccacgtgcacacgtgcaatgaagccacctagatgagcagcacgggagcacactgaatgaacatgtgatcattacccaccaccaccacgcgtcctgcctcccagctggaccccaggctcctccaaagtacaactcaaaggacgctcatcaaagcagtgcttccttaggcgcttgggtgctcactgcagtgggctggctgcccttctcaacgcccgccacactttgtcaattaattagggaggggggtgccagcctggggggcgtggtggggactccgcaagcactcaacagatgctggcccacccaggccagcctctccacccaggccagcctctccacccaggctggttcccaggctgttactttatggaacatcagcaagctgaccgcttggcacagctgcctttttctatatgcataagatgcttcaataagaagcttgctaaaaagaaaaacaaaaaaaaacacctctggctttaaaaatgttttaactccaaagatttttaattagctttattcactcaaaacacacggataagcttgacggctccgtgagaatgctggtagggagcagaaccaaacacccagggaaggaagcaccactgggcaggcagctctatcagagaccacaggtgcacacaagcatcccctcccactcagccagaggggcgcagcgctgtccacaactcacaccctcagccccacttccagcctgatgaacccacctgagccagccacagtgacaggtggagcctagatcattccaaagactccaaagataatgccaaaggctccacttccaggccgatgacaccatctgagccagccacagtgacaggcagagcctagataagttgggcccttctggagggttctctccagaggactggcaagcacagccaatattcatcaaaatgcatgaatcttctctgaaccagtgacttcatttgctccagtgtcctgcgattgattcttctgaacttctgagcccactcaaccaagggcggcccagggaagggcatgtatgcagcccccgcggctgtctacttggtccatgtccagccgcagtggaagcgcctgccctgcccagctgcactgtctgcctctgcttcttccccacaagttcaaggtcggtgtactcaggcatccctgtcacatcgatgagcaaacatggcccagcgatttgtgtttctcagagccctctcattccaaaacaagtcttgatccaagggcacagcggtggccggtacttcctgagggcctgccactgtggactctgcaagtgtcgtatttactaataatggtgcaccgccaggagcgtgcaatgccattcagattttacacaagcaaggtgctcaggccgcaggggagacgtgaccccagggcggacccctcccaagcttggtgtggtgttctgctgggcccccacctccaatttccatctaacagctctgaaatgactggactctgcatctggcctcaccaggtgatgctcagctgccccaagatggaggtgggcacacgctccatgccatctccctgacctcgcaaacccaccacggtgccggcacaaacccttcacaaagcactcacccacttacccttgggctggaaggaaccacaggcgccactgggacggcccattggtgacaaccaaactcaggtgttcctgagtgttcctgagaaccagagttctcagctacctacaaactcaccattaaggggactatgctagacaaccaactttaaacttgttacaaatcccagagagagaagcgtgtgcaggagactggtctggtcccatctccgtactgacagctggggggcgggaaggcccagccgggcccagagccaccctgggaggctgagatgcagctcagaaaccaggggtgaaggggctggagcaggcggggagggaaagacaggaaggagcacccatgtgggacccagggtcccagacaaccccaaagcttcctgcaggtgggaaagctccgccacatgcaagaaactccgcaagaatagcacatgaggggctgggcctcgtctgatgcttgcctcggcccagaggcatctgagcagtggccacaaagcctccatcctggaggaggagtctcagagcctaccgcgtgcctaaccctgccacagggaggtcctttataattcagaggctaagtaacctgctgaaggtcacccagcttgaaggactcaaacccatgtccatctgacgccacagtctgagctctggccagggtccagctctaacctcgtcccagacaagaggaagccccagacttgacagcaccacacacctgagcctgggccccgtgtcggagtcagtgaggcccacgtgtttgcgcctgtgtctggggggtgcaaatccccaatctcctactggagacaagaaaacaagatgggcccagagacagcacagagcccactcagccctgctccgcggggcacctgcacacattacacaccccgccaagaccttcctcttccgctggcaacacccacgtccagaacaaccccagtggctgcacacagggtcagagctctgttaccaggagagcaggtgaattctgcaagcacaaaagcctgtgttcataatccatactccaggggtctgctgggcttacaggtcccctggcttggggcaggtggacaggaaaaggtgtgttccactcttccaagatgcacaggaggcccaggggcagaggcggcccttcaggcaggactttcccagtcccatgggggagggaagccagacaaggcaggtgccaagccccccctccccaccccgggccctcctgctctccctcagcagtggtggttcccagaggggttccctggggctcagcccaactcagaggagggcccagacagcaggccccacgcagaaatcgcacctcctttggggcagggtgaggtaggggccatctgctgggcccattcagcaggaagggacctcttcacctccacagccctcagggactccccatggaaactaattgcctcaaagcataaaaccaccccaggatgggggtgggggaaggggcagtgagggccccagacccccttggatgggaaacaaagctgaacgcagctgctccaagcccacccacctgctactccagggagcgcatgccccagcagaagctggattttcagaggtgtggacatctggccccagggaattcacagggcctaagatcctgccctaactctaaaaacagcaatggcagccccagggccatggtcggatcccaccctaccccaccccacaaaatgtaacttcttaaccattttcaaatgcacaagtcagcagcactgaactcactcacactgtgcagccatcaccaccgtcacacacacattccccacgcgcctccctggggacaccacggactccacttacccccagcagagaccctccccaaccccagcaccccagggacatcagaggctgagggatgagatcacagcagccaggacacagaccagagggatgacggccagcctgacacggcgatcagcgaggccaggaaccgcccctgcccctgcctctgcctcccatcccccgccccccacccaggggctgcttttgcatcttcaggggagggaaggtaaggctcctgcgtggccagcctcctcaccaccagccctgaaggaaagacgaggcgcattcacagcgaccctcttccacgtagagcaacgcagcgtccacagaaggcagccactcctctatgctccccaccaggaacccccagttcccaagcccgagcttaggctgaagggtagaccctgcccaggagcaccccttggatgagccttgagggccttgtgctaagggaaataagccagtcacaaaggacaaataccacgggactccctacaggaggtccccgcaggactctcttacatgaggcccctggagccggcagactcacgcagacagcaagcagaagtggggagccaggggccaggggaggctggggtgagcgctgaatgggggcagagtgtccgcctgggcggatgaagcagttcgggagacggacggtggtgacggctgcacagcaacgtgagtgtgttcagagccaccgacctgtgccctggaaaatggttaagaagctaaatgctatgttctgtgtattttaccacagtcaataaaacaaaacaaagcagcagctgcatgtgggggccacgcacacctggatcttccaggcctccagctcttttgaacccaaggccaaacacggacaggcaggcccagacatgtctgtccctacaccaccggccctgggtcatggggcagtttccatagaaaccgctgtgtccaggagccacgtcactctcacagatggacagacagacggatgcagctctgggaagggcttttccagcttccacatctccaagtctcagcctcatcgtggacacgataagaccaacgtcccccaaacagggtcagagctagacaaacaccagactccaccccaattagtatcatgagcctgagccgactgatctgttccaaagggcgtcatcccagcggctggctgcaagatacttaacatttaatttctaggtccagggaggctgccattagcaagattaattgtgtgcacacacaatttaatttcccccacctcagaaacaaaagtgacacttaccccaattacaggacgctgggccctggcggacagcccgtcattcgcattcgcaaggagacgacacgaacagcatggaaatgaagcgcccctgccaggggggcagggacaccgcgtccccgtccctggggaagcctcacttctgaggagctctttgctgagatcaagatggcctgaggcaggtccggcagggatctggagctgagctgaaaggggtctcagtgctgcctgctcttccgccctcggggtgggaaaccgaggcccagcaaaccacaggcttggggtcggataccagatgaccccagacaagctgacccccaggtcttggcctgggttcctcgtccaggaaactagagtcatcacagtgctcctcttacagcgggtgccgaagggtgggggctcacgggcacgagcctagaacatgcccacgcctgtgtgggagacagcatgcccactctgggtgctagctgctggctttctagactggcctgacccctcctaagagcctaggagtcaaaggggtgggggaaggcggccactggcacagtgatctgcggtcctcggttcccttctctccccaaggccaccctgagacccctggaaagactaagggatgcttgggagggaaaggcactgggtccagggcctgggggagcacatagcttgccttggggcaggtgtgggcagcccacagctccgcagcaaggaccaccccagtcccacactgcaactgcacaaatacattaagccagccggcccgtcagcacctgcttcctcagcgaccgagtgcgtcatgaaatcccaggaaactccccagggcacccaacgaggctcggctgtttgttcagaagacatttcatttacacacacacacaaaaaatttttttcttctctgtcccccgttaaacctaatcaggcttccccgatgtgatggtgttttactcatgtctcaactgttaatgtcgatacaaggctgaagaccccacagcttccatgaaaaaagaactccaggctggaatattagtgtttcccatgaataatacatgaccccgcagggccactcctgggatgactccacgaattactgtctctgcagtggaaggacctgtcatcctggctgggaaaattagctagtaactaacaggatatgggcacactccgggaggctatggtgccagggtgtgggatggtgactcgcaggggctgaggcaggtccccaggcaggagtggcagccagggcatgggcagcacggatcgtgccagcctggcacatccacagggcacagagccctccacacagccgagactccagggggtggaaccagggagcccaggccgggagtctgggcagtggtttcttccgaggagccagaactcggctccaccgcgaccacacggagccttgctgcctgtcacagagggactgacggcgcgtctcacgcaggccgtggggcaaccaggaggaatcgtggctgtgagtccaggagtgagcacggactgcagcttcccagccccggactacatttcttccttccaagaggtgcaggaagaaaccacttgggagagcagaaatgggaaaagtgccgagggtcaaggggccacggctctccctagctggagcaaagacgaccgccccccaccaccccctagagtccctctcccctttgtccatgagaggcagatgcttgatggctcaggactgcctgctaaagacagcactccccaccctcccttgcagaaaggaatggccccagaaccacgctctggacactgtgtaagaaaggaaggggaggtgaggaagggtcatgcacttaaaaggaaacagctgcctcccctgcttctttcctgctgcatggaacacggacgagatggcaggagctcagcagctaccttgaagcacttaggtggaagccgcacgctggtgacggcagagtgagatattcagcacgcctgagctgcttgtggggactatggcactgcctgggatgtgggcactacggaggggcatctctcttgctacctcactgccagccacccatccctgcaaactggcaaggacctgccacctttcacacctgataaacaaaaatactttaaggtcttctaatatctatttgggcattttctggtctgaagtggggaagttaaatgaaataaggtagaggagtgaaaaatgtaaaaaaggcaaagaagattttctctccaaggctcttgcaagggagcaccagagccctgctcaaggtgctcagcaagcagaggcccgggggacaagggtgcagggggctgccagggcccggcactcacgccaccctcaggaacacagtctccagctccagcttcttctccctccctccctcccactctcagcaggagggatgggggggagggtggtggggagggatggagggaagggatgggggatggagggggagacagaggggaggaatagaagggaagggatgaagggggagggataaaggggagggatggagggggagggaagggagatggaggggagatggaggggggatggaggggggacggaaggggagggatgaagaggagggatgaagaggagggatggagggggagggatgaagggggacagatagaggagaaggatggaggggaggcatggagggggaaggatggagagggatggaaggcgaggtatggagggaagggatggaggggaaggagggaagggagggaggggaaagaaggagagggatggaggggagggagggcgggggatgggggagggatggagggggaagcgggagggatgaagaggaggaatggaaggggagggatgaagggggagggatggaggggagggatggagaggaggcatggaggagaggcagggagggggagcgatggagagggatggaaggagaggtatggaggggagggagggagagggatggagggggatggagggagagggatggaaggggatggagaggagggatggaggggaggcatggggatggagttgggagaggtggggatagagggcgtggagtgagaatggaggagaggggtaaaagtagtggatgagtggaccaaggcattcgggggagaggtggagagagagggagagaggaaaaggggatggaggagagggacaaaggacggggtgccaggggtgtggggagacgaaagggatgaaagaggtggggtgtggggaggagggggaaggagagggatgggggcattgggtacggggtggaagggacccaagggcggggtgggggatgatggaacagaggccagtggtgcaggggaggggtagagggggataaaggggagatgaggggaggggtggggatcagcaaggggcctgctcaggtgccagtgggaacaggtgtcccgggttggctgcatggggctgtgctgctaggaagtgaggcctcctggtgcttccgcagggctgcagggctttgtgagccaggagtgtcctttgaacacaaacaagcctctgtttattttggaaatgtgggggctgaggaggtggggagtgaaagctgacactcattagagcacccttaccagtgcacacacctctgtctataagcacactggggaggagacagaattaagtcacttggccaagatcatcccaggggtcagcaaaaatcaatctgcatcaatccctgggccccatgcagggctcggccaaagggcagccgagcacctaacccgcctggccgtccctcctgggtctccgtgcctgaatcgggcgtcagagtccagcagagacaactgtccttcggctccaacagggacacaggggcacaaggagctcaggagggcagggcaggctgagctgcagggctagagggaggagaggactcacaggccagagatgcaagaggaggggcgaatccgggccaggcttcagctcagaggccattgcagacgagaaaagcggacctggcccagccttggcaataaaaagcattccaggttcttgtaagggggaaagaaagagccaagcggtctccatccacggggaacttgcccgagcccacccccagaattatcatcaggatgatgtctcacaaaaagacttcaaagtgagaccaggaacaccatcttcctggtcgtgaggagcaggttttgctgggcggtgaggggccctggcccttagacacgcagtaaggcggactcagctgccctttctctcagaggacagcacggtccaagatctatggctctgagtccgatctgggcacttaccagacagcctgagtcccacctcccgcgaagactcctcttgccaccctcccaaatccacaggcctctaaaggtgggagtctgacagccaggtgccttcaggctgtggaggggtcacacaaaggccccacagctgcagggtggagggtggagagggctgaagaggaagggaagaaggagaaagggagggaggaaagaaggaaggaggctcgggtggcgaaggcggcggcaacagcagctgggcctcagctggtcctcggtcccacagtcgggcagcgccacggtggggcagcgtggaggaggaggccctagcgacaactctggggtcctcaggtggcaagggacctgccccgcacggccgcctaccaggggcgagccctccctccccggccttcataaaagcaaaatctagacaaaggagccaagatggccgacacccactccggccagctccaaaggtcaccttcaagaaacggagtttgcaggaagtcaacggtgcctgcagaacaggggcgagcacccagcccagccaaggccaggaggagcccaagccttcctccgtcgccacacggcagctttcattgcctgaacctcggagggtggcgggacggtgattccacccacagccgcgatgaccgaggcccagcatcgcagcaagtggcagagaagccagagtccaactaccgcccctgaaacccaccgcacctgacccacacagcagcggcgagagtcgggcgcccacgtgtaccacacacacagttgaatgctttactggacctcacggatcctcacagacctctggaaagttctgtcgtaatctccaccttacatctgcagaaactgaggctcggggagaaggaagacagtaacgggcccaaggccaccccgccaagcagcatgacatccaccccacagcccatggctgagaatccatcccccactccccgcctccactgcccgtcagaattcagggaagctgcacgggtgagaccctagaggtcacctcgctggatccgccacagtacccactgccaccaccatgtccgctctaaagtgcactgtgagggatccagggaccgtggacacacagggttccaccctttcccaaggatgggggagccggggcccggcctggccagggatggtgccggccatcagcaccggctgcagccagacccagacctggtgcaactgacccaagaaggagacctaagctccttcaacaaaggctggtgacaggagaggcggctgggtgcatccatccacaaaaccaacaggaacactgtggccacaggagccacaaggatcacagggcccaataaaggtggaaaccgcctttacgccctctgagcccaaaggagaggcccccagaaaccccagagctccccgggtgaccctgcacaaggcggctgttgggaaattttgccacagttgccctctgtccagggaggcatgagggcccagcagggttcacaggctcccaggaggaggaggggccagccctttccccaccgtctcaggcagatccttaaccccaaggggaccacaaacccctccaggaatctaaggaaggctgtgggcctctccccagaacacagggcaccccaagaggctccagatcctggcgcccaccctggacccccagagaaagaagtccagacttggggcccctgaggtgaaacagcagcctgtcccccagcagggcctgccatgacgctatgaccctaggcagggtccagagctgagcactctgctagccctcaccggccctagaccctggggtaaaggacaggagacagcacaggcggaacacagagccctggccatcggtgtcaccgctgttgacgtgggaggcaggaggaagggcaggggttgatgttctgaagatcgcgtggggggcgtccggagatggtgtgggagagggcggcaagaaagagggagtcaagctccaagccgaggcaccgagggccgcccgcaggagaatgacaccagcacaaggggcaggggagggggacaggggctcaactcctacagcaaagagtcaacaggtgttgaaagcagggaatcaagggctgggctctatggagatctctgagggctccaaaggtgaccgcaggagaattaaagacacagttataggtgcagctcctgggggaggcctggcggggctggggtcggggaggcaggaggccaccattcatttcaagcctgtctgtaacatgactctttctgccgtgcgcatctataattaccctgcaaaaataaaaaataaaaatgtaaatgagcaactcaaatgtccgtcaacagatgaatgggcaaacaaattgcggtggagccactatggactatcacgccgacgtgaaaaggagagaagctctgattctcaccgcaacgtgccagcgggtgccagccaggcacagggacaatctattgtgacattccatttataggaagtttccagaccaggcaaatccacagcaatttgaattagtggctgccaggggctggggaaatttgggggggatgaggagttactgctaatgggttggggtttctttttgggggtaatgaaagcgttttaaaattagtggtggatacatggccttgtgaatacactgaaaacccctgcactgcacacttcaaacgggcgaaccccatggtgtgtcaactgcatctcaacaatgctgctactttaaaaagagcaagaacatcagctttctacacactggcaaaaaactgtcttgtaaggccagagttgtctggttctcggccttcttaattggcagccacactaaaatctttttttttttttttttttttaattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcataacactaaaatctttattaacgttagtaggtcgggcgcagtggcttacgcctataatcccagcactttgggagcgcgaggcatgcggatcacttgaggtcaggagttcacgccagcctggccaacacaatgaaaccccgcctctactaaaagtacaaaaattagatgggcatggtggcaggtgcctgtaatcccagctactcaggaggctgagacaggagaatctcttgaacccgggaggcagaggttgcaatgagccaagatcgcgccattgcactccagcctgggcaacagagtgagactcagtctcaaaaaaataaataaataaaataaaaaagaataaaatctttataaacgttagagcaggtcgaaacgtggggacgacagccactctcgcagcgtcagatctaggcaactttcgtcattggctccactatgcgaaactttcaaactgttgttcaggtcactctcagagggcagttgctcatttcattggatccgagcgccacttcattcacataagcaacactgtaattccattctggtttgatttcagaaattctaccagctgtgtctagaattgtgtttacgaagaaaagttgatattaatataaatgacattttcttttcttgtcttttgcttaagaaacttcaaaaaaaaatccaaccaggcgggtacagtggctcacgcctgtaatcctagcactttgggaggccgaggcgggcggatcacgagatcaggagatcaagaccatcctggctaacatggtgaaaccccgtctctactaaaaatacaaaaaattagcccggcgtggtggcgggcgcctgtagtcccagctactcgggaggctgaggcaggagaatggtgtgaacccgggaggcggagcttgcagtgagccgacatcgtgccactgcactccagcctgggcgacagagcgagactccatctcaaaaaaaaatcccaaccgaaacagatgttgggcttgtgagaacgcagcactaggaagcgactcgggagcctatcggcacatgctggttattgctgaaggacgcgggaaaatgagctgacactcgggaagaaagccgctcctttgagcagcagcaagagactaagtccccctccttccgcccaagtggcagaggcgtccaggcgggtgccagcctcagcctctcactgggtcaggagcccagcacagggcacacccaggtagggagcctcacatctgggctcacacccacagccctgctctgcccccctgtaacccaccatctggcccatccctcaagacatcttccacccctacctcccattcatcacctgttacccagatggctgggctgtgtctccttgaacgaaactgggtcccaggagggtgagctccttcctgtctcccccagcccagagctgagcccagcttcatccatggtggtcaagccagagagctctgctgtctccccacctccgcagcaacacaggcccccctctgggtggccaaaaggtgtggctctaagccctccatttccagatcgtccatgattgctcttctatgcctcgtttagtgaaggccaaatatggaatttccaagtcgcctaaggtcaagataatgccagaccatgaccatgcagatgcctgaaatgtctgtatttaattaacgctggaggcaaaaaggtcactggtattaatggagtgaagaaaaaacaacccgcccccaggcctccagaatgtctccctgccagggagacagcagcctctgccaattaaaactcctcttcagaagcgtccagcacccaccaacttcagaaaacctgtgaaggcagagacaggcagctggcttgctggtggttggaaggggcccagcagggcttagggacactctgcccagacagaccacgcaaagcctcctaccagggaaggccacgatcacttccccctttgaaaatcccaagctcttccaacatactgcatccgggtaccctgaggctgggagggacctcggagatgggcctgccccgggctgcaaagcacagagaaggaaactgaggccgggcgggcacaggttgatctagtgtcaccggcagccgacagggtggccagaggggctccaaggctgagtccagcgctttctccacaacgccagaccctcaacagaaagagactttttagggcggatgtggtggttcacacctgtaatcccagcactttgggaggctgaggtgggcggatcacctgacatcaggagttcaagaccagcctggccaacatggcaaaaccttgtctctactaaaaaaaaaatacaaaaatcagccaggcgtggtggcaggtgcctgtaatcccacctactcaggaggctgaggcaggagaatcacttgaacccagaaggcagagattgcagtgagccgagatcgtgccactgtactccagcctgggcgacacagcgagactctgcctcaaaaaaataaaaaataaataaaaagatcatttttaatcccctcaactggtatttaaaatcatcagttgaatggcgaggtagctggactttttatgtggtgcccggggaagcttccaggcctcatgaggccaggcctgagctggtgctgtggctctcctggcaggttcccctggtcagagccaccacaggccgtgtcggatccagggaggatgcagaccctgcctttttttttttttttttttttttttgagacggagtctcgctgtctcccaggctggagttcagtggcgcaatctcggctcactgcaagctccgcctccagggttctcaccattctcctgcctcagcctccccaatagctgggactacaggcacccgccaccacgcccggctaattttttgtatttttagtggcgatggggtttcaccacgttagccaggatggtctcgatctcctgacctcgtgatccgcccgcctcggcctcccaaagtgctgggattacaggcgtgagccaccgcgccaggcccagacccttcctcttgatgagaggaatcacagagagtttgtgggtatctttagtctgcctcagggtccccatcacaaacgcggaataacaatgtctcttccaaggcccaggaggagacgacctgaggagacccatggggagctgggactcctcaggccgggtgcagtggttcatacctgtaaccccagcactttgggaggccgaggtgagtggatcactcgagcccaggagtttgagaccagtcttggcaacatagtgagaccccaactctaccaaaaatttaatatattttatttatttatttatgagatggggtctcgctctgtcacccaggctggagtcctatagcacgatctgagctcaccgcaatctctgcctcctgggttcaagcgattctcatgccttagcctcccaagtagcaagaagctgggattacaggcacctgccaccatacccagctaatttttgtagtagagaccgcgtttcaccacgttgactaggctggtctcgaactcctgacctcaggcgatccacccacctcggcctcccaaagtgctgggattacatgcatgagccaccatgcctggcctctaccaaaaatttaaaaattagctgggtgtgccgggcgtggtggctcatgcctgtaatcccagcactttgggaggccgaggcgggtggatcacgaggtcaggaggtcgagaccatcctgactaacacagtgaaaccccatctctactaaaagtacaaaaaattaactgggcgtggtggcgggcacccgtagtcccagctacttgggaggctgaggcaggagaatggcgtgaacccgggaggcggagcttgcagtgagccgagattgcaccactgcactccagcctgggcgacagagcaagactccatctcaaaaaaaataaataaataaataaataaaaatagctgggcatagtggcacatgcctgtggtcccagctactcgggaggcgaaggcaggaaggatcactggaacccacagatcaaggctgcaatgagccacgattacaccactgcactccagcctgggtgacagagtaagaccctgtctcaaaaaaaccaaagaagaaagaaagaaaagaaaagtaaaaccatggacccattttaggaacatttcatgaaaaaagccactcctgaggccccctggtaatactggggctcagaaaacactccaacatgaaggccctcctgtcactagttccattctcccctggagctggccatagaaactagaatgcctcttcccccaagcaggtcttagaaaccagaacccctttcccctaaagccagtcatcaaacctaaaaataatactctaactgtccctccaccctatctgtataaaaactggccataaagaaattccctgacctaccttgtttgactgtaggtcataagacccaccattccagagagggtcctgccccacacccagaaggaaggggcgcggctcagagaggccagtaagaatccaggctcatctgcctgcccatgctttgtggaacttgcacataaaaatgagcaatttcccctatctttgggactttatttagaatgttcccctgtataaatgttcaatcgccttgccttttctccaattaatcaatctacctcctgtcttgatttatttatttatttatttatttatttatttatttatttatgtatttttgagacagggtcttgctctgtcgcccaggctagagtgcagtggcaggatctcaactcactgcaacctccgcctcccgggttcgtgcaattctcctgtctcagctcccccgagaagctgggattacaggtgcgtgtcatcacgcccggctaatttttgtatttttagtagagacggggtttcaccgttttggccaggctggtctccaactcctgacctcaggtgatctgcccgcctcagcctcccaaagtgctgatatcataggcatgagccaccgtgcccagcctctcctgtctgattttccagtgaaccttaagggggccaagggccttagccccaacactctcaactgatattgaaaaccatggcccagttttaggaacatttcatgtaaaagcaccactccgggggcccagtggtcacaatggcgaccatttattgggcgcttgccattcaacaggccggctacccactccccacgggtctcctcagatcgtctcctcccgagcctcagaagaggcatggttattccccgtttgtgacagggaccctgaggcagagtaaagatggctgcacactctctgagactcctcccatcaagaggcagggtctgtgtcctccccggatccagcatggcctgtggtggctctgaccaggggagcctgtcgggagagccatggcaccacctcgagcctggtctcatgaggcctagaagcttccgtgggtgccacataaaaaagtccaactaccttgccagagagcccacatggggaggctggccctgagccgcaggggcctctcctgccctccagcaagggcccggagctgccctgaggggctcctgccggcccggcctggtgactctacctaggtctgtaggcactgggctgggcccatccctcctggggtatttatttcccccactgttctgacaccaggccctcccgtaagcacagacagccctgctgtccctgactctggaaccccagcgcccactgccacattctaccttttcccaggagacgggccgatggggtcagtggcaatgtgccaccaccatcggagggggctgggggtggggaggacagctgcgctccagaggccaaaggagatgggccgacgtccctaccatgcacctcctcctaccacacatctctgcctgccttagtggtctgcacgtcaggagactctgtggatgctccgagcctccatgtcctacaggtcagaccagaacctcccacccccacctctctgggccaaaagtgacacagtttcgtcaggaccatggagatcacagacttggacccaggaagacccaatttaaggccaggcccatcagctccccctgcaattggcctccctgagacccaacttcattgtctatacactgggataggaacgggcatctgcgtcggacgtgtgaggaccacgcaggacaatccacacaacatgcacagggcctgggacatgtcagaagcctctgctgcaggacacaggacacctggccccacgaaggcagagccctctgaatttgaccaaacctcctccatgcagacacggctgcggccttggggctaccacatccccagatttgcggagcctgaaatgcggccagcactggaagcggggagactcccacattgagatgtttctgttctcccagagctccagtagagaaaatgttcacccacaaaccccccagggtatccagaggccaggggtgctggggtgcaggctgcagacaggttcccacatttggtgcaggggaagacacacatctgctcaaaagaaaaatgagggagtgtttcgggttgaactgtgtcccctcaaaaaagatacataggggtgctaatccccaggacctcagaatttaaccttacttgtacagagacttcaaagagaaatcaagttaaaatgttgtcactggggtgggacctaatccaatatgacccgtgtccttataaaaagaggaagtttgccaggcgcaatggctcacgcctgtaaccccagcactttgggaggccaagacaggtggatggatcacttgaggtcaggagttcaagaccagcctggccaacgtggtaaaaccccatctctactaaaaatacaaaattagctgggtgtggtgatgcacacctgtaatcccagctactagggaggctaaggcaagagaatcacttgaacccgggaagtagaggttgtagtgagccaagatcaggccactgcactccagcctgggcaacaagagcgaaaccctgccccaggaaaaaaaaaaaaaaaaaagaggtagtttggacacagagataggcacagaggaaagacgacaagaatacaaaaagagaagacgccgtctgcaagcccaggagagtgccccgggacacagtctccctgtgccccagaaggcaccagccccgccgccaccctgatctcagacttccagcctcatttcggttccagtacatttcggtggtttcacagggctccttccctccccgctgcactgtccctcgggccccttcctctaccccacgctgggtggtgctcccggctcagggtcccatgcccaccctgcaccgggattccctctgtgagggcgtgccaggtctgccccatcccctggagccccacatcaggctcaaaagacaggggctgaaacaacaatcccgggagatgtgacggccacatcacctgccagtcaggagaggttttgtatcacttagaaaatatgggggtgggggctgcacacaagccttttctggggttctcaggacacaaagtcggacatggcctcagccagcctcgggtccggtggctcacagaggctcacctggttttgaaccataaagaaatttagcaaaggtctacccctgctcctagggctctgatctcacaagcgtgggcgtcactgaaaaacagcgtcagaaaaaattctcaacagggggatgctggcgagggaaaaggggtccctggagggcagaaaaatccacttcgtcaggtccacactgagacccggagagggctcggggaggcagagaccctgagcttgaaagccaggggaagagtttgaagaaacccatttcacacactgagtaaaaaagggcaacttacaagaacatgttattttcatgtttttaaagatgtaaacgattgagcaaattaaatatttaagtaaatgttgaactacttcatctatccctaaaagcttataaaatcatgttgaccaagaaacttaaaatcctcttactgggaaaggggtggaaccagcttgtattttgagctgcttcctatccgggtaaattctgtgccccaaatcacagatgagcgaatggggctccagcccgtgtcctggtgggccggctccagcccaagcgccaggctctcccccagagctccgcattctaaagggaaccactctgccacacacagctttgttcttctgggagacccctctagagaactgaagagcaaatgctatttctagacgctctaagacattaaaaagacacagaagaatcccaagtcctccctttcaaaacctcaatgcatctaatataccaataaaagcgaccatcaacgcctcactttctgagttcatgtcctccagggtcccgtgaaattcaaaccaggaagcacccggaatcactcccagacgaccacgtggaattcgatgagtgagcaggctcaggacggcaaatgcacttgcaggaaagcagcccctgcaacaaagcacgtgtccagccgagcccaaacgtgggcaccaggcacgtgggcacaggcatgcaggcatgcagcacaccctctcccagtggagtcggacgacatgcccgctgctcccaggacacagcaaccggccacggggccgtcgggtgccaggtgtgcagccagggctccgtcctccccgcaagcttctcaatgcaccactactgtccaagctgctgagtcagtgctgagggccccgtgaagctcacctccccaagaaggccccagagtaccggggtgtgaacagaagccctctctgggcctctaggcacaaaatactctttcgcctgagtaaatgatggtgtttttggccctcgtccaccatacagggccacagcaccagcactgctgcactgggcagtcagacttggggccctggcagggaggggatgcagggagcgcttgggacactggtgaagggagagggtgcatcttgtggcttgggcagtgccacgggcagcaccacacgtggaggcttctcccagggcggggggctctgagcagctgccctgtgcaaagtcactcaccaagccctggcccacacttcacagcaccacagccagaacagtggctcagccgggcgcggtggctcacgcctgtaatcccagcacttcggaaggccaaggcgggtggatcacctgaggtcaggagttcgagaccagcctggccaacacggtgaaaccccatctctactaaaaaaaaaaatacaaaaaattagccgggcgtggtggcgggcacctgtagtcccagctactcgggaggctgaggcaggagaatggtgtgaacccaggaggcagagcttgcagtgagccaagattgtgccactgcactccagcctgggtgacagagtgaaactgtctcaaaaaaaaaaaaaaaaagaaacaaaagaagaagaacagcagctctgggtcagggaggggcctaccaaggacatgatgccatcctgagcccaacatgcccatcccttctccccagctccagctgcctaggccctgccgactgccattgcccttccttcctgccagcctggagactgaagcagcacagaaatgacctggaagaccctcagggccctgtgacatctggggagctgatggacaatggggcctgaagaccagccctggggggtagccacctctgtagtggatcactggggctgcagcacagatgaggctcctatagctgggcgaggtgactcacacgcctgtaatcccagcactttgggaggccgagacaggaggatcacttgagcccaagagttcaagaccagcctgggtaacgtggcgaaaccccatctctacaaaaaaaaatacagaaattagccgggcgtggtggtacacaactgtaatcccagctacttgggaggctgaggtaggaggatctcttgagcctgggcggtagaggctgtagtgagccatgatcgcgccactgaatccagcctgggcaacagagtgagaccctgtctcaaaatatacaaaaaaagaaagaggttcctacaaggaaactgcctgacccttagaccttccagacggtaagtctggaggtatcggcagtccccagtgtggcgtggatcccaaaagctacaggtgctggcccctccatggcctggggctctgtggggaccttcaaacatccctgcacacatcaccgtgtgcctgcactatctgccagggtcaaaatgcccaagacagtgatggaaacgcagggctgttttccacgaggggacctctattaaacgcagccacatctcccagtgtgggaggaatcgtggtgttgacaatgtgagccatgtcatttgcccctcctgctccaaatgcaagttctaggcccatcacagtcctccggggagccgcccccgccctgcccactcgccccactgacagctcagactgcaccaagcaggaaggctgcagagagccagccaggacccccagcttcaatcctgcaaggacgtgggagccactgggcccgatcagccggcaatgaaaccaggtccatgaaaacactgatgagaccatggttgggcggagcctcaaggcacccctgaggccaagagactgaccccacaccctggacctctgcacacaaaactggaatccacatctccccaagtcacccatgacctcacgccgcagaacctggcacagctcacaagtcagaaccacagacacaaaacccagtggcgcctggagagctgggggcagcggggtccctgcggagccaggctctgggtcctcagccctcccttctgacgtgcggagacccatggctctacaccgggggccactcaagtcactgcagctgagacactttggggaccctcgccccgtcccatcccttcacaacagacagacatagagacctgcaggagcagggaccctggcctgccactgggcccagcgagcccctccgtgagtgatggccgctatgctgctcggccccctcaggcctgcctcagcctggctggccggcggcggggggagggacaaggacctggtgtggccctctggtgtccacactctcttgtccatacctccttcagccaaggccccaaacatgttgccaagagcagtgacgacagggagatggctgccggtgccagcccacgctgggcacacagacacatgcggccccagcacctcaaattcatcctcgctccctacagaccatcgaacccagcaagccctgccctgcccaggccaacaagcccaccaggccagctcagagccctcaggccacaccagaggaaggccactgctccccaaggcccctcccggatgccggtcactccatcccatcacggttcaagcccaggccgatcctggctggcacttgtccctcatacaaaagacagaaggaacctcacagccacgccccagctgaccttggtggcctggagacagaatcaggagaaagctctttaatccagctggttcagcaaacccaggagactagctcctcggctgactaactttaagctccaccacgttggaaagccccctgggagatgttttaggggatgggagaaggcctcgctggaatcaaaactgatttatggactctggaggggacgctgacatttcctagatccaccgccatcctcgtaaatcaattcccactctccgctcggctcgggccatgccagcctttgtaaagaaatgccaagcctaatgagttttgaaacaaccaggctgaaagtaacaaagagaatgccagtcattggcagtccaactgcagtggcacagacggcacagtggggagagccgggggcgcccctcccaccccaccccctttcctttaccgccctcccccagagagtggagggagggcctggggcacccctcccaccatgccccccttccttcaccaccctcccccagagagtggagggtctgaaggcgcccctcccaccccaccccccttccttctctgccttcccccagagagtggagggagggtctgaaggcgcccctcccaccccacgccccctaccttctctgccttcccccagagagtggagggagggtctgggggcacccctcccaccaagccccccttccttcactggccccccaaagagtggaactgggtggaggctaaagtgaggggtagccctcccctttgaagtggcaccatagtccttgcggccacttaaagcatgagctccaaggggccaggagatgggcggagatggggtgagcctggacccgcagcaggaaaagacagagggaaaatgccaccctagaaactgagacttcgttccccagcattgccacacccaaagctgaaaccccccatgcgaggccagtgggcaccctgtccttccccagtgggggccctcggtcactcaacctcacaccctcttcccctggaaatctcccctcacctctcagacctttccctgatgcccccaagccagacaaggacccgccccccaactgcagtgaccaccccaacctggtgtccacccccagcccatcctaggcccccacagcaccacctggtacacaaaggcaccctgcaccaagcccagagcttccttggaagtctggaatctttgaacctaacggcccaggaagactcagggagtggaaggcagcaggctgtagtgggtctgcgcctccactatgggaaccgctgggagggcgtccccacgcccttgccagcgctgcacccctctgaggcagacgcagctacaaaccaggtgccaggagcaggccccctcgggagcggacttccaaccgcttgcctggtttggttttgcagcccctgcagttctgaaaatgtgtggggacccaggcacccacaatctggtgagggcaaggccattgtgggcccagtgggcatgcaggcagctgcgctcccagaatctccacacagaactcacaccttccactaaaaggggcagggacccacgaggaatgattgggaatgaacctgatccggtaagaacatcgaactcaaaaagaaattaactttgaattacaaaactgcaaagtagggacccaactccaggcacccctagcaatcgcgaggaaggatggatttggctggcccagcctggcagaggaagcatttgatgaagatggttattgactcattccgagaactgtctcccggtggagacaaatctggacatggggaggttgggctgggtgttttggtctcattgcctcctcagaaggggggtgaagatgtgagcggcctcccccaagtccctggcctggaagccactcacagagctgagtttgagtcctggagctcagcaggaggttcaaaactcagttctcgcactgctaactgtgggagcaactaacaatctctctctgcctctgtttctccatctgcaaaatggatcagggtaggtcaactactgcagcaaacaaagcctggagctaaataccatccagctatgggccccacctcaatgagccacacagagtgctcagaacagcgcctagcacaaatctgtgcccactgcaggttcgcgaggatggaaggctgtgccatccacaagagatagccagcggctatctcttcctccttgtcactgacaacatgaacgcagagcttgcagactagatggtccgactgggcaaagagggggagacagccttacagaagatggcagacacacggtgtgtgaggccggaagaaacactctgccctgagactcctctcctctatttggaaactgcgcctgaggattgtattaatatttccattgattaacatgccctcttacatcccaaaacacatgcattaacttcagattctttatgtgtgccaagaaggatgagcctgccactcactctctgtccttcgcttggctgctcacagggcaagggcagggctgggggcctcccatcctccatcctcccctgcatccttaccagctatgctagcactccatcagacagccccccacgagccacacgagctatgccaggccatgtgactagaatctggccaataaagaggaattaacacagtgactggagcttctgaaaagtcggcttcaatgaatcagcttcccccaccccagccctctctattgcctagaatgaagaagtgatggctggagctcttgcagccattgtgaaccatgaccatgaggatggaagaggtagaacaagaagctgggtgcacctgggtccctgagactatggcaccgtcacccctattctagactgcctacctgcaaccctccaagacgaacaaaccctggtgagtttcggctcctgatgtactggggtttttgttagaagcagtcaagcctactctaactggcgcaagctgcgagttcagaccttccagatggaggcactggactgaagggggcaccgtgcggtgggctctctcatgtaaccggcaccaagcccatttgacagatgaggtgccaaggttcagtgagtcacttccccagagtcacacagctagaaaatcagggacagaaggctgggcgcggtggctcacacctgtaatcccagcactttgggaggctgaggccggcggatcacgaggtcaggagatcaagaccatcctggctaacacggtgaaaccccgactctactaaaaaaaaaaaaaaaaaattacaaaaacttagccgagcgtggtggcgggcgcctgtagtcccagctactcgggaggctgaggcaggagaatggcgtgaacccgggaggtggagcttgcagtgagccgagattgcaccactgcaccccagcctgggcgacagagcgagactcggtctcaaaaaaaaaaaaaagaaaaagaaaaagaaaactggggacagaaatgcagtcagagttgtctgcactggtacagaggcgggcacgggagtctaacacagtcccgcagaccgcaagcccatcccagcacaccgtgtttgtctatgggtcacggcagtgatgggacagagccagagatgaagctacagctgggagcgccgtggcctcctgagcaccccagctcctggccaggctacatgggctgcaggaagcagggccgggcacgccccttcttgggagcacaggtctgatctctacagtttcatatttaccgaaaggaatgtattcacgcgtgcactggggaccggaagcacatttttaataaaaactaaaaaggaaagagcctgcctcactcactaagcaagtcccaccaggaacacacccgttccccagcccttcgccctggagcgtgctgcccgggagaactttctgtgaagagagaaacgccgtgtctgtgctgcggatgcctgggccgccagccacacacagcctgcacacgtgaaatgcggctggtgagactaagaccttgacgttcaactgcattgaatttaccagacctgtattaaatttaccatacctctatggaggtatgatccacagacgataagctgcacaccctccagagagtgtcatgtccttatttttacatatgtacacacccgtgacactgtcaacacagtcaagacggtgaacatattcaccggccccaaaatgttttctagtgcccactggtgaccccccactgtatggccagtgtcactcctgaggcctaagtcagggtggcaggcactttagctgtgcatcaggtaactcgtctttcctgctcccccatcaacctcctgacctctgcatcacacacacactaaagacgccatgtccaaaagtaagcgcattaaacaaggtccgcctgggcggggagggctgctcgtcagcacaggccttcagcaagagcctcagggatgccagttaccaaccacacaccgaatgtcctccaaacccactctcacgtggcccagagccccacaggtcaggattgcccaggccaagaaagtaagtcagattttctttttttttatttccaacttttaagttcaggggtacacgtgcaggatgtgcaggtgtgttccataggtaaacgtgtgccatgctggattgctgcacagagcatcccatcacctaggtattaggcctggcatccattagctatctttcctgatctcctccctgccctccaaagatggctgattttcaaagatggggtgtcagctgagctcaggacagccaccagctcccgctggtgaacttagatcagctgcggctacagtcccggcctccaacacacgtgggagaagggctgacaaccaggagtgttttagtacaaaacagacaaaccagaaacctacggcatcaggacaccgtcaccggaggatggtccaagaaggcgggaaggccttccaggtctgggaacatgagacccgggctgaacacgaggctatgtccgtccaaatccccacagtcctgccacacaaacgagccggaggcttctggaggacagtgtgcctagatgaaggaaccaggacgcagtggcgcttttccatctgtaccccaacatgtcagggtatatcaacacccatatgtcactggtgctgggtccgagcatgggagctgcagccaaattctgggggtgggggcacacggggagaggttcctgcaccctaacgtgttgcttctctgcccatttcaatcgcggaacacaaattacacgtgtgatgctcttctccacgtgtgcacagcactcccgaggcgctcccaagctgtcaggcagccatcctcaggggctgcagtcaccggtggttgactattaggggggatagttgtgttcttttatttctgcactaagctaataagtacttgttcagcccctctaaaatcacaatcgtcctgtcctcgttccgtccctctaaaatcagagtcgtcctgtgagccagtgaccactcgtcccaaacatagcttctattcatcagaatcagggctcctgatcctggtgactttaaggaggaaaatccaacttcagccagcacagtccacgggcggtggagtgccatttggaaccgggtttgggaggcaggcactgtcctctgaaggcccagcctgaccctgcacacccagggctgttcgcagaccgtgcaaacctcacctcacttccaagacaaacgtcagctttgggtggagccctttgccccctcttcctctccagggagctggcactctgagaggggcgcccccaacacccacctctggtgagacaatgtcccagagcccagtgttttggtgactctgggctggaacaccccctgtgctcccaaacaacggctcatagctggcgccacggcccccatgagaaggacgataaaaacacgcgttgccaccacacagaacgggagacacacacgaaaggtaagacaggaaggtgggaacgatcgcaggcaccagccacctggcagtcagcacagaagggacctcactacaccagcgagaagaagaaaccaaagtccttgtcaggggtggtgcgcgcttcctggtgccccactccggaggcttctatgccagggatgccaatcagaatcttcaagggcggtttctccaaaaagtgcagaaatgaccgatcctttgccccatctgcccttggtaaaaaaccaaaggcagagcctgcgcacatggtcccaggaggcgggggaccggacgcgcacacagtaggtgcacaatcgacactcatcacggaacctgccagttttctgaagacctacagggagggggcaaagtcagggcaaacagcagggccacgactgagaactcccaaccccatggagatgctcagatgccaggccttgggcaccgcgcccaggtcagtgagcctcggggccggctgtacgctcgtgggagctgacactgccattgggggcagccatggtgggatattcgggaagcaggtgagcaaaggaggagcaggaggtggagcccgcagcagacagaggcccagcaatgccagcctggctgtcctcagccactcccccagactctgcctcccacctccctggagctcttcgaaggggtttctgtttggtccccactccaagagccgctggctatgacttaacattatcctgaaacgtaaaccaacaagcaaccaaagacgatgctcaccgcaaacccctgagaccctaagccccaggaggtgccctggacagtccagctcagtcagaaaggccagcctccaaacccagcatgggctgcctggggcttcgagacagatgtgtctcacagcgggctaagcacacatcagaaaaggcagcactcactgggccagacacagaattaccgtgaagcccagcaatcccgctcctgggtatgtacccaacaggatgggaagacaggtgttcagaaatgcaccgggacacgaatgtccccagcagtgatcttcacagtggccaagaaatgtagacaccccaaatgttcatcagcagacggatggataaacaaaacgtggtctacctggaccgtggaatattcttcagccagaagaaggaacgaagcgctgacttagtgagcctggaggacaccacactcaggggaagatgcagactcaaagggcgcgcagcgtgtgactctggtgaccaagggcagtggggatggggtgggggtgacggctgccaagggatgggatttctgctgtgtgtattcctaccaccagagagagagaggagggggagaggaggggaggaagcaggaagcaggggaggggggaggggaggaagcaagggatgggggagggaagcgggaggggaaggagaggggagggatcacgggagggggaggagagggaaggggaggggagaggagaggaggggaggaggggacgggaggggagaggaggaggagaggggaagggagaaggggaggggaggggagaggttggcattcacttctctatctctgttgccgtcccacagctccacaaagtggagagggaggtttgggactttggaacaggtgaatgtgaccaaggtcaccggtccactcagcgccacaccagtgctgggccaagcggcatcaaacccaggacagctcgcacggggggaaggacctgggagggagcagggaagcacgggtgctgtgtctgggaatcttgaaaacaccaaggagtgctttgaaacaggccgcttggccggaagagcaccggcctgttctccattagtgtccccttttcctggctcagggagttcacacccactttctgacgccttgactctagtcctcattggctctggggacatcagggaattctccatggtggggcagagtggggacatccacagctggaagccacagtcagcccccacaccaccgtcccgccctccttgtgatcacgtggtttcacgactacactttttgaattcccggcagccaccatccacacccctcaacctgatattttcaaggggattcagcacgatctggcgttctacagactccacctgccaacggccagctgactttctcccaaggagcacaggtggtgcaatgaggaagtctctactgaaaaaaatgccggacaaggggctgtgcccactttacaaagcaccctgaaaacaggagccctcactgggccccttgtctccatggagaagacccctagaaaaactggtgccagtctcaaagacaaggcgcacacacacacactcccacacaatgcacacataatgcacatgtgcacacgcacacgatgtacatgtacacgacgcacacatgcacacacacacaatgcacacgtgcacacacaatgcacagacgcacacgatgtacatgtacacacaacgcacacatacacacacgatgcacacatacacacaatgcacacacgcacacgatgtacatgtacacacgatgcacacatgcactcacacacgcacacgtgcacacacaacgcacacacacacgatgtacatgtacacgcgacccacacatgcacactcacacacgatgcacacgtgcacacacaatgcacacatgcacacgatgtacatgtacacacgatgcacacacgtacacatacacactcacacgatgcacacatgatatacatgtgcacacatgcacggaatgcacacaaggcacccatgcacactcacacacaatgcacatgcacacaagatacacacgtgcacacacgcaccttcccttctgaaggaagcctggcaggaaacgggcacaggccacggctgctcccccagggagaatggagggaaggaggggctttgctcaaacacgcctctctgctcctagccagcggggttatccaaggctccatggaggaggcggacaggcaacaccgagctgggcttggtcccactcgataagaaggaagaaaggcgcaagatgaattgcccgcggagcctgtgacttgcgctgaatgctaactgacagtgattcacttggaaagtttctctccacgggataaagccctctttgtagaaagggaaggtggtgggtgccaacgagggcccgggcgcacaggcccaggactaacaaaagcgtcggcgtcaccatcccagagcctggctctctgccaccctgggaagtgctgggactcttgctgggaagctgggcagtttgaggatgtggggctgggtgagtgggggtctcactggtgatatggatggagaaggggaaaggagggggtgaacagagaaagggagagagaagagccgggagtgcctgtgtattgatcccagaagctgagctggaagaaagagttggctagaggctcacggctgggcctccaggaccagcacaactttgtcggttcccctgcaaaggacaccccggatgcctccagccatgcaaaaagcattaattaagtaccttctgaatgcagatgttgggactgtttaggtcaaggggtgtgaaggaagatgctggcatggcagagttgaagagaatgtcccggctctgccattgtctgtgtgacccatggccactcacccaaccccctctaagcctcagcgtccccgtccatcaaatgtgaggattaaatgagacacatacaaagaaacccggagctttgggaacactcagcaaggactaataaggacgaggttgccactctcacggggtcctgtcccctgtacatcccaccctgggttttcctctttctctactgcaaatctctttgcacaaaagcccacccagcaggccccagacctgctccccacccagaggcctatgacagcctagccctagagctcactaaatcatctcccttccctgaggggccctatccccgtcctcctcttccaggggccaagttctttacctgttcctgatgtgaacccattttcaggagaggaggtgacaaactcagcactcaaaaggcaatggtggagcccaatggattacctacgccgacagggacaaactctcaagtcaaaggaatgattctctaatggtggaatgtcaagctgaatattttttgacttaacagagagctgggaacccatcatgagaaaaacagaaaactctttctttttttttttttttggctagaagggttttatttgtttatcgtttctagtaagtcacaaagacgcataacctccaaagggaaaacttatgccactgaaaatgtcaacacagcacagaggggccctgcccatcccacagaggccatgcagttgggactttgcctaccccctctgggcctcactccctgtcctagcctgcctgagagagtgccatcctcccctttattgacggggaaaccaaggcttagggaggaaagcgactggcccaggccgggcatccagttgaaggactaagctggtcccatctgacactgacctatgctgggcccccaaggacaggaccgaacagatcccagagagagaaccctgtggacagaaaaggctagctggacccacaccctcccgagggagaccaggacagtgggagagagaactgacgcagcctcctggagaccctggtcccccgccctggtccccccaccctcccggctgaatccccagccccctaagccccggcccatcgccacttccacgagcacaactcccagattctccttcactgacctccttccacaggaggtcagcaatttctcatttccctgcttcaccaactccattttccaaagtgattgagactctaacaccattaaacatgatttaatttgcttttcctaatgatatgcccacagtattaggacagctctccttttccacttgaaaggcatctcagggtggtttcctccagtgacattaatagggaaaccgtcggaaatgctaaagaggactcggtgcctccagctcggctagaaactatttttaaacaaaggagcgcactctctgcggcggcagaaaagcgaaccagagagcaggaaggcggcgctggctccgagccttgtgtctgcatttcccgcactttcatctgctggtccggacccaggcccagctgctagcccgggctaccaccaccaccaggaaacactcagaaacccaggccaggggccctggaaaggcggcagactccttctcggtggcacccattgtaagagtcagcctggaatctctgagccccaactagtgccaggacagtgccaagtccttcacggcagctcattcgttcctgcctcacaactccacgtggctgatactgttatgtccatttcgtgggtaagaaagctgaggcccacagagtcatgtagcatgcccgaggtcgcgcctttaataaacacacaggcagacctcaaatccaggcccatctgagtccaaaagtcccattctcaacccctgggctcctaagcctcccaagaagcagccgccatgtgtgtgtgtgtgtttgtttgtttgtttgtttgttttgagacagagtcttgttctgtcgcccaggctgaagtgcagtggtgcgatctcggctcactgcaacctccgcctcctgggttcaagcgattcccctacctcagcctcccaagtagctgggattacaggcgtgcaccaccacaccaggctaattttgtatttttagtagagacggggtttcaccatgttgtccaggctggtctcgaactcctgaccttgtgatcctcccacctcggcctcccaaagtgctgggattacaggtgagagctaccacccccggccgccaccatgtttttaaagacttccccacatcccatcctcacactttcttcactgacctagctccgccctctccatcaggcctggctctgcccacagcctctccacgcaccccctcactgctgtgccctggcacctctgacactccccaaccactgaaaggtaaaatcacaactgcctgctgtcctggaagcttctctggggctggcacctgagtttcacagcaatcctgctaagctggcacttgtgggaaaatagaggctcagaaaggctggagactcttagggccccaccgggctttgaaaccagatcctgggagctgcagaccataatctctgcttcactgggtggggcctcctcactggacagccctgggtgaggggttccaggagcccaggtgtcccggctcccagcccagggactcactgtcccccggggccaggtcggctggcaatttctaggctgttctaagccacgggtcaagggctgcccactcagcaagggaagccaccaggacaccgggtttttcctgaacattcctcccatcttgggagagaaaagatgctcagccacttttgccaccagctcaaatatttcagtctcagatcagagaggaatgtaagccggaaacagcgcagagagtggggccagatggacgtggccagtctcaggggagcaacacaaacagcgcattcttggcatccgtgaggcagagacatggaagatggaaggtccccgctgccccgactgtccctgccgccccggccacccctgcctcacccaccacccaaccgcatgtcctccgcggagcccagagtcagttctgctggacatacagcggcggacccaaggctgctttccacgttgcccagtcctgctctgccaggccccaggcatcagtcagcacctgttctctgcgctgagccacgtgccaggaggccagacaggcctgggcgtgggccccagtgtggaccccatcctccagctgcacggggaactgacaggtactccctcttaccgcacaccgagaaccaggcctcactcactcctgcacatgcagccagcagacagctcagcaggtagagggatctgccatcaaaggcagagctgagagcctccttctagtcagccccagaaaggcctagatggaggccaagggccaggagagagagtccgggctctgcctccagtccacaaagggccacgaagcagccctggccctcaccaggcctcagtgtccccactgcacagcagtgcaagacagctgagggcgcttttcgccagccatgtgagcacctgtgcctctccctgcaggctggggcaatccagggtggcttcatagaagaggcggtgctgggctggcccagaaccacaccactggatcactcactgaaagcccatggtcattaggcagaggtgtccagtgccccctccacctgcccagctggcctgggaggcctgagcactgaggtccctgaggccacatggaaaagcgtcgctgataccagcaggggaggtgccccctccccaggtgtccctccctctgagcgccccacagacccatccaggaccaggtcccgcccacccctaggccccgtcacacagaggaggcttggctcagctgctcggctcaaggcgggggatgctgtctgtcactgtctccccacagcaggccagtgctgggcaacatactggccgcctgctgctgcggctgcctgacgacacggggccgcacctccactagtgaaaggggccccaactgaggtccctgaaggtcatgtcccaggagtctccaagcaccctgaacatccccaaaagtctaactcatacccctcggcccacccgcttcctggctggccctgagtgccctccgtggggggccctgctatcgtgcgggatcagaaactctaattggggatatagctcataattagtctttgattaattaaaaaatgagaaaaccaattacttaataaatgtcgttggcttaatatgcataatctctgaagccgtgcagccctgagaggggaaggcaggctattcagaggagtccttggaggggagacggcgggggatacagagtcagcccacttccctccgcctgctgtctcagacaccagagagtccccaccagatgacagctctgtgcgtgccggagtgtgggctctgctcccttaccactccacccctgcacctggccatggcaggagcgccatgtttgctgaatgaatgaatgaacacatgagtgaatgaatggcttcttcttcagaccactgaacgtccacaggccaggtatggtggctcacatctgtcatctcagcacttcaggaggcagagatgggaggactgactggggccaggagaccagcctgggcaacacagcaagaccctatctctatttttcaaaaacagtaataaaaaaagaaagaaagttgtgtctcactcgaagaaacccagcttcccagtgcctctccctgcagcctctccctgtgcctctccctgcaggctggggaaagaaactctaattggggatatagttcataattagtctttgattaaaccatgtccctcataaggggttaatatccacaatatgtaaagaactcctacaataagcccagatacggcccaggccctgctcccctgaccaagtgctctcagcagcctctgcagtgtggaggggctcggccacacacaaggacccctagcctaagcaagtataagaaatcaaccgcggatgaacttgagtttcagcagagccccatccgtcatggaaacgaaccgtcacagtggttctaattgtgctggatgcgagtgtggttctgatcgtgatgggactggaagcgagggtggttctaatcccgttgatgggcagtagtcagcctgcttgcttcccggcaccggcagggcgagtgggccagctaatggcgcacgcacaggtgtgtttggctggtgcagacgccatgcatgcaggcacgggatgggccccgcctgctggaccccaagcccacgctgttagggggacccggacccggctccctctgctttgtttgccaggtggcagcgggaagcttctccagcccagtcttgggaggtggtggggcagcacccacctgctatgcctggctgggctaggagaaggaaccctgccctgcagaagtcctccctctggctctgtcatagccgtgaccccagagcgtctacctgcctgggcttcacatacccaggaaggggcttgacacccacggggaagcagatgtgcccagtggaccaaggggcctggtgatgatgatgccagagtggggcaatttaaatgtaggggcacggggcagaaaagagctgggcttggcggggcagccccttcacagtgagcagctgacctggtcatctgtgagcatttaccttcctgcccatcaggtgatggcttctggctgccaacccgcaggctgtatattatgaaccaaacacttgtcctcaggtacgtggctgagtgacttctcacaaagattccaaggccattcagtgggaaagaatcatcgttccaacacatggtgctgggaaaactggacagctatatgtaagaggatgcaggtggatccttatcttacaccatatacaaaaattaaattaaggcaaaatggatcaaagacctaaacataagagctaaaactataaaactcttagacaaaaacataggggaaaagtttcatgacattggatttgcaatcatttattgatataaccccacagcaccggcaacaaaaacgaaaacagacaaatgagactacatcagactctaaaacttctgcccagcaaaagaacttatccacagggtgaaaggcaatctactgaatagaagcaaatatttgcaaaccatgtctctcataaggggttaatatccacaatatgtaaagaactcctacaactcaacaacaacaaaatctgattttaaagtgggcaaaagacttgaatagatattcctccaaagatgatgtaaacctggtcaacaagcacatgaaaacatgctcaacatcactaatcattcggggatacaaagcaaaaccacaatgagcttcagacctaggcagaggacggctattaccaaacaaacaaaaagacacgtgttggtgaagatgtggagaaatgggagccccgctcacagctggtggtcatggaaaatggtgacgccactggggagaacagtacggagtttcctcaaaaaattagacatagaactactatgcgatatgatccaccaattccacttctgggtatatagccagaagaattcaaagcaatgcagccaacagacacatgagaaaatgctcatcgtcactggtcacgagagaaacgcaaatcaaaaccacaatgagataccatctcacaccagttagaatggtgatcattaaaaagtcaggaaacaatacatgctggagaggatgtggagaaataggaacgcttttacactgttggtgggagtgtaaattggttcaaccattgtggaagactgtggcgattcctcaaggatctagaactagaaataccatttgacccagccatcccattactgggtatatactcaaaggattataaatcatgctactataaagacacatgcacatgtatatttattgcggcactattcacaatagcaaggacttggaaccaacccaaatgtccaccaatgatagactggattaagaaaatgtggcacatatataccatggaatactatgcagccataaaaaaggatgagttcatgtcctttgcaaggacatggatgaagctggaaaccatcattctcagcaaactatcacaaagacagaaaaccaaacactgcatgttctcactcataggtgggaattgaacaatgagaacacttggacacagggcagggaacatcacatactgcagcctgtcggggggtgggggactaggggagggagagcattaggagaaatatctcatgtaaatgatgagttgatgggtgtagcaaaccaacaggcacatgtatacctatgtatcaaacctgcagattgtgcacatgtaccctaaaacttaaagtataatttttaaaaaaagaattcaaagcagggtcttgaaggcattatttatttttattttcatttttttgagacagtctcgctctgttgcccgggctggaagtgcagtggtatatctctgctcaccgcaacctccaattcccgggttcaagccatcctcctgccttagcctcccgagtagctggggtagactacagttatgcaccaccacacccagctaatttttgtatttttagtagagatggggttttgccatattggccaggctggtctcgaactcctggcctcaagtgatccactggcctcggcctcccaaagtgccgggattacaggcttgagccaccacagcgcctggcccttattatttgtgctacagttaacaatagcagtaatcacaacagcccccagcctcacctcatccacggctccaatctgtacactaagtcacctacactgcagcaggcctgcccctgagctcagacaagaacacgtccactaggaggccagtcaccaccagctcttccctcaagaggaacagccttcagggtccaaggggcaatgtcagctcctgggatcctcatggtgatggtctcctgagccctggaagggagggggcctatgggccagagggctcaggactaaatgaccatgaatattcacaggagccgaaggtgaaaacagcccagtgtccaccaacaggtgcatagatggacaagctgtggtcgatccaaacagtaaaatatgattcagtcacaaaaaggaatgacccactggcggcttccacagcgcaggtgaaacctgaaacttcacgctcagtgcaagaagccgacgctaaaggccacatattgtaggattccacttatatgaaatgtccagaacaggcaaatccacagaaacagaaaatgcattagtagttaccaggaactggtggatggggcaagaggaaatgggattttgtttcagggtgatgaaaaaattccagaacaagacagaggggatggttgtacaacactgggaatctgttcgatgctgctgaaatgcacactttaaaatggtaactcttatgttattttatcacaataattttttcttccccccaccggagacagggtctcgctctgttgcccagactggagtgcagtggcacaatcttgggacactgcaacctccgcctcccgggctcaagcaattcttctgcctcagcttcccaagtagctgggattacaggtgggtgccactacatcctgctaattttttgtatttttagtacagacggggtttcaccacgttgtccaagctggtcttaaactcctgagctcaggcaatccacctgcctcggcttcccaaagtgctgggattacaggcatgagccactgtacctggtcacagtaatgttttttaaagattgagaatcaaaaggatcacccagggctccagccccaaagtccccaggggcagagtggccaaggaatctgcatgtttcgccactgcccttgctgctggggatctgggaagcccagcaagttcacagccacacactttgtcattccagagccgctgccttccccagccctaagggcctgaccccacagctgatgcctggtaccaggctggccgcccactcctatctaccttcaaaaaaccagtactcctggagaaaggtcttccagggtgccaagaaatgacacttcgttataattaattacttacactttggtatttttttttcttttctccttcttggtctcatttggcttttttgctgcaaacatcaaattgtcaggctccaacagacacaattaatgtcttgggggcactggggagaaacaattaaccatttaaaacttaattaactgtggacatggaccaaaaaaaaaaaaaaaaaaaaaaaaaaaagcatgcaccagttgcaccaggaccagctaagaaaatgcaagctctcagccaacggggtggggactcacaggaaagagaagtgacaaagacccacccaagaggtcatccagccagtccaaccaaatggattgattcccagatggggaaactgaggcccagggagtagagcagtgaccagtccacgtacaatgagaaacaatggcagggcctgagcacacctcctctgctcctagtgcgtcctgaagcgtgggctgctgccaccactgccacccagaggcccctcttcccagagccaagtcctaagagggaagggagacaacaggtgggcatcactccccagggcgccagcccccggcagcccagcaggtgctaagttattattactaattccaacaacctggcttgcagctttagatcgtgggtctcccttctgaaaaccccaggatagcaccccaaatctctctggtagggctctctggcactgccctagctcctgcccctcccagtctcctactccaagcagacctcccttctaaacctgagcaggccaggccaccgccaccagcctctggacctttgcacatgctgcccctgagacctcccataccaccaccttcacctggtgaactgcagctcacatctcgaaccccagcacctcctccaggaagccctccttgactagctcaactgtctaacacacctctgcccaccaaagtccctgtcactctgcacagtaggcagtggcccctggctccctgtcttcccaggctccgatcatctgaggctgcatgtcctggcaccagctgagctaagcagagcacacagaagcagagaggaccaccctcctggcaacagccccactgtggagggatggggaggcccagcaccagccctggccacaactatagcaactccccaaacctcagccatctcagaaaaatcaatgcaattctgcaaacaccgggcagcctgtcacagacacccgcagcacttctgcaggtgcccacccagcatccagtccttgctttactcaggctgagtccccccctacacatgctcttatcaggacctaccttaccagtggtggcaagaacaaggcaggcttctggaaagcacccctcagctattgtgctctctcctctttctggggacacgaaacctgagaccagctagcccaggagtgggaaacccctggcacatgtacccatgctctcataccacacccacggcagacaacgctaatcaatggctgagcctcgggacccttctcagctgagccctccagtcagccactaccaatcgatcaggattaaccaagtcttcaattaggctcctacctccactgatgtagtaggcacagggaagagatgggaggccacccacggtcagagaacacagcagaggctcagcccagaggctcttgtcccgattccacggggcagtcttttcaacaaatagggctgggaaaactggatatccatgtgctaggtggcccgtggggcctggcattcactgaaacactgctcttgaggtcttggccacacacccacacccagcaccccaactcaccccctgcacccttgcctttctgtctggagttggccccactccaagcggcccccagatcctcccctctgcgtttatcactctggtttctattccttcacccctcagccttctataaaaagccaacagtaatgaccctcaagcaggtacaagttcccaacctggcaccacatttcctggcacaggagcaagaatccctacctcacaccactggcatggagatcaagggatccactcatgggccaaggccgctcccagagcttgaactcaggtcttgaaatcacagcctcctaggatcctgtgagcagggttgaggcaaagacccataggcttcctggcctggcgcgccaggctcagccacctcacatgaagcacagtgggctgagcctgacctccaggcacgcagctcatcagacctgtagggactcggctaccaaaattgaaccaccctccacccttgtccagtgtgaagttaatgacgggcatggctcccgcctggaaaggaaagcagagaaaaacctctcccatccccagttataaaacggcgggtcagcatccgatgggcttaccgactccgtgtgtgtgtgtgtgtgtgcgtgcatgtgtgtatgtctgtgtgtgtgcgtgcatgtgtgtgtctgtgcccatgtgcagcatatctggttgtcaagttcatctgaaagtgggtgggtgaataacgtcctgaaatgacaacaactagcagataaaagaggaaatgttttcaagcagaaactctgaaggcctttgccaacagcccctgcgccgggctctgccgggagcctgaggcagctccccaccccagcgaggagcgactgcattttaataagtaattagtgtggagtggatgctgctacaaagactagcacgtctcactgccagcattaaggcagggagtgcaaatgaactcaccgcagcattagcatctcagagtcatcagaccgactggcagaaaggcctcgggtgagcacagagtcttctgcactcagcaaattaatgaacaaatacgaagaggaaatgaacaaacacatgcagcctcggggcctgggtgtggagataaggggtgctggatcaataccccaaggttactgctgtgttctcccctggccagacagagcctgcgggacacattcatcaacgcagatgtaaaatggagaaatcaatgacatggctgagacggcatctggatacacttgtccagccccagacgcagggcaggtggatggtgggtgtggggcaggatacactggccgggtgaggctggcactccaggccactggaatggccatcagatgcacccctgcccactgccagggtcatcacccacgtgctcaaacgcggctggtacaatcacagcaccactcccaggagcttcctcacgagacccagcccatgaaaacaggcagcggcaccatctggaatctcccgcccacagccctcggcatgggggaggcaaatctttagacccattttacagatggggaaatgacagctgcgagacctgaagcaacctgtgggacaaactgggtcctgatgacggcctgatcctcggcatcacaacctgtccccagccctcaatggtgtcttcgtgggtccactctcacctggccccagaagcaccagcagtctcccacctgagccctcaagttcaagtccggacagtggtgggtgggtttgtggtgggggaaggggcaatggcaggggttgtggcaacaaccggggagcagatgggaagtccagggtgacaaactggggtcccccattgtgccagctcctggtgactgccaggtgctagggtgctggggtgctgtgctgacaggtgggaggtgccaggatggattcgaggtgcctgccctggctcaggtggatagagtgacagcacatgccaggaggttccacgggggtagggggacccaaggctgatagacaagggtcccaggcagaagaggagaggaatagaagtggtgagggaggggtcttactccagcaaggaggaagggcccctctgcctgcacgcaaaagccaaggggcctctcagctgctgacaaacccagggccagagggactgggatgaccacagctgcccgtccatcatctgcagcaggtgcacagccgactccctcatcctggacgtagtgatgcggcctgtccccaccaccagcgaccccagtggcctgtccccactgccagtgcccccagcggcctgtccccaccgccagtgtccccaggcccaactcaaaggaggcaggtttcctcagctgtgacggatcaatggtttccaactatgtttttaccctcttcagaaccctttttttaagcaaaatgtcagcaaaatgccacataaaaaacagataaaagtggagctattccgattcagcagggccctgccctcccttcctcctcccagcctcttgagaaggcccagagtggtctgagattctcagctgaagggaaccatccgtacctgcactgacgccgtcagcaccgacaccggtggtcattgcactgcatcctctatagactgctggtcagcgccctcccctccagggtcaggccttttacttcctctccccagacagccccaccggcctccactctgcctcctggcctcctctctgcctcccggcatcctcactgcctcccggcctcttcactaccctccctgcctccaccctgcctcctggcctcctcactccctcctggcatccacactgcctcccagcagccttgctgcctcctggcctcttcactaccctccctgcctccttgctgcctcctggcctccacactggctcctagcatcctcactgtcctccggcatcctcattgcctcttggcctcttcactgccacccggcctcctctctgcctcccggcatcctggccgtcttccgtgcgccttccatacagacaactgtgctgcgtgcaacagctgccttgctagtcagagggaagagggcacagccgagcagataaaaacggggcccctgtcatcagcaggacctgaggatgcccccagctccactgtaccgcagagcacacgtgagatgcatcttctctgtgcctgtttccttcctcacttcttaaggtccctgcagggtgcaggtgctcgtggacataaaggtccagtagccacaagtgattactcccgtggaggagggaggggcagcaggagaggccggcactcaggtgaccggtggtgtgcgtccagcgtcgccagctggcacttcagaatctgtaagcagccatggagccacccccagacagtgctgagagccagttttaactgcctcagaagtctctgagcctcccaaaatgctttaatgaataataaataggagaattaagcccgtttattggaaggtgcgcgctgctctttaactcgagcaagagaagcggcctagcgatttcctctgggaaggttcattccgccccgagtgaggctggagtgaagtgcactgcccagccagcaccgcgggttcctggggccaggcagggtggcctgggctgggacaccagagaagcagcatcagacttcactcggaaacctgtccccgcacagggcaaggtgccatcagggcaggccctgctgggccagagctgagtaagggcctgcaggagagcgggaaggcaccagcagctctggggagaaccttccaggcagggggcagccagagagcccagcagcaggaggggctgaagcagctccacagcagcgagggggagcaaggggcagggaccagggaggacagagctttccctctgacaaccagaagcacctgcgcccagggggcccccctcctgcaggcagggagcaccctgtgctgctcaggagaaacacgtccttccctcttcccttctcccctcctttcttccctcccttctgcccagctgccttccctgtcctctgcccagaagtgcagccctcacctcctgaacgagtctgtccctttgtcccctgacctagggtgcaagtgcacactgtcaatggcaactatccccacaaagggagagagcaacagcatcctcatcacgctctgctcaccccgctccagccctaacaaagagctgcctgtgacccggtgcccaggaggctctgatcaacaggggaagcgggaccactgtcctcacgtcacaggagaggacatcaggctcagggaaagccacctgcccagggccccgcgaaggagctggacggatcccaatgacaatgccatgaccaggcacctggggagggaggacagcgagggtttgaggacccaagaaactcacagccatgttaccgtgcaccagttgcttaggtggggataacacaggcgacaccacggcacatggtaaacagtcagtgcgctgccggggtgccttccttccctcccgcagacctgtgctcagtcccagctcgcaatgagatcagagtccctacggtcggaactatcatgatctgcagagtccagggaccagaatctcagaagcaagccacagaaaccccgcagcctcaccagaatcctccctccaaatgcccgaccggattccaagctggggcaaaccagcccctggaagaagccgccagagctggcgacccatgggcttctccacactccttcccagctgggcaactggacaaaccgcccagacacagggcacagaggaaaacaggaaaggatctacaggccgtggcggggagcagggccaacggctcccatcagcaagggctgcggactcacccttcacgctcggccataactcggccccagcacgcccaccccgggcagcacaggaagccggacacaacttatttgagccaaaacctaatctctttaatgcaaccctttgaaaaaaataccaggaaagcagccagaagagaaacacttccggaataaaccttctggatcctttagttcctactggaacttgcggggtgagtgaagaggaagaaaatgctaataaaaatgactaggacctgccgttcattttttcaccgagtcctttacagcaacacctccaaggggacagtctcaagcttcatttgatccctgcagaaacaaaggctcaacgagaccaagtatctacagagtccaactcgcgtccaggtctgacggaagctttgctctcacccgcctgcctcctccagggcccgcctggctccaccgagcctggatgagaggaggcaccagaaggcaggtgcagtggaccacctggcaggcttcccagggctccaaaacctggagggtttccaggggtccatctgcctgctgcccaggtctccccaggtggcaggggccaggagcagagggaaccaggctgactcatggtgggtcccctcccaatgctcctcctgggttaaggaaaccctctacacctgtcccaaagggaaggcagaagaaaaaacccaagggccagtgggcggagaccgcccttaagcagcaagtgagggccatgagcagggaaaacactggtcaaaccagcctccacatggggccatccctgggagagggagacagtctcattcacgttagtgtccctttaacacgtggaatgatcctttccatgataaaatcacagaggaaagactccagtgtccaaggctgattgtgggccagagccagcaggcctcggggccaaagctccagagtttttactttctcactcctctctcctaccattaattgctcagcagctaatctgagggtccctgtgagggcaaagactacgtgagtctcctcattttaactccagcatactaagtgcttactaaatacgtggtaaattatatgcttaacagaatgatagatggatgaatgaactaatgaatgggtggatgaatggtggatggatggatgaatggatgggtggatggatgaatggatgagtggatggatggatggatggatggtgaatggatggatgaatgatggacgaatggatgagtggatggatggatggatggtggatggatggatggatggtggatggatggacaaatggatgggtggaaggacgagtaaatgagtgggtggatggatggatggatgaatggacggatgggtggatgggtggacggatggatagatgaatgatggatggatggatggatggtgagtgggtggatggatggatggtggatgaatggatgagtggatggatgaatggatgggtggatgggtggatggatggacggatggtggatggatgaatgatggatgaatggatgagtggatggatggatggatggtggatgggtggaaggatgggtggatggatggatggatgaatgatggatggatggatgggtggatggatggatggatgatgggtgaatggatggatggatggatggatggtggatggatggatgaatggatggaaggatgggtgaatgggtgggtagatggatggatggatggatggacggatgggtggatgggtagatggatggacagatgaatgattgatggatagatggatggtgagtggatgaatggctggatggatggatgatggatagatggatggatggatggataaatggatggatgagtgaatgaacgaataaatgaatgctttttgtcttcccaaggaatgactcccacaacatgagagacttggggagccgggaggcagctgtttagaaaatgaatgacaacaaacccagagcccagacaagatctgaaacaccacagacctccttaaataataggggaaacggcatttcctaaaccagccagagacaccagccagctgtgatggtgaattttaggtgtcaacttgactggatgaaggaacacctggagaaccggggaagcattgtttctgggtgtggctgtgcgggtgtttccagaggagactggcctgtgagcaggtgaggagatgcccttcctgtgggcggcaccatccaagcagctgggagctcagacagaacaaaaagccagagaaaatgtgattccctctccctctcctggagctgggactcttggtctcctgcccccagacatcagaactccaggctctccagcctttggtctccaagacttgccccacaggttctcaggcctttggccttagactgaagatcacaccattgcttccctggttctgaggctttgggactggggccaagccctgtcacccccgttcctgggtctccacctcgcagaaagcctgctgggggccctccacctccacagtcgcgagagccgatgctcctaatcggcccctcttgtctgcctctacccggctgcttctgtctctctggtctctggagggccctgactaatgcgccggccagtcggtcaggctcctttcagccctgaatgctgtgaatgtaagtaggagccgatcagacaaggagtaagagagtcagctctgcccctggtagccctggagtccccagccccacaccccctcggttacccctgaccagccccacccaccccagacgacagtcagttctgactgcagagctttgtgttctggggagaaacagctgccacccccgtcctgggcaggccaagggtgggaggaacagggggagggcacgcagccatatcttcatggtctgaggttgctggaggccgccgagctcatttggaatggccagggcgtcccaactgggctgagctcatgaatgacaaaagatgaatctggacgtgtaggaaacgctcagtaaatgccccgaaaaaatgaaaggggcattcgctcttcatctctgtggccagagggaccgatgcatggaatggccaagtaaggaaccaggcctatcagccccgccctccacaccggctccttgtggtcaacaagctgggagtccgggaggccagagaccagcagcctcggcaagtcccctccctgctctgacccttcctcccctctgtccacggcagggactgcaacaaatacgccccggcccagcaagaggtccccaggagtctgagcacctgggcagaccaggccgcagggaggagctgggcttttgcttgtgttttgtttttccagaacacctgtcccggagaagccaggaggcgctggcagagcagaaccgtcaggctccagaccgtggtgaacgtcccagctccccagcctccgctggccccaggccagactccatttggaagtgctgaccacagcttgaccacggtaggaaaaacatccagggaaggaagcaagcaccgccacagagacagggctggcggggccgaggccaggcccacgctgaagggcaagtgcgggttccggctccattgctcccaagtgtgccagcacccagcacacggtcccagggggcccggtccccagccagctgtccctgacacaccacaggccacattcacgcgggctccaggaggcaaagggcatggctcagatgcggagaccagaagcagcaaggccccagagtggcggggccctggggcacgtgcggtgctgagaccctgcacacatggcttgacccgctcaagggaactttgagggtgggagtgtcaccgccattttacaaatgggacttggagaagctgagtcacttgggcgaggccgcaccctgggatggcagggctgggactcaaagccagcctgccggggtccaagtccatgtgctcagccacctgctctgtctcccaaaggtgcagccattgcgtcttttttttttttttttttaagacagagtctcactctatcactcaggctaaagtgcagtggcgtgatctctgctcactccaaccttcacctcctgggctcaagcaactctcctgcctcagcctcccaagtagctgggattacatacgcccaccagcacacccagctgctttttgtatttttattagagacagggtttcaccgtgttgcccagactggtttcgaactcctaacttcaaatgatccgcccacctcagccttccaaagtgctcaggttacaggcgtgagccaccatgcccgacccagccattgcatctttatgtataaaatagtggagagaaaaacagtaggcactgccatctgtgtgtggaagtctggacttgttttaagcgaccggtggggggcggcaggagcagcaacctgcacttcacaaacacctcctgtggacctcatccagtctcctcagctcagcccgggggtctgcacggtgacatcacctccattcccagcaccccacaccatgactcatggtccaaacccgccgtctactcccagctccccatgagagatgccacagcttggccagcaccaccactgaccgccacggtgagacatggggagaccagaggccagcatgacaagaagccccttctgcagcccctcagagccgcagccgcctcactggaaaccatggacgatgacaagggctgcccatttgcaaactgcttggccacacagctggtaagttgaataatgagagtttaatccaaatttatgtacgtcttacatcactgcattccgccatagcaaattaaaagcaaaatgaaattatatactgaatacgctgcattttaactgttggccaagaagtaggtttggccagggttttcctgtatttttctctttacagttatcataaataccagttgagtgtctaagtatgtgtgtacatgtgagactgtgtgtgtgtgaatgtgtgtgatatgtccgtgttggggggctgtccatggatgtctgtgtgaatgtgtatgggtgactgtatgtctgtgaatgtgtgtgtgttaagttgtgcatgtctgggtgtgggtgtgaacatggaagacgggttcaagtgtgtgtatgtgtgtttgtgtgtggtgtgtccatggatgtctgtgtcaatgtgtgtgtgtgagactgtatgtctgtgtgtgtgtgtatgtgagctgtgtgtgtctgagtgtgagtgtgaacatgtgtggggtgggtgcaagagtgtgtgcgtgtgagtgtgtgtgcgcgtgtgagagtgtgtgtgagagtgtgtgtgtgtgtgtgtgttctgaaggaccttcactaagtccagaaccatcagcctctccattacccagggtgctgcaggcaaattcatctctgctgcttgcagggaaggaacaggagagagttccaactcatttcaaaacaaatctgtaggaattgagaagccacttacaggaaagaaacaggcccaggccattcaagcctccctgactccagcccagcaggcaagcccctggacagcaggacccacaggcctcaacagggcatcaaactcccaggcaggtgcgctgctgcagggagggggctcagtgagtcatttaagggacacaaacttctaaggattcgatgattacacagagatgggctcatgaagaggtccccagatctcacgtctggagaattccaggagcgaggaagggaagcgccaagcctggtggctccgggatcgcccttgttccaggtcctgacctgaggccgtgcagcacttccacacgctcctctcagaaccgacttctcagcatgcgccactgcaaacccaaattccctctgcgcctcacaaatcatgtattcacagagcatttccttagataccaagtccctgataatgatgctcaaataaaccaggcagtaaatatcttgttacttcccatcagcaggtggaaatccattctcccggtggtccaggaagcagtgtctcctagaggcagcccaacagcaggcgggggcctggggcctcctcggccaccgtcagcacctccggcgtccagccccgaatccatcaggaagctattgagaccctgatcccatccatttaaaaagagtaaccgtggagctgctgggctctggaaggcaggtggcccctgcgtccctctgtacccaggctcaccaggaggccaccaatgaactacagcctcccagggcctttgcacctgccagcctcagggtcccctcatgtgcaccagcccggctcctgcatgcaggactggtgccatgtgaggcttcctgagaacacagagacacttcccggggtcaccactggagaataccccctctttgcccaataccttcccagagtcagagacagttctgcttgtcccggggtaaccgagataatccatttacagagcacacagtaggcgctttcccctcctcatctccccagccccttaggaggtggtactaacttcgacccattctcagaggaagaatcaagattcagggcaggaggtaaatgctcagcatcccctggctagaaccacagggccagggttgtctgcactctgctcttcccccacccgcctgaattcgtcacgcctggcctcaccatgactggagagagaaaggggccatcccgttgtcccagccccgacacacaaatctggctttcacaccttcctgtttgtaacaggacctgcctgcacctcccggacatgagggtgcagaaatccactggctctgtgttggagccaatcaggctgctccatggatctggcccacctgccgctgagccggcaaatcggccaccacagctgagcgaccgaggctggagagagtgactgctcacctttccaaagtctcgcacatcgaagaggtcaaaggggtcaaacagctcgctgttccttaatccaaatttatcgtggcagactttcaggaaggtgcgtatgttcttcaaacacagaaactaaagggaaaaaacaaagggagggcaaggaaaaacttattaaaactgtaagctctgtaaaaaccgtaacagcaacagcagcaagctctggcttccgtgcgccagcacatccaagctcattcctgttttctcaaggaggaaatgggctcagagagatgacgaaaccccccgtcccaaggctggggggtgagaagccaggcctggatggaagtggaagcaggcagaccagctccacatccgagggtgtagccaccaccgcccccagccttctcatcacatagctgcaaaacccccaaggcctgtgcattcagaagacacgccactccccgtaaccgtaggtcagggcggcaaggcagcaccctgggccctccatgaccatccaacccagctctcccaggcgcacccagcacatgtcgaggccgacagtcacagctggggcagaatatgcaagccttaaatcaacaagaatggatggcgcatgctcacgtgggcacgtgcacaggcgtgcgtacatacacgaggcttctgacaacaccaacacatccttcctaatcacgggtgacaaagccaacagccaggggccacccccaagaagccacggaggacccagagagtggcaggtgccaactacagtggaagggtggagggagcacaaaagccagaattcccaaatcaatgcatgggtcatctcctctctgcccactgccaaccagtgagctctcggccctcactgcgcctgacgtgccacaggggcggaaggcttggctggggcggaacggccatctgcccagtcctcgtggagaaacagcttggtaaggaaacttataaggcagcaggtgaggtggcccggggggcacgctctggaatcactcgggccccaggttggaatcctgtctgctgactccagcagggagaccagggtgagtggttatgccaggcctggttttctaccgccacctgcctcacgggattaatcatgtgccctgatgaccagagtgggcactggggtgtgggagccatcagccccccaatccagctcagcacggggattcgcgaggggagggtgtggcacacacagcccaataagagcccaggattgtcatcctcatcaataaccgtcccctatggacaaactgcccagctccaagagcagttcagagagcctgtccctgctcactggaaatttagacaaatggacagacttagacatagtgcacgtcagaatcagagcctaagagcgtaaaccaagcagcactgagaacgccctgggagcggagggtcccccagccaggacatacgcccctgctgacccctcaccctgcctcacagcaggcagtgctcaccccagccccttctgcctcaggccactcctcccatcctggcaggggtcggctgctgttcatagacaacagactcatctgttttatcctagagtccctctctgtccacgtgcgtgtgtgtgtgtgtgtgtgtgtgtgtgtgtgtgtgtttctgaacactcgagattaactacagtaatgacactcctttatccctaaatacctgagtgtgtaattcctaagaacaaggacatcctcttccataatcacagtacctacagcaaaaccaggaaattaacatggacaccacacggttatcttatctatagaccttacttgcatttccctaatatataaaggacaaccaaaatgtccttatagctaaaagaaaaaaaaaaaaaaactggcccaggttccaatatgggatcacacacagtttctgctgccatgcctcttcagtctccattaatctggtacagtcctccaacagaactttctggaatgacaggaacgttctatccatctaccgtccaatagggcagccactagacacctgtgcccaccaaacactcaaatgtggctagtccggctgggcgcagcagctcacgcctgtaatcccagcactttaggaggccgaggcgggtagatcactagaggtcaggagttcaagaccagcctggccaacatggtaaaaccctgtctctactaaaaatacaaaaattagccgggcgtggtggcgcacacctgtagtcccagctactcgggaggctgcggcaagagaatcatttgaactcaggaagcggaggttgcagtgagccgagatcgcaccactgcactccagcctgggtgacagagcgagactccgtctcaaaaaaaagaaaaaaaaaaggtggctactgaaaacctagattgctaattttaagttaaattttaaagctacatgtggctagtaactgctagcttagacaatgtgagtctaaaacactccatgatctttgtttttcacgacctgttaattctgaagaatacagacatgaaaggacaaatcctgtgtgagtccacttttttttggggggggggggggacggaatttcgcccttgtttcccaggctggagtgtaatggtgtgatctcggctcaccacaacctctgcctcccaggttcaagcgaattctcctgcctgagcctcccgagtagctgggattacaggcacgcaccaccatgcccagctaatttttgtatttttagtagagacggggtttctccacgttggtcaggctggtctccaactcttgacctcaggtgatctgcctgcctcagcctcccaaagtgctgggattacaggcgtgagccaccacgccaggccgtgattccactttcatgaggcccctggagtcgtcagatccacagagagaaaggagaatagtgggcgccctcgaagggctgagcgatggggtggtttcgtggggaacagagctcttgcttgggaagaccagagagttctgtggatggtggtgatggtgcttgccaacaaagtgaatgtgcttgaccctactggacggtgctctagaggaaaaccggagaagacactgagttttacgttatgtgtattttaccacaatacaaagattaattagaagagacacagagagacatggagacacagacccacgaggagtgcatgtgagatgggcccctttccttagcaactgggagtgacacagctgtgggccagccactccaagggtggccaccgttgccagaagcgggagagggcgtgggacgggctctcctccgtggccccacgaaggagctgttgctgccacacacaattgattcaggctgctggcctgcagccctgggaacaataaggttctgctgcttaaagccaccacggtcgatggtgcttggttaggacagccccagacactggagctgggagcaggcctgagccggggcaggggctacgccctctcgctcatctgcgcggctgcatgtgctgcagcttccagcctggcgtgactattttttgaatatggcttgtctgtaatttccactaagcatttattttcattcttcctcagcctcccaagtttagagttaattacacagatcccaaccataatcacagccggccaggcccaggcttcctttcgggcacaggatgggcccagcgcacccctttcccatgggcccagcaactgctgtgcctggcccggccccacccgtggccactctggccaccctaacctttaagaagtcctcctggtgcagctctgggcccaacccagggtggtctctgcaaaactgagccacacaggctgatgcagatggcagggacagggactgcacggacggggatggcagagaccgggacaaagcctgggggccacgtcaggctccacctcgagggaggccacacacggcccggcctcccttcagggagcatttcctgtgctttctacagttcatcccattttccacaaagggaaactgaggcacagagagttaaggacgtgggcacctgaccagagggcggcagcgccaagaatgaagccatgtcgacatcggccagggcaaaggccctctgagaggacgggcgtgtgggcaggcaccaggtccctcctgccatccctgtacccctttcctcagtggcctggtttgcaaggtctgtggtcgctctggagccaatcagagcctcaaggtccaggttctagacagagaccctgacggttggcagggaccggacccaaggctgaggttgctgcaggtgcatcatggccacaggggcccactgaggacacaggccgagggacagtggcaaagggaggcccagatggtggtcagcgccaggtgaaaagtcccctgtccacgcccaagctatgaaggctggcttcagctgtcacctgtggctgcaggagcaagcggcattcttctctctcattgatccaacctggccttcgggaccccccacaaaggcagccactgcttcccccagcatcctggactttaagtccagctgagtggccacagcaagggtctgtccccagaaaacaagccctgtgacaagggtcccagggctgagtgccctctcccccaggctggcggctatggggtccccactgtgtttgtttagggcactctgagggggcatgggctaccccacctcctgctccccacagccccagactgcagggagggctcccgcccctgggccccaagaatcccttgtccaggctctggcgctgcaatgagaggcagcgtgtagtgtgccctggaaacgtcagcccctttctctccggcccattcatcggcagccgcagatctaatcaggctgaaatcggattagtgtggtgacacaggctccatgcccagtcgcccacctccccaggttcagctgcactgtccttcagctcttgcaaggcgccagggcggggtgtcacagacaggagaggcggcgcagggccggagagccaagaccccagagccaggagcccaggtctgagccacaggtgaggcccgagggcatcctggatggcaagcttcaccggccaagctcacatgctcacaggacagtcacgtctctttagggtctctgaaacaatctattgtgatggggacacaatggcagggacaggcctctctgccctgcagaacccacggcagcccaccgagagcaggggcgcccttcagcctatgtgggcccttccactgccccttactggcaacgggtcaccggcagtgctggagtgggaaacaggacaggcctgcctcgccctccagagctggcatctagccggcatgacctgagaggggtacaaaaggggaaactaagccgggggaggcaaatccacttgcctgagtcacatagccagcaggcctcagctggggagctgcagtttgaacacaggtggcttggccatcgacccctgggcaatggtgatggagtaatagcagagcctgacaatgaccacaggcagggaggatgctgacgtgcacaacagccaactcactcaccacctgcagagcctgtgaggtgtgcactggcccactgcacagacagacaaccaagctccaagcagtgagctcatgggtaggcccaggattcaggggcaaatggagtggccgggatgcaaaagggcagcaggcccccgcctaaggggatgcaagaaagtcctgtctcgccaaggacggcagcacaaggcctgcgtcgtcaaggcaggtgccacactgtctcaggggctgactcctgggccccagctggaccatgcaggaggagcgtggggccgggctgacctttatgggaggtgaccctcgctgctccctcctcccaggagagctcgggcaagtctcctcatgtgcacagtgaggctctggcacagagctccaggcccttccggccaagactggctacgcgtctcggtgcgctgactcacagtgattataggcgctccacggccgccaggttttccagaaggccaggcactgggctaagagctcccttgagtcactgcagcaattcctaatttacagatgaggaaactgaggtttcaggaggtcagctggcctgcccaaggtcactagcaaggatgtaactgagctaacaatggatctgggatggtttgacccccaaggccagactgctggcctctaagctatcctgtctatgggtttctgggcagggaaatcccattattttttcttttttaaaatgacaacagtactttgacaaaaactcagtctgttcagaggagatggggaggcactgagtgtaggagcccggcctttgggcttgaggggcaggccccacccacagaaaccaaggcttaggaatggggccagagaggagggggctgacctgattgatcggcacataataactaactagcacgcatgcgccatttcacagcccactagcactttcacatccacatttgctccgtcagatgtggaaatggaggccccagaaggcaggtgacccgcgatctgaacccaggcccggttcctctcaggatgcccccagcctctggcaggcccatgcccgggaaagtccctttggctgccccaccaggaaggtcaggggcccgggtgtcctcagtcccaggagtggcactcagctgggggtggggtcctgcagggaaagccccaagctggggtctccagatcgcctggcccaaccttccccatccatgtagatcgtcaccaacaggcagggctcctcccaggtctctggctggcatccctgaaccaccgactcctgtcctgcacagtcctacctccccctggcctcttgcacacaaccacattccagtgcagaccccacagcaggtgctccaggtggggacaacccaggcctgctcccactcaacagccacacagcttctctgtacctcagtttctcaatctgtaaaatgggcaaggagaaccctgccctctgactcccacgatgctgggactctcactcaaagagactgtactgaggccatctcactggggaagtccagaagtcccctgagacattggtcactgggagagctggcaggggggttggggtgccacagttagctggagctgaggagcagccacagtgcacgagaacctgggcccttcatcaccatggtcccaccctggagctgttagcccgccaccccgctggcctttagttcgcagcagagctcctcaaggcagctgccagggactgggggagggacacaggccgacaagggacttctggggcctggcctcaggctctctgctcatggccagagcagcccagcaactgggaggtgaagacccccaccccatgtgctccttgctgcaaaagggaacctgggcaccacagccctgaaagcaacagggcaccacagcttctgggcctcaggagaacaggcactctcttttcaagcctctgggtctttctgagcaagctgggggtctccatgtgcagcctccacgccctgcggcaaaggctccaggaagtacccacagacatagatagacatagtgcgttttcttgaaatacttcaacaagtgtcactaacactgcgcttagcagagaccgattgcacgcctggctgctctgcttccagctggagtggtgctgactccctggggccacaatgctgcgtcgtgctgatcagaagctctgactggcagctgaggatgtctttgatcaataaaaaaatgggaaaacaaattaatttcctgttttatttatgccatgctcattccaaaaaccacttaaaatagcttgattactattcaacagatgcagcttgatggaatggatcaaatttggggcccatcaggtagataaacaggtgaccctgggtgacaggctggccaggtgctcacggagacaggagctgacgccgtttgctccctctgggtcccaaatgccctggacaatgcctagcccatcacacgggctcagtatctggtagacgaacaaatgaaccaatgaattaatgaatgaacaaatgaatgaatgtctaggaagcactcttaggtgtcctctgactgctgacacctctcaaagggccctgctttctcctcaagcagcagagagtccacgatgccttccaagacgtcaggggcccccaaggacagccactgctgcttaggtggcaacctcgcttccagaagcatctcttccgaaaacaagcaagcaggtgaaaggtagggtctggcctcgaccccttattcctgcacacatcaatgtcacctgcacaactctacacaccaccccaccagggacccattagctggtcagatccaataaccactctagcagggggcgggggtggtcccttatcacccattttacagatgaggagaccgagactcagggaggcccgtatctgctttaaaactggtctgtcgttgggcgcggtggctgacgcctataatcctggccctttgggaggccaaggcgggtggatcacctgaggtcaggagtttgagactatcctgaccaacatggtgaaacctcgtctctactaaaaatacaaaattagccaggcgtggtggcgcatgcctgtaatcccagctactcaggaggctgaggcagaagaatcgattgaactcgggaggtggaggttgcagtgagccgagatcatgccattgcactccagcctgggcaacaagagcaaaactccgtctcaaaaaaaaaaaaacaaactggtctaacttgacagtcatcatgaacactgagaggcttcccaggccatcaccagggcccccgcgctatggcctttgtgagtgtgtgtgtgagacagagtctcactgcatcaacgaggctggagtgcagtggcgtgatctcggctcactgcaaccttcacctcccaggttcaagcgattctcccgcctcagcctcccgagcagctgggactacaggcctgtgccaccaatgacgagctaatttttgtatttttagtagagacaggctttccccacgttggccaggctcgtctcaaactcctggcctcaagtgatccacctgcctcggcctcccaaagtgctgggattacaggtgtgagccactatgctcagaccgcactgagcccttaaagagaggctgcagtgcggggctcccaaggcagatgtccgaggccactccagctcattcactgctccaggcagggaaagcacagctcagccagggattgattgaggagtgtcacgagttgattttgtctggacaattgaacttccttcgctcgggcccatttcctcagctccgcacgcaccaggaccaaggcgtcaggccagcaggctgagtaatgaacctgacccgcctttgcgcatggcctcgcatgagtgtcccccttcgcccagctggggtgcggagctgctctacctgctgtgatctggaggagtggggtggtgttttcttcgtgcatatcaaggtcttcgggggccagccttgcccccaggtcaggggcaggcgactggcagagagaggggcaggccagatcagcagggcaggcggcccgcgtgccctcaggagtggagctccccccaccaagagcaagcagcttgagccatggctgctacatttgtccacaggaatgacagaaagggctgcaacaacagcgtgtctcgtttcactattctgtaaaggtttccagcattctcagtctcactaacactcgatgtgctaaaacaacgtccggtggctcttccactttctcccataacaaacagcgcccgctgagtccgtgcctggcgcagcacgaagcccttgacgttcctctctgcttcatcctgctaacgagctgtcacgtatccctggtctacaggtggagaaacggctcagggaccaccctgctcatcagggtagtgaggggaagacccaggtctaatccaggtggtctggtcctgtccccatgggagccccacggcataggcaagaggcagcctaatctgcggacaacctgggaggagggagggtcccggctggcttgcgtgaaggcagagctagctgcacacaggctctgtcggtgggtgcctctccatccctctgacaccagcactcctggggagaaacatgctcctcccttacgctgggccctcctgcttcccagggcacctcccaggatgactaccaaaacgcgactcacaacgcactacaccacctcggcactggtagaggaagccctccaagtcagacccacagaggcaagtccctgcccttagcaagcttccggacccctgtctctgcacacttcccctccttccccgaggacgccctgacccaattccggtgccttccaacactttccacaaggtctcctggccactcccacccccagctttccagctttggttcattcaaggtgggctgggggccctggatgctggagacacgtggctgacacgtggcacccgctagggctctgagcctttgactgtgctgttccagtggcctgaacactgttccctatccccacttcctgaccttgtctctttcaacccaagcccagctcatgaaaggaagaaatggcctttctcctcctctgtacctgccccctcgaatggcgggtcacctgctcaccacactccaggcaatgctgctgcgagatgggaaacaggcttcccagagaagatgccagaagactcagagggcccagccagctgtctccaaaacagggccccggaggcatggattcaaaatgtctgctaccagagctcagaccccaaactccaacctgcagcacgcaggcagccctgggtccagaatcccaggatcttccccaaaaagggatggggcaaggttgctttgtggctcaaggccaggaggtcccagagaggcagaacacctgcccccgacccgggcgtctcctgctgtttaggggtttcacgctcagcttttctcacagtctgctcctgtgcagcctgatttccaaacgagctctgctgcaaacttcaagcgcccagccggtgagaaccagcaaggaccagcagccgtgaagtccaggaaccccagtgctggggctcccacccgctgccagggtctgtctgtccacagcccctgagccatgaggagtgggttctcaaaggctgaaaagtcaagatctcaagaaaagagagacactctggctgcccagcaacccctggcacaggcaggcagggccaggccaagctgcagcattgcccctctccatcctgacggtcaagtccttcctcagcagcactcgagaggaaacccagcaagaaaaatcaattctggagaagcctcatttggaagtctgagtggagcaggtgggcagctgggaggctcctattcaactctgcacccgcctccagtccacagtcagacaccgaataagaggcacctactgcatgctaggccgccgcccagccgtgcgtgttcagagccagcagctgagagaggtctcagctttccacgcctgctcccctgaagccctccaaggacccacctctgctgccgacggtgggtttaagccaaggcggggggtataaagagtggcccacacaatcgggacttcaaggtcagggtcaaaccaaaggttttctataaagctagcagtaaattgcttttctagtatttctctttataaccatcttccctgagccggcttccgagtgccggagggttcaaatcctactctctggccacctggctctgagcaattagcccagacgcacgcctgcgcctcggccctccgggttgctctcataggacctcagcccctcctctctgctgcagcccacaagccatctgtgaaacgggctcttgtctctgccacctcattttctccatttcttcccccttccggaaagcggcctccgaggtcaacatgagggcattcgcacgctctctggagcgccctatctccagcgcaattggacaatccaactccagacggacccaagcagagggcgcgattcttcccgttcccccaccacccactaaaatgaaagccaaatggatcccttcacagccagcagacaccggatgatcgctctccagtctgaaggaacgattctcgctattatcccttcctgctgggctaaaaatattgaaggaaaaatgcaaccgcagcactagagagcttcccaagcaggggggtaaaactgagcctccttctatgatcagaaaccaaaggcaggcacagcccttggctatggaggcagcaaggtgggaggcggcctcttcccctgcagaaggccacaagccagccatgcgacagcaaagtgtcaaaaactcttcttagtcaattgccaaacgggcaactacgggggctggagaacaagagctggcacccagcagggtcagagcaggagtagaacagggactgtggggctttcagcctgaaaagtgtccctcatgcccgccatgtccccatttggagctcctgctggagcctctcctgcaggtgcctacaaagccccacccactggtgagtggccgtcacccgccaggcaaccccagctggacccaatgtggcacctcctcctcagcagtccctgtgcttcgtgaggcccatatgtgggagctgggagcgctagactagaacccctctcagcctggacccccgggacctgcccttcacctctcagagcctcagtttcctcacctgtcaagcaggggtggcagtcatacccacagcagctgacaccagaccacgggtgggtcactcaccttgtgctggggacagggcttttaggctgctcggctctgctgcaggaataggatcctcaaagcagaggcggtttccccattttacagatgggcagagtgaggcttcaggaagcgtagttatctgcttggagtcttaggcagctgctcaggatgctacagcaaaatcccacagcccgggaagcttgtaaacccaggggcttctttcttgtagctccagagcctggaagcccagtgccagcgtggtcaggttccagtggcttctccttgtaccattacacagcagagatgtacccttacatccacagagagtagagagaagcagtcccttttggtactcttaaaagggaccatcctattcatgaagggtccgctcttacgacctcatctaaacccaattacctcaaaaggccccagctcctaataacgtcacattttggggtagggtttcaacataggaattttggggagacacaaacattcagtccataacagcaagtgtaatgggttgaatgggtgggccccaaggagacaggtctgcatccagaccctgagaagcctatttgtgaccttacttggaaaaacagtgtttgcaggtaaaattaaattgatgctctcaaggccgggtgcggtggctcacgtctatagtcccagcactttgggaggccgaggcaagcagatcatgaggtcaggagttcgagaacagcctggccaacgtggtgaaaccccatctctactaaagatacaaaaaattagccaggcatggtggcacgcacctgtaatcccagctactcgggaggctgaggcaggagaattacttgaacccaggaggcggaggttgcagggagccgagatcgcaccattgcactccagcctgggcaaaagagcaagactctgtctcggggaaaaaaaaaacaaacctgaggctctcgagataagataatcccagattacccagtaggccctaaatccaagtgtccctagaagagaagacagaagacaagaggccgtgtgacgacagaggcacagattggcatgatgcagccacaagccaaggagtgcctggggccaccagaatcttgaaaaggcaggatggagcctctcctagagcctgcagaggttgcacagccccactgacacctagaacctggagggagcatggcccccgggacacctagaacctggagggagcatggccccactgacacctagaacctggagggagcatggcccccgggacacctagaacctggagggagcatggcccccgggacacctagaacctggagggagcatggcccccgggacacctagaacctggagggagcatggcccccgggacacctagaacctggagggagcacggccccactgacacctagaacctggagggagcacagcctgccaacatctagaacctccagaggcagcacagccctgccaacacctagagcttccagagggagcacagccctgctgacaccttggtttcaggctcgcggcctccagggctgctgctggaaggcgctggcctgtggttctttgttgggcaactccggtggccagctggtggcaggcagtcctgtgcccttggcgctgtgccccccaagcccaccacaacaggcacttggaatggctttgggatgaatgggcacacaatggaatgaatagggcttggatgagaaactgaggcaagagttctcctggtttcttccaccctttgttcccgttcatgccagcatgggttttgcaatgccctgcaccccggctcggagctgggagaccctggaccctgggcctggcacactggggccctctgaaaatgtggttttgacccccaggctcaattcagggctctttgggaagcaaagtccccagagggaccctggcagggtgggaagtcaggaagcacttgtgtggaacctcagacccagttccctctgaccaccatggggcccagcttcagacacccttgagtggggacagggggctcaggcacagggtggggcacctttccggcagggagatgcaggttcaaatcctgaaggtcccccacacccaccctgggaaacccagctcccatgaccccggctcccaggcctgcatgtccaacagctgcctccctgtctccaaagaaggcacctggcccgagtaccccaaaaccaagacctgtgggcctccatccctaggtgtcctccctctgcagaaaaacccactgcttgccagaggctacagccagcacctgacaggcagcgcctcccaccaccccttgcacaggcaggtggctccacatgtgggacaacccactgcacatgtgtgacattcttaagatcccagcactatacacgccatgggatgtaaaacacccttctcaacgtgcaacaaacacggccgaaaccgtcaccgaaagcactgcgcctgtctgctgctggggaatcactccgtggttagcacccatcatttcgagaagaaagagtcaattgtgatgttctgttaccatcccagtcatttccagggatttctgagaagcggcatgtgcctggtgtccctctgtccatctgcccatctgtccatccgcccaccagcacctgctgagggcctgcggccctgcatgcatggcccaggctgccaaatcagttctgtcaccatggggcggcaaggcacaaggaggagcaagtgcgcgtgagacgcccaacaggagagatgcctgcacttcaaggagctttctcgcctggtgctggaaaggacccaaagtactcagtgccgcagcagcacatcgcaagtgcgcagtgaatctgagtgaaatccacgcacgcctgaaggcttccggagaaggcatcgcaggtccagccatgggaggctggggggagcgggagctgtggcactgcagccaagcacttacatgtgccacacacctgtggggcgggcgggggatgctgctgatgctcgagcagggcaaggtctgtgatgtgtgtgtcctcatgtgtatgcgtgtggggtgcccatgcacatacatgtgggggtgcgcaggtgcttaggggtgtacaggcgtgcatgtgttcatgtgtgtgcacatgtatgtgtgcatgctcatgatgtatgtaccagtgtatgtatgtgcagtgtgtgtctgcattacgataaataaagctaagcaaaaatacatctgcaggagggcaaggaccgagataaatcattctgaactccaaacaggtggagggtaagatgtaaacagatttttcctgttgtttaaatgtacttcgttttcattatactgctgtttgcgtgcaatgaatgcaagtgcactgaggtgaggaaaaaggaaggcagacactccttcctccggctaccccacagacacccacaccatgagaaactagggcacccctgcagatgggaggcagcggtgaggtcgcctccaggctcggccaagggtacaggaagggcagaacctgaccaggccatttccagccagactctgcttcctgtggggagctcctgccccttcaggtcctaaaccttcaatcacccagattctggggaccccacagggagcaacatagtcatgccaccctccacaagcccagccagggagtgtggccccatacccgatgccaaggcgaggctcctggctgcggaagctgagtcggaagcacggtccccacactcctccttactccccgcccacgctcctccccactccccacactcctccccacccccctgcttctccccactctccccatactccccactccccctgccatgctgccccaactctccccatgctcctcagtccctccaatgccccccaagctcctccccattccccacatgctcctccccactccccacggtcctccccacctcctttctccccactccccccatgatcctccccacacccccactcctcccccctccccaccacgctcctccaactatccccactcaccccatgctgctccccattccccccaaagctcctccccactcccccacactccccccacgctgcttcccactccccccacgctgcttcccactccccccaacgccccccccacgttcctccccacccccccacttgcactccactcccactcctactcctccccactcctccccacagctctggcctcccccagcccgaggggagccctctaaaccctccagctcaggctgctccgtgaagctcagttcctgccgcttccgctcagcacaaaggcacggcccctgctggaggcccccgctccggggagctctcagacgggcagccagcacctcactgcccatctgctccttccctgcttactcgcagagtcaagacctggagcccacggggccaggaggcacaaagcacagcttcccaggtgacgctggacaagtcgctgaccctcctggagcctcagtttccccaacccagtggctctgaatgaattccctggattcctgagaaggagggagcttcctcactggttcacagggagagagggagggaagggggttctgacaattaaaaacaggtctgcaagtcaggaactcgatgatctccagaggtgccatgatcccctcgtctacccagcctcccctgggccctgcagcccctccctaccctgtgaccctcagcccaagcccctggggagggtctctggttctcagctgtggggttgggcccagcgggtctgggggcctggtggggaaagggtgtctagggtactctgtctttctacctttctgagttgtttcttcttttgctttgttttgtttcgttttgttttttttccaacgagtagacattacttttagaatttcttaaaaagttatctcagctttgggttgggttagggaggagggagtcctgggaatgtataaaaagcacgcagccagttagttcctgagaagtcagaaaatgcgaagatcaactgagaagctgtactttctggaaattccaggcgaaccagcaccaggcccctcggctggtgggcagagcaccagggggcgagggagcgggagggggattccctgctgccaggccaacagctgggccagccaaggtcaggaatgctgcagctgcagcctcgccttccgcccccacccaggcgggagcccagtgggagggaggctgcccctgccagggcctgggacagagccctctgtgggggacaggccaggcaggaaacccggccgtcctcaagcaggaaagctgggccagagctggtacttcagcagggagctgaactccagtcctgggcgcacctgtttgcagtcacaaaaagggcagactgcagcacccacccacctgcccagctccccacccagctccccacctgcccggggtacccaggactctctccaacgccaccagtgtctctctggttcctcactctgtgcaagcctaccctctggtgctctcccggttaggatgatcgtccctgctttaccaggtggggaaactgaggctcggcctggcagttacgggcctcccctgtaccagctgctgcaggtccggtctcatttcaccagggaaggatgtgtgcccaggacgctgctccctgggatgaaacgggtttgtttttttctcccagtatagaaataaccctgcctggatgagggcagggaagtagaataacatgaaaccgacaagaactcccatcctaaaacaccactaaccactgagggcgtttttctgtcgtctcttgactctgggtttttaggggttttttatgtgtgtgtggtgttttctacatatttgactactgggaataatatggcatattgcgtcctggtgccccttcgctgacagcacaggtgtcccagctccctgcctccccggctgcagggcagggcgaggaggggaggccagggacatgcgggcctggtaccttccagggcaagagggacgtcatccccgtgggcagagcaggaaatggaggaatgttgagttccctgcacccgctgtcaccgtcacagctggccccacctcagccgggacaccctgcctgggccactccaagtgactgtcacaacccgagagcctatggccaagatgagctccaccaagtaaaaatggtggagtgtggggaaaagcaagagagatcagagtgtcactgtatctgtgtagaaagaagtagacatggaagactccattttgttatgtactaagaaaaattcttctgccttgagattctgtgaccttacccccaaccccgtgctctctgaaacatgtgctgtgtcaaactcagggttaaatggattaagggcggtgcaggatgtgctttgttaaacagatgcttgaaggcagcatgctcgttaagagtcatcaccactccctaatctcaagtacccagggacacaaacactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggaggattagtaaaagaggaaggcatgcctcttgcagttgagacaagaggaaggcatctgtctcctgcctgtccctgggcaatggaatgtctcggtataaaaccggattgtacgttccatctactgagatagggaaaaaccgccttagggctggaggtgggacctgcgggcagcaatactgctttgtaaagcattgagatgtttatgtgtatgcatatctaaaagcacagcacttaatcctttaccttgtctatgatgcaaagatctttgttcacgtgtttgtctgctgaccctctccccactattgtcttgtgaccctgacacatccccctctcggagaaacacccacgaatgaccaataaatactaaagggaactcagaggctggcgggatcctccatatgctgaacgctggttccccgggcccccttatttctttctctatactttgtatctgtgtctttttcttttccaagtctctcgttccaccttacgagaaacacccacaggtgtggaggggcaacccaccccttcagtggagccaacaaggatgctgcagagcacagctccatcaccacctgcattcatccattcatccttcattcattcattcctcaatcttgtgtctggtcctactttgtgccaggctccaggcaccaggaagaaagccctgggccctgcccacaggaagagacagtcacaacccgaggttcccaggccaggcctgcgaggtgctccctgccccgccccaggtgttatttttggaggaggcggtgggggcctcccagggaagtgagaggtgccgagaaacagcacaggccactgcaccggccacagccccaggggcccaggcccaggcagggcttgcagcagagacagccccagatgatggggttcctgactgagctctcctccatgctgacagctactgaaaatggcaaatccataggcactagagatggtcccactgccaccaacagtcctcaaccccaggctgcaggagagatgctcagaacctgctgggccaagcccctggctgtcacctggggcagctgctgcacggaagccacaagagaggcacagctgggaggcacagacccaggccctgcaccccgacccacctcactcaggcctccgctccgggcttccccaacggtgacctccccaagctcctgcccaccctctgcgccagactgctccttcccagggtgaccacctctcaagctgttcctctcaccacccctttcacaccccattctgctgcaggcctgagctttcagggcaggctctgacccctgcccctccctaccagggagcccagggcacagaggcaccaagcaccccgtgaccgtctggacggaagaaagagtaagcagtgcagaggctggactgtgcaccacgtcccctatcttgtcctgactcccagaacctccaaacgtgacctgatttaggaaaacggtctttgcagatgtaactgaggtaaggacctcaagaagaggccatcccaggttagggtgggccccgaatccaatgaccagcatcctcttaagagacagaagaggagagaggcacagggatgaggccctgagaagatgaaggcagaggctggccagccaaggagggcccagagccgcaggaggtgggggaggcagggggaccctcccctagtgcctctggagggaggggctgcagccctgatgtccctgagaattcggacctctggcctccggaactggaggagaatgcacgtttgttgtccaaagctcctgagtttgtggtcatttgctgtggcagccacaaagcacacagtgagagccgggaacacgggtgcccccaaaccttacaaccgccaggccctcgtctctgaggcatcctctttgccatcgcccctgccccggggctaccgctcattgttccactctctatcaggagaaagaactgtgaaaaagcagcaaatgaaccaagctggggccgacagtccagcggatcccagcaagacaacgcgttcccaaaggcatcgctgcaggtgcactgtgaggtcagggcgccctccgggaccaagctgggccagaaagttcttatctgtgggggttttcatcatctctcagtttaaattctcaatcttcctgcctgcactggccacctgctccttggtctctggcaaggtctccacactggacagaggcccaggggagctgggggaccccactggagcctcactccctgcaggctgaccctgagtgccggccacgggagcctctgactcccacatgcatgggaggagtcatgaaagtggctcctcaaagcctctcccccaaatcatgtctccgcttaatagcggccgccaattatttcccaagccaggggatcaaggacttatctgcggagaaaacgggaagtaaagtgcattcttttcctgttcactaggagtcagtgaacgccctgctgactggcacagaaaagggaggtgcccagtatccaggccaggctctttcctcccccagccccggcatgtggcgctttgtctgcctgactctgtaataccctttgtggaacgcaggagtcccgaacccagagaggagctgcagcctccctgagggaagaagaactctcataagtaaagctcagggaccacctactccacactggctggtgccaggctccccggggacagagccaacggggcaggaggccgtcatgggaagggtgctcgagccggccttggagaagcccaggaggatggtgagcacagaggcaggagggcgtgcttggagaggaatggtgaccacaggtctgccgccttgcaatgcgacgcctgcctgggagcgcaggtgagggagcaggggcctccactggcccacacccggcacacatcacgggcggccccaagctctccaggtgggagctgctgagcgcttttagttagcccaacacggaccaaggccacctcggcttcattcaccaagcggtccccaagaaacaatcactgcagtccaacagaatagtcaaccttttgatctcagaggagtgtccattaagagtagggttcctcactctcagagcagacctcccagggacccccggccaggactcaagccggccaatgagggctgaagcttcggcctgtggccaagacaccatgggcagtggaatgagcaacgtgcagttttgcacccagaaactggtcaggcttctgatgggaacggaggttgggaacaccagcatctggggctgcagaccagagggccctggaatccccttctccaacccagtcgggtttcagtgacccaaggtcagaggcatggagggagccctttcccaccccccgctcaacaggaacacagctgcttcacctctctggggtctataatgccctctgacctcacaaagacccacggggctggtttgggaggcccagcccaggtgctccagtccccagagcacgcataagcctcagccagttttacttcccattgcaaacccctagccggtttgcctgcgaactcccaagccagctgcagaaaagacacaggacacaaccacggcccagtggctcagggagaagacccgggcttgcatgatgtacaccagggagcccacaggagcagagtggcccctcgttctggtggccacgcaggcctaggctgggaacagggagaccctcaccgtgagcctcatccacccagagggtgcccccaccctgactcctcaccccacggtggcccctgccagaacccagcatcatcccccatgccgggtgctggggaccctcttcctgaatggtcctcagccaccaccatccccaccttgatggcctcatggaagccagaggcttagcactgacatagcaaagccagctggctcagcactgggggtggagggaatgagcagacagaaccccacaggagttccaaccccaccctgcccaccagctcctctatgggaccctcctgggcacagagggggatgaaggggtaacaggtaaggatctcaagatgaggccacccaggatcagggtggaccccagattcaatgaccagtgtcttctgaaggcaggagggagatgcagggaagccccatcttctaggagggcctggacttgagctccacactcaagttggccagcagagtccagccatgcccacaagcagctctcaaagtggcagtcccctgtcagctggggtaaccaaggtaggctttctatccagaggcagaggggtgcgggtgtccctgcagagaggagctggtgggaggagctgggtcctccctactcccctgggtcttgaggggctgctcatcccccagcccagggcacctgggctgctgcgggggtcctgcagatcagggtaccctgggacgcccacccaggcctggctccagctctccaagcacagttagcagaagcccctccccgccccaccccccacaaagctcccggtgctgggactcggggggctgtgaacaccaacattttagtgataatttcatcaacattaaggaaattgaaagcaccatttgatttgagctctaccgagtgcattaattccttgaatggttttcgagatatcattgtttgattttgcaggtttcaactttcccttttatgttattaagagtatcttttctgcttcaaaaccacattgagcgcttggctccattcctaggttttccccagacctctgaccttcctccctcctgaggttctttcatggctgctaaaagtcttctttttccagagcaaattttgcaaatctcaatttcgccaagaggtttgacttttcatccactttagtcaataatgtgattgggtacagctttattaacagtcacttttattttggactgattatttctaccaataagcatcttagaacttaattaaaggtggtcattatgtcttggagcaaaggccctttgcacggaaactgggatggtgcccggcagaactcggggtcgaagctacaagagcttccccaggacccagcaccaggaggctctgtgaagacagtattcctctagtaagtatcaattaatgatcagtcaatcagggatcggagccctcagcagagtcagcagcccaggattactagcacggtcaggaagacccaggaaacgccactgaccagaaccaagggagagagggcacggaggccatcaagcagggagggctgggggcacccagggtgggcagagacggtgcagcctgtcctcataagctggctcgctaagggtgtgtgtcaacagagagcctgcacgtgagctccacactccaagtcggccagcagggtccagtcgtgccgacaggcagctctcagggtggctatccctgtgttgggggtaaccaaggtaggctttctacacagcagggctgtgggcatccaatcaaaagggcttggtctggtcaactccagaacttccaagcaccagaaagccattgaaacaagaatataaaacgccacgttgtatcacatccaaggactgtcacacgtgaaacatggcatgattttatgtatcgccaggggaaaaaatgcctgtgaaactctaattatgcctctgattacaaggcttccatgacccactctggcttcagagatgtcagaacatgcaaggaaaactatgtcatcttggaatcaatgaaataaagtacatggaaaaccatttaggataggcaaggatatgagaaaagctgagtcctaaatggaaagtatagcacagcccagttctgtaaatcaaacaggagtgaccacaattaaatgtaaatagctctcctctaggtgataagaagactagtaaactttaaaaaaaattattcattcatatatatatatatatatatatatatacatatatatacatatatataaatgaataggccaggtatgttggctcatgcctgtagtcccagcactttgggagtccaaggtgcagattatgtgagcccaggagttcaagaccagtctgagcaacatggcaaaaccctgtctctacaaaacatacaaaaattggccaggcgcagtggcacacgcctgtagtcccagctactaaggaggctgaggcaggaaaatggcttgagcctgggagttcaaggctgcagtgagccctgatatatatatatatacacatatgtatatacacacacacacaaatacatgtatttacatttgtacaaatatatacacacaaatatatgtatttacatttgcataaatatatataatacacatatttatgtatataacatatataattttgcatgcgtatgctttttataatggatgtcatatatgtataatgaaaaatacattttagcacaacataaaaattataggccaataccctaacgaacatagatgcaaaaatcatccacaaaatcctagcaaaccaaatccaacaacacaatataaagaccccttaccatgatcaaatgggatttatcccaggaatgcaaggatggctcaacatacagaaatcaataaacatgatatatcacatcaacagaaggaagaacaaaaaccatatgatcatctcaacagatgcagaaaaagcatttgataaaattcaatatcattttgggataaaaaccctcaaaaatctaggtacagaaggagcactcctctacacaataaaggtcatacatgagaaacccatagctaacattatactgaatggggagaacctgaaagctttttctctaagaactggaacaaaataagggtgcccactttcaccactcttattcaacgtagtactagaagtgctagccagaccaattaaacacaggaaagaaatagagggcctccaaattggaaagcaggaagtcaaactgtccctgtttgcagacatgatcttagatatagaaaaccctaaaagctccaccaaaaaaacctagaactgataacaaattcagtaacattgcaggatacaaaattaacatatagaaaacagtagcatttccatacaccaacaatggactagcagaataaaaaaaaaatcaagaaaggccaggcacagtggctcatgcctctaatcaccgcacattgggaggccaaggtgggcagatcacctgaggtcagaagtttgagaccagcctggccaacatggtgaaaccccatctctaaaaaaaaaaaataataataacaaaagttaggcaggcatgatgatgggaacctatagtcccagctactagggaggctgagacaggagaatcatttgaacccacgagatgaaggttgcaatgagccaagatcatgccactgcactccagcctggatgacagagcgagactgtcaaaaaaaaaaaaaaaagtcaagaaagcaataccatttataacagctacaaaataattaaaatttctaggaataaatttaaccaaggaggtgaaagatccctacaagagaaactgtaaaacactgattaaaaaaattcaagcagtcaccaaaaatggaagacatcccatgttcatgcattcgaagaattaataatttgaaaatgaccacactaccaaaatatctatagattaaatgcaattcctatcaaaataccaatgacattcttcaaagaaatagaaaaaacaatcccaaaatacatattgaaaacacagaagaccctgaagtgccaaagcaatcctgaacaaaaacaacaaagctggaggcatcacactacctgacttcaaaacacactacaaagctacagcaacaaaagcagcatgatactggcataaaaacaaaacacatacctagaccaatggaataaaacaacccagaaatgaatccacacatttacagtcaactcattttcaacaaaggcaccaagaacattcagtggggaaagaacaatctctaataaatggtgataggtaaactgcatatccatatgcagaaaaatgaaactagacttccatgtctccccatatgcaagaatcaaatcaaatgggattaaagacttacccataagacccaaaaccataaaactactgaaagaaaacattggggaaatgcttccggacattggtctgggcaaagattttttgggtaaaacctcaaaagcggacagaacaaaacgaaaaatagacaaatgggattacatcaagctaaacgcctccacacagcaaagcaaacaatcaacagagtgaagagaaaacctacaggataggggaacaaatctgcaaactattcatccgacaagggatttttaataaccagaatacataaagaactcggtccagcgaggtggctcatgcctataatcccaacactttgagaggccgaggcgggaagatggcttgaggccaggagttcgagactggcctgtgcaatatggcgagaccccgtctctacaaaacatacaaaaattagccaggcgtggtggcacgcacctattgtcccagctacttgggggctgaggtgaatcacttgagcctaggaggtagaggctgcagtgagctgtgatcacaccactgcactccagccaggtgacagagcaagatcctgactcaaaaaacataaaaaatttaaaactttaaaaaaaaaaagtcaacttaatagcagggccgagcacgatggctcatgcctgtaatcccagcactctgggaggccgtggcgggcagatcacttgaggtcaagagtttgagaccagcctggccaacaccgtaaaccctgtctctactaaaaatacaaaaaatcagttgggcttggtggcgggcgcctgcaatcccagctacttgggaggctgaggcaggagaattgcttgaacccaggaggcagaggtggcagtaagccaagattgcaccactgcactccagcctaggtgactgagcaagactttgtctcaaaaaaaaaaaaaaaaagcaaatagtaatgataataataataatctgatttttaaacgggtaaataatctgttattaagacatttctcaaaagacatacaaatggccaacgggcatgtgaaaaaatgctcaacatcactaatcatcacaggaatgcaagccaaaaccacaacgagataccatctcaccccagttataatagctattatcaacaagaaatcaacagatgctggcaaggatgtggagaaaggggaacactagtacactgctggtcagaacgtagactaatacagccactataggaaacagtacagagggtcctcaaaaaactaaaaagagatctgcctgatccagcaatcctaccaccaggcatgtaaacaaaagaaaggaaatcagtgtttgagatatatctgcactcccacctttaccgtagcactattcacaatcaacctaaatatcagtgaatgaatggataaagaaaatgtgacatatatacacaatagaatactattcagccatgaaaaagaataaaatcctgtcattgcagcaatgtggatggaactagaggtcattgttaagtgaaaaaagccagacacagaaagctaaatatcatatgggccgggtgcagtggctcacacctataatcccagcactttaggaggcctaggctggtggatcacttgaggccaggagtttgagaccagcccgcccaacgtggtgaaaccccatctcctactaaaaatacaaaaattagccggatgtggtggtgtgcacctgtagtaccagctactcaggaggctgaggcaggagaatggcttgaacccacgaggtggaggtcgcagtgagccaagatcacaccactgcactccagcctgggcaacagaggaagactctataaccaaaaaaaaaaaaaaaaaaaaaaaacctaaatatcatatgatgtctctctcatatgttaaagctaaaaaagttgacctcatggagggacagagtggaatgatggacatcagagactgggtggggcgacaggaaagtgaagagagattggttaatgggggcaaacatgcaattagacaggaacgagtcctagtgctcagaagcacggcaggaggattacagttaacgataacttcttgcatatttcaaaataactagaagagaggacgtgaaatgttcccaacacaaagaaatgccacatgtttgggatcatgggcatcctaatgaccctcatttcatcattacacacggtatatgtgtattaaagtgtcacacataccccataaacaatggcatatgtgtatcaaagtgtcacacataccccataaacaacgtacaattattatgtaccaattaaataaataaataatacatttgaaaaggttgtgggggggaaaaacaccaccaaaaggcaagagaggctcagagatgcagttgtcaaagctctggtaccacccatgcaccaggcaacatgaagaggaagagaaacgcgctcggggccagtcccatggtccccagggtccctacccatggggccatccccgggggcctggacagagctgccggtcctctagagcctacacgacccgggctctggggctgcctggggacatcctccagccacacactgacccatcacagagccttgtagccgggagagagagccaccatcggcctctgcctctcgtgcagcttcagaccatggcactgtcctctgtcagccctgggctcactcctgggacctgccggggtagggccctgtccccagctcagatctggagggtgtctcgagacccccggctggctggctcagcggctcgcgacagcacagccaccctcggttgcagcaaatgtgcctcactgagaaccaccacgaggctatttcccgattaaagctttaacagatcaatagcaataagtgagtcccccaaaaatcaatctaaggcagtgcccttttctaagaaaaaccactctttccacaggcaaaaaccacttaaaaataagagacaactgttttgggttttgaggcagtttggccgggtgtcggtgaaagccgtctagttgcctgagatgaatcccacatgccgggattcacacttcccccgagagctggattccaccgtgcccgccgggcctgcgaggacgagagctggattccaccgtgcccgccgggcctgcgaggacgagcctctgcacctgcttccctcctgccggatgaactgcggcttctcacggctgcgctgctggcatggtagagaatacaacgaacagggaaggagggaggatctggaattcagtctgtgccaatcagacgtctctctccagggatctgacagtgccagaggctgctaagtttggtcactcccaggctggggccagacccaccaagaccactgacctcccaccttcaagtccagcaaacctggacaccaaccagcatcagcaccactgagacaagaagcctgaggccaaccagggaacctcaggggtggagctgaaacaccccaaccctgaccagagcggattccaggaaggctgctgggagaacccagacatccctgcaaccttggccagtgggggacttgaacccctagggccaactccagatgagccccactgtccatcgcactgctcaagcctgaccccagagcaccctcttcatcacccaagtccaatccaccccaagcccacccactcctcctgcgctccagcggggccgtccatctctctccattcccacttctctccccaccccccagcctggacacccccatctgcctctgccccagcctctggggctccaggcctccctctccaggtgtccctgtagtgcagacacagtggagctttccaaagccaaatctgagcacgccacatctgcaccaaccctgcccagggttccctggcacacccaggatgaagccggccctgcctccctgcagccttcaaggcagtgactcagagttcctgccaccccccagacgtgcagggtggtctgcaccccctggcctcagcacccgctgctcctgccatcctggtcctccaccctccctgcccactcaacagctcccacaatggccacactcctcccgctcccctcagactctgcaggactccttgaaggagagaccgagtctcaaccatctctcccttgccccaagggccaatcactcacaagtgccaggtcctcagctccctgggcacaggaaggcctggggaagggccccacccgatgaccccacacagcaagcgatgtgaggaaaacccccgcccgccatgtcttgaaaatacaagtctcgtaaaaaggcagtttcccaagcggaggctgggggatggcaccacgttcggtgcttgctgggagccagggaccttggcccacacgaggccaccgaggctcacgggacctcaccagacctcacctgaccacccccacagcccgttctacagaggagcccacagaggcgtggcagtggcgatcacgaggctgtccacggcacccacagccctgtggttggtgtacctggtccctttgacagacacatgtggggctgcagagatggaggtggctccttccctgggcccagccttgctggcccagcacctccaacttcgaagcccagccccagcctctggcctagctaccaacaagaaagctgcctctcctcaggccccaggggcaggcagcagaaagcctcgggcctgtcacctgccccacagcctctcgtgtcaaatggtctcgtctgtccatctgcagggcagccctgaactagcaggccactcctcaatcacagtaaatgcaaacggcttctgtactcttgctttaatctacagcctggctctccctggttaacagatgtttcgtttaagcagctaaattaccacaaaatacacccaaagagatgacaggccaatttctcccaaggttcatttgcatgagaagggaatggtgtgtgaaaattctatcttttcctttttgaaataaaaaatatatatatattacaggtgcaagtcacagtatctcaggagcccgcggtgcctcctgcggggagtggggacaccaaggtctggaccgggaagccccgggttccactcccaccatcgcttcccccaacgaagtcaggcagagtccgtgtgccctctgaccctcagtctccaaagcttgcagatggaacagtcgtaactgctgctgtgaggcctgtcgggggcagggaaagccctctgggggtcagacccacttggcccctcggtgtttaactgatcctgatcgtcaccatctgggtcgccacggcagcccaggggcagccgcaagcaggcaccgtgggaccggtgactccactgtgccccaggaacccaggagggggccacatgttctacgccaatgactctctagcctagaaactgtcctggccaggcccacggcccacacacacacagaggggcagcccaggagccagcccacccctcccaggccaccagacggcaacaccagagaaaggctggggggcctgagctgctccactggggaggtgagtcgtgactgtgacactggcctcctgcccaggccacccatttcatactgcaaaggacaaccatggccagcatgtggaggctgctgacatgaagggtcaaggccagcgtgggaaggagcagggcaggacaggggccccaggagctggtccagggtgtgggctgagccagtcacgggtccccagctgtcaacaaaacccacagcctggggccacctgcaccacccgggtcctgaatcacaatggggaggcggccagggcttcccccaacagaaagggcaactcctggtccaacagcatccccgtagagtgcacagacctctgcaggcaaaaaaggcccctggggctgcagatccccgagcccttggtcacttcaaagggcagaaaacaacctcaaggaagtggacggcatggcccggattcaccagagatgcagataggcacagaagggaagtcttctgccccaggtcacacagcgcggatgcagaccaagccccaattcctgtccccaaaggccattctgattcatccatagccacacacacccacacacaccccaaagtcccaagaattcatgctgccaagaattcgggccgcacagatcagccaacccataaaacacacacatgactgcttcgaaaggtgaggtttatggcctggatttattgacgtggtttttcactcccagataaggcacctgtcctcagcgggcacgcccctcagctcccgctaactaaacagtcaggaattgctgggcacccgtccgtccgacccttctctaagaacatctccaggcttgcagcccaggcgctgcgatgctggggcagggcaggggtgggggaggctccaggaacacactgcgtcattagctaatgcagaaaaatggagattcacccaaagaaagcagcggagagcccatgtcattattaaaggcaaacactctttgccgctggctcccgcagacacatgtagccgaggggcggcccgcctcctgcaagcctgagcccccctgagaaacatctccttaagaaacagaagagggaacttgtcacccagagcatggagcacagacagtcagagtcatcggcagggcctcccgcaagagtcctcacaaagcagatccgaaggcagcggaggctcttgccactcactccagcgaggggaacctgactgcagacacccgcccaagccctcctcccacccactcctggaggcgtcaggcagaaatgatggccccactttacagatgaggcaaccaaggcccaggcatgatgcaggtggcccgagatctcacgtgcccactggacccatcttccttcatcacttaacctgagttaggcactggctactcccatgatgaggggtgtctcacaagtccatggagaagctccccatcaccactttgaagatgctaagggaagggtgggaggcggaggaggagggcactggggaagccgttgcctggaacaccaaccagcctccctcctggagagagatgggaacggtaaggaatccccagggagccctgccttggtaccaaggcagcgggcagtgaagacccagtgccacggagggcccaaggaaggtccatgggcacaggggatctgcaagcccccctgtctgcacacagttgaagagacctcaatgccaccatctgtctggcatctggcccgcctggcccagcgctcagcccgcccagagcgtcaaccccctgcatcctcacacccactctgcacaggaaaaactggcgctgtaccgcgaaactcggagttcagaaacgtgccaaagtcccacaaccaggaaagaacaggcttcttctggtgtatggtaacatcagcctccctcccatgacccccgggcaggactggagagttatcctgtcaccccggcatccctatgccgctggcctctggtcctgaccctggaggtgggctctccccggaaggccatctgcaaagggcagcggtgcagaaaaccactcccagagaggaaggagacccaaagaagctggcgcagacgagctgacagtgcccaacccacgcacgccctacagagaaggaagatgacttcaaaataacacgacactctccctcccaattccagtgatcaaggtggcaggtgaggaaccctagataccccgcacaagggtgacgccctcgccctttgtccctgggacattgccagtgtgtggctacccacgcctacccacccatcaacacccccatcatgagaaaggacacctgcgtgtccctaaagaggaagacaaaatgcagggcccccccaggccttgggataagcatcaaattcccactcagctgactgctgggaaagaacctcggggcagaaaaacaacatggcaattcaggaggaaaatgaggacgtggaagcaggatccagcaggtcagagtcctgaccccagattaccaggccaggaaggtgggggctggggtgttgtgaacctgttccagaacgctcccttcacgctcacctggcgcactgtcacgcagggctcagctaaaaggtcacttcctccaggaagccccagaccctgccccacccacccgctgccacattcctggcagggcccagcgtctcctcacactccctccacactgcctgtgtggtatctgcctgtgtcctcctgggccgcaagcagggctgcctgtctgcccggagccaggcacggggtagcggtcagtaacgcttgctgggtgagtgaatacccaggcccaccacaactccagctcccttgcacaagggcctagacagggaggtggtcccagaacggcccacagtgcccctccaacctccagcctccccttgaggcagccactcgccgggtgggagtggacgtcaggtgaggtgaccagggcacaaagcagcacagtcacatcagcagtggtctccgtttgctacctgcttttgcgctgggccaaacacacacctgcaccctgtgtcaggtgtgaccactccacatccacccgggggacggggagtgcaccaccttcctactgtggaaatgggtaaactgaggctcagaaaggtggagcaagttgcccaaaggcatgagcaagctacagtttccaagctggacttggaaacagctcccttaacgtggtcctcttcctcactgtgccattcacccactcagaaaatccacacactccctgcgccctgcacccagcagtgcgccgcggacagataggtcacgccctgcacccagcactgcaccatggacagacaggtcagcacacaaggcttctgcttccaggacttccagacaggacactcacttttctgactggcccccgaagtcttccaagaacctccaatctctcaggccaacagtttccctcaaggtctgtaccttgtggtaccgtggggagcgggcctcacccaccctcctgcagggccttccacgtgattcatgcccctggcagaacccagcgtgcgtcatggcccagagcgagtgtggtccatctcaaggccctttttacggccttttcctgctgacgccaaccaaggcaggtgaaagcaccaacaggccgtttcacagaatgaagggaatgaaggcctcatttcatcaactcctaccccgaggcagaacccatccccttactaggaaaggcaggcaccccagcctgccccggcacccccgccatgtccatggcctcccccaccaggagctaggagggctggacacaaacccatatcctcgctcagtgctcagtgggccaagcctgtcacccacagcaggaacttgctgggtcaatgttatctgcctctctccctccctacctggcctcccacacttggcttacctcccatcttggggtctgtttctggggggcccagcctcagagccttacaaaacaggattaaataaaacttgccagccctgggcagagactgtcactcacacaaacccctcaattttcaaaacacgacatgtattgcggaaagtattagcagcagcaacagccccagtttacagataaggaaactgaggctcagaagtgatgtggccaaaatcacacaactgagaaatgacaaaggacacaaagtctagctccctccaaagtctctgagcccccagcctgcctggcatggccaagggaagcccacacggggctgctcacccaagaacacagaggcacagtgccctgggtccaagagagtgttgagctctaagagaatatttaaatatctcatacctgtatgttcacctttatacctatgcagtcacagaatagaactttcaatatttgtcaggagagagggacccaggaaggcagacgggtctcctccaaccctcccacacttcttctcttgtcaggggacttttaaaaatgctatgttggccaggcgccatggctcacacctgtaatcccagcactttgggaggctgaggcgggtggatcacgaggtcagtagttcaagaccagcctggacaagatggtaaaaccccatctctactaaaaaaaaaaagaaaatacaaaaattagccaggcgtggtggtgggcacctgtaatcccagctactcgggaggcagaggcagagaattgcttgaacccaggaggcggaggttgcagtgagcggagatcgcaccactgcactccagactgggtgacagagcgagattccatttcaaaaaaaaaaaatgctatgttggccgcctctagggtcatcctcccacaaggggatcctttctgcagcagctaggttaggatggggtccctcaacccctgatggaggaggcgacagtgagatcctgagtggactctgggaccagcatcctctggccagcagtccaggggggcagtccccccagccccgcccagccctgcctctcctggcctcaccctcgatggaggaggagacagtgagaccctagattggagccctagtaagaagatgggctctgcctcggggttgcagttgatgaaacgaggccttcattccccacaagggagaggctatttattttaattgtggtaaagtacacacaatgccacaaaccttccgcactatggagttgtggaactttttcatgcctggcaaacagacccccaagcccctgagaactctctccccagcgccttctcccggcagctacgcatctggctttctgtcctgcgacggagctgctattctggacgttttaagagaatcacgtgggacttgtctttcaggcctggcttccccgccttagcattccattttccaggttcatccacagatattctactgcatggacggactctgtgtggatcccccattcatccactgaggaagccactccttttatccccatcctacagagaaggaaactgaggctccaggaaggtcaagctcaaaagcacacagtgtgagcagctccaggactccagcctaggtcctaaccacactgccctgtgcctggacaccccaaggctgaagggggtgcctctcctacagccagggactgcggccagaggggagcgaccacgcagcgaggctgaggtgctgggagttgcggagcccagctccaggcccaggccacgcccagccgccctgccccaagcctgcctccttccagctctggaatgaaaacaaataaaaccaagagggacttcaggcagagtgaggcccccccagcatcccacgaggacctccggcatccaatgggtgcctggtgtccatttgaggagcagcccagcagctgtagatggaacagctcagatctgaagggggtcttggctttcaccaaaatgactgcgggatcatttctctctcccgtcccagcagaaagatgagctggggcctaggggagggaggcacagatggcccagtcacagagggcaggagggtctcaggatgcggcgctcatgagcatgaaggactagaaccttccgccaccccagggggcctgggacacagaatgttgccagacaaggattgtctaggcaccttgtgcaccggggacacgtggcaatggccctggggccagtcaccctccacgcatgacagctgtcacttacccaggcaaatgacatgacaggcggtccatccccatccacgacagctgtcactcacctggcacctctggttcctgacaacagtcagaggtgggacattggagctgcaggcaagtgtccagagcctgcccctcaacacgcagcctgcagcccctgccggacgccaaccacagacacgccagagaacagaacaaggcagaaaaaccaaaacataggcctcaaaactcgggggagcagccgaggtcaagggggcagcacctgagtcaggaaggccacgccaagtccaggtggctcagtacctcaggcctctgcccctcagctggcaaaggggatggggcgtccacctgccctggggcacgcagctcccacgccccctgcctctggagatgtcctacgtgtatgcgtccacctgccctagggcacgcagctcccacgccccctgcctctggagatgtcctacgtgtatgagacaaatgtgatgatcccagaaatgtggctgaaaactggacacacattcaagaccaggagcggggaggcacacggtgttcgagggtgaggccaggacaggcagggctgggcagggctggggaaactgccctccctggcccgccggccagaggatgctggtcccagggtccactaggaggatctcactgccacctcctccattgcaggctgggggaccctctcctactccagccactgcagaaaggatccccctgtggaaggatgaccctggaggcagccaacacagcattttttaaagtccttaacaacagaagacaggcaggcaccccctccccacccctatgcagatttcaaagaacacagggctgggaggccttgaggaaacttggagacgggctccccaatcctgggaaggccacagcccgcaagcacctggcgggtcacggaaagataccgcgtgttcgcgctgcctttgaacccaaaagtacaaaacaaaccaacagaaatactgatgacttcagggccaagctggcctaggggacaaggagtaggtctgtgagaatgatttgtcttcatccttacacaaactctgtaaagactgacagatgaaccccacaaaacagaaacactgtttccagcagcatcaggattgcaaaacctgcagctgccaggcagcaggagacctaactcaggggcgcagccgctcagtctggcccaaagttcaagctcccactgcccagtcctgtcccctccacggtcctgtatttgtcattcttgtttatcttttggattcagaagccaaacagcgtccccagctccaggcaaagagtccttcagaacacgaagcttcaggggaccaaaaaccgggcacctgagcctggggctggccccggtgaagaagggggctcatcagagctgagggggtcagggcaggggagttcgctgggtttagggtctcctccagccagctcctgaccccagtgtgagagcaggtctgcaggtcccggagcgcccaccccagccgcgtcaagtgggcacatggggaggggcactgaggcttcggaagagctttcgtgccaggggtggtggtgtcggagaggcgagctcatggctccaccctgcaggggctgggagacatgtccgccgagcacttcccacttgccaggcaccgggctgacagccgggtcctcggccaacccttgggaggggctcctaaaataccccctttgacagcggagaatgcagggtccagagaggcgccacgggtctgccacgaggtgctgagccaggatctgaacgcggctgtcagaggctcaacgctgtgtgtgcggtctccaccctaggaatgtgtcggccgctcagtgcccaaccacacacgaagccaggcccagaggagatgggtccccaggcaggggctgcatgaggacggctcggctcccagggcagcaggaaggagcggacgccgcagccgtccggaactcggacagaggatgttgacagggagggaggacaagcaaatgaagacttcctgcagcagagacacagagcccggagccacggccgccggcaggacaggcagccaggcactaatccgggcccggccccgcctccggccatgtcccagagccccaccactgacctctggcccacgaggacctcctgctgtcagcctgctgactttgccagggccccgagctccccaacaggccccagctgaactcactcagctgaaacggcattcggggagcacaggtgctagtggtgaggggaaggcggcgccagctgcgcaccccaccgccctgtcacctcatcagggagcctgccggcgtcacctgaaggcagccctgccttctgcctgccttctctctctcatctgaaagtgccatcttcctctctccattcatccttattctgtgccccctccagaaagccagcaacaccaagcacagggtttctgcctctgcggctcaatgccacgagccagtgcgcgacacacagagtagggtggagaacaggctgggccaccagccacccgggagcaggaggcccaggaccggaagccatgtggccagagggcagagctggtcagccctggggccatctctggactcaggcacctggttctctgtctcccaacctcccaccaacccaaggggccattttgccggtggaggggggaagtgaatggcgctccagaggcaagagacctgcacgggctggcacgaggcctcaacccccacacagctgcatgacctcagactggcccgtcacctgtccctccttcatccattaaccagggcagagccgcccccacctggtgctgcccagagtcttccaaggaccaggggaggtgccagtgctgggcggtcctgaaacaaacccacccagaatagagaaagggcatgtgtcagggcagaggggccctggcaacaagatctttccccagggcactggggtgctgcccccgaccctgacaccgcagaggctgatcatcacccagctgcccgaccagccatggggcatggccacctctctggaaccttctatcacgcatctccctgggtctcagactcatcatctgctgcagggaaacaccatcccctgcaaggcagagggaagaacaccaagcaggtggcccagtgccagccaggtcgagctctgcagtgagcggcagccgctgccttatgtctctactcatcagagctggtggcatgcagcttcctctgccccaactgctgctggaacgcagatttcaaaaactgcaacaccccttccagcaatgatccaggatgaagcactgtggcagcgcctccagtctgtggccacacagagccctctctgtagaacaaccacctgtctccaacccttagctaccaaaagccatctacttttcagggcatctcaagtaccacctcctccgggaagctctccgccatcaccctgcccccagggatctaaatacctcatttgctgaggactagcacagcttgctgttgaccctgccaacagcaaagcctgcacgtgccccatcttcgcccagtcaaacccaggaggccctggggagaagcaggagacggggtgaggccccttcttcagcgtcccgtgttgccagcaggttttcctcactcatggtcctcatgtgagtattaacagctcccttccccatctcagacttaggtgttgtaggaccatctggctcacctgattctgcttgccccagaatgcctccttctgcagacaggcactagtgaccacgaccacaccccccactatacccgtgcagtgtccaggtgcgcccagcagcgcgcccagggcttcaccttccacttggcggcgagaggggaggggaagagaggtgggtagtgaggcggcagtctcaggaagagagccactccctcaggccgcccgctgcactctgctctgatgctgagggagggcaggcggcgggtgagggccggtgcccttcactgggagtgagccgccgggctcggggtgagggtgccgagtcctgaggctcagtgggccctgctgtggggtagaaactgcgctgggcgccagacacacactttttgcaccaaatctttccaagagtctgcaaggtggccaccgtcatcccatttcagacaaggaggttgagctcgagggacacggccaccaagaagatgctatgtgtggccaagcgagtgtggtccccactgccgcccctgcgggccactcatcgtgtttccaagcatttccaaggatctctttctggcagtgtcattccagacacgaggagcccggcctctgtcaggaaaatggggctgagagcaaagccccctctagactgccccaagggcgggggtgggggtcatggaggcgctcagcccgcttcctggcacgaagagggcctgggagaaagctttgctcttactgagcacttgctgttggaccagcccctgccaaaggctttagatacaaatggaacagtaaatgcaacaaactgtgcgacccggaaggggaaagcccgggggaccaagagcccttgtcaggggactcgagcaggcctgggggcaggaaaggcttcccaggacaggcctctaagcagatggcagcagtgagccaggcaagaaggttcccctccagggaactgcaggggaaaggccctgaactgggaggcacaggaaggtggccagtgtgcctgaggctggggcaccgaaggccagggagactcggcaggggcgacggccggccggcaggagggtgcctccagggcaggagcaccaaactgtgcatggctgcagcacacgtggccgcagactaggcttgtggggcaggaggccgcaagaggggcacctgggacggggcacggccaaccaggctggcagggcaggaggccacaagaggggacctaggacggggcatggcagactctggctggcagggcaggaggccccaagagggggcctaggatggggcgcggcagactggctggaggggcaggaggccacaagaggggacctaggacagggcgcaggagtctctggctggcggggcaggagggcgcggcagactccggctgccgcctggttttggagggctggccgctgtgctttgcagggcccaccacctggttttgcagggcgcgccgcctggttttggaggccccactgcctggtttcatagggcccgccgcctggttttgtacatcctgcaagctaagaaaggtttttacgtttttaaatggttgagcagggtggtgggggaagcgtaagagtaatatttcatgatatgtgaaaatgataacacatttcaaatttcattctacaaaaataaatttcatgggagcattgccacgctcctccgtttacagaccacccagggctgctgtcgtgctgcaaggggagagttgcgtagtcgtgacagagaccgtctggctcaagaaacctaaaatatttaccatccaggcctgcgctggaacatctgccgccacctgctctaggagagagacggcagtggccgggctgggacaccggcagagaaggaagtgacttcaggggcagtcaggagggagacctgctggggcctcagctaggggctcgggtctgggcatctgcataaagccagggtcttccacactggccccaccaggttgccaacgctgtccctgtcctgggagtcccacccctcaaactgggaagccacagcccacagacatggcctggacacagggacaaacatgtgtccctacaagtctcctcaaaagagggcatcacgctgcccaccacccaggccagagcccagcgtccttccaggaagacaaggaagatttcctccaggaggagacatcctcatgacctgcgccccatagcaagaaagggctcaacagaggcacagggggtggggcggatgctcacccacgccaggcccccaccaaggtcctgcctccatgagtccaccgccctgaggccagggccccgacccatctccaagtcccaaaccgcaggcagacacgggtcactctcacggcggcccccacacctcacacccagcattcctcccggtctcatcctgccccacaccaacgccaggatttttgcaatcacaacgctcggcagagaactctctctcttcgccaacgccaggctatgctgtccttgcagccccgggtccttcctactgaccccaggcctgagcctggaatcccactcaacacagccctcaagtcccactcccggtcagtccctgtcactaacagccagggctcccaccccaccccaccccaccccacgctccccggctcctgcccagcaggaacgccagtgctcgcaagatgagtgtttctcaccctcattttcgttactgtccctccaaggaggcttttcagatatttttcctaatctccctccctgcatgaaattttcatactgcaggtgcactgtttctgtgagttttttgttttttcttttgagatggagtctcactctgccacccaggctggagtgcaatggcgtgatctcagctcactgcaacctctgccttctgggttcaagccattctcctgcctcagcctcccaagtagctggaattacaagtgtgcaccaccacacccagctaattttttgtatttttagcagatacgggggtttcaccatgttggccaagctggtctcaaaatcctgacctcaggtgatctgcctgcctcagcatcccaaagtgctgggattacaggcgtgagccactgtacctagtctgtctctgtgttttgtgtggcatgcacatctgtagtttatttgtgaaaataagatttcttctgactgcagtggctcatgcctgtaatcccaacactttgggaagccaagacatgaggatcacgtgagcccaggagttcaagaccagcctgggcaacatgcaagctctcatctgtacaagaaattaaaacattagctgggcgcggtggcacacacctgtagtcccagctacttgggaggctgtagtgaaaggatcccttgagcccaggagtttaaggctgcagtgagccatgatcacaccactgctcttcagtctgggcaacagagtgagaccctgtctctaaaaataattcataataagaatatttcttcatccccaaagatttgatttttgccccctcaagagcagtaatgcccctgttgaaaatgcataggctaccagcatggccaacgtgtcgaagccttatctctcctaaaaatacaaacattagccaagcgtggtggcaaaagcctatagtcccagctactcaggaggctgagatgcgataattacttgaaccgggcaggcaaaggttgtagtgagccaagattgtgccactgcattccagcctgaaggacagagggaggccctatctcaaaaaaaaaaaaaagcataggttaagtaaaatatattattataatcagtgctacctatttctttttgcttttttattgcagccaccaaaattctgaaaatacagatgtggcttacattatatttctatctggcagcactgatatagacagaaaacaaatacccatgtcaacatgtatagacacatatggatacagagacacatacataaataaatacatacacacacatacaccaattccccaggtgtgaacactgagagtgcctggaagcaggaacaccccagcagcactgagcacacctcatcctatcttgccttattgtgtgtgtgtgtgtgtgtgtgtgtgtgtgtgtgtgtgtgtgtgtgtgttttgtttttgtttttgttttttctgagatggagtctcactctgtcacccaggctggagtgcagtggcacaatctccgctcactgcaacctccgccttccgggttcaagcgattctcctacctcagcctcccgagtagctggaactacaggcgtgtgccaccacccccggctaatttttgcatttttagtagagacgaggtttcgccatattggccagactggtctcaaactcctgacctcaaatgatctgcccacctaggcctcccaaagtgctgggactgcaggcatgagccatcgcgcccggccctgatcttgccttctaaatacccctctccactaccaaggaaccagagctccttggacaaacagctggttcttaagctgggacaatggaaatgcaaggtaagcctggaacatcttgttgaccagcctgggttaccagccagaaagtcaggcacggtattcacatgtcctctgcagctcgaagaatgatgaggacgaatcaaaagacacagggaagcaagccggtgtaacacagttcccactggtcaaacctgagactatgtgagcatcaatataaataatgatggtaacaggttatatgcatggaataaaataggaaaccataatccaaactggagacatggcagcaagggacagaatgagggagggagagagggaaaagaaaagcagagatggatgagaagaaaaggaagaaaagactgagagagatgagcagagaaggacaagagaggaaggaaaggagggagaaaaggagaagcaaatatcaagatatttatattgactcaaagtatcttctttaagtacgtgttaacagcaaacggaaaccaagtaactttacagtgaaatcaagcaaactccaccttcaccaagtaactaaacagaacatcaccagcaatggggcacagccaagccctggaccacctgctaggaggcaagaaggatgcagcgtggaggcggagctagacccctacagttgcgtgacctgacgctgctgatgggggagcattctgtaaccaaaggaggctgtaaccttccaaagagtcaaggtcatgaacatcaaagaaaggctgaggagcagccccaggttgacagagggggacacagccacaggcagcccagggtcctgaggctgctctatgctatgaagggcatttgctgggacaattgtggagaagtggacgggtcacggattgctgctgttggctggatggagacggattgatgctgttggctggatggagacagcagtgctgtggttacagaggagaatgcccttgtttgcagtaaacgcactgatgccccatacttaccctcaaatggttcaagaaaaagttacctgtgttgtactcataacttttccaatgactgagatattttcaaatttttttagacaataaaatctatcccccccaaaaaaagaaaagacgcccttgtcttctttgcaaccagcattccctcctctgctcccggcagccctgtgttgtggacctcggctacaccagcccagccccttctgctggcaccaggggcccttcgggcacttccatgtcgcttttcagtcaccaagcacctcatcaacatccactggggtccttgcgtgaccagaagcctcatgagagcagggacagccccggcctgttctcctccctccccttggaggcacaaagcctgcgtggcacacagcagggttttattattattatatttatttattttattattatttatttattatatatttatttatttattatttctcgaatgaaggcacaaggttctgagggacccagagaggaggaagcccagccgtggccctgccttggaggggctcagacctggaaggggggcagccacacaaaggtgctccagacacactgggtctgtcattaggatcatccttcacactctccagctgtccagctgctgagttttgcagaaggagcagcaagggtatcgtgtgatgaaacaaagagtttcattacacgaggccagagagaaacctggaacagtggaggagtgagatcgaggttcaaagcgcgtggaggacagggtggggagagggtgaaacccaaggaggctgccaaggggagggagcccctataccagctcctacaggaagaaccaggctagaaggagagaaggtcttccagcaatggcacagctcacgatggcacacatcaaaaaggcccggagggggggatgccaaaaccatcgccaggctggcgtgtccgggaagaggcagggagcacagggagttgaggtggaggtgggggacagactctggcaggcccagggccaagcctttgcgtggtgtccagcaatggctgcctgatgtgttttacgaggaggaggccaccaggacgatgtgggcaagtcagaggctgggcggcgggtggtaccttaagggtgcaaactgctgatgctggcacaggcaacctcgggacctcccaaccgaagctgctccagacacacccgatttctcgttagggtcagcagattgtggccatacccaattagtttaattaaacccacggggcttccaggcacttcagataaaaaacaaaataaaataaagtagatcctgccagcttcagaagaaatgaccaggtgggcaactgggatctctgtgaccacctcctagcacccggctctgcacacagcaggtgctgcataaatgcacgttgctatgatgctccattagggcaaataacccagcccagattaaactcaaagtgggaggggcgctccaagtcctctgaaaataggatgtcaccatgagaagccaggggaaattctggaaggagggaacatcatagaggcctccgggctagacggcctcatatgccatgactggcagggaggtgggcaactccccgccgtgtgcgctcgaggggccctgcaactcaccagccagggatcacaggcacccaccccccacccctgccaccccatgaaaagagacacacaccgtgacaacccaaaacccaagaatgaggccagggacatccctcagaaagtccacaagagagtaagccagcttaggaaggcctgcagtcatcatttatttaaacagtcctgggagggagactgcaatccctatgttggttttgccacttactcctctgggcaggagtggtggggtgatggggagtcactcaagctctccggaaccttgacggcctcacctattaaacacaggcagcaacccccacctaggcttgtgcttaggccacagcagggcaggtaagaaagggcagatgtgatttttctatgacccaaccaccaagggtggagatgacttcttccctctcccatccccaccccttaagaaacgtgagtttcagccggacgcgggggctcacgtctgtaatcccagcactttgggaggctgaggcgagcagatcatgaggtcaggagttcgagaccaccctggccaacatagtgaaaccccgtctctactaaaaatacaaaaaagagctgggtgtgggtggggcactgtggctcacgcctgtaatcccaccactttgggaggccgaggcgggcagatcacaaggtcaggagtttgagatcagcctggccaacatagtgaaacgccgcctctactaaaaatacaaaaaatagctgggcgtgggccaggcacggtggctcaagcctgtaatcccaacacttagggaggcctaggcgggtggatcacaaggacaggagttcgagcccagcctggccaacacggtaaaaccccgtctctactaaaaatataggctgggtgcagtggctcacgcctgcaatcccaacactttgggaggccgaggtgggtggatcacctgaggtcaggagttcaagaccagcctgaccaacatagagaaaccccgtctctactaaaaatacaaaattagctgggcatggtggcgcatgcctgtcatcccagccgacttgggaggctgacgcaggagaatcgcttgaacccgggaggtggatgttgtggtgagctgagatagcgccattgcactccagcctgggcaacaagagcaaaactccatctcaaaaaaaaaaaaaaacaaaaaatacaaaaaattagccgggcatggtggcaggcgcctgtaatcccagctactcgggaggatgaggcaggagaattgcttgaacccaggaagtggaggttgcagtgagccgggaccgtgccaccgcactccagcctgggcaatagagcgagactctatctcaaaaaaaaaaaaaaaaaaagctgggcgtggtggagcgtgccggtagtcccagctactcaggaggctgaggcagcagaatcgcctgaacccaggaggtggaggttgcagtgagctgagattgcgccaccgcactccagcctgggcgacagagcaagactccatctccaaaaagaaaaaaaaaagtgagtttcccagaaaacaaacaccagccacacagagaaacgaagtctttctcccaacccctgtgtgcagccagatgcagtaaagtggtttctccacgttgaatgaacaggcggggctgtcacagccaatgtgagggttaagggagcatctgcagccgtccccgtgcaggcaacagccgtacaaaggtggcccaccctccacgggacagaggagtggatggcaagatcagcctcagcgacacagggcactacgtgccacagtccaggtgacggtcatttcctgggcactgtgcgaagggtgtgccttctgtgcctgcccttagcaaatcctcacagcatggctacgaggggactgctatgactgttctcatgacagagatggggaaactgaggctctggaggtcgttgcctacctgggaggggacagtgccaggattcaatcagagcggagagccacacagacacacacccatctggtcctcctaccatccaggcccctacacgccctccacgagtccggcagcagggcccctaaacacccctctaccggcccagcagcgggacccctagacacccgtccaccccccagcagcagggctcaaggggcctctgtcagggttcgtattgctgcctggccaatggctccagagaccccaggaagtctctggcttgaacttccagtgcaggagctgagccaagccacctgccacagccacggccccctcctcttcccatcttcccaaaccacagctggggaggggcagcccccggacccagcgagtccaccaggcaaggctgggctcctcccaagcctcctctgtgcggacccagctgccctgcctctgccctgagccccagcctgcaagcagcagggaatcctgcccgagcaagtcagcctgggcagcccctggaactcatatcaaaggcagccaccttggttcgaggcccagccctgctccccaacagctacccttctcctcagtttctccagccataaaatggagtccagacttcccagtccccgtggggctctgagaacagatccggggaagccctctgcagcagtgaccgccacccccgccacctgcacctgaccactgacatcctgcgggaagaggcgctggctcccagggaggcctctgagggctcctgctaagccggtccaggcagtgctgggtaatcattacccagtgggaaggcggccccttcccctctgggcttgcctttgtcagcgccccccaacccggcagagaaaggcccggtctcctaggaaacgcagtcaccgccaaagggcagaggcctcgctgcccagcctggaatcgctggtgactcactctccctccttcccaggaaccacgtcctaagtcccactggtgaatggtccctctccacatggagttgccactgcgcgcggtgaggggctgctgagctggctggaagaccgcacctcctcggcgctgggtggacccggctgccacccgctctgcctcccccgacctcttctaagctgctcccggtaaggattccgcgacccccggagaacaggacggaagcctcgattctctcaagtcttagccaagttccctcttaagaggccaagaaaagcagcttcgttcggctgggcaggcattttcctgcctggccctgcggccgcacgcgtgcctccgccgcgacaaaggccacactcagcgcccgaaggaggggtgggggtgttgggaaagcgatgggggccaggactggggccaagtggccctggggatcctcgaggcggctcgacccgggagccaggactggcgccaagtggcccgggtccgggtccgggaagaggcggaggccggcgagggggcggtgcccggggccaacccagctccctccggccccgagggctcccgccccgcgcccctcccgggccctccagccgcgccccgggccggcgcagcgaccgcgcccgctcttccaccggcgtccggccaggaggcgcgaggcccaaggatgcgacccacgacgcgcacacccggctcggcaggctccctgggaaatgaggggccactcgcagggccccgcagagcgagcgcagcgccggagcctcccccatcccaggccgcgcagaccgcggaaccggcgcaccagagcagtgcccgcgggcggcggcggcgcgacccaggctgaggggactttggccaacttcgcgcctcctgaggtcgcgtctcggaggcccggggcgcaccctccagccgcccgcccgcgtcccggagcccggccgccccagccagggcgcctgggccgccgccgctgcgacctccgcgttcagtccgcgcgtcgggcagcgcgaacgccgcctccccggggccctcccgcccgccgggcgctcacctgggacatctgcggccggaagttgatgtccttgaggtcgatggagccgggggagaggttgtgcagcagctggcacagaaggaccccgtcgcgcagcgcctgcgccaggtcgaagaccacggccgagggccacaccacccggtggttgggcggcaggaccttgcaatcgatgagccagcggccgcactgccgccactgctccatggcgcccgcgggcccgaccggctcagggcagtgctcgagccaaagtgcagcggccgcggggcatcccgcccgcgcgcgcgcggggctcagggccggggcggggcttcgcgcgggctgccccaggtcccccgctgcgccgccgtgcgtcccctcctcttcctcctcctactcctcgggctcctctcgggccgccgctcccgcccacgtgcggccgcggggcgggcaacgggcagcgcgccggatctccccgcttcacacacgcaagtgcctgcgggccccgggccgggctccacgcagccagtcgccgcagcgctccccaatccgcgccgccgggcgccgcattctgcgctcggggcgccccgcggccgccgcggctcctgccccgcccgagacaaaggcccggcggggtcgctcgctccgcgcgtcccgggcctgggccgcccgcgtcgccgccgctttgttcgccccacccgcagtccccacgcccggcgctgcgactcgacgactcggcggctcggcggctccacggctccggggcgctgggggcgcagggggcgcggccacggccgggcggggcaggggcggggccggagcactcgcctggcacctccccgtgtcccaagcgccgcccccgcccccccacttcctgccccgctaccgcccgcgaaagttgcggtgggcgggggttgcggcgcaggcccaggtccggccgactttctccaagggcgctcggactttggggagcccttctccctgggggagcgacctcgcccgtggagtgatggccgggcgtccccccgggtgcctttggtcctccgtggaggtcaggaggtggtccctgtcgcgctgggcgccctcgcatggccgttcggtaacgacagactcgggagagggcaccgggctgggccgaagcttactgagcccccttggcccatcaagccgccccggcgggatacccgaggctgaggctgaaggcacacgggcccaggactcccagagccctcttcctgtcctccgccctggccgggggcccataggaagacccccgaccctgcataaaggccaggattccccagcttttggccaaagtcctggccactcgcagctgcccagcgggcagttcctggcgtccagggcggaatgcgtgacatgagtgagggcaggaaggtgctctccggcccagggtcgcagccggccccggtgctgatccgccctgatctcccttctaggccacaccctgggtggtgggggcgcggtctgtccagctggcaacgtgtgacggtaggaggggcttcaaggacaaacagattctgcaactgaaattatatggatcctggctcagctgccgggaaccgcgggttttcactgctgattcactgggggacaccaggcaagtccaagcccttctctgagactggctcagcccggaggctggggtgcggtgtctgagggctcccaccctggactccggtggaatcctgggcctgtatgagctggggctgcactgcagcccccggaccccttaccccgtggcttccctgcgcaggggccggaacggggatgcgagcgcagagagggtcccctgggcccagggcctccgatgggggtcctgtcctggaaattggtctctgcagagtcagactcaccccttctccactgaggtggaagcagggggtcccagcttagggtctggcccgtagagagaggtcaggaaggagctggcccctgcagcagtaaactcaggccaggtggctggtgaggcgggggctcaggtctcttgcccttccccgaggaagcagcagtgggcacctttagggcaagggggagagctttcctcaccgaagcaagatggggcagcaggtggacccatcagcatctccctaagaaatcagaaagccaggagtgaaacctgagcggggccctccagccccatctgagagcctacactgatccctcctcctgcaaagcctcatcccctcctctctagagcggggagacccggctcccactggacttgcttgtgaagaatggacggataaattacccagaggcttcccactgtgctgggacagaaagggctcagagaggaagaagagctacccactctcccaacccctcgcctggaccgccggcgcattgatgcactaaatgtctctttccccaggtggctccctcagcaagaagggggcctctgtcctcacggtcctgggcctgcctgctctggccaagaggaccagccaggtctgggacccaggcagccgcccgccaacaatgccatgggtacctgctgccccctggtggtgctgtcaccacggggcacctggctgcacccaggaggggctgcacagaaaatctggggttgaccgttgagaagacccaactcaggagacacagacttcaccacagtggccctgagccactcaggcctccctggttcccaggtcctgatcggcataggacattcaccggccctgtgcacctcccagaatccttggaggctctgagggcaggatggatgtgaatcaaagaacaaaagtttggtggggccaggtacagcagctcaagcctgtagtcccagcactttgggaggctcaggcaggcagatggcttgagtccaggagttcaagaccagcctgggcaacacagtgggtccctgtctcaaaaataaaataaaaggtaaagaaaatggggcaggagctccctttgtaacctttagtgtgagtgtaatgatgaacaggttgagactgtggactcaaggcacatgccaggaagactaatagagaggacgctgtttgggaaaatcctaccaccatccatgtccacttggactcagggctgtctgccaggactgcctgctgcacacctccagggggcgagagtcccatcacaccttggagatgggctccagggggagctgcttacacagactgccagtgagcagctgccagtccagccgagcagattaaaccagggagcaagaagtgccagcatgggccacataccccaagtatgggggagggtcacaggtggcggaggagggcaccaggcagggcacacccggggagggagcagcaaggcttccaggagaaactgaggtttgagttgacaaccagagattgatcatggttgcagtgactaggagagggtgacatggaggatggagagcttggacaggagttgatttttaaaccacaaaggaattcagtgttgccatgatctcaggcattgaacaataaaccgcagtgtcctcctgagctcctgtctcattctccccggcagccatgtgggcagcgagtcccagcagtccaccttcctgttctgtccagcatctgccccctcctggcccacccccaccaagccccaggccccctctccttggacccgcttccacccttccacctgtcctccgcagccagcaaggacccagtcggccctcagtgacaccctgtctctcttctgcgcggatgggcacctcggggctcccgcctcactggaggtaaaatctagcaaatcactgtaattgtaatttttaaatccaatatattctttcatggaagccacagatgcgttaaactgatccaaagacagcttataaaaggcaatgtaatcggaggctggacgtggtggctcatgcctgtaatcccagcactttgggaggctgaggcgggtggatcccttgagtccaggagttcaagaccagcctaggcaacaaggtgaaacgctgtctccaccaaaatacaaaaattagcctggcatggtggtgcacgcctatagtcccagctacttgggaggctgaggtgggaggatcacttgagcccaggaggcagaggttgcatcgagtcgagatcgtaccactgcactccagcctgggtgacaaagtgagaccccatctcaaaaaaaataaaaaataaaaggcaatataatcttatttattgacttgtggcatattttaacactatcgctatgtgaattaacgttacactacgtaagattgcagttacgtcgcacattgtcactttcaagccgttatattttaacagcattcatagttgcagtaaccaatcctgtgtcttgagtctgagtggccggcctaggtgatggtcacctcctttaaaccacaagccactccatcacttctagtcactgttattgtactgagtggtccaacataaaaaccagctcaccaagcacattggtgagctgcccaaggtcacccagcaacacaggaaaaagccaagtccaaacgccaggccttattgacacctgtgtgcacccctaaatagaggctgctgctgaaagggctttccacgcctagaactttctgctttcccttaatgcactgatgtgggtggggaggtgacgagggagggaaaatgatctgatgtctagaacacgtggatacggagtcagcaacagagcgcagtgcctggagcccacaggcacacccccccgccccgccactgtggtaccgaaatgagcccttagtacaggcaggagtagcaaggctaagaaacgggagccgaagggtccgacactgacttaaaggagggaagggcagctggaagtatatccacgcatcctggaggtcctggaaacctggtgactcttggatcctcggggtcccagagaggagacctttggaggaaggagtgggtagacaggtggctgcccttatgtgggcagcatggctgggcttcccctctggcttctctgcccagtcactcacaccacgagtgatgctccacctacaactcagcacgtccttcctgcacccaggccctgagccaggaccacccacaccctaggaggcgaggactgtcatcgtactgtgctacagatgaggtcggctcacatagcttgagtgacttggccaaggttatgcaactggcagagttcagattcgaactcaggtccaccttctcctatgcctccagctgagaggtttgcttttgttttctactgataaataatgatttcaagggcagtggcacaggacaatctgagtccacgaccggcccagcgcccctcccctgggtttctgcagagctgccctcatcaaattggtgtcctcattctctgggcagccccagggtctggtttctgaacaggaatacatgtgtcccttagcgcgttacatgccacagtggaagggcttgagagtttacctctcactcaagactgtttctttccatacaggccctcccagagaacctccatacagccagagtgggcactgtctcagtccagtattcccccaaaaaacaccaagacctgctgcaaggtctcagtacttttcatcaaaaggtccaaggctcaggggaccctcattccacagccagcatcccagggatagactgaagcttcttcaaaggagctccgcccaaggctggagtctgtccatcatccctccacctgcccctccatccatccctcctatatcttgctacccactcttccatccatccgtctctcaacccatccttccatccatgccacattcctccactcatccctccatccatccctccttccatccatccctcccacattcctccacccatccctccatccatccctctcacattcctccacccatcccacatccctccacccatccctccctccatccatcccacatccctccacccatccctccctccatccatccctccctccatccctccatccatccctccctccatccatctctccctccatccatcccacatccctccacccatccctccacccatccctccacccatccctccacccatccctccttccatccatccctccatccatccatctctccctccatccatcccacatccctccacccatccctccttccaaccatcccacatccctccagccatccctccactcatccctccctctacccatcccacatccctccacccatcccacatccctccacccatccctccacccatccctccacctatccctccactcatcgctccacccatcccgccgtccttccctccattcacccctccatccatccctcccacattcctccacccatccctccctctatccatccctccacccatcctggaatccactcttccacccatccctcctacatccttccatccttccccatctatccctcaacccatccttccatccattcttccacccatccctccctccatccatccctctacccatccttccacctatccctccatccttccaccaatccattcctccactgttccctccatctatccctccgtccacccatccctccacccatccttccacctatccctccatccttccaccaatccattcctccactgttccctccatctatccctccgtccacccatccctccacccatccttccacctatccctccatccttccaccaatccattcctccactgttccctccatctatccctccgtccacccatccctccacccatccttccacctatccctccatccttccaccaatccattcctccactgttccctccatctatccctccgtccacccatccctccacccatccttccacctatccctccatccttccaccaatccattcctccactgttccctccatctatccctccgtccacccatccctccacccatccttccattcattcttccactcacccctcctatgtccctccctccttctcccatccctcaacccatcccttcacccattactcccccatccatccctcaacccacccccacattcatccctccctccatctatccctccacccattcttccgcccatccattcctccacccatctctccatccatccacctatccctccatccatccacccatccctccatccatccacccatccatctctctattcatctctccatccattaaattcatctctccacccctcccccacccatccctccattcatccctgtattcatccctctgtgtatccctcacatccctccacccatcctccatcctccacatagaaaatactgactgagcactggctttgttcatgaggaagggcaagtgaatgttttgactcttcccaacatgatgggataaaggaattattctcatgtccaaaccacatgaacacacacattgtgcaaattccatttgtagctacatcatgcaaattcagctgtcacaatttcctgggaaattataggtgtagaaaaagaccatctggcccaccatgcagtcagagtatgcctgactgaattattgggtgggggcttttacattttgtttgaaagggcaaaatatagattttttacttcttgttcaactttcaaaattaaatcaaatgccataatccatggatcgtaccctaaactgaaatctctgaaatctcactgccaagtggccattgtttggacaccttccagtgactatttaggagaccggggcagttttctgtgagcactgcctggagtctttgagctcatgagttcagggtcacctaatcaaggctttaaggaagggggaaacagtcttccctccgtgaatgtgaacggacttcatgcaagtgtaggccagaggctgggcagcgtgtggaggtggacttgggatctctgcaggagccctctcatcacagcccagcaggccaacccaaagcaggagagggaggcgaggcccagaccagctaggaggatgagccaagacccacatggccagctgtgagttatgggaatgggttatgagttatgcgatacaagggggaggctggggagcctcctgaatgtggtccttggcagactcagcctgccgaactctggaaactttggctcttactgaaagggaggcagcacaccctggtgctaggaagacacggccaagggacactgggctctaagcctgtccatgcccttaatggcattcaatgccaccctgtcctgggcccctccagctgtcctctagccacagcacctcctgaggcgcagtaagggcactgccaaggagacatacccacccctaccctgctagacagcacccctgccagaccacagctcacgtactccaactctgggacatttctgccacccccaaaggagaccccgtatcccttagctgccctcctcaaccctgcccatcctcagccatggcaaccactaagctgcttcctgtctctatggatttgcctgttccggacacttcatctaaatgaaatcagccaacgtgtggccttttgtgcctgacttcttccctccagcatgatgccaagttccattcaccatgaacgtgcaccaggaagggcttcattcctttttatggctgacaaataattaatagtaagtggaatcaactttagtaatacactgtacttgatccagtatatttgaaatattatcatttcaatatgtaatcaatgtacaaatctattagagagacatttgacattcttttttctcgccaagtttcaaaatccagcatgtggtttgcactgatagcggacttcagtttgaaccctaaattttcatcagacgcatttgatatgtgtttaggtttcacagaattcacagttgaaaaagtagatttgcatacccaaattgtttcccgtaaacttagaagtttgccaaaaatgaaattgagtatcaatttttaaattaattaaaattagaggccgggcatagtggctcgcacctgtaatctcagcacttcgggaggccgaggcaggaggattgcttgaggccaggagtttgagaccggcatgggcaacacagtgagaccccatctctacaatttttttttttaattagccaagcatggtggcacacacctgtggtaccagctactcaggaggctgaggtgggaggatcgcttgagcccgggaggtcgaggctgcagcaagcaatgtttgcaccactgcactttcacctgggagacagagcaaggccctgtctcaaaaaacaaaaaacaaattagataaagattcagttcctcagtcagacaagcctcatttcaagagctcagaagccacacatgcctggtggccactgatatcttgaacttggacttgggtccacctgcctgaagcctggttctgccccaccagcatgagcttctgtctcctctctcatgagtggccatattgcgatctgccccacccgtggccataggggttctgggagagcggggatgtaaagagttccgcgctgaggctgacccccccatatcaatacaagaatgcaaggattgctactaaagagactcttctcctccatcagctcagaactgggccagctttgcctgtccctgggacactcaacaatagcaggccttggagactgctcagatgtacacacatacgtgtacgtgtgcatgtgcatatgctgggaactggggagagagtgtgggtgatacttccccaagggttggccaagcctttctgggctcttttctccatctgacccccatccccacctgcaggaagaatgacccctttaaatctgattgtgccccctgttgctcaaagcccacctttgtgtctacataaaaccctacacacctatatttatagcggcattgttcaaaacagccaaaatgctgaaacaacccaaaagtccaacaaaacaaaacacggggctggatgcagtggctctcacctgtaattccaacactttgggaggctgaagcaggtggaccacctgaggtcaggagttcgagaccagcctggccagcatggtaaaaccccatctctactaaaaatacacacaaaaaaaacccaatgataactagccaggtgtggtggcaggcacctgtaatcctagctacttgggaggctaaggcagaagaattgcttgaacctgggaggcggaggttgcagtgagccgagatcgtgccattgcactccagcctgggcaacaagagcgaaatgaaaacaaaaacaaaaaacacagataaacatatggtggaatattactcagccttaaaaaggaatgaagttttctgatccatgctacaacatggatgcagctcg

SEQ ID NO: 375 - DNA, 184494 bp, Homo sapiens
caaggctgcagtgagttatagatggcaccacactccagcctgggtgacagagtgaggccctgtctcaaaaagtaaagaaatgccaaaactggatttttttttttttttttttttttttttgagatggagtcctgctctgtcacccaggctggagtgcagtggcgtaatctcggttcactgcaacctcttccttccgggttcaagcaattttcctgcctcagcctcccgagtagctgggattacaagcacatgccaccatgcccagctaagttttgtatttttagtagagagggggttttgccatgttggccaagctggtctcgaactcctgacctcaggtgatccgcctgacttggcttcccaaaatgttgggattacaggcgtgagccactgcgcccagccttattttaaatgtttacatttaacaaatgaacgcttttaacggacacacagaaatataattgtgccattcccaaggtaattacagtgtttataaaagaagaaccttagttcatggcatgcttcaggcagtgtggtccagaaatgggacccaagtttgaaattggatgatgagggctcctttcaaactcgtctgtctcctttggagagagttaaacctcaaggccctttgggtgtgtgtggtccaggctgagccttctccctcattccttgtgatgggcccaattgaaaggtccctcttcccctaatgcagagtggcagcccatccctgccctcttccattgcagggcagcggccagtggggagcgctgaggtgctcaggtcaggctgaccagaggggctgagcccacccttgccagcggagagcagcacaggctgatgccatcctctccctaactgtccaagccatgggctctgccttctgaactgggtcataccaaggtggggacttgggagccaggtcaggagctggcctgtcctttcggctgcccaggtttattcatggtgctggtgggtgtgtgctgttgctcttgggcacctattgtgcatttgcgtgacaggcggtgaatggaagagtgtctggggcccagagggcagaatcagagactgtccttaatcgtctttagagggaattatgtttaacaggaagtagtgagagaaagtggaaaaggcctcttccttcgcccttgctagcttggtctccttgacaagttctgctgttttctctgtgcttcagtcccctactttgtaaaatgggggcaaacatgtgacaccattgtcctcagggctgccgggaagagagtggaggcaggggtttgagtgacattcccctgtgtggacagaccacgtttcatttattcatcagttggtggaaactggattgtttccactcgtttcctattatgaattccacgtttaacttttatgaatactttcctatgaatactactgtgtttgtgtacaagtttttatgtggacacgttgtcatttctcttgggcagttacctaggactggaattgttgtaccatatggtaactgtgtttaatttttggggtaaactgccagctgttttttatgaggtggctgaaccatttcacatttccagcagcaacgtatgaaggttctagtttgtccacatccttgtcaacacttactatgatctggctttttcactgcagccatcctagtgggtgtgaagtggtagcttatggttttgattcacattttcctgatgactaattatgtttgagtatcatttcatgtgcttcttagcaatttgtgtctttttctggagaaatgtctatccaacatctttgcccctttttttgttttgttttgtttttgaaacagggtcttgctggagtgtaagtggcatggtcatggctcactgtagccttgacctcctgggctcaagggatcctcccacctcagcctccagagtagctgggactataggtgtgcaccaccacacccaactagtttttaaatttttttgatagagacaggatttccctgtgttttccaggctggtcttgaactcctgggctcaagtgaccttcccaccttggcctcccaaagtgctgaaattacaggcatgagccaccacgcttggacttttgccacatttttaaattgtgttttctttttattattgcgttgtaaatggcctttgtattttttctttaatttcttaaagatggggtctcactatgttgcccaggctggtctcaaactcctgtctttatatattctagatacaagtctcttatcagatacatgatgtgcaattattttctctcattctgtggctatcttttctctttcttaatagtgtccttggaagcacaaaaattttaaattttgactaactccagtttacttattttgttgttgcttgtatttttggtttccttttttagtctttaaaatatataagatatatgattcaaaattaaaaggcatgctcagagcagtctcgccttcatccccacctgccctctatagggaggcatttaaattaatttctccttttatcgttcctgtgtttatatttgcaaaattaaaaacctttttttcttaaacaaaggtggtatgctacagatactctgcatttctttcttcttttctttcactaaagaaatcccggaactgagcccccgtatcagccgattgaactcactgtgtttcagggccacagtagtccaggtgtggatgtgcatcaaatggtttagtcagctggttccccgctgagggcctcttgggcctgttcccagtcttttcctgtaagagatcatgcagcaggggataatatcctttcgtatagtggaggtgtgtcttcaggacagactcctaaaagtgagacggccgggtcaaaagttaagccgtaggaatcgtggctgttgccagattgtcctctgcaggggttggactgctctgtgtgtcaccagggaggtatgagagtggttccaccacaggctcacaaacagaacatattgtgaagcagtgaggttcttgccagcgttatctcagtgcagctttttttttttcaatcagctgtattgtgtgatttacatacaatgaaatacacccactttaagtgtccagtttgttgagttgtgacaaattatctacttcctgtcaccacagatgggtttttgcccttgtaggatttcatataaatgaaatatgaagtatgatgtcttctgtgttagggttgttttcttaaaaactgtatatattcaaagtgtgtaaggtatctttatatcacatagtgaaatggttactacagtcaaggaaattaacacatctgtgaactcccatagcatgtggtgagagcacctaaaatctactcttagcaaatttccagtgtacagtccagcatgattaacagtagtcctgtgctgtatatcagacctccagactattcatactacgtaactgccaccttgtacccctcgtacccttcgaccccattccccaccccttccagttgggcttccttgacccaggataaagacactgagattcatatgtgttgtcgcacccatcagtagtttaatggcttaggagtatccactgtacggatacaccacaatttctctgctttcccgttgatgatcatttgtgtggtttctagtttgtacctattctgagtaagactgctgcggacattctggctcaagtttttctgtggacatgtgttttcgtttctttggagtaaacaggagtggaatggctggatcacatggtgagcgcacacttaaacagtcactagaccttcctccaaagtggttttgccagtttccatccccactaggagcagtgtgtgggcccttcctgccccacatcctcacagacatcgggcatcgctggcctttagcttcagctctccgaggaggtggggtgcactgtctctttatggttttgatttgcatttccctgaggactgcaaactgcacgtcttttcttatttgccattatatttcctctttggtgaagtttctcttccaatcttttccccaaaaatcaagtttttgtctctttattattaagttgtaagagttctctttattttctaaatacaagttcttttaatatagagatattttctcctagtctgcaacttgccttttcattttctcagtggtatccttccaagatcagaaattttaattcttgtgaaatgcaaacccatttttttttctggttagtactttttgtgtcttaagaaacctttgcatttcctttattatgagtagggctgtgcatctttttttttctgtttaagggccatttgcttattttttctgagaactggccgtgtctttgtccactttttaaaaatttggtctattggtctttctcttcttgaattttatttatttctttgagacagggtctcactctctgttgcccaggctggagtgcagtggtgcagtcacagctcactgcggcctctacctcccaagctcacaccatcctcctatctcctgagttgctgggactacagacacatgccactatgcctggctcatttttaaaaaattattgtagagaaagggtctccttatgttgcccaggctggtcttgaactcctgggctcaagtgatcctcccgcctcagcctcccaaagtgctgggattataggcatgcctggcctctcttcttgatttctaagagctctttgtctattaccgagatgagccctttatggtatgttgttatgttttctctcagtttgcctttttgactgttttcccgtgcatattgcatgcatgtgtttttgcagagtccagtgtatccatttttttattgcttatggatttgggatcataggccttccctactcccaggctataatgagcttacccgtgtttgtatctagtattcttatggtttcattttctctaacgtttggatttttatcccatttggagttgattctaacatgcggggtaaggcatggaatcaattttatctttttccaagtgactctctacttctcttcatatcagttttttaaaaagtctatcttttcgtaatgagccgagatggcactccccaggccattatcattaaaatccttgatttccacatgttcttggacatggtcttctcgtttctgtactcgtcgtgtcctgcgggccgtctgagtgttccgtgctgacgcaccctctcctcctcgggggtttcatggcgtctccctcggcccatggtgggggcttctcaccgctcttctgttcggagggtttcctgggtgtgtctgcttcctgtttttccacatagcctagaaccagctcgcccggctccagaaaacatttgttaactttgaaaattgagactttgttaatgtattcactttgagaaagctgacatctttatggatgttgaatcgtcctatgcagaaacaaggggtgtggctctatctactccagtttacgtctttccaggagagattcttctaggactgtcgcagctgttttagaggcttcatatggattctgtacatccgatgttaggtttattcccatgtgtttagctttttcactgcttttataattttttttaaagtttttatttttatagagagagggtcttgctctattgtccaggctggtctcaaactcctggcctcaagcagtccactcgcctcagcctcccaaagtgctgggattacaggcacgagccgctgtgcccagccaatataatgggttcttttcttttcttttttttttctcgaggcagggtctcaccctgtcgcccaggctggagtatagtggtgcgatctcagctcactacaacttctacctcctgagttcaagccattctcctgcctcagcctcccaagtagctgggactacaggtgcccaccaccacgcctggctaatttttggatttttagtagagacggggtttcaccatgttggccaggctggtctcgaactcctgacctcaagtgatccacccgccttggcctcccgaagtgctgggattacaggcgtgcgccaccacgcccggcctctttcattctgttttgaactaaacattgtttgcactgcatgtggtgggttataattggttgttgtcaattttatatcttgctcttactaaatactttttcatttgtattctaaggatatcttagcacttattttattggggtttccaggtgtgctttgatattacctacaaagagatcatttttccttagggttgaatgtttttaaaggtttgtattacatattgccaaatcttttaaaaaatatggtaccaatttatacttctcttgtggcagtgttttgccatacccttgtcggcactgagtattgatattttttaaaatgtgccagtttactatgatcttcactaagaggacattcactgtgccccttctccacaccagttgcactgccaaggacacagctgcggtgaggacacagtagagcctgcagatcccagcccccagtcccactccagtccctgtccctatccccaggagtccctgttctggttatttcttgaggtttcaaatgaagatggctgctgccctctgagcccagccaatgggacgaagccagtggagagcccgtccctgccccagagattcgctctggaaaatccctgagtggttttgtaaaatgcattttacaaaataataatccccgcacaataagtcttctgggtgtctcgcaggatcccctgcacagctcaggcactgccagcagccgcatcccctcgagtggctcaatctgtccaggagcaaggggtcagccaggcaccttccagggccagtcccaggccacccagtcccagtgtggctgagcacctatgcctcttccccatagctaaaaacccagtaaaatggatgataaaatgggtaacacctccctgaaagtttctactttcctataaagcccagccccggcccaggcccgagtcctcttatgaacagaacaaccccaaccacccatttgcagagggcactgctgtttggtactgaccctgccctgcccaggctggcagccctccaaggaggctgggcaggaggtcccggaggacacggcccacaatgctcacccttttcattctccatcttgccccatcacctcccacctcggccccttcctccaggcagcccgccccgcccttttccacacacccctggttcccagcactgaagcttgcttgctgtgtgatctcaggccaattgccttacctctctgggcttgtttccatcttcacctcacaggtagatgtgaggtcacctcacaggtagatgtgaggagtgaaagagggagtattcgcagcaggtctacacagcgtgtggcacagagctggctacatgaatgtgtgttcgttgaatgggagagtgaaagaatggatggattgtgctggcaaaccctccaggggctcagtttcttccactcggaccatcagaacccagagatcagatccaggagctcctaaatgcaacctttgttagaaacacagctcccctgccctgcactgctcagtcccaccctgggggagtttccagccgcactgaggatgagctcggtggggacctgacccagagatagggacacctggtcactggaccgcagaccggcccatccacagcctggctgggctggcatctagacctcgcttggcagtcccctcccaagagctcagatagtttggcctcgggagacaggggcagtgagaaggctgcctcccctcagcctgggagctgggtcctcaggagagaggaaatttccttctatttattttcgacatcctcgactttgaaagccaagctggtgttgatatttaccttggccaggcctcccatctccccgggccagcctcgtgtaaacatgctgttccttctctcagctctgctagcactgaggtggccttttgcaaccaattctaggaatttggaagtctgaaggcgtaggttcagggactggccctccagggagccctgggtgccaggggccctgggacctgctgtgctggccttgggctctctccctgggggctgacaccaaggactgcagggaatgaatgggcctgggcccatgggggtgtcggccagggtggctcttgctgggtccctcagttctcctcacagccacgttggggcctcctgctccccaggttcactgcgaggctcagactcggaggacacgcattgagggactgtggcaggatctggctgtctccactgtctttgctccaggccacctccaccctggctggtggggagggcttgctcttgagccagctctctagtgtgagttgggagtgtgggcagctggactacagttagagggaacatggagcaggtgcccagggtgcagcctcccaaggcagcacgtgcccatgccagaattcctgccctcagggagcttgccttccagagggcaggtggaccacaaggagaacaagctggcttggggtgggggtgagtgctgcagaagccaggatgagcagaggctggctgggtcagggacggtcccccgaggtggacatgcaggaggtgagcagaggcacattccccagtgcaaatcccagccctcccctgttggttccaccaggtggttcacacactagtgacgccttggcaagtctgagatttggtttccttgtacagaaatggggtgacagtccctcagaaacaagggagtggttctgcaggtgggagctgccatgactgctgcggttttgaagcatctgtgtgccccccaccgggcagtgggacatctcggctgagcctctccccttctccatgcagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccaaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaagatagtaagtattaaggtttttgtttactgtctatataattaatagaaaccagctattttttctccattaaaacatgcatcacgtttaaagcactatggaatcctccaacctcagctctagtctaacaaactgcagtgttcagagaagataaaatgcccgtgattggtagagtctgcagtccagttgcaagcacctgaaatctagagagagaaagacctataacctgtatgagacttccccttccaaagctgtattgtctacattaaaaaaaacaaaaacagtaacaacaacaaacacacaaatggtcagaaatgtcatccttaaaccctttgtttttcagcagtttgccctcagagttctggcataacacataaagttgtcaggcaactttagtcctcctccaatagtgcaaatcagacacgacagttctcttcaagtatacacacgcacacacatggaccgaaccaaacacgccgtggaagctgagccacacacaccccggtctcaagaagcaaaggaaaaagcacaaagcgtctgagtcaccaattcatcatggcttgtgactgagaaagcgctgtggagtcctggccccgtcggggcagcagacctgcatcagaggtttctttggtaactgaggcaggaagtaaggatgctacattagacagatgttccacgcgtagttcctgctatcatgtttgagggcccccttgtacggataccaagcaagtacaaaaacagaacacaaatcccaacaacatggtttttgcaaataaaccatcccttcccttccccccaccccacccccatgatttttttttttttaagtactgactgttcaaagctcaggcaaaccatgcagatccacgtgttgttggaggaggcgctcccttcaggagaccacagagggggagtgactgtggctgaccatgtgggcagaggggctggcgggctggcccctgcgagaggcggactcagggctgctggatgctccgtccttggccgctttgatctggagccacgtgtcacccagagctttggcaaagtggtcgtccacggagcccgtgatggacacggagttgggtgccggctcgggctccttgtaattcttgcccaggctcctgcggaaatgctcctccaccacggggtcacaggtggtggcagctgcaggcaagcaggaaggcaggcagtcagacacaggtggctgcagacagacaggcacggttgcagcaccctccctcaggcagcccagagccggactggctgccacggtcagcgtgggctctgcagacagaacccacctcccccggctaagtcaggcacttgggcaggtcacttttctgtaaaatggtgatgtaccaactgcactgggccagagtccgagttcagaaagagaatgtggcattaaatttaaataacagtagccgctgccctccctgcaactagggcatgagaccctggaactgagcgaggcggtgtgtttctcatgcccttcccacccaagtcatgcgcaacgctaggcgcacactggacgtgctcaagaaatactttttcaacctcagcaatagatgggctcaggggcgagaggtttcagccaacagcatgacagagaagggctctgctgccactagcacagctgtgacaggtgaggaggcccgggacactcaccgctcggtggcctccggtagctggcaggcccgggcgcggcacagccgctgtgcgcgatggggcagtgcgagaggttgcagttgcgggcgccagccgaggcacaggtgatcacggagggccggttctgcggggaggaggggtgtcagtatgtggagaccagcttcagtaccgggcaccacccctggggccctccccagcacccttcaggctctgtcctggtgcccttcctgacccagtctgccacctcccacttcaatactggagtcctgttgctaaacacagccaatccacagagtgagcgcagctccaagggtgtgtgtagtggcccttggtcgtggctgtttggatcagtgagggtacaaaggacaaaagctcaactgttgagttggtctgtccccatctctcaaatctgttaagacaaacaccgggcatcctgtggaggacagagggttgcaggagggacctcgattctcccgttaacgtccccagagcccttcccatcatgtccactgagccgcgggtgtgcctggagccatccaggacacttcaatacacggcaattaactggaagcattttgcttgagccaaagccagctcgagttggcctcagtgatgacctacaaatcgggacagagaggaaatggaggaaatatgcctaagtgtggaacggcacacatcccaccccagcccgatctgccctgtgcacagcctcactctctccttcacccccacccccacgctgtctgcctggcaaactccccttgttccttcaagccctgttcagatctctctctgaagcctttcactggccaccgccccaccaccaccgcttttcactcctgctcccctaacccaccaagattcagcaagtgcatcggtctgtccaggtgctcccgtaagaccatgcacaccaggcagtatgtctggccccccagctttggtgtggaacctgggacagaaaatatttgtgaactaaacagaacttcctcaggttcccccaggaaaagtatcttccaatacccccgaggacaaggtggtggagtatgtgggctaagttccaggacagccagcaaggagctggttgaaatcaccccacagggaccaatggtgacagcagtgtcagccagagggacgctgggccttatcctccccagccagccctttccattaaagttagagcagtagctggtataaagacacaaaaggcttgcatgccagaccttctcatgatagacgacagtgattgggaatggtgaaagtggattctaggatgaaaatgtggatccacaaggatgaactgggattgaacacaaggacctgtgcttgggtctaacaagaagcgacacatgccagggtagggggggatgtggcttagcaacagcagaccaaccaagaattcagggtttcttagtggcccgacacttagcagcgggacagagctgcccagggttcgtacggcctccatggtgtgcacaggtggcagcgcagagagaacccgggcaggtggagctgggctgaatgtccacgttctgcctgtggacagggcctcgggtgagagacttcacaatgctgagcagacaggctcggaaagggggttggggaccgacagatgaggcctggagcagatctcacactggctgaccacaggggtcaagcagcagcaagagagcagaataccgagacctggacacgcacagagccaggaggaaggagggccctgcccctgtccagctctcagagatggccaggcccttcctgagcctggctgcacccatgaccttgggctctaggagacccccccccagggtcctcccaataaaactcccttttgtgctcagccggcttgttctttgcagcgagcgtgtcctgacccacgcaaatgtggggaactggggagacatttcgagcacagggagggggaatcaaggaagatgaagaaatgagctcactgtccagcctttatgtcagtctatccaaggcaggaaaggccacttcagaagagactctctaacaagggaccagcagggcaggctggctgactggtatcagaccaccttcagggcatctcctgacctgagctggggcgaattgccttaaccggtcacctgcagatgtgaagatgttcagtgtctgggcatcctctcctcctccccacaacccaggctgcagggtggcccgtgagccctcgtgggactggctccaccacccctcctccccagctggagtcaggcatcttgcccctgcctctgtggttgagtgcaggctgggactcgtccacctagaacgggccccaggcctccagatggtgagcgtttatgggatcccgaggctcccctcccccacacccttattttccagatggggaaaatgaaggccagaaacaccctgttggaagttacgctgcggatttgtggcagggccagtatgagccctgtcactaaccccttcacccgctgtcccacccacctgtgactgtcctcagacagaggctgccccgggggagagggctcccaccacctctcctatctgaaagcaacccccaaggctggctgcgccaaactttttttttttttttttttttttttaaagacaaagtctcactctgtcgtccaggctggagtgcagtgacgcgatcttggctcattgcaagctccgccttccgggttcaagcgattctcctgtcagcctcccgagtagctgggattacaggcacccaccaccacgcctggctaatttttgtacttttagtaaaaacagggtttcaccatgttggccaggctggtctcgaaatcctggcctcaagtgatccgccgcctcaaccccccaaagggctgggattacaggtgtgagccactgtgcccagccctcaatgtgcgaagcttaaccccatcttgcctctcctcactggctgctgcccaaggccaccctcttggtgtttgtctgtcctgagctgctatcacaaacatgaaatggggggacactttctgtagcctccccatacatgcccctctgggaactttcctgtcccagttcccagagatctgagacacattttctgccacacagaggaaggcttccaccgtgcccaccccacagggctgcagcatgcgtcctgcctgcctgtggacacagagctttgctgtcaccccaggaagccccctccccactgccatttccctggctctgagctgcaggatgacacccaacagacttccaggaagagacctcggagctgctggagcacaggcaacgtggctgcttggtgtcctcagcagggcgcccgagcccagctcggattggtgtgcatggcctcagccccgccacgctgccgcaggaaggagccccacgaatggttacgacatgaatgacatgtgctgacagcagccacggcaaggagggcaggactgaccaaccccagccgaaaatgacagctccggtcagggccactgtgcccttcccaggaaaatgggcagcttggggtaccccgtggcccctggctttgtcctcagtccaggccaggatcccataaagatatagctggggggtcgaggttcttcctcctaggaaagctgctcaggagccccaaggcacaaggaggggcccttgccacgtgtgccgtgggcagccaggcccattccaggctggggagagggagacagggtaaagagagtcaggccactctgttcagcagttcagtttttgcaaagcaactgtgaccgaaaaccaactgcaagattctcaagagccctgaagagtcaaggaaataaatcatccaagaacacactaagcccgccaagggcccaccctgaccatgtgggcagagatagcttgtaaggctcacagttatgtcccccaggtcatcaagggccagaggctggatgtgggtgctccgagattacagctgaatcctcccctccatacccgtgtccttcagggactccccaacagcagtggcaatggccagagagccaggttctgcctgcacggttcaggccatggctcatggcagcattacaatgcctgttgagcttcccaaagcagaaaggtccactgcccaccccggggagcagtgagcgggtccctgtgggtcgcactgcgcacacgcctctgttccagcccctgctgctgcccaacagcacaatcctctcttctcatgtccatttccccaattagactgggagctccctgtggccgtgacagtgtccacacacacgtctctggctgcccacagctctgctctgcagagggctgggtaaatggtgagcgctcgtaaaacgttgaaatgaacagcagtgataacttggcctcgggttccatcagacacatcagcgatctctcctccagactaaaactgagcgtgctgagaacaaaaactgcatcttgcttgactggcttctggtaccccctggcacacagcaggggtctgtgccattttgttaaatggatgaatcaaacaaacaggattaccatgtcaggctctgaggcaagatgggcaactgttctcagcttcaccaggattcccaagcaccagaaccacctctcccaactcccagggcctaccccacccacagtttcaacagaccccatcagacacggacaccaggcagtgccacttggagggaagccccggtgaggccacagggacacagaggctcttgcagctgaatgcacagagcccggaggcaccccctcggggcacggcaccatcctctctgtcagtcttagcaaatgctgactactgactaaggacctattaggtcgcagtccctggagattcggagagctcaagcagtaattttgagcctcctcaatgctgctgccttctcccatatatttccccaggaaccccatttttaaaaagatttgtttctaccaagcaagctgtgtttattaagcaatcatttaatttcctattttcctttcatagaaaaaaatccctatgtaccaatcataggcttctgaccagcatgggctcacaaccctgtgaccatcaactgtgcaggaccccagcccaaggcaaagcaacctgacatttcccttcatccgcgtgaccgtctaaaggagaaacgtaggacccccccacccgaggatgactacattcatcctaagagaatcaggcctgccacagaagactgctggaggaaacacctcagtacaccacccctgtactgggagaggaaagagatgaagccccagtgacattcaccttgcccaaggccgtgagtgctaagaggcaaggcccgggcaggtctgggcaggaagtaaaagcagaagaggactcctgttctgctgtcccttgtcccaagtgcacaacagaggcgaagggtggcatccctcaccacctccctccctcaccacctccctccctcaccaccgccctcggagtcctctgctcggggctctccatccagcccagtcccccagcccctggactccccacgccaccctcccagacagaggcccacctgctgccgctcccccggggtcagtgtgggcgagaggccggctggcctgctggcgtccaggctgttcttggtcagtgcgaggggctgctccaggccaaggctggggagggaggtgtacaggtggctgccgtgcaggctcatggtgggggccacagcgcgctcgatggggctgcggctccgctcccgggggtctctgcggcagtctccattggcagtcttgttcctgaaaaagaggaatgggcattcagggggcgttttctcaaaggcaaaggggacagtgactgtgcgccaggcactccgtgttgcttatttaattttttaccctgaagctcaggtcgtgtggctgggcagcacgatgaggagccggttgccagcccgggtcagccggacaccaaagcctctgggtgccggagaagctgctgccagcggagtccaaagtcagctccatagaagatggagcccccgactcagtggcgtcctctgcctgactctgtgttcacttctataataatctccactccctgggagcctggggagctggaggccaagctggttcgataaggacctgccatttggacaggacggggacgctgacaacgatccagagtcactggctgcgtcctacatgcagggccctattcaaagcctccacagcactgctcagcccatcttcctcacagtactgctcagcccgtcttcctaacagcactaagcaggcaatgctgccaccatcccctttccagaccagaaccccaagactcaagagtggtggaataatcagctcagactcccagctgacatgtggtggcacgtgctctggggttcccggggtgctgtagggagccggcgcgcagctctctcgtccaggacacacgagcaggagtgacctgcgtccagaaggtccatcactagccctggccatgtgctgagcacccaggcgatgccacgtggaatccaggtgagacagtcagcaccacctccatctgatgtgttagtctgaaggcagcgttacgtgttgcatctattagacaccaaccccacacaggtaagccatggccagccctggtccaccctccctgctttattccaggggtcccacagttccatctgccttgggtcttgccccttcaatccaccatattatccgctgacagagtaacctttttccgtaactcatgagctggtcatttaaagaaaaaggtggtgaattatgatttgagtgaattttaagaaatacaaattattttcagagtctacaagtagtcacctgtcttaactagcagaaaagcctaggcctgccctggtgaagcagcagccacagcccccgtcccggactggctgaatatgttacacacacaatgaatgttacacacacaatgttacgcatgcacacagaatgttacacacacactgaatgttacacacacgcacaccacacacacacacgcatgtgataggcgtacctttctaaaactgtagattaacttcagttgtaagaaacaacacacggccatcccatgcaccctttaccttgactcccgcgatggtgacatcttgtaaaactacagtacaatatcacaaccaggatatcgacaatgagacaactaccaaccttattcagatttcgtgttttgcttgtatccattccagagcaatctctttataaggcaaatccaaccacatccagcccttagtgaatgtttttagcagctcagcacgggccttggtagcctctgggcctgaccaccttcccgtcctcatctctggcttcacgcctccaaatgttgtgttccgtagttccaaccatctacttgccattcctcaaataagatgcggccactctctgcctctgtggctgtgtacacgcggtgccgctctagcctccctcctccccgtcctgcgctgccaaccacagctgcagtgtagaatcccaaggcgccccgtgcaaacctttaatacagaatccatcccccaccgtcaatgatctcttcgtctacgcacccgcccctcctcacacacggcagcctctgagggcgtcgagtccctcctgtctcattacgcttgctaccaggggtgcacagagacttaacgggtgaatgaagagaagcagcatatgggtgaccgtgtaagaaaggcaggtatcgtggagtggaactgtgggtgggcagaatcatggagagctggagggctgaggagtcaactggaggcgcattcaagcctttagatggaccctgcggcccagtcggtgagctgctaagggctgagcaggagaagcaccagagggggcctgagtgcagcctcggctgtgatgttgtgatgtcattctgcgccatctccagcaggggcacgcgctcagcttagtgacccgaggcgttccgagcctcggcgtccccatgtaaccatgtggtcacagtaagatccacccagaggactctaaatgggggacaaacagcacacaaacaaaaacaatcagagcggcgcagtgcagccctcagtgagcgccaagagaaccctgtcagccctaaaccgagtatattgattatagggtgattagctgtacaggacccagtattcgtttatggggtttttttcttcccctttattttctggctgatgatacagaatatcttaaaagcaattaaggattaaatgttcagcccattaagacaatcatggaagagaatgttctggcagagtctagatagtaggttccatccacgccacacacatcctggcgattttcaaaacgttaaaatactaaaaaccttaatactgaaaccagcctgtccataatgtcatctgtctgtggcgattcagaagacagcacaggtttctgcaatgaatgcctcaagggttatgatcccagacaccgatgtcaccagaagaccttccgcggaacggacgtcaggccaagcagtcctgagatctgctggcttctacctaaacgggacttggttcctgaatactcagttcatcagtgtcaccacacatcctcatcttcagtgtcccgctcccttctaaattcagataaagatacaattttattgttaacaacatgagtgaatggcttctctccaccccaggtgatgcttccacgggccacttcatgaagtgcatagacctgggggctcatgtcccagattcaggagagcctcagacacagtctgcctccgaatttagacgtctgtttactcaaccagcgctagttaagtccctgttctgtggaggttccagaactgcagggttacagccctgccttctcatgggcttacaatctagcagggacagaaaggcccgggaggggctgcagctcccaagtgacagctctggatccgggcaaggataaagacacccccgggtggcatggaggagcagactaaaggtcaggcgtctgcccatgtccaaagccaaagtcgtggtacataaggcactgcccacccctcgcaccttatgtcctaggggcacggcacagtcacgcagatgactcagctgcgccttaggaaatccaagcatgactatgagaccacatcacagaggaaaggggtgccagggccgccagctgccagggcagaggtaaggacggggcagccctgcacctaaatctgccatctatgctcccacagccccactgtgcgcccaccctacgcagggcagcagggagaaggggacttccaggcccactaactggaaagacagtccgtggaacacagcacagtgggcactatgggtcagacaaagacactgaaaacagcgagaaaaggcctggagaactggctggttaattttagtaaaattatacattactcacatttccagctcattttcctggttcccggagcttcaagacagacattgttttccaggccccgctcgcccggatgaatcacctcccggccactgcttcccaggcgtcatgtgctcccggggacggcagaaaaccgcacgcatcctgcccgggagatggaagtcgcctccgctcctggtcaggactgtgcccgagagagcccacggcatccccgcgaacacccaaaggactctgagtggctccgtgccaggcctatcagagccgctgaggctgcacggcacccggccccgccccgggcctcatccccatcctaggcgggcacttccactgccagctgcccacggagagaaagatggaaagaggagggagggaaagagaggcctacaacaccatcatccaggacagagctttctgagtactgaaagccacacgctctctaagctaagaaaccaagaatgtccataacatctggggaaaagtaaaccagattccaagcagtgacattgaaagaatccatcacgtgaaagaagtgcactgcgtctatttgatactcattaaaatgagtttcccaccctccaacaaacgtgctttgggatgcttagcccttagccccatcacctgacgttctgagcctgcgctgggcttcattcaccgtggactgccacaagctacactgatctgagtctgagttcctctgcctggggagggggtatgggtacaagacattttgaggatacattctggggtccccaaaggcccctgagcaccatggcatggcaggtgctcccacccagtgaaagagatgaggcccagggcagccttgggccctggcctcccaaaaaccaacatcctgaggcggcaaagcagcccgtccccatgccaggcgttgcctggcaggagtagaatgaaggctatgcagagacatcccccaagcaccagagtccaggtggagacaagagattcaaaggaggaggggccggcacagggccagtgagtgggccgggacacagccccatctccagccctttcgtcctctctctcccaccgcagcagttacaggagaatccgacatctgagaactggcaggacagccagtcgttcacacagtcttaacacatcataatgagactgctggctgggcatggtgacgtgcacctgtggtcccagctacttggaggctgaagtgggaggatcacctgggcccaggaggtggaggctacagtgagccatggtcacgccactgcactttagcctgggtgacagagcaagaccctgtctttaaataaataagattgctagcacatctttaatcttaaaaagcttcctcagaaaacagacttaatgccactgaagggtgccctgaaacctggttaaagtggtcagctgtatgctctgctaatttactacagctttttaaataataaaattttacctgaataatatagacagaacttcctcccaacctttacctgctgccccctggggtttctgatgtgcacagggcaggtcagcaccatcccagttttacagaagagatgaccaaggtggagaagatgaaggctttgcctagacatgctgcccaccacagacaccggccctgtggcatcagccgctcagggtcgtcacaccaggcccaccaagagactctccatcacctcgcagctccatcccaagctgccaggaggcctttccgacccaccagcaccatttccacccaccttcctgccccaactgcagagacacaggaaaggagcagtgcggagatgccggccaccaaggtctgtccccggacagtcctgccacgctggctttctcagtcagtaagcttctgaagcacagctcccaggggaccccggtccctggctggaccgtgcactcccgggaaggctgacactgcagcccccacgccctaatctccttggctccgcacgggtgaccacataccagatgttctaataactgtccatagagtaaataaatcattaaggtacacatagtatgtgtgagtccagttaacagcgtttgtggcaaatgacaagggagttaaggagatttcagagaaaatgactggtggcaaagacttttttctgaaaaagcaaaatttaaggaacatttaaatgttgggcataaacagtggtgagatgtcttctcccttttagtcccttcctccaacttctgttgtcctcctcacctcctccctgcttctaaatgtccccgagctcatccaaagcaccccacaacacacacacaggagtgaactcatcaccgtggcttctctccccttgtgagtgggagaattcactgcttcccagtgagcaacaaggtgcctgggtgtgtccccaagacatcctggtcaagctgcgtcactcctctgtgccaattttagacgggaagtgagggaagtggttgcaaaggaaggcctgggtgaagacgatgtttgccgaggtggcggaggctgaggcagagacaccctcctaagtacaaatggcaagaagtgtgtcgtgggcaggaaaaagctggcaaaataccggcattcggactgtcccaaagacagagatgaccctgaggctcctggcttcaatagcggggtccatcctcgctggcagggacacagggcagagactgtctctgccttctatgcgtcagcaactactgccatagcttaacattgcttaataattgaaaaaaagccaccaaaaagtcaagggaatgaaacccgagtgcgaatgccgccacagccagcatcactgccacaaccatccacccacgtaatgtttcccccattaactctccataaaggggccaggtgcagtgactcacgcctgtaatcccagcactttgggaggccaacgtaggtggactgcttaggcccaggagttcgagaccagcctgggcaacatggcaaaaccccgtctctacaaaaaatacaaaaattagctgggcatggtagcgcctgtaatcccagctactcaggaggatggctggagcccagtaagttaaggctacagtgagccatgacagagccactgcactccagcctgggcaacagggtaagaccctgtctcaggaaataaaaataaaatactccccacaaaggtagtgtccctctttttgctggttcagatttcagaaatcaactccatggacccggcaacacaggactcatttgctccatctattgcgagacagctgtggcttgcggtcccagcgtgagaagcctattggccgggcacagtggctcacacctgtaatctcatcactttgggaggccgaggccggcagatggctttagcctaggaattcaagaccagcctgggaaacatggcaaaaccctgtctctactaaaaatacaaaaattatctgggcgtggtgtcacgtacctgcagccccagctactctggaggctgaggtgggaggatcacctgagcccaggagatggaggttgcagtgagctgagatctgcaccactgtattccagcctgagtgacagagtgagaccctgtctcaaaaaaaaagttggggaatctctgagtaagtgattgacgttgagtatctttattatcatcagctctcatttattgaaggacatgcccaatcatatgctagacctcatcttagtaaattcactgccccactgcaaaataagcatcatctccattttacaaataagtaaactgagcttgagagaggctaagtaacttttctaagtttacaaaactagtacaacgattccaatatatattggactggctccaaagcctttccattttccgggagggaggaaaatacaaagactcgtgtacctaccactcagaactagcaaatgaaaatgtgctctcatatttgcttcgggccttttctttcctctggccatgatgaaagcagcagaacatgcagacgcatgaggtccctgctccaggccctcctcagtcccattcccctctcttcgtcccctggggcatcctctgttttgtatttggtgcctcctgctacctgactgtcgtcctcttgccacacgtggatgtgtccggaagcacacatccgtcgcatgcttcacactccagcatgccagcacactgtatgtcttgttgtacaaccgtgtctttccctcatgttggtcttggagctctacccatgttccaacacagagacctggcttatccatgttatttgcctgctctgtggtattcttccatacgaatacaccactgcatatgtacccgttcctttatggaccggcgcctgggcactctttggtttttccttctgaaaatgacccccgtaggccaggcgcagtggctcacacctgtaattccagcactttgggaggccgagacaggtggatcacctgaggtcaggagtttgagaccggcctgaccaacatggcgaatccccctctactaaaaatacaaaaattagctgggcttggtggtgggcgcctgtaatcccagctactccagaggctgagggaggagaatcggctgaacccgggaggcggaggttgcagtgagccaagatcgagccattgcactccaacctgggtgacagggcaagactccgtctcaagaaagaaagacagacagacagacagaaagaaagaaaagaagagagagagagaaagacagacagaaagaaaagaaatagagaaagaaagaaagaaagaaagaaagaaagaaagaaagaaagaaagaaagaaagaaagaaaggaaggaaggaagaaagaaagaaagaaagaaagaaagaaagaaagaaagaaagaaagaaagaaagaaagaaagaaagaaagaaagaaagaaaatggccccatagtgcttaagtcctcagacatgtgtcctggtgctggggacagggcttctgacattctctcaggtcagtatttgcaggtcatccaccttcgacttcaacacatgtgaccagaaaccttcccaaggcagccatccactttgctgtccctccgacggccatggctgaccactgctgctgctgtgtatcctcggtgacatctggccttggcagcctatggatttctgccattctcctggcatgaaatcactccttcttgttgttttaatttgcatttcttcagttaccagcgcagttgagcatcttttcatacacttactgaccattctactttatgctgtgaactgcctttaatttctgtaatgggttgaactgtgtccccctgaaaagacattgaagtcctaaccccctaggttctctgaatgtgagcttatctgaaatagggtctttaccgaagaccaagtaagctgtggttatgagggcgtgctctaatccaatgtgactggtgtcctattagaaaacactggaaatctggatacagtgacagacacatacggagggaagaagatgtgaagacagagagaagaccgtcatcaacaagccatggaatgccagaggccaccagcagctgagagaaaggcctgcacagacgctccccacagccctcagaagcagccagccctgctgacaccttgatctcaggcaccaggaacggtgagacaatacgtttttcttaccctaagccaccccatctgtggccctgtgttatggcagccctaggaaacgaacacaattccctaggccgtacccacccgctgccttgctttacacggctttagatatttgccacacccatgtttcttctgctttatctatgatcaacctaaaagtttttaaagcttcctctggacatttaaagagaggtcctgagatccactgggcctcggtcacctgtcctgtatgcctgtcatcctgaggcactgcacgagcaccgcacaatgacagtccaaacagagaccagagctgggcaggccaagtcagcccagacctgccagtaagaagctgagagttccagaggctgggaagggtagggagaaggtaggggctggagagatttgctaaaggatacaaaattacagccaggtaggaagagtaagttccagcactatggtcacctagaccactgtagggtgactgcagttaacaataatacactacacagtttcaaacaacatccatatattggatgttcccagcacaaagaaacgattaatgtttgatggaggctaaccaccctgagctcatcactctacatgacacatgtcgaaacttcactatgtaccccatgaatatgtacaattactgtcaattcaactatatatgtgtgtgtgtgtgtgtgtgtgtgtgtgtgtgtgtgtgtgtgtgtgtgtgtgtattttaaaagctggagggctagctgcccccaaatatggttcaggaagccaggaaaaagagccccatcttatgcgcctacatacaaaagggaagaagcttgtcggccgagttaccatccaaaacccttttggcttggtagtgtttggggaggatgaaagaataaagccgcagatcttttcattactcctgcatctcctcctctctcttcttcaacgctcgtgccaaccccccattcccactttacaccgaggaaaagtggattgagaggtggagggatctgcctggggccatgtggctggcaggtggcagagtagggacttgggtccttgctcccctgctgccaatgcccggagggtttcaaaagcagctcaggtctgtggtgcgagagggaaggcggccgcactgagtgctgtcagagcaaacgggcgtccattctgctgctctcctgtcagtgtggactctgtctctctaactgcgccaagggtttccagtcactgtgctctcaagagtgacagtcattaaatcagcatagccagcatctccacatgctccagccttcgagtttcttttgactccctccagcagctcagctggaatgtgcatcgtgtgtgagtctgcccctctctctccttgagactggaaggagctccgagggcaaagtgggtccctcctttccttgggcacaatcggtcctcagatctgtgcaagggacggaagacacttgggaaacctggcggatccggaaccacagtgtgcacttacccagcggcagccgcttaaagaaagatcccagacaccagccttaggagagaaactctaagtgattttagttagagacctgtcggaaacgctgctgctggaagtctccatctttccattctccctatggtggcccaaaaagccaggtggctggtttggctagaatgaggcgtaaagtcagagcaaacaggttctgagtgagtctggggccaacccctgcaactttcccatatccaattccagcattcagagaccctctttgcttggcaatgtgtgcaggctttccagacccgttgcctctagagaggcgggactcacggaaatgctggccagcagcgcggagcccgtccaggttgcccagatcctcaggtcacgtttctgaatagctcaactctatgtaaataaggtaccagttttctttaaccagaactgtctacatgtgttttccattattagctttagttttttaagaaaaactgatgtttgagaaacaggtcatggctgagaacatgaccggtaaagcatctcacctgcccccacgttagcaactgttgccagggaagtagttgtgagagcacagccagcagtggatgcccacctgcggccatgacccccagaacttaattcagatggggcaggaatccatgtgcatgctaagcactgtttacaggcaaaacagatgtgtcccacattagagttttcaaatgaatggagatgttgctgagattaataaaattgaaaagaatttaaaattcctactgctaatttgtagttgtttttgtcattatgtaatctctcaaggaatatgttaaaaatacaaccactatcatatttttgacattaaatagagtccttgtatcacagaagggatgaaaaacactctatctttccttcctcactgagctgcagtgtctgaggtggacaaaaccctgggagacacggcgatctctgcacagcagcagaggcatcagcatgtcggcatcctgccttgccatcctccggggactacttgagacagctgaggcgaggactagagggaggggtgaagaaaaggcatttgaccactaagaccatccagtgctagtcaacccagacgtcctgttctccctgctgcttcactccaccccacaccctcaatctgactctgagctccgctggaaaggcctttcctgtgctggaaaagtggagggcaggacccactgcctccgatgcccgcctcaggaaggcagagggtggagagagagcccatccaccaactcaagactaggagagaagacacattccctctagacacccctggagggaaacgggaacagtgtctgctcggtaggctgctcagaagtgtctgcaagtcactgtctagaacagggcctggcacacaactattttatgaatgagccaaccgaaaactaaacaaattctcaggagaaaccagcagcaacaggttagagtcagacagaggagctcatgaagctgggtgacccagggctgggccatccatggccctggggctcctggggaaacccaaggagaacagccctggccagcgccaaccccctagaaacgagtggtctgaggagaccttctgccattccctctctcgttcttgcgactggcactgtcatctttcaaaatttcaaattcttttgaaggctcactcttagtttttactccatattatgcagcaaattgctggaaaatattataaaactgtttagtggccaggtgtggtggctcacgcctgtaatctcaactttgggaggctgaggcgggcagatcacttgaggccaggagttcaagaccagcctggcatggtgaaaccccgtctttacaaaaaatacaaaaattagccaagtgtggtggtgcatgcctgtagtcccagctactcgggaggctgaggcaagagaatcgctggaacgtgggaggcagaggctgcagtgagccgagatcatgccactgcactccagtctgaacaacagagcaagaccccaccccccaaaaaaactgtacactggaaagattggatgctttgtccaactcaggagaacacttcacactaaaatggttttaacaggagagagatgtggaatcccagcctccctcaaggagcaccacacagctgctgcttaaacactatccagacagctgcctacctccttcctaaaggttctccctcctaatgaatgaactctgccttcaaatacaattctttggtcccaggtctgccctttggaaaaattcaatgaatcttatttcctcgtccaactactgaaaaggacttctatgtcaaccttgccatgcccagaattctccttcaaattactctgacacaagactccttatccaacctgtcacccacagggcacatgccacaagtgaacattcatatttaagagggtcacactccagaagcagcctaaggaaatagggcacacaggcaaggactcactcccttccatttatcgtagcacgtttctgaacgaaacaccagcgtagacagtctaataaaaactaacctaaagcatcaggattattccaagacctgcagtcaccagtactatcctttcatcaaaacaacccaagatgccagtaggcacttccacacccatgttgcacagtgtggtcacataaaagtctccaatccttttcttcccattatttcagctttgtgaccccatactggctaaagaccagacatgaatgagtgcgtgcaggcatatgagagacaaataatcagacttcctttctgcgtcacgtggtgtgtggcagtctcctcctccccacacaccggagcatggtcacaactgcctgaatgccagccgccttcccatggtccagccctaaggttggtaggaaccagttcgaaattattttgtggacttctccgtactacaggaagacctctggttcaataaatttattcagcactaaataaaaatatcaaacctgattttcctcttaaagttaccgatctaccctgactgaactcagaaactctgcaaaaaaaaaaaaagtaataataataaataaataaaccccaaaactattgagctaaattattatacacccattgaaaatttgagtattgagtatacgaagtgattaaatgctcatctagtaagagattttgaggcatctactgtatattttctttttttttttttttttttgagatggagtctcgctctgtcacccaggctggagtgcagtggcgtgatctctgctcatcgcaagctccacctcccaggttcacgccattctcctgcctcagcctcccaagtagctgggactacaagcgcccgccaccacgcccggctaatttttgtatttttagtagagacggggtttcatcgtgttagccaggatggtctcaatttcctgacctcatgatccgcccgcctcagcctcccaaagtgctgggattacaggcgtgagccactgcacctggcctctactgtatattctttaaagtactaatagaccgtaaggaccttcctcctgagagccaatcatgtagtgtgttaattctcaacatgaactgcctctgagcatccaggtagtcagggctacgctccatctttccaaaactagggggaaagggttggccaagctaactttctaaaaaaaaaaaaaaaaaccagactgctttacagaaacaagatttacattacttaaagaaaaaattattttgaggacctccaggtacttagcaaggctactgctttactgacaatggacaccctaatgacaaataaagcagagttcccacgggaaaaaaacagtactgagagcctatttcattgatctgagttataaaactgcatttcttttaaaatagtctcattttcaaattctgcaaaaacttcagaactaagctatctctggagcttcactgtaacatcactcacatctagatgcaaccccctggctataaaatcatatttcacccagaagtgttcgtctgtggagtgtgcagtgtggaagactgaaaagaacgtggggggagttcaatcattccattcaacactgaagtggcatctcttcccccaaactcgtgagttgatgattcaaataatgcctccagagaattcagaagcaccctcccccccaagtttcatgcaccccaagtttcatgcacctttcctttgtacgagggcttccaaaccagatggtaatggtgactcttcactactctttgaattaaattaaaattaccacccccggtggtcatcacgcatcacatctgtcgattattaggcaccaaatactgtattcctggagctcggtctgccctccaagctgcctgactctccttcacagcctcagtcaccccagatgagtatggaatataaaggattcacacacaatggactcattaatgtttattcagttgacctgaagttggtcatcacagtttttcatattttttttactatggtaaagtactacatacataaaattcaccacttttcagtgacaataagtacactggtatgttgtgccgccaaccgcaccatccgtctccagaactttttcctcttcccaaactctgcactcattaaacaccaacctcccatttcctccttcttgcagccgctggaactaccattctaccttctaggactttcactactctaggaacctcatgtcagtggaatcatacaacatttgtctttccatgactggcttacacaaggtgcatctgtgtggtagcatgggtccgaatctccttcctttttaaggctgagtaatattccattgtgtgtacagaccacatttggtttttccattcatccggtgatgagcacttgggttgtttccaacttttggctattgtgaataatgctgctatgaacatgggtgtgcaagtatccgttcaagtctctgctttcagttatttcgtgtgtatacctataagcagaattgctgcatcatatgataattctgtttaatgttcaacacatcattggtagtaaaggaggtgggaagtataggatgcatttttcatttaacgtttggccctctctactagagaaaaattaaaggtttccaaaaggatggatcttgtccacaacaataactgaaattgtaagcctttgtgaaaacagcccaagtggttcatgagagaaatgaatgttcatcaataatgtaaacactggacataaaagttaaatcaacaaagaatattcaccacccagctcactaaatccagcaaacttgggcacacaaggggcccactggagtcaatgatgttgtaatcaacagtgagcatttcggagacttataagctacatatttgtggttctcatttctcactgtgaacctttaaaaattgtttcaagtcatcggaggatggctaatgttaacagcaatacatattgaccatttgtataacattggtgtacagtgttacaaagtgctttgcatatacattatgttaacagatcctcttcaatctgcaactcctttttttttttttttaaaaaaaaagataactctttctctgtcgccctggctggcatgcagtggcacgatctcagctcactgcaacctctgcctcctgggttcaagtgattctcctgcctcagcctcccaagtagttaggattacaggcatgcaccaccacgcctagctaatttttatatttttagtagagacggggtttcaccatgttgatcaggctggcctcaaactcctgacctcaggtgatctgcctgcctcggcctcctgaagttctgagattacagacgtgagccaccgtgcccagccatgcaacttctctttaatggccagaaagtgcatttctcgaatgatgaaactaaaacccggagggtcctcatctgtgcaggcaggtgagcatacctagacacccggccctcaagcagtcacttactccactctccattttcaacccagcttcattcggaacaaggaggggacaaaagggtgggaggagaggctgctctgtggaatgaccgtacaagttactgagagatgaaacaaaagcattcattttctattaaatgtgaaagatctctcaatctctaattggtcctgcactctaaggcaacttagcagggactcaagtacaatttccatggagagaagtggtcaaatagctgaggtcaaaccctccagactccaactgcagccaagtgcttttatttcccttgtaattttctttaagaataaatgttaaacctaaaacatacccccttttggaggcgatcttggcagctggactgagtgggaagaaaaagcaccttgtactccccgaatcagcagccaaactatgcaccattgtctagaggcggtcacatgacagccatcacctgaaacttggttacttccaatccatgaaggaaacaatcactagtgtgccttaacccttccagctactgcaggcagccatgctgcagctgctctcagcagccctctctcccattccagtccccgcttaggagaaactgtgcatggcacaaatctgattgggacaaggtggcgtttggggagaagggagggacgagaaggaaaatcactgctgtcccttctaagcaaagactactctacctctcccagcacttgctgtctcgcagtttaaattaattacagctgaaaatacagggttgccatctggtttgaaaaagcaaggataagggaataaaatgaaagggttcttggtactaacctcactttaatcattgccaaagagcatgaagacagcccagcgtcctcccacaagaaagccttgggcctcacaaacttggcaagcagtctcaggcacaaaactggatgggcgggcgcttgtcagaataaaagtcctccctgaaaggagggttgcgaggtaaggggcctgcttgccccctgcactgcaataaaagtttcctatgggtcctggggtaggtcaggaactcctgggagggtttatttatagagggtgccttgccaaaacgctacacgcatcattacagttccatttggtgagaaaatagatttgctgtcagaattacagcacgcgatttcctctttctttgtttctccatcttccataacataaggcttttataaaacttcaaaataaggctaaagaaaacacaggagaggaaggttgctgcagaagtggagacgctccgaaggcacgatgcatgcaactccacagcagggctgcagccggcccctcagagaaggaatgccagaaatcccctattctctgctgcagccgcaactacagtctcactcctgcactgtaggaagcaacttccttctgcctcccttccaccagcagaaccctaggtgagaggcttttctcttaggactcaggctgccacagatggtgactccaggcactggagaagcaaaggtgccacagccatcctaggtttgtcttggtgaacttacaggtgggtgcaagaagttgctaagtctgcagatgtcttagccatacgccagcatcaagtagcccggagaagtgaagcagaagattttcagcccaatttaaatttccacctgcccactacctgagttcttttacacccaggtcagttttgcaaacaagaccctgatatacccaagcccagctgctttcagaaagtaacaccaattgaagcaccacggtatttatcagagtaaactctgatcaaccagatatagtattttataaaccagaggttctaattataaaagacaagataaaagcagattatgaaaatagcatttctgttctggtgaaaaacacatcttcaaccccaaaatgatgtgaaaattgtcttccaaatcctgccctgacagaatcactgtctatagcaacagtgtccataacattccaaatctcaggagtgtaactttctagtaaatggtacatctgtcaagccacaggaaacatctggtaaaatggttaaataaaagcagaatttaaacttttctgatttcagagcttactaatggtactcaacaagagactatcaaatactctaaaagctcaatgtgacagtgaaaaatatcctggaggggaccaggtgagaaaaagaggacaaaaaaagaagacaacccgggaaggagtgggctgcaatcccactctcgtcacgatgacgatgctcccattccaggcctgcctctgggagacagtggccatagccccctcagctccgccaaggatgggcacattcctgcccatcaccatggcagaaaccttctctggcctagttaagttcctctctacccagggctgactcccccaagcatactcatatctccccaacgcacccaacccaggaggccctcaggagaggtttggggggatggactgacgaagtgatgacacacaaacaataagcttccctccgctccacggcagacatgtgtattaaacacatacaatcattctaccatcaagacacacccaggccaggtgttacacaatacatttcagtcccttccagaacattttacgaggcttttccattaaataaaagatttaatgatttggccacatccaaattttaaaaatctatatttcaaaaatacagtaaataatgctgaaaagcaaataacattacttattttccccaacgcatttgacagagcatccttaatatgaagagtcgtaacatatcaagagaaagaagatgaatactctaatttacaaaaaagacaaggtataaacaacatcatggtcacagaagaagaaatgcaaacggccaataaggatatgaaaacatcattcaagttctctagtagcagaaaacaaacaaacaaacaaaaaaacacacaataacaatgtttctccccgagaaacttgcaaatattatataaatgaataaatggtagcagtcacctgtgggaagatgccgagagagagacagatgcatacagctgctggtgggaacagatcagtaaaccatatagagtgaagctggcagaacacaccagcgaaaacagacatggaagacctctgacccagaaattccacttctataaaagtgggaatatatgagatgggaggaaggatggagatattcgaagttctgcaaatgacagtaaaacaatgtaaacaacccaaatatctgtatttgttaaaaagttcttttggttacaagcaacataaaacaaacctagtttaaggaaaaaggggcaacttactggaaagatactgtgatatttcttggaaatgaaaaaatgctgaccaaccaatccttgaaaagagaaaaaaaaaaaaaatgaggtggccccagggatctgggcttcaggaggcggaaggcgcccatggtgggtccatgtgcagcatctcaccagagcctgccttctgccctctcccagcacccagggatccaccaccaccaccaccaccaccaccggctccaagtgtcacaacttggtgaccttcctaggtcctatgtacatatcatcctccaatcactgctccattaaggagttattaacatcaagtcaaaatcccaagaacactttttattatacatcaaatatgctgctaaaaactagaacatgccccaacacacacttaaatgctaccagttttcacagtcaagagacttcactgggctggacacagtggctcatgcctgttatcctagcactttgggaggccgaggcgggcagatcacttgaggtcaggagttcgacaccaccctggccaacatggtgaaacccagtctctattaaaaatacaaaaattagcctcatgtggtggcgcatgcctgtagtcccagctacttaggaggctgaggcagaactgcttgaacctaggaggcagaggttgcagtgcaccgagattgcgccactgcactccagcctgggtggcagattgagattccatcttaaaaaaaaaaaaaagagagagagagagggagagagacttcaatggagccttgaatgaattatttataagtaaaaaattgagggatctcccaagagagaaatctattatggtcttgtttcagatttgtaggtttaaggagaaaaagggacaggggaatgttccacctctgccatgaataagatactggattttttaaaaaagtaaaactgctggaattgttggctagacagagatgagcctttggggcaggaaatcaaatattatgaaaaggtgatttatcttagagcaggcatgaggtgtttaatttattccatgtatctcgccatcttgcattccaaatcttctgcctcctccaacagctctcttgcttcccttgtcctctttctgaatgcacacttcccaccacagaggaaccacacatatcctaaatccctcctttatcatatacaacgtcacccctcccagtgctgatggacaggcgaccccctgccgttggtccctgggtgtttcaaagagaggccctgaggagctgacactccagagcagtctctgggtcccctcttcccatgaaagcccccaacccttccccctgcaaagtgggacaactcctagattaaagattgctagaaaatacaatgactaagtgtagtgtgattcattactgaatcttgaattaaaaagaatgtaaaagaattttttaaaaaatcttaaagtataaagggcattactgaatatgaaaagatgatgtgagatcatatcattgtctgcacacatatgaaagaaagataaagcaaatacgggcaaatgttaacaaccgatgaatgcagggaagggtatgtgagtgttcactgtgctagtccttcagcatttctgtaggtctgaactttctccaaaataaaaagtatctatggtgaggaaacggtgcaggaaggatagaaagaggagattatcaccaaatttggctggaatatgtagaatgatgtgatttaaagcacaggtaatatggtatacactgccctccatatcctcaagttctgcatccacagattcaaccgatcatggatggaaaatggagtcaggcctctgatggtacagacttttttcttgcttaggaataataattccctaaacaatacagtataacaaccatttccacagcatttacattgtattaggtataagtaagctagaggtgacttaagtatacgagaggatttccataggttatctgcaaatattatgccattttacacgagggacttgagcatccttagatttctgtatcctcgagggtcttggaaccaatctcccaaggatatccagggacggctgtatatgacaatcgctttgtcgggagccctcaaataatcttccccaagagttggcacagggataccaggaggagcctgcgtgatggagagaggcctgacatgcatgaaaagatgccactggcaacaaatatgttagtttcaaatattagcctcaaaatgaaagtcacaagggaagttggagaatccaaactgcttgccctgaattgcacgagacctgcttctcacacagacaacaaactctgtgtagcttgccgaaagtcgagaaataatagcagggatttaaataaattattttgaaattaaaccatggctagtggccaaagagactttcaaggcaaggccaaggaggccatcttctgagtaataatactgggagagggagtttgggagcagatcacaaagtccttgatggtcatcctaaaggaactgtgtcttatttcacagtccaaagggggccagagccacaatccagtgataaactcagcaaagtcctccaatgaggttctagaggaatccctgccgatgaaggagctgcatggctcaggcgcctttcagcaatgcctcccctaccaagcgtagccatggtagacagtcagcttctaggtgacatggagtgtctgtgtttctatcactggacgtaacttgctcaaaagccaacggcctaagacaaaatgatgtggtgtcattcaaaaccaacacacagaggatgacagctattagtgatacaagcacaaatctgtcacacaaaaataaaataaacgcaacaacaatctactagaaaacagccgaaaaacactttggctttgaggactttttggaaaaatttgaaaaataccagaactggtacatacttgggccgagatgtgtttgcttttctagcagagtatgagcaaatctgcactttgggtcaatttccacccaaaagaaatgtctggtcatctctctgccctgtgagactcaacccaaatgcactgaattcctcactttcatatacctcactttatgttcacacttggactggagccagatgcataagcaagaaatacagaggagtgaaaaaaatcatttcatccacacaagaaacctggggggcttcttactgagagtcaacaccgggatgagatcacgtgccgtgaaagaagcatcacgggcagggctggtgctaccgactgaacctcgcgcatgtgtgcgttttcgttttctgttttcaagagcttagcagggaaaggagagcggtggcgctctgttctggcacatgtggaagtaaacatcaaggctctaagggagaaaatggaagtatactaagtggtgccactcagggtttatgtgggcttaaaagtgattcttaacatctgtcccaaagggaagagtgtttccacagagctctcctcgtggctcctttttcattcacacatttactcagcacctggttggtgtcaggcactgggagggtatagtgctacagacctgagcaaattcagcccctggtctggtggaacttgtagaccagggaaggggacagacagctggacacccaactgtagcagagtgtcatcgttttacacaaagtagtattcaccttgaagcaggaggaagtgccacttgccagaggaggtggctttcagaaccacactggaggatgaagtgagtgtgcaggcccccagttgggctgcagcccagggggtcctacaggcagacgcccatggagatgggccttggcagtgtcaccctgtggtggactgggagccgtggaaggattccaagcagagatgaatacttcagaaaccaccttctgacactcgagcaccagtaagaccagccaggagggcactgccgtgcaaacagggggctaaactacagccccagccagggcctactgggaagttagcaggctgatccacaggcaatgacaggaggaaggaggaggcaacgtcccagacaaatggaaagagagttgtatcagtcatgaatagggggacagaaggcaaggagtagacttggtgaagtgctggaagaacaatggagcagctgatggcaattccagtgaggcggtgctgaatttagggcacacatacaacacccagtgagagggtggatctatggggtgtgaaggcttggtctaggctagaggtaaagatgtgggactcaacctattgtggcaagtccagccacgggttcatgtgtgacttggttataagggtctgtgcaggcagaatgccagagccctggagaataccaataacaacgagtctctggaagatcctgaggagtggccacagaggtgggaggggaccacagaaagccagaaaagggccacaggaagcaggggaggagagcccttcagggaagaggaaatcaaataagacaagggactgcactctttcctgaacctggcaaccagtaggtcactcctgaatgcagggagaggattcaacagaattgttggtatggataacagcactggactagggagtggatataaaagaacaggtgatctctctagaaatagctatggaggcggggagaggtagggatggaagataagcaggcacagggtcaaaggaggacagaacctcaagtttcctcaatttctctggcctcagtgaatttctctgaaagccccaagcattaaagatggcacccagcagccccaagtcacggaattaaacaccatttcatgttcatacttaaactttacagcaccagagccttgcaagtctgaaggtttgtgataagagaattttggaaccaaataaaatgctccttttgttaggcaatatttatggggcaagtatgctccaaggaatattaaaaataggtcttatgaaaaggggatgaaggattctgtcttagcttgagctgccataacaaaatactgtggacttcgtgacttaaacagacgtttgttttctcacagtcctgaaggctggcagtctgagattcggacgccagcatggttggtgactggtgagggcgcttttcccggcctagagacagccgccttcttgctgtgtccttatgtggtggggagaaagcaagcaagatcgctgtttcttcttataagggcactaatcctaacagaccagagcctgccctcatgacctcatgaaaccctcatcacctcccaaaggcttcatctctaaagagcatcacatcgggggttgaggcttccacacgagaattttgaggggacaccactcagtccataacagattcaatggccaattccatttgagaaactcggctaaacagtgtttctgcgcataagacttctcaaagcctgaaaggtgctaacatgcaggagcagacctgggagactgagtttgggaccaccgaactttgaccagggaacacttccgtttcccttagagcatcttgagagaagagtgttttgagacagtctgagcagtggcgaggggtgtcactccagttgtcagatgcagctgaggaaatgactcctaacaagctagaaaactcataaccatccctagttgggttcaatgacatggaaatttagggatgcagcaagatttcagttctcagatgtgcttctacattgacctgacgtaataggagttggtttgtcctttctacttggccttgacccagtttctggagcttgtttctatgtagattcattagctgcattattcttaggtctcttcaagaagaaaggcaagaggtagtataagaagttggaggagagggcagtagcaacagttgcttccttctattctgcagtatgtgttgcctctgctggggctggaaggctcggatccagaactcagatcccttgtctggcacagtttctagctactgccagacccagaacattactgcaacattaagccctctaattatgttttggagacaatctgtgaagaaatttcaaaatgaagagtgtgtgtgtgtgtgtgtgtgtgtgtgtgtgtgtgtgtgtgtgtgtgttttaacccatagaaacagcaaaatggagagagagcaagacctgccatttaactaaaaactacaccagatacagaatgtggagcttgtaaaccaccttgctatgttccagctgccatgtgacacaagcaaataattgctttatcagcaagaaattagaggaaaataaaagaaccatcaatagccacacctagccaaatttgttagcatttctcttcccagtcttcaatcaaatctattaatgtagatttgggacagcacttcatatacattcaggacaaactggttttgtgtcacagtaagaggtctatgaaggtcacaggcaatgtcgaggttaatcctctagctacggataaaaagagctgctacatatgtgcccagagcagaagcatcttcgcgaagacagcattccaaaaagcacactcagaggatcaggaaaacagcagaatcctgggttgttttgtttccttacattttgaatacacttgcatcatgttaaaaggtgactctgcacagaccaatgcacattctgtcacataccccaaacgtcctctaataggcgttcctctttgagaaaaaagtcctttcaaggttttcgtcccacttttataaacttcatggcacagatcagaaccacagaggctaaagcctaagtccccagtgcagcctggaacagcctttgttctgcttctctgactcctgtccccccttggcatttcttcattctgtgtcgtcgtttggccagaaaaaatgccagcagcaagatggggaactgccttcccagctctctgcgaagactcttaaggcagaagcgaggcctgctgggagaaggctgatgtcagctcttaagagcacagctccctgctcggataaggaggcctttgttttcagctcaactgtgaaaatgagaaaatgcctctagcctgacaaacaagaaacccacacaacacaggtcaggcctgtgacctttacttaaaggtaccacactccattagcaaaacacttccagggaatctgcagatccaagagtggccctcagagaagagcagctctgcttccacctcaggaaggcaggttacaaccctgaagcaaacctcacagagaatcagttcctcggtgacgatcctccctaatgggaatggaaacacacacaactgacatacatggggcaaagtggggggatgctaaagaaactaaaaatcccgatgtaacaacaatattgcagtttccacattagtaatttaggacaactacatttatgaccataaaatatcctcttaaatccccagaatgcctttgggaatacttgtaagatacagtatgaaagtaaagaatatagaatttcagcactgaccctaccaagtttagactatgccaaggaggcgtggcagaaagaaagagcagatagtttgaaggattccattccataggctttgatttatgaaatctagagggaaaaaaaacacatgtcttcaaatacttaaagtaaattataaaatgctccagtttgaatcttttaggctaaggttactattggcttgggccactaacttaaaattgggccacagattttaaacaagaattaaaacaatctaaaaagcagcttcccaagcgtaaagaaaacccttgtttgttcctgtgggattctcacctgtacaaagactcatttcaggcctcttgggggcagctggacagcactcccccttccacaatccctgagggaaccctggtgaggctgtggggacctggagtgtgccgaactactaacgtcccggggcctccacccctttacttccctccatcctcctttgtgtgtgctaaaatgaacagtccccacctcccaaatatcctcagtagtgtgtggtttgagagtgcttaggctgcatcgtcccaaactatcaggcattagggtccagtatcgaatgattcatcgcagttggatatgtgtgctattagcataaatatcccatggtggctgacagcactggctctaggatcacacagcctgagttttgaatcctggctctggtacttaccagagtgtgtgaccctgaacaagttacagaactctcagtgttaccatctgtaaaggagggataacgatagtctccacctcatagaactgtgaggataaaacgatcgtgcccatgaagcacgcagcacagtgccagcgcacaagggctcacgagttgctgttactaacaagccctggaaaaaagccctcccaattctctggatgctgagaatcaggacctatcatcattctccatgatgaaaagttcacctctctctaaagcttgtgtagacatgaacacaataacttgttttgcctataaatacacattactgtttacgacgtcccagctgctagcagggtcaagggactaaaataacctcagcttttccatttcctctgggttcacttttaacctgaaatgaggaattgcttccttcactctcatggaatttgtgaaatagtctcttggtaactggtccatatacatccaaactaaaggctctaaagacatagaagcaacagctgccaaagagggtatgatcatgttgccaaagattttacatccagataccaaaaactacagatactgcagaacatttgaggtctcatatatataatcaactcttctgcaaaagataaagaaaatccagggaaaacccccaatcccattttagccaatcatcaatttcttcttcttactgagttcctattatatgcccagcacctgatttcaaaggcttcctccaaccttttgttaagctgaatgaattcgtggttttgagtttgtttttccctctttttctattcacccctatggtgagaaaagtgaagtgacagggccaggaaaaaacaaaacaaaacaaaacaccagatgaacaatgaaggatgaaaggacaatgcaagcaaaggaagagggagggaagaggaggaagaggagctgcaacaggaaccggagagcccaagcctggaatacacactcaagggcacaccagaatcgggacatcgggctccagcaaacacttcaaaggaagcgtcatagaagcaaagacaacaaggggcccatctcacaccaggaccgtgtttcaaaggccccccatcagcgaggggaggctgcgttttctttcactgggcccttcctcgttcattatgggttgctcagtgggtctgtggcaaacacagctggatggagcacaaggctagtgaccatggctttgatcccagtgtgagcctaggggctctgccctattctgtggccgggggcaaatacactgtaaatatatactgctgatcaaagagaggatgcctgctccaacgggaacgtgggctcaaacagcacttcccctagagacagggtccaattcaagtcaacataaaattatttagcacctaacacatgccagacattggactggtcaagtgtcatcttaaatacatgatgtgcacctctaaagctgcatgtaattccccaggtgggatgtagctatggcatcatcaaatgatcactggtgttggtgtcacacacagcagggttaatcccagctgccaacaacttagacacatcatcctctcacaaactcaatttttgcttttataaaatcaatctgatatagacaaaaagacagagatagacagatagatgtagaaatgtgcctacctagtgtaaagggtcacaattattgtgagagttaaatgagataatatatttcaagtgtccaacacacggccagtctgaagtaagcactcaataaatgttcccttcctcacaggtgacacatcccactctaagtctacacacacacaggtgacaacctcttcatttcagcacagagccctctcaaggttctacccacgaagcagcctagaatgactctcacaaccgatatgaatttaccatactgttacactgcacccactgtttgccttcaagagttttaattctattacaaatacacaagatattaaaatgcacgaggtcatccattgcagcactgttagtattgtaaagcacctgaaattgccaaaatgtccaaacacaggggactggttggatgagctttgatgcatgcaggtaatagagtgccacgcagctgaaatccagagtgaggagctggtaggaaaagatttccatgatgtgtcattgaaaaacacgaaggcggccaggcacggtggctcacgccagtaatcccagcactttgggaggccgaggcgggcggatcacctgagatcgggagttcaagaccagcctgaccaacatggagaaaccccatctctactaaaaatacaaaattagccgggcatggtggcgcatgcctataatcctagctactcgggaggctgaggcaggagaatcgctggaacccaggaggtggaggttgtggtgagccgagattgcctcattgcactccagcctgggcaacaagagtgaaactccatctcaaacaaacaaacaaacaaacaaaataagaaaacaccaaggctgaagtgagtacacacagtaggctatcgcacatgtaagaaagaaggggaaatgcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccactgtggaagtcagtgtggtgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacatcatggaatactatgcagccataaaaaatgatgagtttatgtcctttgtagggacatggatgaaattggaaatcatcattcccagtaaactatcacaaggacaaaaaaccaaacaccgcatgttctcactcataggtgggaattgaacaatgagaacacatggacacaggaaggggaacatcacactctggggactgttgtggtgtggggggggcggggaatagcattaggagatatacctaatgctaaatgacaagttaatgggtgcagcacaccatcatggcacatgtatacacatgtaactaacctgcacattgtgcacatgtaccctaaaacttaaagtataataataataaaataagataaaataaaaaaaaagaaagaaggggaaatgataaaacattcacatatttgcttgatttaccaaaacagaaacacaagaaggatgctttgcttccagggaagggagtaaaaggtgtgaacaagacagggtagggagtaacattaaaagcacactttttagtacagttttaactttggggagcatgttcatatcttacatactcaaaaaataaaatttgaaaggatggaaaaagtctaaaactgaatgcaaacagaaatgaatgaacctaacaatatatttcaaataatacaacaatactgaggagaaaagggaaagtaactcttcaaattcatcctgtgactattataccctcagcatgggagaaggaaaaaccataaacaaatcctgaactctttttagtttgtttttcaaagtggtattggcaccatgcttctgaaactacctgaagtgcactgcaggagtggaccatgagtacatgtgtggatgtagttcttactggtgaaccagggagatagagtatggaacggggagggcgaggaggagctcgggagagttgggttagccctggagcatcgccaggaactcattatctcctagctctttccatggaaaggatctagaaacagcactgttcaatagaacttcttgtgatgatagaaatgttctgtatctgtgctgtccgatatggtagcgaacggccacatgtggctactaagcttgaaatgtgactcctgcagctgaggaactagatttttaattttaatttaaaatcaacacctgtggctggtgtctgctgtactattagacaaatcaagtctagaagcaatgtgatcatagtaacaataagttaccatgaaaaactatgtaatccatagtaacgataacacctagcacctggatctgggcttctaaatcctattccccactaaaaggatctggagtcccctggaaaaacggctaattccatggctggagcaggtaggctacaagatgagcctagaacaacttgtaggccagaaaataagaaagtgctcaacaaccacaaggaaataatggaggttatgacaaggacataggaccagtggacagggttcttgtttgtcaactctgggacagctacaattcattcagtaagacaggaaccccggagtccatatggataataagtagataaataggcaggcaggcaggagaaaggggaagagctctttcttaccagattgcacttgaatatcaagggccattaaaaaaaaaacttactgatttttccacaagatgaatcccactccacctcttcccatcctttaatccactctttccaaacacagagtacttttcaacttccaaacagacattcatcttcttaagacttttcttaagaaataaacagaaataatgtatttctcagggtcaccgtattggaaccaacccaacagtgtcatggataggttaatggataaatgcagaaattgacctttctagtcttaaaacttaaaacttacatttgttttatctgaggtctttaagaaaagaccttcagtcctctcaaaaacaaaaaacaagtgtcaaagaactgaagcccaccaggtaactacatccagacaaagagatgtgggaccgtccttcatcatgattgtgtccttgctcctcccaagttcctatttgttaaatcttgtttcatttcttccctgctatataaaccccagctttagtccatcagggagatggatttgccccatctcctggactgtagcacccaatgaaagccttcttccttggcaatactcctcatcccagtcattggctttctgtgtggtgagcagcaggacccagaccaaacccctggtggttcggtaacaatatcaacaaaaaaattaataatgagttcaaatacaccaggtcctaagaggctggaataaaatcccaggaattctaattttcaaaattctgaagaaatcactaaggaaacctctctttttttccccttcccctaaatcaaactggatagaactcagtcttactctctgttgccttttttttttataagacatcatctcgctctgttgcccaggctagtgcaacggcatgatctcggctcactgcaacctctgccacctggattcaggcaattctcctgtcacagcctcctgagtagctgggactacaggcgcacaccaccacacccagctaattttttttgtatttttagtacagacagggtttcaccatattgatcagtctggtctcaaactcctgacctcatgtgatccgcccaccctggcctcccaaagtgctaggattacaggcacgagccacctcgcccggcctctgctgcttcttactctggctcagagccacctgatctctccatctttctactagaaaatgtctccatatgatgcttataataaaatgcagccaaaccgtgcacctttcaggccttgttagctagctaccgaaactattttttctttcttcctctctctctctcccttccttccttttttagaggcagggtctcccttttgtaccctggctggagtgcagtggtgtgatcacacctcactgcagtcttaaactcctgggctaaagctatcctcccacctcagcctcccaagtagctgggagcaaaggaacactccaccaggccaagctaatttttaaaattttttgtagagatgggggtcttgctatattgcccaggctggtctcaaactcctaggctcaagcaatctgcctgcctcagcctcctaaagtgctggaattacaggcatgagctagcacacccagccaaaactcttttccaataacactcctttccccagaattattatgactgctttagtgataaaatacatcacattttcattacatgttattaacaaactctaagaagataaagcacaaaaaccattttgtaatctccttaaagagatacactaggctattccttttcaaataattatgaatctgtcatttattgcagataacttcttaggcattaaatataaaggagggagcatgctatagcccaaataggaaacatttcatcaaacagcagcactaaataccctacaacacgaagaagtaagacaggcagcatctttccaatctgcctgtgaaatctgtcattaggctcttagaaaacacagtacaaacaatggtaatgttactaaaataactatcacacagtaaacaagtaacactcagaaggacctaaccacacgccaatcgcctttcctccttacactgtacacttaagaaaatacattttataatatatatattttttaccacaataaaagaaaaatgaggggggagtcacctggctggtgtaagggagtctgagagaggaggttactcctgtttctattttcctaaaactttgcataataatgtcaattgtgatttgcacataaaatttggcgattctattatttacacttaaaattatttatagtgtcatcacagacccgtacctcaaagtcttatttttagccaccaagagagctacaaaattattttcttttttttttttgagacagagtctcgctctgtcacccaggctgagtgcagtggcgcgatctcggctcactgcaagctctgcctccaaggttcaagtgattctcatgcctcagcctcccgagtagctgggatgacaggcatgcaccaccacacccagctagttttttgtaattttagtagagacagggttttgccatgttgcctaggctggtctcgaactcctggcctcaggtgatccacccaccttggcctcccaaagtgccaggattacaggtgtgtgagccactgcgcctagccacaaaattattttctgaacattttaatattctaataataatattaacaatgactaaagctgagtacttactatctgccaggcaccattcttaagtccttacaataatcctatgaggaaggaattaatattatctgtgatgaaagataaagaaagtgggaattgaacccaggcattttgattaaaaggcacatactatcaaacattaaatccaccatatatacatatgtatattttcttactctctatcatcataaccagtatctgaacaatggaataaaaataacaacccccatcaacaaagtgctataccatgccaagctctttgcatattttaactctagtcctcgtaatagctctatacattaactattatcattgtcattgtcattgtccaatgacaaggatatcactgtcaaggatactgggcccagctaaattaagtgacttgtccaaagcctcacagctgttgtgtggcagaatcaggatttaaattaaggcatgtttgtctgcaggctgccttcccctttcttacttatgaaaagaaaaagaaaaaaaaaaaaagaccaaatgttcttatttgggtttgggaaaagcagatgggaaagtataagaaattcgtgggaataaaagaatgaactgcaagagctgagcacccaggagttaagctagccctgcctgcggagtgcactgtttgcagggccttcctgctggattcctgatggtagcaaattccagggctccagactgcaggctcagcctctgactaacactgcagtgatttatttgaggataaatacctctgtcagtgtcttatgactgaacacaacagtccaagctgactggaacgagcggaatgcgaggacgctggagctgaggcagtagaggcgggagctgggccacctctctgcggaaactctgcctccaaggaggagccctcacaggaaggtattcctgtggggaaaaagcagtgccctcaggaattggagcatcttgaataatgaggaaacactgactcatgctagagtgagcgcttgggaagggggaaggaggaggacctctgtacctgcacacacaaagctactccctccaatactcagtgcaaccttgccaggattggcaagataactccaagaacaccaaccgccctcaccactgtacccgtagactctctgggcagctggtggggcgtctccaagtcctgaaaactggggagaagcctctccctctgcgaggagggtgtgtgccgagaggagagtgcaaaggggagaagccgggtgcacggaagcgggaggcttttccagtggaaacatggtgacgttgcacagattcagggatctgtggtttcagcccgtgtttcacaaataacaaaactgaggcccaaagagttgaagcaattcatgtcaagaaggtagacagtgtcagtggcagatcaaggactggctggatgtggtgagtggcaccttgtcatgagcataggaagctggcttccctttatgggaaggtcccaagtttgtaccaggggcacataaggtgggatgaacacttcttcgtgtgtacaatcctagactcctgagtaagaactttacagacgtctgcttggtcaaaaaggtgctgagcttcccttctatttgtctggtgcacagtgacattcactaaatgttgattctcctaaaaacaatcaatatgtatgggcaaaaaaaagcgaagcttagcagatgactactcgactgctcgcagaagctctaaggggacattaacttctatggagtttaacatgcggaaggtcctacaagtaggctggagggaagccagacttccacctcaccgcgagttatcaaaatgagtttactaccttctttttggcagatgaatactatttttcttttgtaaataatatccttttcaaataaagtatgcaaatgataacatcagaattagcacaaagttgcaaaacaaataaggccccagcacggagcacccttaagccaaaataagaacagaggaactcacagatgggggttgaagatgcgactcattttggagacgtggtcgttgtcacagtctaggtcctcgtcacctggctccatgctgaacttcctcttgctggggctgattgggggagggccggtgcggtgactgctgagggcagaggccaccggcagggtctgtattctgggttctcccctgagagcagcttcgcctacgcagagagagatgatgtagtcactaagcaggagaaaggcccccatctcagtcccccaggctccccgcccgcccagccagccccttacaaaactactcccagtggaaagtttttggcaatgggacggggccgcctgccatcctctgaacatggtttgagtgtggttagctgccaaccatgagacattttacatcaacgtggttttctagcacagtcactctttagggtagagtttaaaataaaaagttgcaataaaatagcaggggggaggcaaaaagcattttctgtaaacaatttcaaaagttaatttaaaacaccaaaggtcttttcacgtgtgggtattccactcgatacagataggagaatgacctcactgcattcatgaaaccactatgcccaactcacttttcctgcttgttctgttttttttttctaatatagtcttggtatttaatttcttttaaaagaatgaggaaagtgtgtgggctaacagttcacacatttgtaccgaaagttaaaagaaatataaatacatcgtttaatgggaaataaatgtttaattcttacagtacgctaaatattgcacattaaaatattatcagcacaaagcttcggcatataacttatcgcaagcataatacgtgggtaggtgcagttctgaaacatgtttcgaagttaggcaatcaaattagggtccacatttccatttgatttgacatcttggcgtttttcattattattttaaaaggttttgtactaggcaatcactttgtgcctcgctgtgaattaaaataagcatagcctttcatagtaataaagcttgtgtaccttctaaactttataaagacgaatgattactttaagagaaaacttcaaactttctaagtcacatggggggagcacctaaatttttcacaaataataacccttttgttgtgctgtacattttggtctctcggacctgaccaattttctttccatttggtcacaatttgagagtaatacgaggataaagtcaacttcatccgaggccttgtggtacctaagaaaaggaatctttgtttgccaccactaattttcatatcatcacagatgtgtggacagtgttaacagtcatttacttcatacacatatgacaaatatgattttgttggagaaaggagtgaggaaaaaccctctgaatatttaccaggaaaaataaaaacttggccaatttactcagcaagatataaactagcaaatatacagtgacccataatacacctccagccaggatttcttttaaggattctggccccaaagcaaactggaactttccattttaaatgagatacctaaaacacaggcctcacgctggcctgccacactcagaaattcagtatgatcttggttggcctatactccctatttagtaattttcattttaaaaaacaaaaaaagcagtgctcatctttataccttcataaattagaaaaatatcctttctaattatctccgttatttgtgatacttcctcctccacaaagagagaagagggtgtttccaagggaaagcttcagaagcccaagcccagctaactttctgggaagccctgatgatacccccaggaacgcagcaactgcaaatcaaacctcatcaaaatggcaccagctgaccctcctctccacccagggtttctcaacacccctggcaggatgcgaggggatgaggagtcctcgggcttggacccccgaactgtggtcatcatttcatcagatgccagctgtgtagcaacaagagttgctatggaaaacaaccactacagcaacagactgaaatcactccaaaaaaggagccgtcactcattccaccagcatacactgtgacgcggaaagcaaaacccttgggttaagaacaacattcccactcccctccccagtttccatcctagtaaaaattctcgtgcttgtttgcatttttaagttcatccaacggatgcagtgcttatctttaagactgaatcactgatgtctaacatcgaaaaaaattccacaagaatcctcagaaaacactggagatttctaacccacgggtgggggtgggaccagggctggggctacaggccccatgaaggcactccaggtgtccttcaccagggactgtgacagacgcctccaccaggtcccggggagacggtggtaaatgcgtgctgtagtacttcagcatctcagcttgccggcgccggaaggagcccaggaagcacggtttgcctcatttgatggatgacgaagctgtgccccaaaacatagcgtgacttacccaagatcctccagttaacaggttagctggaggcaagaacccatggcctctgcaatcagacaacgcctcatcctaagactgtgcagcctcacacaaggcttacagcaaaggaaaagaatccgcacataaggtcagggacaggtccgttcagttatgtgcctttatgcatctttggggcccctccctagatggccttaacccaacacttgtatgttagacaagagtggtaactgttgtatgtgtggtggggttaaaattatttttgtaaaactgaagcagacatttgttctgggagataagacacttgcattgcaatcttgactcctcctttatttaggatggggtgaatttgggcacgtgcttcccctctctgggcctccctccatacaacaaggggctggactagctaatgtgtcatgttctttccagctcttagaattactgatgcaattctatgatcaacaagtgaccaaccaactaaccaacatttacaaagaaattgctacttgtgtaatggtgaactaagacagcaaaactcaaggtatgtacctcagatgttattcatcgaaaaaaacaagggtgaccctggggtcaaataaatttggaaaccgtgagattgaacaacttttacaggagtttaactacaggcctttctgtcttctaatgcatctcagtctctgagatggaaaccccgcagggctgctttccatcgcccgccacgcccccgcccacccccaatcctccacagctctgtgaattccatcttccaaagcgcccccacgcccaccccccacccccaatcctccacagctctgtgaattccatcttccaaagcgccccacgcccccgcccacccccaatcctccacagctctgtgaattccatcttccaaagcgcccccacgcccaccccccacccccaatcctccacagctctgtgaattccatcttccaaagcgcccccacgcccaccccccacccccaatcctccacagctctgtgaattccatcttccaaagcgccattctcagcatgttggcccatcctcaccccagatatccagtgactgcagacttcttctgcattcgaaaccccaactgcctttctcatttttattcctagtattcctctttatgagccctgaaaatttcagcccagtaagttaaactagactcatcaccattccacagagaacttgttcttcccccaatcttctcatttaagttcatacatcctgcaaaaccacttaaaatgcctcctccatcaggctgtcctccttgattcctccagctgaaggtcatctcctcttcctctgaacatctatagaaacttatcactctggtgcttccctccctactttattttgtgctcctggaagcaggtggcatttaattcatttaataaacctgacagtgcagagcacaactgacctactgaatcaatgaggcaaggtgacagggtgggcagtttacagagctttaggatatgttaaagatcaaagatgttatagaataaggagtgtttaaagatctatttaaaaatataagaactcttacaacaattaaaaagataacaaaaaatagaaaaggatctaaataggcatttccgaagagaagatatgaaaatagccaataagcacatggaaagatgttgtattagtctgttctcacgttgctgataaagacatacccgagactgggtaatttataaagagaaagaggcttgatggattcatagttccacatgcctggggaggcctcacaatcacggaggaagccgaaaggcatgtcttacatgatgacagacgagagaatgagaatgagagaaaggggtgttcccttataaaaccatcagatcttgtgagacttactaccacgggtacagtatggggggaaaccgcccccacgattcagttatctcccaccaggtccctcccacaacacgtgggaattatgggagctacaattcaagatgagattgggtggggacactgccaaaccatatcagatgtccaacatcgtcagccatcaaggaaatgcgaatcaataccacaaagagataccactaacacctgttaggatggctatgatcaaaagacaatacaaaagtgttagcaaggatgtggagaagctggaacacgtgtacgctgctggtagaattgtaaagtggcattgagaggtgaggccagctggacttgtaggttgggtgaggacttagagaacttttctgtcttacaagaggattgtaaaatgcaccatcagcaccctgtagctaggattgtaaaatgcacccaatcagtgctctgtggctagctagaagtttgtaaaatgtgccaatcaacactctgtaaaaacacatcaatcagctctctgtgggtagctaaaggtttgtaaaatggaccaatcagcactctgtaaaatggaccaatgagcaggacataggcagggacaaataagggaataaaagctggccactccagccagcagcagcaacccactcaagtccccttccacgctgtggaagctttgttcctttgctcttcacaataaatcttgctgctgctcactctttgtgtccgtgccacctttaagagctgtaacactcaccgcgaaggtccccagcttcattcttgaagtcagcgagaccaagaacccaccagaaggaaccaactccggacacagcatggccatggtggaaaacagtctgacagctcctcaactgatgaaacacagagttaccacataacctagcaattctagtcctgggtacataaccaagagaaatgaaaacaatgtccacacaaaagcttgtacatgcatgttcatagcagcattattaaaatagctaaatagtggaaacaaccaaaatgtccatcaactaacagatgtaaaaaatgaaatatccatgatgtaatattatgcagctataaaaaggagtaagatactgattcatgccatgacacagatgaacctacaaaacagtatgctgagtgaaggaaagcagacacaaaaggccacctactgtctgattccacttctatgaaatgtcagaagagggaggctcacaggcagaaagcaggtgagtcggtgctgggggctgggagaagggggaatgggaggtgacagttcacgggtggcaggtttctttgggggaatgacaaaaaccttctaaaattgattgtgataaaagttgcataactctaaatatgctaaaaaccactgaagtgtattgtagactttaaatgggtgaattgtatagtatgtgaattatgtctcagtagaaatgttacctcttcctcctccaaaataagaatatatttataagcagtataaggctccaatatcattagattcttttttctctcaggcttttcacactaaactattaaacaattaagaacaggcatttgtgaatttccccagaaataaaaacaaaccttttgttattacagttacatctccctagaatattaaagtcagataatttttaaaacattatttattaagctaaaaaaagtcaaatcagtgaaacacttgaggtgacttaggctcttggattcatcagatcctataaagctgcagctcagcttttaatcagtgtgtcgagtgcctgtgacacactgaaggctgtgcaaagtactgtcacaaaaatacatgatgaaatgtatacagaccctgaccacaagggtgggaggcaaaagcacatacaccaaaaggaacttatcttgggagtgcaagaggcttttccctcttgttctaacatgtattcgaaatttcacaatggtctggcaattgaaaaaggagaaaagattatctttctttttcaagaataaacagaaggaagatttgagctgagtaaccccgtattttaagctttacaagttggcttaactacaactgtcagttttacttctttcaaattcccaatgacaactaaagaagttttattttttaaatgtatttggccttttacatgaagataattttatctaggcacacgttagaaaaatgcctagataaaatgaagaaaaatgccgaatatatacaaaattaactcctgtggttttttggcatggtggcaattctaacacatggatcaataatattccttcaaatttccccaaagaagataagcaaagattttggcctaagatttcacaagaatcagcatgtttatttcaatggcagagaagtttaacagagagaaatgaaaagagagaatcacctcgctttatgctgtgctataatatgattttgacaaaatatcacaagaaaattctgctttcaaagtcaaaatagaaagaggggaggagaacagggaggaaccgtggaaaatgtaaccccactgtaatcctgtcattaccatatctcaaagattctaagactatttcctacattttaatattgctaagactgaagtttatcttacaaataattggcatatattaacagccaagattgcttctttttcagtggtacataaaataatgattcacacagaacctaactccagaggcttcaaaacagcactggtctcttcaacctccatttttttttggagacggagtctcactctgtcgcccagactggagtgcagtggcgagatcttggctcactgcaacctctgcctcctgggttcaagtgattctcctgcgtcagcctcccgagtgtagccgggactacaagtgctcgccaccatgcctggctaatttttctcaaattttttagtagagatggggttttaccatgttggccagggtagtctagaactcctgatctcaagttatctacccaccttggcctcccaaagtgctgggattacaggcctgagccaccgagcctggcctaacctctgtttctttactcacaaaattaagtggtttgattagatcatcttgacagcctccttttggctctaatggactacatcttccataagagatacatcttctaaagttaagtttccttttactgctcatcaagaaatactttccaaacttttacagaacacactttacatagtggtagaaaaagcagattcaacaaagcaatcaactaacaaaattttttgagattagctaattattagcatctcatgattaagggagatttcattaaaaaacaaggactcttctagttctcaaagttccagcaacattcatttattcgaatactacaagaaagttgtagccagctgaaacctggacaaatagaatctggttcaccaaatgcagattcgattttcatagaacagaacaatcaaggccatgaccttcaacacagagatggggcgagtgattgggtttcagggggattaatggactctcccagggataaggcggcgttagcaatgggaacccgggtctcggccacatggcccctcaccaactgtgcaggcccatcgccagactggggtgtgggctgcatgggaggcgatggcatggctctgagcaattaaccaaaataatggtatttatgggcattttctggagattagaccaacagcacagggtgaaatgagaatgtctttatggagaaggagagggtaaactacagtcaaatgtatcttgctgtaacttttaaggatagatttttgacaaagatctctatgccgtgccgaacagagagtttaagtccacaacttaaatctccgctgtgtctaaggctttacgttcagcccccctcccagcccctttatcatgtttgaacctaaatcaaagaagcaaaaccatagctcggtcggccaagccagccgcgctgcactgatgtgtctccttcaggctgaccacagcccatggcaaccgactgacatcatgtcctggcgagagggcaccctggtaagaggaccctgctcccagattccacgcccctctcacatctcaccctctcatcactgtgcagggcagaagcccccggcagccagggcttactcactttctttcaaataatacttctttgtctcacggtcgagcagctggggagaagacaccgtgaagtcaatctccttcaaattgttcaacttgtggctagccccattctggctcacttttttctttttttataggacgcccattgcaatgcgagccggcagataaaagccgtgacgtgctgtctgcccaagcgcaaggatcgcctgcaatcccccagcccttgggtggcaacacaaagcacctctcatactataatgctctgggcggccccaggctcagctctaatcgtgcagagcctgacctcgcctcgggggagccggctggactgggaagggctgtgcagggtccacaccctggactgggcttggtttgagcagctctactctttttgtttaagagcaaagatgagattgtgttgagagagtacagcctctatcttggactgctaataatatagataaggataacaacagcacaataaaactggtagaagtgaagcatatgccatcttcactagaatttcaaggaatctaaatcatttcatacacactatactttgtagaagccttcctgtatcttctatgagtgtgttttattttataagcgtattacaacatgatctattgttctgacttttcttaatgcagccctgtgagggaggcggggaagaagagctcccgccttgcagccggggaaactagtgtttcaagaattaagtgaatttctcaaggtcgcaaagctgattaatggaagcactggaagtagaaacctgggatttagactccccaacttccatcatctttctaggtgtgcaagatgcttcactggttgaggaaaataaatgggaggaagacagttgaggagggaggaaggcggagaagagagggggagggggcgggaggaaggggagcttattggctgaaccatgcccacccctggaattaacacgttaaagtcccaaaccccagtactgcagagaacatggctgtatttgaagacagagactttaaagaggtaattaaggtgaaatgaggtcattaatccaatctgactgttgtccctataacaagagattagggcaaagacacattgcagaaaggccaccatgcgaggatatgggagaagagaaggcggccatctgcaagccaaggagagagcctgccggagaaataagcccgctgagtctttgatctcagacttccagcctccaggaccaatgagttaatacatttctgttgtttaaaccacccagtctgcggaattttcttctggcagccccaggaaactaatccagagaggaaagaagagaggacgggactgaaacctggttctgacaccaaagatgaacagctgcaactgtcccatctgtctgacctaacatagtgggactgagatgaaagcaactgaacgtacagatgccgcttccagaccagaaccacctgagcacaggaggaaacaaacacatggactggcaagggaggagaatgggtttcctggctgggcactgggcaagtggacagctgcggcctgcccctctgacttggtgatcatctgccctgcactagccagaggaacctcgacctcccaggaattcttctgcttgcctgtaagagaggaggactaggtttgtgttcacaaaccaggctggggcctcctttggatggggaggcagtgggtctgaggtgggacctgctcccagacatgtcgtactgatgatactggtgcaggagggatggtgtctgctggcgcctctggttttaagtattaatagctataattttacaggggctgaagggaaaaagataaaagaatgccaaagaaattatgtctataattctcaacatctattgtgaatatacactagttttttaatgaactgcagttactctgaataccaaaaagcactaaaaatactttaaattaaaacttgttatcacatccacacattgttattcatttaattaggaagttctatactgcttaaaatcattttattatcttcagggctaatagaagtccctgctgtctcatttaccctgttggatttagtttacaactgaactgtatcttgatagactatgtaacactgcaacctccgtggaattgagtaagtggggtcaaactaatgtcttactatacatatcattttggcttgaagaaaactcaggtatgtaacacaacacaaacagcctgaagatcatcagatctaggtttgaggttgggttttagctttgtaaatcataagattcaaaaagatcaaacacaaaacaaacaaaaaagaatgaacactcatccacttccctggtttcccgatgcagatttagtaacgacacctaccttctattcttggtcctccattccctagactctggctctcaggtagcctcagaggcctctgagtaaactaggaaagtgcagtccccgcttagagtgcgagctccgctgtggctgtgctcgtgcaggctaaggactggcatctgcctattagaacagtggtccaaagggtcacatgcactgacatggccctgacacatcaccggtgaaccccaaggagacaaagccagctcagaacctttaacaccaagtgcacagtcctccttaatggaaaaggctcttaaagcctggcagaaattctgcactatatttacttgcaaatctacttttgtaacattttactgttaatgaggaggaggagagttatgaaagtaaattgttagcagatggtattggaatcaggcactttgctgggggctcaatttcctccctggtagagcttataaatgtttagaaggagtagctggatgagggtaagcaaaaaaaaaaagaggcttgttcaaacctcttcagcagttgagccaagcctccggagggaccctggttgccacgaaacagagggattaagctggtaatggtatgatctcttcaaaatgtaagtgttttggtaaaaatactcaaaaaacttctgtctgcaagccctgtaccatgtgacaggttaagcaccgaaggtcatatgctaccatctgcattttcaagacattctttaattggagggagttccagagggtacgactgccacaggccctgagatggttgagtcctggaatcaggcactgatcactagagggggaaaaaagagacacagtcttgcaagtgcagagagagaacagaaaactaaactttccctcttctgatctcccgtaacactccgagcctctagaatggccctgcccacaggctgcctaatggaagaattcaccacgtgctgctcttctctgtaatacctcgcacgtggtcccgggtactgttctgggaggcacggagcagctcattcatttctgtatccctggccactctaccagtgacagagaaacatagtagaaagtgggctgtggagtcagaaaaatgtatgatcttagcagtctcttcatctctcttgagcctctatccaactaccgtgagggatttctatgcgaatcaatgagaattcatataaaggtcccagcccagaacaggcaatttatttattacactgtttgttggattccatctgttggtgcaattcccatttgaaggataagatggctgaacaaagggaacctctaactgtccttctcgctactcatgacaggcccccgcctcgaatacagtcagccactagccgatggaaggggtcaggagacacagtacccaagagcctgggtgagtgggtgctccgaatctgctccaccaggagccggcgacgtcatctcagagcagctgcctgactttctatgactgtttccacatgtgtgaaaatggtagtgtgaacccacacacaggctcagagcgatacccggcacggtgccgcctcctccccacacacactctggacttacaggctttcttccatgcacgtttctccctccctagaatgtgttcagaagccctctctgccaatgcatactcatctgcactttcaaaacccgacttgagtgcctcttgtcagcctcagccccaagagcaccccttttggtgccatctacctgggctgagctgcctggcagcgtcccttgtgacgtgctgctggctccaactcaaaaactactcatttctcagcaacaccattgtgtgctaccgccaaacaggcgatcttgctctctgcagtaggttccagtccagaccctgaggagtaagatggtggtcccggaaaccagttcaaatttctcactggcatacagagtgctgaaggaaggctgtgtataggccccccgattctgatcgtgaaatctcattatcagttccaagccccccacggagctgcagtgggcaggtagctgggacgagacacattcccaagtcagatatctcagccagccatccaggtttcccacggaaattcattaactcactgtattccttactattgctaaatatgctggtttcagaagccacagagtgaattttccaaggattaaaataggacacgaagttcaaagatgtctcagtcctgacacagtggaagcagcattagggacttgggcacgcacaccattcgagagcctgacaaccctgaagacaagtaaagcgagtaacttaaagtcagcttcagtcaaccttactgctgaaacagctacatgcccaagtaaatcattttaatttttccaacttttaatttcaaaaaattttaaagctacccaaaaagttgaatgagaacaagaacatcccattctctttaccttgattcacctatcataagcatttttgtcagtttgttttagctacatgcatacacgttttcttgctgtgatttttgaaagtattaataagtgggagacatcttatttcacccataaatacttaagaacagggacattctccttcagagccacaataccattatcatacccaacaaagttaaagttgacgtattgtcattatctaatatccagttcacattccaacttcccgaactgacctgtctcttttttggtggcagggagggttgggggaggacttcattaattaagggtcatatgctgctcagtgaagttgtcatgtttctttaatctcctttcatctaaaggaattcttttctctttcgtgacactgatgtttttaaataatgcagaccaatgagctgtccctacaaattttggtggcctaatcatttctttatgattagatctgagttaaatctttttggcaagaatactacccaggtgatactgtgtgctcccaccgcactgcaccacaccggaaggacctggcgccagcccatcccatcactggggaagcagagcctgcagtacacacagattgctccttgctctgttagaaacaagtaagctcctcccttttgtagtaatagtttgggggtgtgaatcctgtcattgtcactcaatcacatactcatttttttgtttgggttctgtttttctattatttttatttcccatactcatttattacacacctttaatttgcagtttgagagtgcagagctaagctggattaaagacagggtccccagatacaattcagcacaagtccaactggggacacattttcatacaaaacacattgaaagaaagacagacaatacaatcaggagtagcttatactctgcctggaataaagcaggtgcttagcaaatatttgttgaataagggacctgtatggttcaggcaaataaaagctattaggccaatctgcatcctttccattcttccttctcacatcacctcacccctggggctgaaaggaagtcttcgaacgtggccaccctgcctcccaccacgagagatcaggatccctgactgattggattgccggagtaaaggctcaactgcctcaacctgatcagcccatctcaccctctctctccagccttacccatctctctttctcttccctcccccgcccctcagactccactgctcctgaggtgtggtctgcacacgcaggggatgcctcccacctcccctcccacctgcctggaacagtccctcactttcaggtctggtctagagtgcaagcctcaccttcttcaagctcttcctcagcaagtaagtgttccttggtcttcagtgtctgaaaacatttacaagcatcctgcgttatggctcttaatcctatcgcctaacggtggtactatttacaaacattttcacatggctaggaagccttcaggccacttcctagacccagctcattccctagggcctcctttcctttcctagagcaggctccagggataagccctgtccttgtcctttgctatgtcctttcataaaagctgccacccatgctctcttattgagacagtcctcatcccaaaacgatagtgaagtgggacttgtgtccctgccacatcaccccaaaaactgacacatggacatggaacctttatttaaaaggctaattgttgaatccagtcctgtctaaagaatgtatacaatttaggactggcagaaaaaaaatcagaggatgtggttcagtgaaaggcattgttgtgcctgggatgtttgtaggactactccaggaactaaggaaaacacacagatgtttgagatctggtctttgcctcgaaaattttagttctagtgggagtgataagttatggagataaagaactgtaaggatggaacattataaatgccaaaataaatcagatgctcttgaaatgggtgaattgcatggtatattagttatatctcaataaagctgttacccccaaagagcttctggttatgtaggttaatctactgacatttatcatagtaggaattaaaatggggaagttttaaaatattaattaatttgaaataaaaaataaaaagagatgcactttttatttttttaaaaaaagagagcgatgccacacacattttatatgagggagacaataattctaactctaacaggagtgggatttgaaaaacaggcaggatttggacacttagaaatgatgggtatgagcattccaggcaggtacaagagtatgaggcaaggcagagagcaggaatgatgccatctttgtgcgagagcaatgggactagaacaacgggtttgtttccttagacttaaggctggatacagagaggtgggtcagataataaagggctctgaacacaggtgaacggctgagacctgacgaggcgggtcactgacagggagccactgtaagcactgacacagctacagggaggcttccgtgaggggtgctccaacacaccatgccagatgggtgcacacacctgagtcagggaacagggcagggacgcaagcgttacgtgaggaagcttcaacaatgttcctatcagtgaggatggagaagaggcaggttgaagacacattttaaggaaagatcagagagctggtattccagctagtattatacattgacctgatctttccgaaacaggccaccctcagcttcttcctaataactctctcaatgttgacccttccttcgtataaattgagaaactatgagatgaacaagccaggaagctacacttgttccctagcttatcaatatgtaacaaggaagagtgagttagtgctagaactccatattttaagttccacaggttgatctaacaaagtctaattaacctctcatatttacatttcaatcactgtcaggtgacgtttttatgtactaataagattccatttttattcttgaagaaaactgtcagtatactcattttctttaaacaatttagatgtccactgtttgatggcaggggttgtgctaagagcttccatttatccatgattaatcaacatttattcaacagacatttcctaaaatctgagttgtgaagaacatcaaacaaatcaaataataatgcatacttatagagggaaaaatctgaataccgatgtttaaaaactgactccaatgaaatctacctatattaaaataaaccaattctaaaaaatcatcatccttcattagattggtgtcaggctaatatacagatatgttgggtttttcacagtatatggtatattctggagtgcttttacagataaattttactcaataattatagtttatgtaagctattattacaagatgtctgtattatccaataaaaaaactaagaggctattagaactgaagtcaaaagtatgtgactagcttgagaaagtattaaaatatttattggagagttactggagagtcaaacagctaatttcatacatgggtaagtaattaaataccaaaatgtatttatttcttaagaaaaatggcttaataatggtgttcagcataaccaaagaataggtaaatctgtaaagctgctttttaaaggtgcaattgcagacttattccacagattttaatgttaatgggaaatcgtaagatccttatgcaaaaattatacacaatcaaggacttttgtttccttaccaagctccaagaaaagagactattaaataataaagtaaaaaagtcatagaatttaacctgaaaacaaatattccattagcatgtaaaatttaatgtgtttcctaaacaaaatcatccccatgatgccaagaagttttctactggagtgtgaaggtgaaggaggtttccccaaattaatcaacctaaaatattgggggatggggatgttgcttacttttcatttctatttctttctatcctcccacctctctctctttttacatttacattacccagtgagcaaattttatcaatgagaagccaggaagggctgactccctttggtatatttacttaagatataaaggccaatcaaccattgtgctcagaaaagttgtggccgtttctgggcctacttcagatctctccttagctccaagtgacttattatgaagccaaagaaagaggaaaactgagctgatcaaaggccaggctgtcattaagtgaaaatgatggaagatgaaaggcttgccctgcacttcaaaggtacagctgagctcgggtgagctgacagcaagcgatcagggatcagagaggcaggcggtagcttaatggactagatgacattcctagagccattcatctttataccaatcacgaaaaatagaaacataacgacaaacatgcatttaaatgctttcctactggatataaagaagagtgggtaacccaaaaatataaagtgacatacatcacatctacacttacagaatataaaataatgaggtccaagaactgttgaagaagttggcatctctaagcagtgcagaattacatgttaacagtttttccttatgccctagggtgtgtaatgcaatgaagcttaattttgagagaccatggatgcagcagtctcacttccctggtgggctaacgcagaacacttggtgtgttgacgcggaagggcggtcaaacttgcttaagattttggggttagagctggtctagagccaccatagggctggggaaggaaggttggaaaaatcaggccgattgatgattacacaatattccccttattccaccccattcacccctgtacagtgccctcccacccatacacagaacctcagcagacagaggcccctctaggcagcaaagatgttacattgtaagaggcctcaaggcattaactcgagtctcctttcttttctttttcctctgtaggaaccaacatgcatctaatcttctaagactccctagaatgactttaatacaatggaacaatattatctgtacttctggtcacactggagacttttcagggaattgactgggtttctcctccctatagtttattgttagtggtggcagcacctgcaaagagcagagaaaaagaggagagagtgccaccccccggcaaattagtaatcaggatgttgggtactgagaagagatgctctagaagctttatatatgtgaattcatttcgtactcctatttacctgtgaagtaggcactatcattagtttcattttcaggaggaaatggtcaccaaaagtggctcagcaacttgcccaaggtcacagctagaaataggaaagactggatttacacccaaaggtctggccccagggactatgtttccaactcctataccactcggagaggtttcacagagcagatggtgaagggtcagcaggagtggcccagtgaacaaaatcctgcaaggtcggcacagcctgagggggcaacagcacagcacccctgagccagcagggtgagggcaagggtgaagagcagcaaaaggtgccggagggcagggtgagccttggtcatccaaaggcgttagcaccccagggccgctaaagtaaacattgatcatacgtaaaacctttgcttgcacctcttccaatcagacctgccactaccaaaactctccttctctatggaaattccagagctaccttttctactgagccacgctaaataaagagctgggacttacttcgcggaaaatttgggagccaatgacaacattcaggctggacaacaataaattcacaactccccttggccatctctgtcctgggcccttgctgaccggctccacctggaattccatcccctccttccctctcacccccaggacccgaccgtcccaccctgtgtgcacatatcatgctctgtaaagatcatctgaatgtacacgtaggatgtcagtttgcttcttgtaagatagctagtactgattataaagaaaacaacaattccagattgtcagctcctcaagaagggccctgggtggggtgtccagagagcagcagtgaatgccccttaccaccagacacaaagcctggcactcaggtgttctctgaatgaccgataggtgccattagtaagatttataattgagctaatactttgcacaatattttaatgtaagcaaatgcacacacacaaagaactttgcaaagaatggaatgaatggagcaacaatattctccacattaagtctccaacttttataatagctttattgacatataattcacatgccatataattcacccattaaagtgtctgactcaatgtgtttataattgtggggctgtgcaacaatcaccatgatctaattttaggacatttcttcaccccgaaaagaaacccatacccattagcagtcactccccatattctcctctctccaatgcctagcaaccactaacctactttctgtctctatagacttgccgattccagacatctcatataaactcaatcatataatgatttggtgtcttttgtgtctggttctttcactcataatgttttaaaagttcatccatgttgtaacgtatgtcagtactatatttcttcatattgccaaataatatttcatcgtatggagaaaccgcattttatccattcatcagctgatgggtatttggattgcttctactttttggctattataaataatacttctatggacatttgtggacagatttttacagggatgttttcaattctccagtatgtacctaggagtagaattgctgggtcaaatggtaactctatgtttaacatttcgagcaactgcaaaactgtttccaaaacagctacaccattttacattcccaccagcaacgtatgaggcattccaatttctccacatcctcaccaacacttgttattgtcttttttatttcaaccatccatagtaggcagacctcactgtggttttgattttcattttcctaatgatgttgagcatatttttctgcaattcttggccatttatcttctttggagaattgtctattcaaatcctttgcccatttttaaataagattatctgcctttgtactgttgagatgtaagagttctatacatctcaatacaggtcccttctcagacacatgatttataaaaatattttcccattctatgagttgtcttttccttcaaatctattattatagttacctacagccttcagaggtaccaacaagaaacctttacaaaaacctaaccttcatcttacatcttttacaaagcttacgaatttgattacaaatgttcttctaaatgccattatcttcccatccggtttcttgataagccagcctatgctgaagccccagccattgctagatacccaccaccgatagctgggtagcaaactcctggataataaataacagtgatatttaccactgacattctggcatttcagaaattcaatctgtcttcccaatgccttattttaatggtttttacaaaaaaaaaaaaatcatactattactagatggcagaacctaatgtgtgtttggccagcctattttctttaaagccatgctgacaatgattgttaaaactgctcccatgctagaatgctcctcaattgtttccgtcttgacacaaggtcaatggggactagagtaatgaagaaataaagcaaaactgaaacattttaatttggggtctacaagactatattaacttctagcaaattaaatggatgagtggtttgcagccactgacatttatatttcacgattagttctctaggccccttattctctctgcgccattaacctttagggtgtagctctttgtcagtctcacttcaattatgctttcgagggattatagaattagcaattccagttttgatggcacgagctctgtcaaatcagagagacagatgtgagctcatgtaactgagaggcttccatctgttggactgagaactgaaacctggaaaggctcttgtatttcctttcttacgcttccttgggctgttccagcttggaattacccatttacttacatacttggtatttgagcaaatatcttaaatagctgaggtagcaacctttcttgccaaaggtggatggctactcaccatccaccttttagttatggattccaatgctggtgacagaggagaaagtgatgtcacctcatacatatccaaatcctagcatccacaggaacccacacagaatcaaagcccctcactaagttaacaggtcatccactgggatcacatcaaggctctgtcgactggctggaaggaacagaaggaagagcccatggaacagaagcagcaaaggattttattttcagcagagtgaaaattaggtgttgtatactaaagagaaattagtcatcctttggtatatatactcaggggattggttccaggaatcccaccaatggcaaaatccacacatacccaagtctcaaagtccactctgcagagcccgcttataggagaagctgggcctctacacacatgggtttcacatcctgcaatattttctgtctgcaattggttgaaaaaaaatcctgagtcgaagtggaccctcgaagttcagatggtattgttcaagggtcagctgtgtattctttctgtcagggttttctgtaagttgggaatgctgaaaatttctacaactgtctaggtctaactgtctgcaggtgacaaatgtatttctgaaaattagatagtaaattaaacctgatcgtgatttaaaggctctgctgagctcatatgtaaagcaaaagtggttctcagtttaatttcaccaatctgtgaaaattttctttttttttttttgagtcaggatctctgtcacctaggttggagtgcagtggtgccatcataattcattgcagcctcaacctcccaggctcaagtgatcctcccacctcaacctcccgagcagctgggactacaagtgccctccaccacgcttggttaattttttgtattttttgtagagatggggttttaccatgttgcccaggctggtctcgaactcctgggctcaagtgatcctcccacctctgtctcccaaagtgctgggattacaggcatgagccacagcaccggggcaaattttccttattgtttttcatccagccactcctatttcatgtctagtacaatgctttccaaagtgagttcctggatgacctacgtcagaatcacctaaaagacttatttaaaacacatattcctaggtctggctccagtcctaataaaaagttgtccagggacccccacgatatgtcattttagcgtgccccaagaggtgtctcttctcatgcctcttccactttcacaactgatcaataccaagatcagccaacaccacatcagacatttctaaggacgtgtcagcagtgacgtggcacatgggagaactgatgatgtatctcagtactcacatccactcaggaaatgcctgatgaacgagtttcagaaagcaagatttaggccgtcctggttacctcctgccagcactaacacgtgaaacagctcaagaccagctttaggagggctcacctctattttcaaataatgacgtctttctctaattttttttttaatgtttgcctcttgagagatcagggacttcattaagtaaccctcccatgcctcagtttccccatatggaaaatagctatactatctgctgccttctattcctataaggcatacagtcatatacttcctatttgtcttttgcacaacaaaacaactcattccccaaaagctttgaattaggcttgcaaacatagtccttaactaccaaactgtaaatttctcaaagtctagaaaaatgagaggggcaaggaaagaaacaaaaagaaacttaggcttaactgtaccagctagtctcaacttgatccgaaggaacactgctagcattctctcagctagcttctcacgattacatttaaaaccaccacaaagccaccacgatcacgctctgagaggccgccgcaggtaaacagagggatagggtaggaacagcccagcataactgacaatgctctttaggggatctgcagatctgccttctcaaacatctcatttcacttcatgaatatttacaaaatatttgcaaaagaagaactaaggcaatgaacatgtccagaaagaaccacatgctaacttctaaaggtttctctctccaaaaattcagtagtgccagaggcctgttcttttgtcccaggttgtttttcaagtgctacctcatgacagaatggatcactcataataactagatgttagcatctgtgtcacataattcatctctggcagtccacttcttttaaatcctaatagtaggcctcctaaataggattgctagcatttggcatctcatttgcctctatgacaacaaaactctagaagacgtagtttataatacattatggtttcagctgaatgacatttggttctaaggtctttgaaagtacaagtttgaaaatgccaaattttatctatatccatatctatagctccatctgaaattagacagattaccaaacagaaaatgtcactcagattctaaaaataaaccatgctattgctccagacaggttacaccagagggttaggaccatgacattttgctggggttcaagtgcaaatcagcaaacaaaatggcatgtttttctcttcctttttcacagctaaagattagtgaaggcagcattgtagtctgtgtaactgctcaacccaacctttatccaggagctagtattgcttctttaaaaacattttttttttttgtaaataaaatgtggtacagccatacaaggaactactactcagcaataaaaaggaatgaagtaacaaaagaccaaatattgtattattccatttatatgaaatgcccagaataagcagatctatatagacagaaagtagatctgtggctgccagggaccagcaggacgggggaatggagagtgaaacgggtcaaggtttcttccgggagtgatgaaaatgttctaaactttgatcccagtgataactgtacaactctgtgaatatattaaataccattaaattgtataatttaaacgaatgaatggcatggtgtacgaattatatctcagcaaagctgttaaaaatcttaacttaaagaaactatcatcttttaaaagctatagcagaaagagagccagcactggagagagtaaatatggtggcttttcacctttccaagaatctcaatgagccctgggcattgcaaaaattagtcaagcaactgtcacaactgcagtggtaaccaaatacggaagctgaatcaaatacggaaaggaaattcttttgaactcaaagacacaacctttccaaaaaaatacactgcaagcacacaaacagaccacacaaagtcaaaacaaaacaagtacctgtgtgggtggaaatgtatccaagtgccactcttttcttcaagtctttcattctcctcttattacttcaaagataagccctggatgggcaggaactaagttgttttggttttttctcatgacacaaaagatctggcagagctggagatttcattaccttgaaaggcagtaatatttgaaggtaccatgactattccctgaacagtgctctaaacacattgtggtggctaagagctatggttatcccacctcttcaatgagaatggggcattcattctacagaaagccacttacagacaaaatgggtatcacatcatccataaaatgaagtaaagaacagttggctgaaacttcccaaacagcccgttactccatgtgatataaatgggtttgcaaagctcaacaaaggaagacaagcactaggaaggcaaagccagtcttcctagcatgataaccaaaagtgtctcagccctctaaagagctctaggatctcaaatcatgtgcacaatacagagaagtgctaatggtggaagggatgcacaagagatggtagatgtcttgccctcaaggaattcatattttagatagggtggctgggggtgggggtggggggcagtgaaactggattattttttggcaaacatgcaaacgagtgttatcacttaaatgtagtcatactagaatgacttgaccctattccaaataaaattgccactgattaaaagacacttgcaaactccacttgtggaactggcttcagaatgacagagaaaaaactagctcttcactttataggcatacttatgtataagtatggcaaggagtaagcactgtgtttgttttatacacacacacacacacacacacacacacactctctctctctctctctctgtcggtttttaaattactggccactggtgagaaaaccatcaatgtgtccaggcgcagtggctcacatctgtaatcccagcactttgggaggccgaggcagttggatcatctaaggtcaggagttcgagaccagcctggccaacatggtgaaaccccgtctctactaaaaaaaaagaaaaattagctgggcgtgggttagccgggcgtggtggcaggcgcctgtaatcccagctacccaggaggctgagggaagtgaatcgcttgaacccaggaggcagaggttccagtgagccaagatcgtgccattgcactccagcctgagtgacaagagtgaaacttcatctcaaaaaaaaaaaaaaaaaaaaaaatcaatgttctgagaataagatcatcgcagtattacgttaaatgtgtaattttccaaggtaactattacttatttagatgtgtaggttgttacatttgtttgcttttcatcagtcacatttacattaaagacaataaaatacaaagtgatataactgccaaatgtatattacagactataaactcaacagaaattcaaaagaggatgatataaacatatcacacattgaaagaggacaaagcatcttgctaggcactgacattttaaaaggttaaagtacaaaagttactttagataggaggaataaattctgctgctctagtgcataggaggattactatggttaacagtaaaagattgcatattctaaaatagctacatgagaggcttctgaaggccctcacaacaaataaatgataaggtaatgaatacaagaactacactgactggatcattatacaacataaatatgtattaaaacatcaaattggcccagcatggtggctcatgcctataatcccagcactttgggaggccaaggtgggcagatcacctgagttcgggaattcgagaccagcctgaccaacatggagaaaccccatctctactaaaaatacaaaattagccaagcatggtggtgcatgcctgtgattccagctacttgggaggctgaagcaggagaatggcttgaacccgggaggcagaggttgcggtaaaccgagatcgtgccattgcaagccagcctgggcaacaagagtgaaactccgtctcaaaaaacaaaaaaaaaaaagaaaagaaacatcgaattgtaccctaaaaatagatacaatgtgttgactaaaaaataaaatttatcaaaaaaagtttaaatgttttcccaaatatgaaaaattaataagcatttaaaaattaatcaatctcggccgggcgcggtggctcacgcctgtaatcccagcactttgggaggccaaggcgggcggatcacgaggtcaggagattgagaccatcctagctaacacggtgaaaccccgtctctactaaaaatacaaacatttagccgggcgtggtggcgggcgcctgtaatcccagctattctggaggctgaggcagaagaatggtgtgaacacgggaggcagagcttgcagtgagcagagatcgcaccacttcactccagcctgagtgacagagcgagactctgtctcaaacaaaaacaaaaacaaaaaaatcaatctcactgctaataactttaaatttaaatatgagatactactttggaccaaacaattgccaaagattttggggaaagcatgctgattagcatgcagtaaaataggcacttccataatctattaagacctttcaaatataggaaatatccttaatgaccaactacagagaggtgtttgcataaatgatgccatagctataggaaaaataagtagacattaatgattttttgtagaatttcaaaaccaaagccaattttcacaatactgaatgaaataaaattcagaatataaaattttaaacacactatgattttggttgtgttaaattatatacactcaggagaaaagactgaaatcaatagtgcaatatggttgtttctggggtgtagccaatcttttcctattctttatacatgcctgtgtttttaaaagattctacaattctctatatttctttggtattcaaaaataaaagcagacaataagaagaaatattcttcccaaaacatgtagattgaaaaaaaaaaaaggttaaggtccaattcctgcctataagatcttccaggtaaaatttcataaaacgaggttgggccacaccttgaaagatacatagaatccacatagctggggctggaactgggggctcacacctgtaatcccagcactttgggaggcagaggcaggtggatcacctgaggtcaggagttcaagaccagcctggccaacacagtgaaactaaaaacacataaaattagccagttgtggtggcaagcgcctgtaatcccacctactcgggaggctgaggtaggagaatcacttgaacccgggaggcagaggcggaggttgcagtgagatgagatcgctgcactccagcctgggctacagagcgagacgggtctcaaaaaaaaaaaaaaaaaaaaagaatccacgtagctggaaaggagtagaaagggcattccaaatgggagaaaaaactcaaagaatctaaagagggaatagttggcaaaccagaagataaatcaaattggagttacgagagcttaatccttgagctttattttaacaggccagtggttggatgaatcactaccaaataagaaataaagcaaagctatactaagctaaaggaaagtgttctcaaaaaagagtcttctgtgccacgttggtgttttttcacatccctctatctggctgcctgctggtttccatggcttagatttacccatttggaaaaacaacccctcccctgacaataccaaaatcactacctctgccatgaaattaggcaagaaatatacatactccagcctctaatttagacaataaacttgccaaaagtacggaatatatctttttttcacatagtaccaatcaacagtgtcataataggcattccaataagtaatgaattacaagttaacaatgagcaacaccttaatattgtccataaatccccaccagaactgaaattttacaagttggcaatatcaattattggtaaagatttagagttcctggccgggcgtggtggctcacacctgtaaccccagcactttgggaggccgaggcaggtggatcacctgaggtcaggacttcgaaaccagcctgtccaacatggtgtgaccctggctctactaaacacacaaaaaattagatgggcgtggtggcgggcgcctgtaatcccagctactggggagggtgagagaggagaatcacttgaacccaggaggcggaggttgcagtgagccaagatcacgccactacactccagcctggacaacaagagtgaaactccgtctcaaaaataaaaaataaaaaaataaataaagatgtagagttcctgaaatgcttatacactgctggtagaagagtaagatgctataaccactttggaaaacagttgtgcagttgcttaaaaagttaaacgtacccaataatccggcaattctactaagtatttacccaaaagaaatgaccacatatgtccacaaaaagcttgcataaaaatgttcgaacactgtacaacaaagtgtacctcttaaaatggttaaaataatacgttttatgttatatatatacttggccacagaataaacaattctgagcaagttcattcattatagttgaaaaccggaaacttaaaacatcatccatcaagtttagaagagatgagcaaattgtggtatacgcataagacgacaatgccaaagaacaaactactccaggagcatgcatgaatctcagaaacactacgttaggcacaagaagctggatccaaattactttatacgacgttcaagaccaggccaacctaatatataactgcagaagccaaaacagtggttctctttgggggatgtgcgtactgactggtaaggaagctcgaggaggctcaggggcgatgagaatgctctccctcttgatctgggtagtcagccccaatcaaaaagactattaacaataaatacagaataatggaggccaaagtttagacagcccaaggccaaccactcataaccaaaacttaagtcatcctgatttccccaaacactaaacctaaatataaaagaaacacaaatctgagttttttgtccttatcagcagataaggacaaaaataaggtttgataaggatcaaacccatcaactaacaacaaatcagcttaaacagctgtctgccttaaggatctatacatgacagccattcatgaaaaaggtcaggtcattcctcctttatgctctaaactgcaccgtaactgctataaagtaagactgtgacatttttgggtttgaggtctcccagtccatgaactctcctcttgtatgtatgagaaacacttaaaattctaacttgatctaattttatgtttgacaaaacatggggggaaaaatttacaaagctatacccttaggagttcatcataattaattatgcctcaataaaaataaaggaagaaagaaaacagaacaagtggaaaatcccagtccattatcccaattaagccccaggtttgcattttatctagccctcacgaagtactccactatcatgaggtcagagctcatcatcagaaatccccctcggagtgctgtagtgtctgtcctattcaaggcagcgttaggtctgaccacagtattttcagaacatacaactaatccatcaatttcttaagccttttaaaattcactgaacttggccgtgcgcagtggctcacacctgtcatcccagcactttgggcaggcagatcgcctgaggtcaggagttcaattccagcccagacaacacagtaaaaccctgccttactaaaaatacaaaaattagccgtgtgtaatggcacgcacctgtagtcccagctacttgggaggctgaggcgggagaatggcttgaacccaggaggcagaggttgcaatgagctgagatcgtgccactgcactccagcctgggtgacagagcaacactctgtctcaaaaataaaaaaaaaataaaataaaattcactgaatttaaaagttctacatatatttcattcctattaagacccaagacgaaccatttcatctttctttttaaaaaaggctaataatgcttcaataaatgctagttcccagtatagtgacagatacaatggagtgaggcagtctgactctggccatagttaacagatcaaggaaaaaaatcccacactcctaagattccaaagaaattttctgcaagtttccttaatgtactttaaaatccttcagaagaccatggggaaaataaatcatcctctcaaattcatattctgaagtttgaaaataaaagcagttccttttcatgtttggatatagtcactctgaacagtaaatcagctaacagacatcaacctggcataagactcttcataacctgtaattatcttctttatttccctgttgctcatctgtctcccctgctagaacatacactccataaagtcagggatcttgctgtctgttttgctagcagccatatccccagcacataaaacagttcctggcacataatgggtattaaatattttcccatcagtgatcagttcgtttagcagactgtccaaagtcaagtaactagaaagcaagacgaacaagggcagctatctgtaatcaagcagccaacttcaaatgttttcctacagaagctaagtcctaaagagtttttcttctctctcttcccctcttattaatattcctccttttcccagctatctttcctgcctctaagaacagtattctaagaattaagaaactcacttgtatcaccaactcgctgagtatccttgggctagtcaggcaatttcaatgcttatctttagtcaaaagacactggagtcattcataaggagacaacacttgcctggtgtgaagaacgagtagctgcaagacaaaatcctagccctcccagaaattagagtaagccagacagaggagggaggtaacacagcgagataaattccatggcagaagtatgcacagcatgccatgaaaatacaaacacctaatccctccaagaaggcagaggagggccaggagcggtggctcacacctgtaatcccagcactttgggaggccaaggcgggcaagatcacgaggtcaagagatcaagaccatcctggccaacactgtgaaaccccgtctctactaaaaatacaaaaaaattagctgggtgtggtggcacgcacctgtagtcccagctactcaggaggctgaggcagaagaatcgcttgaacctggaaggcggaggttgcagtgagccgagatcgcaccactgcactccagcctggcgacagagcaagacaccgtctcaaaaaaacaaaaaaaagatgaagaaaagaaggcagaggagaggagggtcactttccagaagaagcccttgcccttgagggactaataggagccacgagaaaggaacagggagatttcagatagaggcaaaagggcttactcacaggaagcagtttcacgttatgtggactgcagggtgtgagcgaacatggaaagtaaggctgaagaggtaagccggaatgatattctggtaatattacagatgtaaacctagaagaagatgagattagaggcagggagcagtttagagattattttagcaattaacaggaaaattaatggagacctcgtaagagaggagttcccaggacctcttcaacctattccaccctttgccccaggtgaccacgctcactcaaagcttcaagtattctctatccaagtatctccagcagcagcctctcctgagctctagaaccatatacccaactttctattatttatctcttcttcgaaatctcagagcctttaaactcaacgcagccgaagctaagcctatgagctcaccccagaacctagtcctcttcctgtgtttcctgtctctgcagatggcagcaccacccatccgcttgtaggagctggaaacctgggaggcacccttagtgtctcctacgtcctctccctcatccgctgttcaatccatcaccaatccctgccaggctcctcccctaaggatctcatacgtctatccactgctttcctctgtggccaccgtcagaatttgccttacccctatctcttgcctaagccagtgcaccaggttcacatcctctcctattactatttcatctcttattcccttccagtccattctcaaactgtgacaaaagtttgtttttagtgctcatcagcctgcgtcacccttttatgcccgcctactcaccccgaggagctccatcaagcccctcttcactggtgttgctcaccatatgtgcaccagcaccttatttctgaaggaatgaggactcaggttttttttttttcttttgagaccgagtctcactctgttgcccaggccagagtgcggtgggatgatattggctcactgcaaccgccgcctcccaggttcaagtgattctcctgcctcaccctcccgagtatctgggatcgcgcaccagcatgcctggctaatttttatatttttagtagaggcggcgtttcaccacattggccaggcaggtctcaaactcctgagctcaagcaatctgcctgcctcagtctcccaaagtgctgggattacaggcgtgagcaaccgcccctggccaggactcagtatttgagcaaagggaggcaagaattttaagaatttgtaaaaagtcagtattgcatggcataaagagactaaggtaaagactaaaaaagactgaacttgccactaggatatcatttagtgaccgtgtctggaacaaattcaacagagttgtgggagcagaaatcagaggacagcagattaagagggaaagggcagaaagggagtagaggtgagctggccttcttccaataacgtggatggcaaggacgatacagtctaatggctggaacaaacacaagatttagggaagggtttgtttttgttttaaagttgggagagacttgtataggagcacatgatgaagggaaagaagcaggagaggaagaggagggtatcagaacagaaagagatctgtgagcaccaacagaacaatctgccttcatttcccctgaaggaaggaacatgaatggtgatgaattcagaagagcttgcaggcagggaagcaacatgtggttcttttattttctctaagatatagagcagattcttccagctccacaagaaggtcctctcccactcactctctctttattggacaaaatatagaaccaaatactgtatgcactgtatcaaacaccaagagcgcaatgcttgatgtccactgtgagttctggaactttaccttgttccctaccagtatcagccctcttttattggtatgaagcctctaatagaaaaaagcctcccagcctggtctccagaaactggtgttaactgctccgaattttgaattcagcagagctgtgctagaaaactgcacataaggtttatactgagaatgacagctattttccattccctttactttctagtcggtagaacttaaagcctggcacagctgctattacatattccttaaacagcgaaccagatcattctcgtgggtgattttaagcattagagaagaggtcataacttttcagcaggaaaataaaacaaaggttctttctggggtcagccaatagtttatcagtggctcatcagaaaaacaatagtttaaaaggacttgcgtagttaagaatggaagaacatgggtaaagaaaaaaactgctgacattaaaatagaattttaaattaatctcttgtcgcgttaatagtactgccatataatggaagatgcatttattttctaaggggaaaatgtccagaaacttgcactcatcactcccttaactgttatcagggaagaagtgtagagtctcccagctggattatgggtagtgtaaacatctttgctaaattgcttggcagagtacatctgcatcaaaccattagagtctggaattcactctattaaaatcaaatcattagccaagaagaattaacaggaaactattttcatgcaaaacagatataaaataaaaatcaagagcaatacatgagtaattctttttcattcacaattttagatggtgcataatgcagagtattgttttagaaacgtgctgctctctaacagccatctctatacaatatagggtattgtttggatactggagcaatttaagctttttctatgtatccaaaagtccctggattaagatccaaagaaacctggcacagcaacaaagttgacttgtaacacatctcagcctttaagcaaattgtttattaatgcagcaggaaagtcgctgttcaggccctaagtaagctatgtatctccggaagtgtcccccatgttgcattctccaaaactgtgcagaattttctcctagttttccattacaccaaggatggtgggagggcttcaacaggtgatgaagaatgtgaacaaaatactaactgaaaaaaaagttcttcccaaagtatcaccaactctgtttaataaacagtggagctacagatgaatgagaagggaagctgggacatatattatctgtatataatgtctgtatatcccacagccaagagttctcacactcaaagagacgctggcttcacatggagaaaacaacctctcaggatgtgtgcactactttaaaagatctcacaaaaaagatacaaaagaaggcatacaggcatctccctatacagggtaaaaaaaaaaaaaaagctagaatttgtttagaattagacacatggtagtaaaggtataaagaaaagcaagttacaactgtggtgaactcttggggctgggagggatctgatcaaaagataatacctggaaggggcgatttactatttcttgacctggccatagtcaccgggttgttcatttctctaaccataaaatacacatttttatacacttttctgtatgtatatttcattataaaacatgttgagagatcgatccctaatacatttcttagtagagtataggcattccataaatgtttaataacagaatggataacaaaatggtactagtactaagttttctctaatcacttactagatatatttcagtttgtcatgtttacagacttctttgcaaacaaaagagtgaaatattaagagtttggaacgatcctatgcatagcaacacattaaagaggacttttaagaatagattctctatttcatttagagtaaataaacattctttcaactagtcatgattcacattgataggattaaaacattctatacataataccttgaaattaaaacaatcaacagaattaaacaacaatgcagaaaaggcaagacagcaaagcaaagtgacaaaaataattccttcgaacttacagaacatgtaacattcagaaaggaaaggagagcaaatgaagaaagcaaaatcattttcaggtcctgcttttaaaaataagcaaccacggttaggattttgttgtggagttggggggtgggaaatgacacatgagttcattaaaaaataaaagacggagagaaaactgttttggaatacaatgcagagcaagtcttaaaaaacagttgccatgagcttcaatgtgcaataataaataccactaaatagaaaccgccactgaataaacgtcagatactttgagatgacaaagatcgccagaaacattccctggtccgactgtttttatatatttgtgtacatgcgtaagtgctaaatctggatctaatttcttcctgaaaaaatccagttttctgcaacatcctcacagtcagggagaactaagctatattgagaagtttggaatctcctcacgtgccaaggaggattgctttctatctttaccgcatgttttaaaaaatcttcacagcaacacatccaggcaccctaggaatacaaggccacgcagacaatagggaacggaggaaggagggaggaagacaaacctggcctccagaaggagccaagtgtaggctccaagagataaacagccaagtacaataatctttcgagaagcgggctgagaaacaagggtgggagctggaaggaagggtataatcacaccttccttcacaaactgtaattaggagaaagacaccagccaggccagctctctcgcagagctcctgggctcacctgggcatgttttactaaccaagctcctcctagtttctttctctctctctctgtctcccccttcctccctaacccccactggcccccactccctatcctttcctgcaagtaaaaagctaaagtaaaatgactttccacagcaaaacagttacagatgttctacctcggaatacatcccagatcaagagctcgtcacttgatatgcagggctggggaccaggagagggtacgaaatggccctgcgctgtggccttttcacctacccaagcctcctaagtttcctgaaggttctgagctcattagacaaagaacaatgaagccaggactccactcaaccgctggtggttagactggtggaaaacaaaagatcacagggtctcactgaactcagcaactctccagtgtgcgtcttcccttccattccagaaaattaatttaaaagttgcccgtgatgaaacaagggataactgtgcctaaaacaatgaaccgttctaaagcttgaagtcggaataattcgctcttaagctttgagaggatcacactatgcaatgtattcctactttctcccaatataaatcacgctattaaattaaaaggagagaattcttccaccaaattacacactaatggctcttaacccataattaaagtatcgctaccagcagtgtaaagccccagccagccagggctcagacccaggtctcagccccagggatgatgtcagtgcagcgacagcgatcttgaggaaagcccgtggtctaacctgtccctgtccctgctccctggggactggctctggagctggcatccacgcaggcctcctcctctgcacaggcagacaaaaggaaagcaagcccagtgccagagcagcacgaagagcaccttccagcgaggccggtcactcagaggtgtctcacctaccctttccccaacatcacaacagcctcggaatttggaccagcaactggcttcagagcaaggagaagtgggagaggctccactgtgtgctgtaatccagggtgttatccccgtgctaggccgtgagggcacccaggacggggcatgaccctaacatcacggagctaatgaggagataagacatgaaataagcccggcgcggtggctcacacctgtaatcccagcactttggaaggccaaggcgggcggattacctgagatcaggagtttgagaccagcctggccaacatggtgaaaccctacctctaccaaaaatacaaaaattagctggtcatggtgcagggcacctactgtaatcccagctactagtgaggctgaggcaggaaaatcacttgaacccgggaggcagaggttgcagtgagtggagatggcgccactgcactctagtctgggcgacagagcaagactccgtctcaaaagaaaaaaaaaagacatgaaataattctggagaggcagcacggcatagaagattcatagaagagtcaaaactcaattcaatcctgccacaaactttctaaataaactaaatcaactctctgaaaaacagagtttccctctctgagcctcactttccttggtgaaaacaaggcaaaggtattagatgatgtctgaggccctggatagctctgcaataattagatagagaatacaaggcagtatataatcaagtattaaattatacaggagcaactacagctgccattgagagcttgcactgatttttttttgagtcagccttcattctaaaccacttcctgaaagcccactcagaccctgtgctaggattcagggatgcagcggtcaccaagacagaatgctctgccttcacgaggctttcgccagtctagtaaggtattctcaggtgttcagaggagggaaaaaatgagggctggggttggcctatgacctttgcatggagacagaggcaaaactgggcttcaagtgggtatcatctgagcattcagtggggtgatggacgcagtggttaattgctgagtacggtagtaataagccatgaggttctgaacacatagcacaagcccagttctactaatccgctcatcattagtgaagggaattagttagcttccagaagtcagccagacttcgattcttccggccctctccctaacgtctccttctcccaccccaaacctgctaattgtggttaactttttccctttattcttttcagttattcttgcagacaactatggtggagggcaggagccaggaagcagttaccaaggagggagtccacatctaagcaatatggagtcagtcaggaaggaagaccttgtatgctacaaggtaaacggctaaaaagatcgatttgcgtattaagtcacaagagaggtttaagaaagacagtacaggctgagtgcggtggctcatgcctgtaatcccagcactttgggaggctgaggtgggtggatcacctgaggtcaggagtttgaaaccagcctgcccaacatggtgaaacccatctctattaaaaatacaaaaatgggccgggcatggtggcaggcacctgtaatcccagctactcaggaggctgtggcaggagaatggcttgaacccgggaggcagaggttgcagtgagccaagatcgcgccattgcactccagcctgggggacaagagcgagacttcatcaccaaaaaaaaaaaaaaaaaaaagaccagacacatggtttattttagagtagagctatgtctcatacaactaaggaatatggtataatttagctggtaagaataattaaccatccgcatcttaatttttaaaactaaaatgtcataaaattaatttgtcccttattcttaaggggcatgaaacttgactgtgccctaaatgaaatcaaatgttgcctaccaacagtacattccattttccaaacaacttccctggaatgctggggagctgatatgtttaaaacgaatattctccaagtccaagtgttggattttaaagaaccataacctttccaacttttcctacaaaaaaatcccgtgtgtgatttatgcccatcttcaaaacaccctctggagttcagaccagatgtgtgcagtgtttacactgagaaaaccactaggacatcaacaattcactataaacaccactcaaattttgctgtgctttccttcatttcctctgtatttattctggtgttaaaataatgttaactctcataataaggaaaataggagcagatgtttaaaccaaacagacttcagcccattatcccatatagctactcaatcttcaaaatcaaagtttcttcctcccaaataccgagagagaagagcagagcagagcactctagtttcctgggtgttgcatgctacacaacaactcgacctgggctcgctgtccgtaagttggtcctcaccaatcggagacaggaaaaactaatctggtatcaatttcctaacaatcttatatttctctcttaggccattatgttttgtttttaaaatatcgtattacttgttggcaaagacaatacaacagaaattgcctcagaagtttttctttcttgttgggggaagcggggatggttaaaaaaaaaaaaaacaagaaaaacaaaaccctgactacaatgtgtgaatgtcacgggaaacaagcccagcaatggctgcttacggctttctaaagtcggctgccttttttaagtgagttcagaagcaagatgttacttaacacatcagatgcaaagaaagaaattcacgaaaattctcatagcaggaactagtaggagtaaagaaaaacaaatactctttttaaaaaacgttaaatatgagatcctcatccatagagttttaaaaaacaacgtgaatgagggttgttgttgttttttttccttgaaggggaaaaatactcttgaaagggtgagttttcaactgattaggaaacaggcctgaagtttttagattaaaaaaatacaagtgaatcaccctcccaagtttttgtaactgttttctttttcaagagaaatgtcccgtgtattattggagaaaaaatggaaactgctcctgctgaatgagaaagagaagagtcccggatgtgtgtgtggttacaacagaaaacactcttcctgccaggccgaactcccccggagatgccctcggcggcagacccagggccattgccactttttcaaatcgcacgtagaggatgtccgagggcttaagaaatagatttttctctgactgctaccagagacagttggaaatacaagacagtgggggaagcacctcgcgggcagtaggaggtaataaataacagttcggcgcggctctctctttttcagggcaggctgggggtcggggtgttgtgtaatcgctcccacagggagcggagcgcgaggaacaccccccagtgtcagcgctccccgggctgcacaggaagcgccagcgagacaaagagcccgcctgtgctcgctgacacggtgcccttccggccccacgcgggagagggacattctccgctgtttgggacgctcactcgcgagcacaaaaactcgctgtaactttggctccccctccgtgagctgcagggcgccgtggcccacagcagggtacagtagacggtgcaatccttaccagcccctcccccaaagaggctcaacttttaccggcgtcctacaagtccttcccctaaagacaatattaacggaaatcaaaaatacatacattttaaagagttaaaaatgtgaggcgcgagtacgttgcaagcaacgagcaaactttgaagggtttctacttcactgcctccccgtccagccccctccaccgccccccgcagcctgagatccgaacacactcggtgccgaaccgaacctaagaaacgccggcctttcaagtgccctacaccccggaggaggacagcgggcgcttagaaggcaggcacccagcacactgaggaggagtggccgggacgagcaacgggcagtaattctacaacgggacatctaccttcgtagcacagaatgccgatattgttgttcatcttgtccaagtactgatagttcaacaggtccatcttcataaatagcatttattgggctagcaaagaaaaccagctctttgcttttgccccaaaagagttaagtttcaaaaatcaattgttgctgagtagctcctggctcttcaacttcacaaaggcagaggcccagcctcagactatcaaaacaaagtatgcaaaagttaaaaaaaaaaaaatcaggcacaaaaaaatcgagctcacacgaaacccttcaagggcttactggtagacggtgtatgtactgtatccccgatcgagtatgaaaacagcgtttcagaagtccttacaagtccttcctggaaatggaaaagagtgaaaaagagaaacgcgcagcccgtttcctaggacaaagcggcgccggcccctctcacagcccgctgcaagccggcagcgctgacatgagggctatgcttggcatgactcctatgccgccgcttcctcttcccgcaggaggccgagcatgctcactgcgccgcgctgccgaggcagggagggcttctgcacaggatcagcctctcaatgtagcaagtgttggaaagaaagagaaaggggagggggagagactctagagacggggccttggcagagtggctcttgacaggaagcagccaagccgctgcaaaaccgtaggaggaaaaaagaaaacccaggaagtttctttttcaggagctaagtacaaagtaaaaaatccatcatggaagcaaactcccatggaatgcaactttcgtgaaacttcatgttggggtttcggaaacccaaagtgctagtgatgcataagccatatatatatatatagtgtctttgtttcttttaaagattgttttataatatccatttacactttaactggatatttaaatttctgatgttaatgttacatatagcttcttccataatccccataacaactgagatggacagggcaaggagggtatcaccctttcacagcagaggaaacaggttcagatggattaaatgactggcccacagcccccaaaatagttgacagaactacttttaaagtgttttttcccacctaatgttataattttatttaaaaaaacgagggggccgggtgtagtggctcacacctgtaatcctagtcgaagcaggcggatcacttgaggtcaagagttcaagaccagcctggccagcatggtgaaaccccatctctactaaaaatacataaattagcctggtgtggtagcgcacgcctgtagtcccagctactcaggaggctgaggtgggagaattgcttgaacctgagaggaggaggatgcagtgagccaagatcgtgacactgcactccagcctgggcaacagagtgagactttgtctcaaaaaaaaaaaaaaaaaagaaaagaaaaaaaggagacaaggagaggagaagagatggaagagtgtttaagcaaatagggctataatatcaaaaattaaaagtgtacttgaaattatagagggaaagggtaaaattattttcatttggcatgtatgtcacccacctgtgtgtaagaagctagtggcatgcagctgtactatttgctattggaagaacttggggcttaaactttgattacccagtgcctagcacaaccaagttcaggtgcccaaaaactgtttactgaacgagtgaaccactgaatgttcagttttcagcacatcaagaacgtgttaacaaaatagaaaaaaaaaaaacaaaaactaaacatttgaattactattctaaaaatatatttttaatattccaaaataatatttgaataaataatttgaaggagttgtatgttaaaaatccagcaataggccaggcgcggtggctcacgcctgtaatcccagcactttgggaggccgaggcgggtggatcatgaggtcaggagatcgagaccatcctggctaacacggtgaaaccccgtctctactaaaaatacagaaaattagccgggcgcggtggcgggcgcctgtagtcccagctactcgggaggctgaggcaggagaatggcgtgaacccgggaagcggagcttgcagtgagccaagattgcgccactgcagtctgcagtccgcagtccggcctgggcgacagagcgagactccgtctcaaaaaaaaaaaaaaatccagcaatagttgcattgggtttattaggcacactcatggcaaggtgttctaatgaaatcttacttgggagtccggatgcggtggctcacgcgtgtaatcccagcactctgggagactgagacgggcggatcacttgaggtcaggagtttgagaacagtctggccaacatggtgaaaccctgtctctactaaaaatacaaaaattagccgggcatagtggcatgtgtctgtaatcccagctactagggaggctgaggcaggagaattgtttgaacacgggaggcagaggctgcagtgagccaagattgtgccactgcactccagcctgggtgacagaacaagactccgtctcaaaaaacaaaacaaaacaaaaaaactatatgacatctaaatactaaatactgttgccgtcattgctgcaacagtaatcactggggtgacatcaggggaagtaagtaataggggaatcaagatttcacaagctttcatttataagaatatttattgacactatattacatgtaataagctatagtgaaagatatgtatcctatcaattgtaattaaaatacttaatggtatttggtggggagggttgaagaaaactcaaaactcgtaacatccagtatacatgagatcattgcactgaaaacaaacaatatcaggtatcagatttaaatttaactgatagttttggagtactcttactgtgctacgtttttacataaattctcaatcagaaaactttatccatcattgtcccacatggaagagaggtggctgcacattagaaccaggggggagcttttaaaaatcttgctgctgaggttgcatccccaactcatctgaggtgggaaccagcagcagtagcttctaaagtcccaggtgattccaatatgcagtcaaggttgagaaccattgctttcatctagggaggaaaaaaaaaaaaaccctgccttaagatatttcattttattcacttattttgacatgaagaatttttttaatagtaatttaagcaaatgattcaaacaataccattgtagaaaatgaataaaatatttggtaacgtcccttaagggactcagcatcacttagaacagcagttctcagcctccgggtggcaaccattttcgtggacaccgtctcacaggtctaccttgactattgtaacattcccagccacagccaccacgtctttcccgctgatccgggaggctagcacggtgctacccaagtgtgatccagaggggttcgagcaccaggtgttcctagtccccaaaagctagatacagaaacggagaatgaacatttaaaacttttatagcaattcgatagactaattttatgtctctcaaatcttaatattaaagaaatttgagggctgtagttttcgtatttctagttatagggctgcattacattttataaactatcagtctgcaacaaagtcttggggaaaaatgaaacaaacctggtttcacagagaagcttgtgctccagaggggccagctacaacagcccgcctctgcaggctgggagcgcctcctggaccggctctaggcctttccatcccagctcctgacaactttcaccttagtttcaagcacactggatgacctgcagtgagttattccacaaagcacatcagtatgcttctcggtgtgcaggacgtctcttctttcccaacctgtctactcagcaaacatccactcttccttgagacttgtcagaaagcccctcttgtcctgtgaaatctccctacgatcccatcctaccatctcctcacaccctacgccaagctatccttttacagggtaagtagtccttatccaaaatacttggaccagaagtgttttggatttcggaccttcttggattttggaatagttgcattatacttaccagttgagcatctctaattttaaagtctgaaatctgaaatgctccaatatgagcattttcacctgaatgttgtgtcagcactcaacactgttcagattttggagcatttttcatttcagatttttggattaggacgctcaacccataccttatatgtgcttctttcctagcctagatcttcggagcaaggactatgccttcctcaccttttcgaggtcagtctggcagaagtctggcagaagcctggcgcatggtaggccatcaataaataccagctgaataaaatcagtaaacatctaaacggcagattcttcatttccccatccctacttccagcacactctggattatcttactcgatgtcattaggtggctgtcaacatctcttggagaccacaggtccttgcctttaagaaacaccatgtagattctgattgtacttcagggtacaatcagctcatccataaaaaaaaaaaaatactagaaaatatcaatccttctcagattcattcataggataatatattcataattaaagtagcaacaggatagttttgtagggaattggaaagatgggtctaaattttatccacacacacaaatgagatgggaaaagctagttctttttctacgaatgaataagtttgatctatcaaatatttaaaacataaagcaaagaatatattttggagtgttactgggtagagactaggtaggaccagacagatactgtggatataggaatcagaaatccaggccaatggggaagaagtggattacaaaacaaacattactgagaaaagaatccagatagcactttgccttatactgtacatcaaaataaatcccaaatgttttaaagattatttagatgcttttaaagtaaggtttttgctgcaaaaacttacaaaactataaggatatgttcagactatctgatgtggaataggaaaacatttgctaagccagaaataaaatttttaatcaaagacagaagccaccaaggaagatgtagaatttgattgagaatacagattttatgcttttatacatctaaaaacaccaaaaccaagtaaaggcaaaatacaaaactgaagaatatatttgtgtcatatattacagtgaaggataaatgttcttggtattcaaagaacatttaaaaatagaaagaacaaaggaaaaaattgaaaaaccacttgatctgaataacattttttaagagcatgagaaacaaatggccaacacatttttgaaaaactattcaaccttactaataatcaaagaaatataaattttaagtgattttccagctaccaatttaacaaaaagactttttcaatcttatttcttgctggtgaaacaggatgccattggaatctttgctcactgctaatgcagtataaacagataacgcctgtgtataaagcaggttggcacacactagactgttttatgaaaaatgtccatgcctttgtccttgccttggactctacttctagacttctgtcttaagaaaataagatttgaagagtttcataaagatgcttatcatacagctatgtgtaaaatgaaaacctgaaaacctaaagtccaaataaaaggatgcattaaaaccgtggcttatcgatgacagactattacgcagccattacaacaccttcaataatctataatgacatgaggaaatgctatgctatatactgtgtgacagtactacatttgttaactgaaaacaataaaaatcggatataaaactaaaacacacattattcaccaactgtgctaatgtatttatgaaaacatacatatatatataggaaaaagtatacattaaaaagactggaaagtattccaaaatgttaatagtgcccatctttgaatggtgggcattttttccattttcctgaatttctaactagcctacaaatagtttattcttcctataatgaagatgcggataaggaaagttcttgatttttaaaaagcagcaacacaatgaaataatattccctggtgagacataagcaatggatatgtatatcttattatagcttacatatctcatgatatctccttttgatttgggtttaacaacttaaaaataataagaatccaaacatttctttagaactttggaacattcaaagatgtttaagatggggtatctgtctcaaagagcaaaattgacagagacagctctacacttgcagagcttatagacatgtgtacgtgctttttatcttctactgcttactaattatgtcatatgtcagtaccaattcccccaaactagaccataagcttctagagggaaggaaagctaagcctcagtccttagagtaaaactcccccacagcacacaagtgctctatttggtttggtttggtttggtttggtttggtttggtttggtttggtttggtttggtttttttgaaacagggtctccctctattgcccaggctagagtgcagtggctcaatcacagctcactgcagccttgacttcccaggctcaagtgatccttccaactcagcaggaccacaggtgcatgccaccgtgtctggctaacttttttttttaatcattttttgtagagacaggttctcactgtgttacccaggctggtcttgaactcctggccttaagccatccacccgcctcggtctcccaaagtgctgggattactggcatgagccaccacgcctggcccaataagtgctttataaatgttaattatggttgtgcctcagcatctttgtggaataatggcaatatgacgatagaagaaagcccaggctaattactaggctgatctgtttaattagctagaggtttgactaccactttagaatagatcaccaaaactgcgagctgtgtaataaaagccaaatactcttctatttaatatcagcctgtggaaagaaaagccaaatgatcaaaatcactccccagacatttatttaaaataaaatgctttcatttgagcacttgaagagaggggaaagttttaatgttaagtctaacataacatctccaaataccacattagaaaatatgagtaaccctactgcgctatctgtttcccctactgggttccgctgtgctcttcctcccagggtttcaagtaagctggatatttagttaatactttcattttaaagtgctttttttctcttcttgctacacatagaaaacacacacacacacacacacacacacagacacacactttaacctgatgtaaataatattcaaaacagaccttactaataacaagaaaataagtttgactattccttgagctaaagcatcagttaaacaataagttggaggtgcaaaactgtcatgtttcagaggatctctaggtccgtcgcaatttaccagcacattcctcagtgtactaagaacagtaccaatgatgatgatgatggtggtgtttgtaaaacactacactggtcaacacatttttgcttcgtaatctacttaatttaattactaagacaaggttgtaagaaggaaagcatagaaaagggtttaagggaccaggcgcggtggctcacgcctgtaatcccagcactttgggagggcgggtggatcacctgaggtcaggagttcgggaccagcctgactaacatattgaaaacccatctctcctaaatacaaaaaaattagccaagtgtggtggcaggtgcctataatcccagctacttgggaggctgaggcaggagaactgcttgaacccaggaggcggaggttgtattgagccaagattgtaccattgcactccagcctaagcgatagagtgagactcaaaaaaaaaaaaagaaagaaagaaaaagaaagaaaagggtttaaggtaaaacctagcattgagtaataaaaaaggaagacttaagaaaccaaactttcttttcttttaaacattgtttagaatgcaaattccttaaaggcctagctgaattaccaaccccccgcccccaccaagaaccattagctaggattaatctcttcatcctgcattattttaggtttattctatacttcattctaaaacaaagcagactataagatagtttctgtgtctgtcccctaccatattataaagactgctttgtacacggtaggtcaacaactaagctgctgagttaaaggagaaaccaaaacaaaacaaacttcaaatgccttaaatatcaatgacgtacagtaagtaccagggagtagctgatttaaaaaaaaaaaaaatcagcgacataaaccaaatatctaataagctccctttgttgttactttcttttaagaattcctaaatatatcataaaatagtgattatttatacaacttggggctgctcaaggatgatttttttaaaaggacagtattttgtggaatttttcacaaaagcaaatatcattaaactatgtcttagattttattatttacaaaatactaccatttgtaagttaaaacacactcaacttctattaagtagcgactgatcattctctgtaatataagattttaacacaaatctatggacttttcaaaaactttaaatgggtcttcagatcatatttaaattttcaatacaacaccaccctctaggggtgaactttaaattacaaagaccattttgaaaaagcaaactgcagaattcgtgctattcttgcctgatgtgcattatatttcaaatacaaaaataaaccttattttatttaatattaaaattcatagaaaatatcttttaacaaatagtttaattcttactaaactctgcaaaagttaaaacaaaatacaaaatcaattaaattgatgccaagtgattaaataggaaatgtgctttcacataaatttaaccttaataatcctaaaaagtgcagactgggaatggtgttttttgtttttttgtttttttgacatggagtctaactctgttgcccaggctggagtgcagtggcgcgatgtctgctcactggcaacttctgccccccgggttcaagcgattctcctgcctcagcctccaaagtagctgggataacaggcacgtgccaccacgcccgggtaatttttgtatttttattagagatggggtttcaccatgttggacaggttggtctcgaactcctgacctcaagtgatccgcccatctcagcctcccaaagtactgggactacaggctaaggaatggtgttttaaataaatcagaataaatcagtgcgagggaagggaatttaattagattagcatccccaagaaaagagaaatctcttgcaaaacactttaacttgttagttttacaactactgtcttacatgtttgacaatacaaatattttcttgcatgtttacatacatgattattttagtgattttcgctactacaaccaatttaggttcagtaagtcccattcaaagaacattcacaattaaaacgctattctgatattcactttgtaccaagtcataattactcatagatgtattcctgcaagattgactagaactgacttccatggtaaaaatagaagaactggagaaaatgtcccaaatattcaacaactgaagggctaagttcgctgctagccccaatgtgtgacccaacttcatttcacaggtcagtctgcctgcacagtgcttcattcattatgcagcacgctaagcacctccacagtcatccttccaaccagttagggtgccgtccaggaaagagaaatcatggctgttatttatatagggagaattttaatgtatcccacctccacctattccttcttccagtaactacccccatagggtaacttactatcctaacctttaagaacgtagatcagttgtataacactttatagaaagagaatcgtatgatgctagctactcttgtggctggattccttcactccacatattttatgagtggtagcattatttttatgtgcagttgcatagcattcatttgcattgctgtctagtactccattactccaatatatcgcagatccttcattctaccactgatgggcatttaggtagtttctacctgggggttattataaatagtgctgctatgaatattctagtgtgtgtctcttatcagcctcggaatgcatttctgtcgcacatgtactcagaagcagatacgcagaaagtgtatgttcagcttaagtaaatattgccaaatagttttccacagcagttgtacccgtttatactcctaccagcagggtatgagatttcaagttgctccccatccttgccaacagttttccaactctttcattcctgttattctggtaggtctggagcagccacactacgactttacttcgcacttctctgatggacagtaagaactctgtgacacttgtagcaggcagagggatagaattcacccgagacaacacagagggaagggccccggccagaggctctcaaccaaggagattctgccctcctcaggagacatctggcaatgtctggttatttcaaatttgggggtgttgttaacatctagtggttaggagccagggatgctgccaaacatcctacaatgcataggacaccccccaccaccaccaccacaacaaagcattatttggcaaaagtgacaataatgccacaaatcaagaaacccaaatcaagcaaatcattattgggcattttctccttagccaaatcatcattctctgatacagcacaagaggtcaatgtcctattgtcttaaaatgttatttttcctagagttgaggggatagaaagacaacaaaggatactaagtgccacactccatggcacagtgcatatcttctgcatatcctgtttctttctcagttctcgcgacaatgcggagatgaggaaacagataccaagcaggctccttggctcctctaaactcacgcaaagagcagcagagctgggaccagaagctgtgattttccactgcacccagggtcttacttttaactaaaaataaggggagtttttagagtccacaattcctgttaacttgcaaggcatgaattttaccttattagctttgcaaaaggcaggcaaataaaacgaggtatgagaaaaagatcatttgcaatgttaagattattaacctgcacctgtaagtatcttaaaatatttcaacaaatccaccttcctcatcacacggtgatctctttgaaatgaaacccataccatatttttctttgtctatgcccaatacctgtaagagcaggcattcaacagttaacatgtcctggattaattactggcctgaaaccccagtgagagaagacagaatctttataaaacaagcaggtggtttagattttatttcatcaccaacacaactatatttagtaacattaactagaataaacggtttttgttgaaaaatattcaattaagtcaaataatggccaataccacaaaattctttttgaaatgcaaacaattcaatttttccaaggatgagtttgccagcattaccttatcctcctgtggatcttctatttgaggcttctatttgtgaggccattggcattattagggccaacagaaatccacccactattagagcagttttgaaccgtggccatacattacaatcacccaggaggttttgaaagccatgggtgtccaggaggataatttggtaaatctgcagtagatgaattttgaatttacacccaggaaataactacacttagcagtatcgtttgaaaatagctacccacgtaatttttgcaagctcccctccccttaggggtcaggaccactaccctggagattctgaactgaactgaggagggcacctggctgcttttcatacccaccagagttcaacatcccaatgagttagttgctcgtgggcaggactagggggcgacgtgagcccacctaacaaacagcctggcttccttcccacagggatggcaccacctggtcatttgtatttaaacaattcccatctgctttacacagaaggggcaaaccaaacccaccacccccattctcagcctatcttcttaaattatcaacacccagtagctggaataggacttgaaatggataaacctaccaacacttgactgcagtgagcccagaaatggacaaggcaggatttcctgtttaccccacatagggtggggagtgcggggactaaggggtcctaagaagagacagcatttgccggaggaaacagtggggtttccagtttgtgtctggttccggctggtggcggggggtttctagtgactcgtctcactgcataggagcctgccctcagaggacgcaggcaggtgtcatttcaggcctgtgtactcctctgatgaacggccatctccctcccattcacatccgtgctgttttgccttatcattgtttccccagcacctaacacaaagcctgacactggtgggtgaccactaaacatttcttgaaagaacaaatgggaagggagagctccagaatctaagctgggaacagaggaaagcgagaagcctaaaagaaggagcgaactgaagaatgaaggaagtcaggagggagcgcaggtgcacagctttgtgatgctctgcgtggttacaataaagagatgatcaaagtatgatttcctgaagcacatggtctattgccatacaaaggctcatgatccctaaggaggggagaataatgagaacaggcctaccagggagcacacacgacagacgaggtccattcaccacacagggagtgcttcccaaatattaaagtccagttgctcacttaggatggaagcaggcctctgtggaaagtgacatctgattaagtttgaggtgtgccttttatatgagtggttctctccagagatggtgtccaacacagggagggatccacggtgacatataaggcccccggaggctagaggagttcccaggggtgctggtgttggcagggcctttaggctggaaggctaacaggctaggagcacctgagctggggatctttgcagaaggggctggcagagctcagcctgctgtggctaagccctcaacgtatctgtcaaactctagagctgagatgtccactggggtgcagtagctgaggtcagtaactcctatagggtctgacagtgtgtggtgtcgcattctcgaggggagggagagcacaccccaagttctcaccacagcaaagcaggccactcgcatagcaagccaggtaagcactgggagtcacttcaaagctccataccatgtgagaaccagggatggctttgagaaagaactaggtttctagccaggctctgaggactagccacaatccaggctctcagagaagcaagatgactgtgaccccagcaacaacgaagcacggccctggtcaggcattcagatgccaggaaagagaagagggggtctggaaaggaaggactgacccgaggaggagaggactgtcctaagagcgtctgcagggaggctgggagtaggcagcaaggaggtaaggaaggccagcctggagctgagagcagtgacgggcctcccaagctgagccctctgtactcttcacactgctttctagcaaaaagagcactggatacagagtcagaaaaatccagttcccaggccataacctttgctagccatgcaatcttcatcaagtgattccacctctctaagcttggatgtccatctcggcagcctctgtgttgtctgcccgagccctaaaatccaaggactccgatcattcctcttttccctctccactcttccccacccaaccacaggccgccattcactgcaatctcaagacagaatgtcatgttttatagaatacacgacggtaactggtatttctaggagggttggctcctgggtttatgctgtttttcttacaaatgtggcaagcaaatgagagcttcacctcccaagacaaaaaaataaaaaagagacattttaatcttaacaatgggcatgaagaatactgtttggctcattttcctgctggtatgaattaacaataacaattacagggaacaatggtgagaggatcttaactaacccaaagttctctgtgtctctggagagaacactgaggcaaaacagctgctaactaggaggaatctggctttctcttccgtaaaatgaagagatctaaaactcctggctgtcactagttctaggtgagtctggctactagagggttaaggagactaaccctttcacccataaaagtttcaggtgtaatcctattactttggaatggctagcagtgttctacgaaactattcaaggattaaggttagagaatgcctgtgccctatggtacaggctgccataaagaaaattatgatcctagatgcagtgatgccaatttacatggtatctacataaatgattcttccagctccctcttctccattttctcagtaaaacaagttttttgttagtttttcttcttgagacagggtcttgctctgttgcccaggctgtagtgcagtggtatgaacccagctcactgcagcctcaacctccgggactttaaaaaaggcgatcctccaacctctcagtctccggagcagctgatactacaaatgtgcaccaccacacctggctaatttttgtatttttttgtagagattgtgtctggccacgttgcccaggctggactggaactcctgggctcaagcgacccacctgccttggcctcccaaagtgctgggattacagacgtgagccaccatgcccggctaaaacaagtttttaagagggagagaaatgagcaaatacagcattgcacctgcacgttcaggactgtctactccccaaagcaataatcaaactaccatattttatttatagctgctctcaaggcacaactgcttccaaagtacaagctagaacatttctagtttggtctggaaccacaaaggaaaggtacaccaacatgctgtaccttggaaagctgacctgtaaaacggaagccttcttcgtaatatttaaccaaacacagggcctgacaccttccagtcctcttctgacagatcactgcaatatgtttgctgttttaatatcatgattaattaaagagccagctgacaattttacaaactaggaaggacacagaggaaacagaatacgcgaactattcctggatctttccttttatccagccggcatgtggcacgctattcttcatgagtgagaaaatccatgccctaaattctcactcataaatgcatatttagttaatattgaacaaaaagaaaatagtccaaataatttgtcagatatgcacttataaaacgcactgagtcaatgaatgcaaaaatattttgaagagccaaaaagtgctatcagctgctaatagaagacactagacaaagtacagcatctagaattgtttttattgagagaagaattttgctgagcccagaagcagaaacatccaacataggtacctaacaccacacacatacagcacctccaggcgtcaggcacaactatcctgcccagagtcatgatacaggtgaacacctagaagttaaacccaatatatatacaatttccatgcctctaagaattatttacttgtgtctgggaccctagacatacagcaagcaaggcattcaaacaacatgaatagagtgccacgttaacgaagatctcactccactggcccagaagggattgggatccaaagatgagtaagacacagtccctgtccttgaagagtatatcacagagggcagaacataagacctacaaacaaacaatagaaggcagagggaggacaaatcctattttctttttttttttctgttttcttttctttttctttttcttttttttttttttttttttttgagacagagttttgctcttattgcccaggctggagtgcaatggtgtgatctcggctcaccgcaacctccacctcccgggttcaagcaattctcctgcctcagcctcccgagtagctgggattagaggcatgcaccaccacgcccagctaattttgtatttttcagtagagacggggtttctccatgttggtcaggctggttcttgaactcctgaccttgggtgatcccccccggctcggcctcccaaagtgctggaactacaggcgtgagccaccacgcccagcttcaaatcctattttgaagggacttggggatttcataaaaaaagtggcattggcatgggcccttaaaagaacaagatctcaaagcaggtttgaggaatgcggcattctaaacacagtacttcagtagacacaaacaaagtatttgctataacccattgattattgcatgagcagattaagtgaattttaactgattactaagaacaagagttccgtaaactgtaaaactatttaaaatttcccatcttggccgggcgcggtggctcacgcctataatcccagcactttgggaggccgagactagtggatcatgaggtcaggagattgagacatcctggctaacacggtgaaaccctgtctctactaaaaaatataaagaattagccgggcgtggtggtgggcacctgtagtcccagctactcaggaggctgaggcaggagaatggtgtgaacccgggaggcggagcttgcagtgagtggagatcgcgccactgcactccagcctgggcgacagagcgagactccatctcaaaaaaaaaaaaaaaatttcccatcctgccagccagcagttagctagaagcaggttctgatcttggttcggccacagactggctgcgtgagtttaggcgtgttacagaatctctctgatctacttctgcatctttgaaaaatttggataatgatacagcctgaccattctcctttgatcataccacttttctcatggcatttaatatggcctactataattacacatggctttatctcccctgtagaccaaaccaagagctcctgagggcaaaggcctttgcttatttactctgaaacgcagcccagtgctagctgtgctagcagacacattgtcaatgccagcttctaccctttctgttggattcccacttgctatgaaaatcctttcctttgttctacaaagtacactgttcttcaaatcatgaagtaacccagtttcaaaattttagttttactttgtaagtttcagcatatctctatcccagtatggtggggtttcttgttgttgttgtttttgttttgttttgtttttaatattgtaaatgttataggtttcaaagattatctatttgggaacttgggcataaactcaacatatatacttctcatgcttccaagtactggaagcatgtggaatctgagtggaaaaatcatttaaatttagctttaaaaattaaaaaattaaataacgttgggatccaaaggaaagactcttaaactttatgttaactgaactttcatttcggccttgtttccaatagattgagaaaaagattgaataccaaacagcaacaaaagcagcccatgatgcatttcagtgtcatcagggtggctgtggggctgaattgtaggattatgatagccaaaattctttacaaaactgaacactaccctgctagttgatcgattcaaacacaaagtgtgagcagcagtcaaaattccttctgtcctagagagaagaaatgccctcaggatggagggctggaaagaaagctctctgaggcggctgactgcaatgaaggttgccagtgccccccgactccaccccagctcctcccagtcacaaccactcagcaggctggtaacgcagaaagaacgatccacattgaaaactgagtcatcatgagaaaggctccatcacagacaatgcaaataaggtacaggacaaaggaaggaaaggaatattgccaagaaaaggtcaatgaagacacaccagacagccagagagattatgctggaaagaattggaaagttatgaaccaacatttttccttttatttatttatttatttatttatttatctatttatttatttatttatttttgagaggaagtcttattctattgcccaggctggagtgcagtggcatgatcctggctcactgcaacctttgcctcctgggttcaagcgattctcctgcctcagcctcctggagtagctgggactacaggtgtccaccaccacgcccagctaatttttgtgtttttagtagagatggggttttgccgtgttggccatgctggtctccaatccctgacctcaggtgatctgcccgcctcggcttcccaaagtgctgagattacaggtgtgagccactgcgcccagcctgaaccaatatttctctatgagactttaaaaaataggcatagcctccctgaaacaggaactcaaataagaaacaggacaacaaggggagattaaaagatagcaaagttcagggaagaaatgaagttcaagaagagtgaggcaatcccggaaacggatgccgcactaaacagcaataaaggaagtggagacactgatggaaacacaaccaaatatatggaggacacattccagaaaatcccagtgattggctcaagaaggagcacatgactcacagacattagctgcagactttctggaacaaagcccaagaaagctatcagaagaaacattctccctggctaacattatgtcgccagctgctaccacggtggaagtcagcccaaagacagggccacataacaagaaaaccccaagagaaatgaaggcagaacctgagaacaccatgatcctctgagtcaaactgcacccgaagcccaccagaccttcagacttttcagctatgtgaatcactaaattccttttattttaaaaaattcattagaataagttttccattactggcaattgaaagcttcttgatacacttaagaacagctgaaatgaaaaaagcaaaatgttcgtaattctaaaacaatacattgggaaggcaaacaactgaaaaattattcaaaacaggagaatgtagtaaggtggcttattataaaatggatttatcaaaatccaatatgaaaacaacattttatgtgcagtaggcacaatccaatggccaactcaaaatatactcccaattcccttctcccactgcctccactagagggactgagaaagctgaatgctctctattccacaatttctcctaactaggagtgccatgtaatacggatctggccaatgagacaggaacagaagtctgctttgagcttctgggaaagtttttgcttttcttaattaaaaaaggccagatatggctcatgatatctcattttctctctccttgtcttactgcctggaatgcaaatgtgatgcctggagataaggcagccattttgtgactgtgacatgaaaagcaggagaaggctacaaaataaacaacagtgattacctcagaaaaactaggaacttgagatgggagggactttcttcacaaaccgagttttctttttttaaaaaacacattttataacataaactaggaaataaaattattttggaaatataaaggaaagattattagggtttgcttgcagtagttaggaggtttctgagaggggaagagtaaaagttgggaaagcgaggcagcagagtaaaaggtgatcaagctatgaaaacaacatgagccaggagtttactgaagcagagtttttcaaagtagaaagcagtagaatatacgagtgaaaagataaagggggctggaggatgaggataagccagacagaaatcagacctgactctacagtgatggacactcctgaatagtccctagaggttcctttttagcagggccggggaagtggtacaataaaaacaaagtttgaagtccaggatacagaataagttggcgtttaaagctaaagaaaacagaagtgaaaatcagaacaaattcatccaattcagttctcaagatttcaagattaaaactgcaacatttaactgtaagaatcctaggcaaggcgcggtggctcacgcctgcgataccagcacttagggaggccgaggcaggcaaatcacctgaggtcaggagtttgaaccagcctggccaacatggcaaaaccttgtctctactaaaaatacaaaaattagccaggcgtggtggtgggcacctgtaatcccagctacttgggaggctgaggcgggagaatagcttgaacctggaacacagtggttgcagtaagccgagatcatgccactgcactccagcctgggtgacagagcaaggctccacctcaaaataaaaaagtaaaataaaataaagaaagaattttattgctgtacacactgaagggtttggacggttctgttattacatactttctttacatatccttgtttctgaagtaagcaaaacaatggaatttaatttctctatgctgtaagaaaacacatttgtcatttctttttacatttcattaaaagtaatggcaaaaaacacaattactgttgcaccaacctaatacaatgtaatgtaaaaagaaatgtaggctgggcgcagtggctcacagctgtaaccccagcattttgggagtccaaggcgggaggatcacctgaggtaaggagttccagaccagcctggccaaatctctactaaaaacacaaaaattagccgggcatgctggtgcacacctataattccagctacttgggaggctgaggcaggagaatagcttgaacccgggaggcggaggttgcagtgagcccagatcgcaccactgcactccagcctgggcgacagatcaagagtccgtctcaaaaagagaaaaataaaaaagaaatgcagctgcaaatagaacagaagctggacacagactggtccctggaaggaaggcaaccagagtccagtgcactacttttggatagggaggtaatcaagagagcactctatggggagtccaaagacctggactctggtttcaagtctacctctagctcccatgtggccctgggcaatcacctctgctttctgaagctcagcatgctcgtctgtaaaataagggaattggaccaaaaattcgctacagtccttttcaattctaaattctgtgaatagtttacttcagccttggagctggcagggacggtggctgagagaagaatctggggaccagggctggagaatcagggctgaataacgtgggactgtgcagtaaggggtcacccatgaaacctggagtgtgtatccatctaataacaccatttacattcttgaatattccggaagtcctacacttaggaagaggtactaccaaattccctatttgccctgaatatggggacacataagagctatagtaactataaaacatgttttatagatcttttttaaaattgtgtaattagtgccttaatatgtatgacaaagagtaaaaattcatccagcacgccatgatcttcagccaattcataccagtaactagtgatcaggcatcccaattttcttttctctatttttttttttgagataaggtctggctctatcacccaggctggagtgcagcagcaactactagagattgtcttaaatgtctctagttaatttctaaatcattttgattaattccaaaataaagttccaaatgctgttcaccaaaatgaaagcaatttgaatatttttcttttttttttttttttttttttttttttttgagacggagtctcgctctgtcacccaggctgcagtgcagtggcgccatctcggctcactgcaagctccgcctcctgggttcacgccattctcctgcctcagcctcccgagtagctgggactacaggcgcctgccaccacgcctggctaattttttgtatttttagtagagacggggtttcaccgtgttagccaggatggtctcgatctcctgacctcgtgatccgccagcctcggcctcccaaagtgctgggattacaggcctgagccaccgcgcccggccaaacatcttaatccactctaaaaagtcccccatattgaaatcccaacatgccttcatacacctgcagcttcaccaaagcaacttcacactgtgctgccagccacagcctgaggctgagtgactccggagtggcagaaagagcctgctgagcagctgtgggggaagagggcatccagcattgctccctgcaaaggaagccaagtcctgaccatgcctgaaggcgcctgacaaagtctccacagaacaccacggccaggagaggctgtgacagcactcattcattcagcatatatttactgatcacctcccaggtgccaggcactgtgctaggcactggagattccacagtcaacaaaatgagacaaaactccctcttttcgtgagctgcacattctagtgtatgtgaaagacaaatgagagaaatcaaaataaagcaggaaagtgcaagcaaggcacaggtaggggcaagagacaaggaaggctgctctgagaaggtgcctctgagtgacgacaggaagggaggacacaatccccgaggattagaaagttcattctgggccgggcgcggtggctcacgcctgtaatcccaacactttgggaggccgaggcgggcggatcacgaggtcaggagatcgagaccatcctggctaacacagtgaaaccccgtctctactaaaaatacaaaaaaaattagccaggcatggtagtgggcgcctgtagtcccagctacttgggaggctgaggcaggagagtggcgtgaacccgggaggcggagcttgcagtgagccgagatgtgccgctgcactccagcctgggtgagagcgagactgcgcctcaaaaaaaaaaaaaaaaagaaagttcattctgtgctgcgggaaagcacatgcaaaggccccgaggcaggaggaggccagcgtgacttacaggtcatggaagagccacagttcttatctctgcatgagatgggaagctcctggagggcttccgaacagagcatggccagaatctgagttcccattttaaaggcccactccagcaccagcgtggagaacagagagaaaggagatggagttagaaacgggaaagcagctatctgtggactagggtgctagtcacagtgatggcaaaaagtgatcagatgtgagatatatctgaaggcagaacaaacagaatttgctagcagacagtttgagatgtgagagaaacagaatcgaggatgactgtaaactttctgggctccataaaagacaaatgcatatctggacataattactactcacactggacacaggcttggaaatccagagccaaagacattctgtaaacaccaaaagggcatctctaaggacctgaaaacctacaggcttctaaggctccttaaaactccaaccttacaaagaaattcactgtaataagtagttacttacaaaacatgaatgctacaaccctcctctgtgctcccctccactccggtgtgcatgcgctctcctatctgcggcgcctgctctcaggttccccctctccagcctccttcctgactccgcttcctcattccacacaccttgatgcagatcttctccaaagatctagcctcatttgccctttcttctatctctacagtctttcactcagcaatctcaatcacttccagcaaccatctcttcaaagaaaaagaccccataaatttctatctctggcctctttgcaccacaggttgagaattcaaattacatccttgatgctagtagtgcagatgcctgccgcatctcaaactcacaaagccctacactgagactccaatcttcccatctctttggctaaagccaggggcttatgactgagtgacaggttacagagcttgggcttcattccataggttaacatggtgcaaaatacgattgctgagctttgcaatgatctgtccttatctttccttctgaacgttcatacatgttatctgtttaacctctttagcatgtcaccttctacctttatattacgtacctttatattaggtaaattgtgacatatactatttacatattgacatatagtatatgctatgatcatttatcatataccatttatctgcatgttttatcttacctattaggctatatcaccatttaggacctattggatttacctttacataacttctgtgtactaccagtgtacaggtgctgcccatagaaaggcctcaataaacatttgtttgatacaaaacacatgtgtagaagaccatggaaagcgaccaaacatcaaagccatctcattacaaatttcttcaaaaggtgcttcctttaaaactcccccagtatcattatcccttgggttacattttctttgttctacaattaacaaacgttccttacaaatagagaacctttctgactcatttcatgagggtctcaaatttctatcttcttctttttttttttttttttttttttttttttgagatggtgtctcactctgctgcccaggctagagtgaagtggcgtgatctcagctcactgtaacctccgcctcccgggttcaagcatttctcctgcctcagcctcccaagtaggtgggattacaggcacacaccaccacgcctggctaatttttgtatttttttgtagagaccgggtttcaccatgttgcccaggctggtcttgaactcctagcctcaagtgatctgcctgccttggcctcccaaagtgctgggattacagatgtgagccacaaatccagcctcaaattcctatcttcaagccacaggaaacaactcatttcttcaagatataaataaataaataaataaagagcaaacaaaccccaagactagtattttggagggagacagaatttcaaatgtcaaaacaactttgctctcatcttctgagatgccctttagggtaaccattttttctaaatgcatcatgcttactattgcttgtggaaatttgcttattcaaatgatccaatcccttctccttgctactaaaagtgcagccacctaccagcagcatcagtggcagctgggagcttgtcacaaatgcaaactaacgagccctatcccagacatactgagtcagactctttggggcccaggaatcttaatttaacaagatctctgggtaaacgtttgagaaggacaggcctatcccatggccagagttacctttcgaaaacccatctcaacgtgtcatcagaaaccttcaatggccacagtataaagtccaagcctctgcagaaagtgaaggatcttatcatttaattgccacaatcttcccattaagtcaatcagcatgtgttgaccacctgctcacacgccaggctctcttgcacgtttggagaagatagcagtgaacttggctgacagccctgctctcatggaacttaccttctcagagggaaactgacctcagaactcatctcccaactaaccatcccattacctgtgttctactcacactgctgtcttcacccttctccaagtacatccacacattttacatttcatgccagggttcgtgctgtttcaaactcaataccaaccaggctgaaatcatcctccttactctgggcttctgctcgtcctctaacacagcaaaggctgcatccctagactgtgattcatatttaaatgtctttttctcctctgctgggcagtgtgagcctcaggggcagaaccatagatccttcatccttgtatacgtggcacctagccacatggcttagaataaatagcatttaattaaatattcttaaaaatacaactcagggatagaattttggcagtgttcaaaatgcttcctttggaaatctttaaattttcctctaaagccggtgtggtggtgagagcctgtactcccagctcaggagaaagccaggaggatccttgagcccaggagttcaaggttgtgatgagctgtgacgccactgcactccagcctgtgcgacagagtaagaccccgcctctaaaaaaagaagaaagttttcctctaaagtctaagaccttcttttttaatgatattcatttaaatagtggaaaatatcctttgacagtataattacaattttggcaatggtctaataaatggtgtaagagggtgatgaagatgggcaatgcaactgctattctaaaacgaactttaaatattaatagaactcattattttggtacattttatgactgaaggcaactccaaaaatgtcttgcacagtgacagcctcactgtaatatttttattctagagtaaggaattagaataacttttttttttttcattttatagacacagggtatcgctctatagcccaggctggagaacaatggtgtgatcacagctcattatagcctcgacctcctggtcccaagaaatcctcccatctcagcctcctgaatagctgggactacagggcacacaccaccatgtactgctaattttttaattttttgtagagatagggcaagattcctggcctcgagtgatcttcttgccttggcctcccaaagtgctaagattacaggcttgagccaccacacccagctagaatatcactcttttcaatgtttcaattctgccatgctttggtaaaactaaacagaatccctcttccagcaggtaaatcttctgttaagacaatcattcatgttttcaagaatgcattatgtatgggaggagggtgcggggaacatgtctgtttctaaaacaaaaaaaaaaaaagcaagaatattcagatgcggatgggctaccgtaagtcttccctatcatcctccctttttctacgcccctcccacaacttggcacttgaggcacctccagtgttccctggaagacattcaaaagcaaaataaataatggaaagaaaactgaagtctacgttggaaaacctttgtcctaatcccaaacgttatgacctcaggaaagtacttctactgtctgcacctcagtttcttaaaaggaaagctgaggttccttccagtttaaaatgctagcactttcgaatgttttcgtctctagagatgagagaacatgccaattcacctgcgtcccaacagcccttttgggaggtatgcacgcagctctacttaagatttgattgaatgaagtcacacaccattaaacattttcaacattcctatcctaaatatgccttcatttttgcattacatataagtaatataaccaatagctatagtaaacattactgaggctttcttttttttaagacaaaaataagtaaatgtctatactgacttcccatactgtctttggaacccactgattgagagaccagtatcctgcctggatattaatgggcacctgccacataaaagagagagtggtgggccaggcacagtgactcacgcctgcaatcccagcactttgggaggctgaggctggcggatcacctgaggtcaggagtttgagaccagcctggccaacatgatgaaaccccacctctactaaaaatacaaaattagcaaggtgtggtggcgcatgcctgtaattgcagctactcgggaggctgaggcagaagaattgcttgaacccaggaggcagaggttgcagtgagctgagatcgtgccattgcactccagcctggacgacagagattccgtctcaaaaataaattttaaaaaggagagggtggtgcattaaggagagtcgacagcagctgcccccgtccttaagaccacagtcaggactcaagcacaaaaagtgttttcatgaagtaatgaggctttagataaacataccacacttttctttgcaatactattttgcaaattaattaatttcaattaagaaatgtcaattaagaaaatgtgaaaatcaaaagaacatttttaccatggtgcagacctggatgtctccaacttttgagtgcacaggactcagggattttgtcaaaatgcgtattctcagtcatcagttccgcagcgaggactacgattctgcatttctaacaagttcccaggtgacgctgtgggccacatgtaagtaacaaagaggtagaaaacacagttgtccctcagtattcgccggggattggtcccaggacccccaggtgtacaaaaatccatgcatactcaagtttcgcagtctgccctgcagagcccacctgtatgaaaagtcaagggttccacatcccacaaatactctattcttgatctgctttgaaaaacattcccatatggggtggtggaccctcacagatcaaacatgttgctcaagggtcaactgtatatgccaggcagcaatatgcttcctaaagggactcattctgaagatatgtgatctaaaaattcactttttttttttaaataacttcaactgggaaaattccacgaagccagaccctgggctcaaagcccaggatcccagccacacatctcttaaaaataggttttcaaaatgccttgcattttttaaaaaagaatagcatatttgcctaaaattctagccaaaatgcttgatattcaccactctattattattttttgactaacttcttccttgttcagttctcacttcctcctcgcctgtcactaagctgagtcacaaagctgtcaacgctctgctgcttgccaggtagatgcaactcctttctccatttgtttatctcctgcaaagcggaataatttttctaaattcactcagattcccagtggcacacagtatcatgcagaacagttgtggaattaggaaaccaacaagaaattttgtacttcctgaaattttgtggttacttcaaatcatcatcctgtaaagataacaaggatgagtccctttgcaaagcaaaaatgctagttaactacaaaactggaatttaagtacggaaggtcaatttcaaatgaattcacaatgcaaaaatctttcagacacctgagaagtaacttgactattgaacactgtactcgtagagttaaaatagctcaagaagaacgcatatgcttctatttagtgtttttttttaatcctgttgcaaattctactattctagtattttcttatgtttaaaaatatcttaattctcatttactatccctggagcaatatccctggcaaattcttcataattccccatgagtcttccagcacagatgcagctttccaagtcaaaatttgtacaaacatcatctgtcaaacttctgcaaggtaatgacatactcatcctgagctgtcacctccccttgcagagactttgctaaaattcttagcatagcaaggactttcaaacagctttctccagcccattcactgtacaggtgaggacacggagaaccggtaacttgctttacttctacaaaaatgctacaatgcaaatttataatgctacggaaaagattatcctggcttcttcacttatgcattttctaataatctacagaaggcagagacagccaatgatgagaaataaaagctctctatttataaacacgtacctaagaagctactaataaaaaattctataaaaggaaaacgagaacactgaactctctatcatatttgaaaaagaaagggcagacatcgcacaattcaaacccagcttccagacttcagggagctctagaaacctgaccagcccacaacaaaagacccagccaccggactgggggttccacaaacagtcagccctcagagatcacccaacattggggctcagaatataagttttgcacatccccttttttgaattcaggaatgtcttccctgcccttaatcacaagcagacaaccagatatctgaggaaagctactaacgtggaagatagagaccaagttaaaccagaaaagcaaatcagaggacacagagactatacaagaagaaaattaaaatatatatatataccaagtacctcagaattacagtatccataaaacagggtgtgattttttaaatagttctagaaaacaaaaaacacaatagcagaagttttgaaaatactgacagaaggattagaaaataaagttgagaaaaatcttccaaaaagcagaacgagtccggaagggagaaagggggaaagggggggaagtagactagtccgggaggtccaaaaactgaaaagtacaattgccagaagaagaaaagaaaggaagctgagatatgaaaatatatcagtggaatctaagaaatatcccccaggaatgagtttctagattgaaggggtttactgagtgcccaatataatagttgctttttcttctaaacccccaagtcatggcatttgaaatttcagaacactagggacaaacagaagatcccaacagtttccagagagaaaaaactggtcacacaccagcagatacaaaatcagaatggccagatgtggtggctcacgcatgtaatcctagcactttgggaggccaaggtgggtggatcacttgaggtcaggggttcgaaaccagcctgggcaacatggtgaaatcctgtctctactaaaaatacaaaattagctgggcgtggtagcggcgcctataatcccagcaactcaggaggctgaggcaggagaatcacttgaacccaggaggtggaggttgcagtgagctgagatcgcgccactgcactccagcctgggtgacagagcgagactttgtctcaaaaaaaaaaaaaaaaaaaaaaaaaagaaatcagaatggtttcacatttcccattggtaacacaaagccagaaggcaatggagctcgcctccaaaaccctgaagaaaaatctacaactgggaatgctacactcaatctatcaatccaatgagaatggagaataaagatgttttctgcaatatctcaaaatttatctcccacacactctttgtcaggataagctcttccagcatggaagagtgaccccggaaagaggaccacatgagacacagcacatgggagaaaagtgaaggattccccagaacgaacgcgaagagggatcccagcatggcacttgtgtgtcccagacacggaactgcggctagagagccaagacacaatccccgagagttactctgtgcagtcactgtgctaagcagtgcacagacagcatctcatttaaattctacaataagcctggagatcagcaattattagctgctattatgggaattttaaagatggggaaagagtcagctaggttaatctccccactgtcacacagctttacatggcagagatgaaaattcaaacccaggcctgccacccttttacacctacacacgtgtccactgcaggattctgtgagataaaacagaaacctggaaatgtgaaggaaagaaaggaaacacggattaaaaaggcaaagaggacagacacaagaaacgggacacccaggaagagatgagcgatgggtgttatgctgttctgtatttatttcctattttaatgatttttccaaattgaaaaaggaaggggagaaatataagtgaacaggaggagaagaaagtaataagggggggaaatggaaagacataggaaaaagacatgagactaaggaatacaactggaatgacactctttggcattcagaaagtgtagtcttaaatagcatattctccctcgatgatgtgaagtgatacatctcattcattactaaatgttcaaatccaagggattcccaaattccttccaaccatcttttcggttttaaccaaaatgcaacataggctgggcgcagtggctcacgcccgtaatcccaacactctgggaggccgaggtgggtggatcacctgaggtcaggagttcgagaccagcctggccaacatggcgaaaacctgtctctactaaaaatacaaaaattagccagtcgtagtggcaggcgcctgtaatcccagctactcaggaggctgaggcatgagaatcacttgaacctggggagcagagggcgcagtgagccgagactatgccactcactgcactccagcctgggggacagagcaaggcactgtctcaaaaaataaaaaataaaaaaataaaaaaatgtaacataggccagaacaggcatgaactatgcgtgatgtgcttactacattcaggggttctagggcagtatggggcttgtctaactccatggactcctccacccataaaccaactcagatgtgtttgttcatatgcttttaaacaaataaaatgttttacacaaatgtaaaaccccacggagaaagaaaaaatataaaagtgtaatatataagttatccattccatagacctttacagaagctcaccttaacaatgctgttacttagatatggaaaactcatttgcctaacatctgcaaaactgctcagagataacaaacttaattctttttagatacctttcttaagagattaggcaataaacatcatttagttaataattttcaactaaagcaaatacattatataagttatacccaatagagttgaaatatccaattcagtaaaacaaactgttcagttaactagattaatggtagcctcattaacagatgttctgacttgatttgcgtgtttttcttacattttactctcatacaaaaatgtctgcttgccttacataaagatatacattgccttcaacagaacctaatttactttatcatgttttattctttactctcactttatcttagttacacaccatatgtgaccttcaaaaaccacagagagccaaggactatgagcagttcagaaatcccacggatttgtataattaaaaataatttttggccgggtgcagtggctcacgcctgtaatcccagcactttgggaggctgaggcgtgtggatcacgaggtcaggatatcgagaccatcctggctaacacggtgaaaccccgtctctactaaaaatacaaaaaattagccgggtgtggtggtgggtgcctgtagtcccagctactcgggaggctgaggcagaagaatggcgtgaacccaggaggcggagcttgcagtgagccgagattgcaccactgcattccagcattccagcctgggtgacagagcgagactctgtctcaaaaaaaaaaaaaaaataaaataataataataataataataataataattttacaacacctataggctattgatctgagttaataattaaagaaatataaaagaacatggtgctgaagtataatatttcatctactgaatcacaaatcttgaaaagaaaggccaatatccaatacaggtgaaattaatacaactgtaactattttgtggcatgataaatttattacaaaccatttagaacagtttgaatatatttggatataaatataaaaggtttgcatataaatataaaaaacatctaagaagtgttgttattttattcagcaatcttcctagaattaggaaaaaactgaaaagaaaaagaatattaaaaaatagtccctacaataattattataagcagcctacttaataaaaagggtaacggattaataagtaaattatattacatcaactccacatattatgctgccacagtagcactgtaaaatggtttaaagcatttgatcactttgtatttaatctattcattaaatttttttgatataaaaaaatttaaaaaataaaagtcatgcgtaattctaccattaagagataactacagctaaaactgttacactttttttactgtgcaacacatgcatttatggcagagttactatcatcctatatatgtagttttattgttaaatattttggttgttttcagtattttacaacactacaataaatatcactgtgcaaatctcagatgattttcttagcatacattcctaaaaggagaactattgagttaatggtatgagtagtgtgccaactggtactcccataagtgagtgagtgtgggtataatttgtaatattttttaaaagaacagactgcaattttttttttttttgacagggtctcacgctgtcgtccaggctggagagcaatggtgtgatcatggttcaccatagcctcaacctcccagacaagtgatcctcccacttcagcctcctgagtagatggaactacaggcaagtgccaccacacccagctaattttttttgtattttttgggaaaacatgaggtctcgctatgttgcccatggtggtctcaaactcctgggcccaagtgatccacccaccttggcctcccgaagtcctgagaccacagacatgagccaccgcacccagcccagattgcaaatttttagaagtgctatagcgcgtatgaacaaaaactagaatatacaagtaaccaagttttaaaatttcagttaggccaggcacagtggctcacacctgtaatcccagcactttgggaagctgaggtgggtggatcatggtaaaacctagtctctactaaaaaacaaaaaattagccaggcgtggtggcatgcacctgtagtcccagctacttgagaggttgaggcaggggaatcgcttgaacccgggaggcggaggttgcagtgagctgagatcgtgccactgtactccatccagcctggcgacagagcaagacttcgtctttcaaaaaaaaaaaaaaaaggaaaagaaaaaacatcagttaatgtgtagccatattgctttacagtctaaatgaataacttctgggctagcttcaacggacgccatcattctcagattttagccctcaagaatagaggctccctagtttgctttttgtttttgaggcaatagagtctcactctgtcgcccaggctagagtgcagtagcgccatctcagctcaatgcaacctcccacctcctgggttcaagtgattctggtgcctcagcctcccaagtagctgggactacaggcgtgcgccaccacatctggctaattttttgtatttttagtagagatgaggtttcactatgttggccaggctggtctcaaactcctgacctaaaatgatgcatccgcctcagcctcccaaagtgctgggattacaggcgtgagcctctgcacccagcccaaggctccctagtttgattcacaccacataaaatgcctctctgacccacagctaaattcttagtgtcatggtattttccctccagaacacagagtagtaattctgacttaatgacctttctgcaggaacgccactcgtggcagcaacattcctttcctttaaagtggcttttgcttagctgtgaccttagcatttcatcctaacccaggtgaggaatataaagtcattcattataatattctccctcaatcacttgagtccaggaggtcgaggctgcagtgagccatgatcgcaccacggcactacagcctgggcaacagagtgagacccttaatatacatacattctccctctttgtttatgttggaaattttttataataaaaaaaatttaagtacattaagttttaaaacaactcatagcaaaggaatgttcctaagaagtgccatctaattttgtaagtacagtcatgccctgcataatgacgtttcagtcaatgacagatggcatatgccacggtggttccataaggctataaagagctaaaaaattcctactgcctactgacatcatagccgtcataatgttgtgcaacgccttacgtgtttgaggtgatgctggtgtaaacacacctgcgctgccagtcatataaaagtttggcagatacaattacgtgcagtatataataataatgagaataaatgaccctgttattggtttatgtatttactgtactttttatcactcctttagggtacactccttctacttacatgtattttttaaagttaactgtaaaacaaccccaggcaggtccctcaggaggtgtccagaagaaggcattgttatcacaggaggtaacagcttcatgcagttactgcccctgaagaccttccagtgggacaaaatgtggaggtgcaagacagtgatattgagaatcctgacccttgtctaggataatgcgtgtgtttgtgcctgagtttttaacaaaaaagttttaaaagtaaaaattgaaaaaaaaaaatttagtagaaaaatgtttacagagctgggcgcggtagctcacgcctgtaattccagcactttgggaggccgaggcgggcggatcatgaggtcaggagatcgagacgagcctggccagcatggtgaaaccccgtctctactaaaaatacaaaacttagccaggcgtggtagcatgtgcctgtaatccctgctactcgggaggctgaggcaggagaactgcttgaacctgggaggcggagcttgcagtgagccgagattgcaccactgtacttcagcctgggcgacagagcaacactctggctcaaaaaaaagaagaaacatgtttatagaatgagaatataaagaaagaaagtatttttgttcagctgtacaatgtgtttggttttaagctaagtattattatgagtcaaaaagtttttttaaaaaaagtttatcaagttaaaggtacagtaacctaaggttagtaatttactgaagagagaaatatattttaaaaataaagttagtgtagccttcatgtacagtgtttgcagagtcgtaggacacacgactgtccttggccctcccattcactcaccactcactactcacccagtgcaacttccagtcatggtaagtgccctatacaggtatttcaatgcttatcttttattctgtatttttactgtaacttttctatgtttagatacacaaatactcatcactgtgttcaaactgcccacagtatcctgtgcagttgcgtgccacaggggtttgtagcccagatgcaacaggtgatcccacacagcctaggtgtgcagtgggctgagtgcagtgggctgtgagcctgggttcatcaagcacgctctgcgatgttcgcagatgacacaattgcctaaggacgcattctcaggagtatccctgctatgcaaagcctgactgtactccctgttataaccatgagctgttttccacagcagcatggtcatcactatccccagacaccaccaaatttacatctactcagagaaataattatattcaatttaaaattttaaataagtactacacaaagatactctggaaggtcaaaagccgcatcatccttggcctgaggaaatcaagatgatcacagggctgtgcgggagaccagtagtgccaaaacacaaggtccagtaacacactaagacgaatcccaggaagacagcgggaggacatcgcacaacgtctcagtgcacaccattcagccactcttttctcacccacacactgatgccaacttcctgagtaacattccgagtaaaacgtgcacgactcactccagacagtccacttagtgtccacccacactcacgtggcataatggaaaggacgcctgctaggaagtcagccaggcctggtttcccatcccatctctgccaccgacttgctgtgagaccacaggcaagctgcgagccctgcaaagcagagatgacgcttctcacctcagcacttagtatggcacctggtgtggcacaggcacgcgatgagtatctgttgagtgaatgggagggtggcggaatccccgccgtgaagctgcctacacgatttcaatgggagcctcccactcccccgcccccacgcctcccttcccttctctttctatgggtctctgccttccctccctcagaaacgtgctagtcccatggcgttcataattgttctttctaaatacattccaaatcatatttctttttttgtttgttttgttttgttttgagacggagtctcgctctgccgcccaggctggagtgcagtggcgcgatctccgctcactgcaagctccgcctcctgggttcacaccattctcctgcctcagcctcccgagtagctgggactacaggtgcccgccaccacgcccggctaattttttgtatttttagtagagacggggtttcaccatgttcggcaagatggtctcaaactcctgaccttgtgatccacctgccccagcctcccaaagtgctgggattacaatacccagtgtgcctttcttcattcattcattcaggagcctggctgtgctctagacactgcgaacacagcattaagtaggctcggcgttgggagcccgctgtgatacagcccgtcggctcatggaggagctgaccttccaccgggcaccatgggcacagggccttgggcccacagcacttttggggcccatgaaaattgtttgtttccacaatctcagaagaaaaaacatgaactattaggatgaaaaaaatgttttactatatagtattaatatttcatttgcataccaatgcagttgtaaaatataatttgtaatatctttttaatgaaggaaggggcctacagaggcacagatgcctcaggctcatgagtgtcagatgcagcccaaggaaacacatgctaaggatggaatgcaaaggagccagcgagtaagattcgagaagggcgtttcaggcagggagcatagctgctgcacaggtcctgaaacagggcgacggccataacagtgcgagggaaacaggtgacatgacaaaggccgggtgtggccacatctccaaggcataaagacaaagtgggacacagttaaaaatgatacgggatttaggccgggcacagtggctcacacctgtaatcccagcactttgggaggccaagtgggtggatcacttgaggtcaggagttcgagaccagtctggccaacaaggcgaaatgctgtctctaataaaattacaaaaattagccaggtgtggccgggtgcagtggctcacgcctgtaatcctagcactttgggaggctgaggcaggtggatcacttgaggtcaggagtttgagatcagcctggccaacatggtgaaaccccatctctactacaaatacaaaaaattatctgggcgtggtggtgggcacctgtaatcccagctacttgggaggctgaggcaggagaatagcttgaacccgggaggtggaggttgcagtgagctgagatcgcaccactgcactccagcccgggtgacagtacaagaccctgtctcaaaaaaaaaaaaaaaaaaaaaaaaataggcaggtgtggtggtgggcacctgtaatcccagctactcaggaggctgtgacacaagaatcactcgagcccaggaggtggaagctgcaatgagccaagatctcacaattgcactccagcttgtgtgacagagtgagactttctccgatgaagaatataactttctctgatgctattgaaatgcctcctttcaatagcgatggaaagtggaagagtaccaggagtagttacaaggtgtagatttccacataattgaacttgtccaactcctaaaactgtttaataacggacagtttagtgaagtaacaaactttccatctcttacatccaagcagaggatagaagccaaatgtcaggaatcttgcaaagggaaccctgcataaaaaggaagattgaacaagaggacaatcaaggtcctatccattcctacaggcctaaattagcatcttctgcatggaagtcttcaaagggaagcagaggtttcctgcaagtggggcaaattaaactacacgagaggccaggcgcggtggttcacacctgtaatcccagaactttgggaggccgaggtgggcagatcacctgaggtcaggagttcaagaccaaatggccaacatggtgaaatgctgtctctactaaaaatacaaaaaccagccgagcgtggtggtgggcacctgtaatcccagctactcgggaggctgaggcaggagaattgcttgaacctgggaagcggaggttgcagtgagccgagatcacaacagagcgagactctgtctcaaaaaaataaaaacaaaccacatgagatatgaccttaccccaatcagaatggccatttattaaaaagtcaggaaacaatagatgttggcatagacatggtgaaaagggaacacttaaatactactggtgggataataaattagtacaacctctatggaaagcagtatagagatttctcaaagaactaaaagtagatctgccattcaatccagcaatcccactactgggtatctaccaaaaggaaaagaagtccttatattaaaaagacacctgcatgtgtacatttgttgcaacacaattcacaattgcaaagatactgaatcaacttcagtgctcatcaatcgatgagtggataaagaaaatgcgatgtgataacctgaggtcaaaagttcgagaccagcctagccaacgaaaccctgtgtcaaccaaaaatacaaaaattagccaggcatggtagtgcatgcctgtaatcccagctactccggaggctgagacaggagaattgcttcaacccaggaggcagagtttgcagtgagccaagattagacgactgcactccagcctgggtgacagaggaaaaaaaaaaccaaaaaactcaaccttgtaaaaataactcaactcttacctttgattatggcatcctgtaatgaaaattttaaatcctatatattctaaaggttttactttttaacttctggatattagtcttacttaaggacttcccagacaggtgtgatggatcacacctgtaatcccagaactttaggaggccaaggcgggtggatcacttgaggttaggagttcgaggccagcctggccaacatggtaaaaccccgtctctactaaaaatgcaaaaattagctgggcctgatggcacttacctgtagtcccagctacttgggaggctgagacaggacaattgcttaaacctaggaggtggaggttgcagtgagctgaaatcacaccactgcactccagtcagggtgagagtgagaccctgtcacaaagaaaaaggaaggacttccctaccacaagtttgttattataatatatatgaagaatataaacttttaaatatatggttaagttctttaatccatatgaaatttattttggatagattttgggatggaaatttatgctaacaaatttagcatgaggtaaaaaactttccctttttttttctttaaaaaaaagacagggtcttactttgtcacccaggctggaatgcaatggcatgatcatggctcactgcagccttgaactcccaggctcaagtgatcctcccacctcagcctcacaagtagctaggaccacaggcatgcaccaccatgcccagctaatttttttattttttgcagagacagggttttgctattttgcccagactaggctcgaactcctgagctcaagctattggaccacctcagcctctcaaagtgctgggattacagatgtgagccaccacgcctggtccctaacataactttcttccaaataactggccaactgtttcaacctttttctgtgtgtgtgtgtgtgtgtgtgtgtgtaaacagaaaagtaaaatttctattttcatttgcaattccttttggttttcttttccgtttgtttgctttttgagttttttgtgatttttttaagttcagaaataaatgtgcagttttgttttataggtaaacttgtgtcacagggtttgtagtacagattattttgtcactcaggtactaagccaagtactcaatggttattttttctgatcctctccctccacctgccttccatcctcaagtaggccccagtatctgttattcccctctttgtgtcatgagttctcatcatttagctcccacttataagtgagaatgtgaggtatttggttttttgttcctgcgttagtttactaaggatgataacctccagctccatctatgttcctgcaaaagacatgatctcgtgcttttttgtagctgcatagtattccatggtgttgttttttttttttttttgagatggagtctcgctctattgcccaggctggagtgcagtggtgcgatctcagcttactgcaacctctgcctcccaggttcaggcaattctcatgcctcagcctcctgagtagctgggaatacaggcgcgtgcccccacagctggctaatttttgtatttttagtggagacggggtttcatcatgttggtcaggctggtcttgaactcctgaccttgtgatctgcctgccttggcctcccaaagtgctgggattacaggtgtgagccaccaggcctggccacattttctttatgtaatctgtcactgatgcacagttaggctgattccaagtctttgttattgtgaacagagctgtaatcaacattcacatgtgtctttatggtaaaatgatttatattcctttgggtatatacccagaaatgtgaaaagataatctacaaaatgggagaaaatatttgcaaatcattcatctgatgagagtctagtagccagaatagataaagaattgttacaactcaacaacagaaagacaacaactcaactcaaaaatgggcaaagcaagaggtcaaggcggtggtgagctatgatcacactgctgcactctagcttgggtgacagagcgagactccatctcaaaaaaaaagcttttttaaatgggcaaagcacttaaacagtcatttttccaaatcagctatacaaatagccaaccggcacatgcaaacatgctcaacatcactaatcattaggcaaatacaaatcaaaacaacgagataccacctcacgcttactaggatagctactatttaaaaaacaaaataacaaatgttggtgaggatgtggagaaattggaacccttgtgtatgggaatgtaaaatggtccagtctctatggaaaacagtagggcagttcctcaaaaaatttttaaaaaatttccatatgatccagcagctctgcttctgggtatataccgaaaagaactgaaagcaggctctcagaaaaaatatttgcacactcatgttcatagcagcattattcacttgggtctgttgatctgtccatccacagataaatgaacagtggcctatacatacaatggaatattatttcgtcctaaaaatgaaggaaatcctgatacatgctacaatatggatgaaccttgaggatattatggtaaatgaagtcagtcagtcacaaaaagtcaaatatcgtatgattccacatatatgaagtacccagaatagtcaaattcctagagacagtggagcggtggttgccaggggctggtaaatggggaaatggggagttacgtgttcaaaggatgtagactttcagttttacacaatgaaaagagttatggatgggtggtggtgatggttgcccatcacatgtatttaataccactgaactgtacacttaaaatggttaagatggtaaatttcatgttatgtgtatttcatcacaataaaaaacaattttttaatcattcttcctccatggattttaaattttgtccctatgacatataaattcctatacctcacgtgtatacatgtttctgagctccattctgtttcgtttattctatctcggcatttttcaaacaataaggcacaatccattggtggttcctaaaataggttgaatagattataaccaccattattgttgttatcttctaatgaagtagaataggatagaaaacagaatacgtctaacatagtaaagtattaacccatgaaatttgtttatatacatacatatgtataggtggtgttggctgaattgtaaaatacatttgttactatggatttgtagctcaaagtttaagaaacactgctgtaattatccctatgtcagtattatcccattccaactacttcatagcaataaaatttataaagtgttttaatgtctgatattaaaataagcaagcaactcccttccctccccacctcttatctttcaaaatttttcaggtaaacttaagaatcagcttatcaattaaaaataatacttttgatattccaattaggatgtatttaatgtacagattaatttgaatgtaactgacatctttgactgaattttcctatgtagaaatatagtatttccttttattcagaaaaggaaatacatgccatatttctatttcagtagttttatgatttattcacaaaggtcttaacatgtatcttgttagatatgtccctaaataattgaagtctatggttgatatgggaatgagttttgtttttgtttttgtttttttgtttaagagatatggctcttgctatgttacccaggctggtgtcaaactcctggcttcaagcaatcctcccacttcagcctcccacagtgctgggattacaggtgtgaggcactgtacccggccctgagacttttgagataatttctaactggttatttcaagagaacaaagataatattgatttttacatatcactcttataaccagctgccttaattaagtctctaatcagtcctaggaggttttcccccatttattgttacgattttctggtaggctattatgacatctgaaaattatagtttttcctatatcttttcagtttttatatatcccttttttaagaaaaatcactagctagaacgtcaagttcaatgctacttgagttgtgtcttgctcctaacttaatctgttccaccattaaacatattcattgtaagtttctatcagatatattttatcaattaaagacagtttcttttgatttacatcttattgtttttatcacaaataggtgccgaatttcatgaaatacttttttagacttctgtcataaatatattaatttttcctttaatctgttaaagtaatataatttattacattacaaaagttactattattgaaacatccttgcattcttgtgatgcaaatggcttacttcgacatgggatatgttactctttcaatataattgctagcctgaattttatttaactttgtactctcatatctatgtacttgattttatatacatacaactttgtgttttatttggctttagtatcatgttatattagcctcacagaaagaattacaaagtgctctatactataaaatagtcttataacatagggaaatctgtttctttaggatttggtaaaattcacctataaaaccatatgggcctcacatctctgactacttgttaaatttttaccatgattattgaccaatttaggtttttaacctctttctgattcaaacagaatcatctatttcatctacattttccattttttggttacatgtgcatatatttgtatagtattctcatctatatacatagtaatatcccttttcttgtttcatatatgttctataattatacattttgttctttttcttaatgaattcaccaaaggtttgtttaatttattgatctattttagaaaacagtttttggttgtcagtttttggttgtattttttaggtttattggcttatcttcatttataaagataaaagtagactgggcgtggtggctcatgcctgtaatcccagcactttgggaggccgaggcgggtggatcacctgaggtcaggagttcaagaccaccctggtcaacatggtgaaaccccgtctctacaaaaatacaaaaattagccgggcatgatggtgggtgcctgtaatcccagctactcgggaggctatgacaagagaatcgcttgaacccgggagctggagggaggttgcagtgagccagtatcgtgacactacactctagcctggggactgagtgagactccatctcaaaaaaaaaagagagagagagatcaattttttttcttttggagggattgaggagatactggttaaaaaatacaaaatttcagcacaatgaacaaatgttcttaactgaaaacagaggaaaaaagttttcttctttctgctttgggtttgtcttgtagtggagggtgttcctttggctcacttacttcccatttttctaataaatgcatcttcttttcaatgtttcttggcctcagcccaccagaacatgcatctgatgcatgttaagactctggggttgacctccatgcctgttcctttcctcgtcccgcttcctatctctgactttttgatcgttctgcaatgttttgctctctatcttccagaccgctaatttggtctttaattctatttgcttctcaagccaacctagttaaccttttaagttcaatcaccacatttttaatgtccatgaactttcttgttctaaaagatcttttttcacaacaggctacttagattcactatacagcagctcaaatctctttgaagataccgactaacatgtttttggcttctgctatgcgccccaaagtctgcttactctgggctttttctttcatactatttattctcctcaaatgtctggtgatcctttgatgtgcattcacactttggaataaaagactgggccaatcaacaagggaaaccactgcatgcttccagtctggtattaacgctctcctggggaaggccagctacctgcaggctccgtgtaagaggacagaaagtgtccaatgatgggctttgctttaaggtatacaagtaaacaagcacggaggcagagtgggggacaaacaccaaatctgccaaaacagtctctcctccagtggcgaaggacgttcacagataccgcctgctagagggcctacatttccttcccaggacccctgttactgcaggagcccgcagggatctgacactctgctcggcttctctctcaggccccaacaccccctcaaggatccctccccagacacagttctcagtttttagccagagaccattgtataaatgtaatgcttcgatttcctaaatattactctagggccccttcctgttggtggttgttagtcactgtaaactcagcttttaatcccccccttttcttttgcacctgtgttttgagttacaattgttttgtttttgttttccttttgtcaatataatcccatctgttttcagtcttccaggaattcttcataacttttagtttaatagaggtaggcatcctttcaaattttctaatactattacagatgttttaaaatatttaccttttgttatttaaaaagatttttggcaagagagaagctggatgcatgtgttcagtctgccattttactcctaaaaatccagattgtcctcctgaatgcctaaatacttttttctaatttaaaatgctttattcaaagcaccctaaactagtacttcgctaggaaactgaaaaatattcctcttaattctgcttgctagtgaacagaacagactttaggcctcttgaattcattttaaaagtaactacagtccagttaaacaaggtaaggtccacaaaagaaaagacgtttaagcaacattttccaaagagagaaaaaaaaacacatatatgtaaggtttgatgagacaggcagtcctagaaaaacaaatggtacttcaccagatttcaaatgtaaagatttattcatttacaaggaatcaaaagtttgatccaataaaaaggcagttacaataaatctaaagccaatgaggattaagtttgattttttcaagcttgatttgatttctataaaagtataaaccccaaatatattgcttctacacattatatgcacatcagatgccaagtcaacgagtatttcataaatgtataacataaatatttaagaaagcaaaagagtataaagaaaagatgtggcctttgtcttttaaaaacagaaaatctgaataggaaaaaactatacacgtatctaaatctccacacagagataatgatagacgtagaagatggtgtcatgttacatcccactttttcagctcttacagaattgctacagtaattcacaagtatggtgagggagggagagtagctgaaacaggttgttgttgttgttgttgttttttatctgttattttaggttttactaatggaagtattgagactagaacaaaaagcacatactagatagatacttacctgaccaatcctggcaagaggactattgtctcactcacatggaattttaaaaatctgaaagtcttacataaaaatccaggtttccagtttgtcttgagtagtcagaaaagctgacaaatccagccccacattcctatgggaaatcatcagctggtgtgctggtaaacgttaacaactggctctctatagaagaaaaacaaaagcaaaagcccctgatctgtatagcatttgccatggtgtaaatacacccatcatggctgatttcaagctcccaacgtgatgcctggaaatgacaggcacaatcagctcatggacaacagtggccagagctgagtggtggctgccccttggacaggagttacgggccttccgtcctcactgctccctatagtcttacagtggctgctacctgcactggcaccagcccgccccacccctttctctctcttcacccccaagaattcctgagccagatccaagctggtggtagtgctgggcacaatgtcctcctaatcctcatcagaccacatggaaaaatcattgcttaggtaccacattttaggaggggcactgccaagcctgagtaggtaaagacagcaatgagctcagaagacatctccaacacaggatggctgacagcactggagatgttcacaccagatactgaccggggcagtgactctcaaagtggagagagaagagatgatgggtagggagaagtgcaccaaatgaaaaaaaaaaaaaaaaaagaactacttcatccaaaaattcttgactctgatatgttaaattcaattgcaaatgacattaaccatccacaacacttttatgtgtattaaaggaaaatatggatctctaaggattgtgaaacatttgtttaaaggaaacagtcaccctcctcaagtgtctaaacagctattcagtggaagaatctattttcagcatccattatgctaattaacaaggcatgttattttcaccagtggatatccaatttctaacatttattatgctaatttgatctgatataaaactataaaaatagcagagacactggtagtagctgtctctggagggcagcccttctgattaaaggccagatgtctagccctggatgcccccacttagagaatggcttaaataagcacctaatccacctgatgttttatgaagccttttgaattagaatagactactgggagatggtattttttgatgtcattgttcacaaaagggaagcaactgaaagcgccgacttttagaaagaacagaaacatcagtgcttattttaaacctaatgggagcttaggaacatggtccagtcagaggaggagcgctcccctgtggtgcctgaagcactcgactgtccacagctgccgacactcacctgggaactactgttctgatgatcccagcagcaacgcacaattcagtgcgccagcaccaaaggaggaaggaagacagaggtttgtttgggttggtttttttgagggggggtggggggatgtttattttactttaatcttgaattaggcatccaacttctcctaatttttattctcttaattttttctctgatacctcccccacccagtctactgcaaaggctcttgctataagaagtaatgaaaataggccaggcgcagggtctcatgcctgtaatcccagcactttgggaggctgagacagcggagttgcttgagcacaggagttcaagaccaacctgggtgacgtggtgacaccctgtctctaccaaaaatacaaaaaattagctgggtgtggtggtgtgtacctgtggtcccagctactcgagaggctgaggtgggaggatcacttgagccccagggggcggagcttgcagtgagccaagattgtgccactatactccagtctgggcaacagagcaagaccctgtctcaaaaaaaaaaaaagtaaatgaaaatgttttgtaaactacaaagtattatcaaatagaaatagtattccttggaatttgtacattattagtagcaacagtgatctttaaaatgagtcatttctgctagtgtttaataaattaattccttagagataagcctccctgcaggggctacttcattaccaataaatgtttactaaatgcccaccatatgcaccaaatggtagacgattggaatacaaaagcagaagggagcaggattctcgtcctcaacaggcaaggatctgctatagactcacaccatccttcaagtctggccaccctccccatgacactcccttctatgttgcctctgggttatcttgtctctaattaaacactttggcaaagtgggatctcgttacctggggaagcagcccttttcccctgaatcagttcctttccttcagttagctgaggtacttactgggaaagaaaactccatacatatgaaggggagtcctgtggcagcgtgcacctgagccatcacacacacaagagggcagagccatgaacgggggatgaaggactgtccccgagcacacgctaccacacgtcctgaacgtacggctggttacagctagttaatattttggaaatgctattttattggctaggaagccttttccaaatgaaaatctctttactgatagattagtgaaggtagtatagaggagttttattttgtttttgtttttttaatcagcagaaaagtctttcccgtcctctgggcagacagatagcagagaattacgcgcttaggtttcacagccaggctgcttccgttcaattctcagcactgccacaaccagctaagtgtacctgggcaaactacagaagccctataaacctcagtttccttatctataaaatgggactaattatagtacctacttaataggggtgttctgagaactgaatgagatgatactgtaatccttcaactgaggtccccagacaaatgctcaggagttcatgagaaatttttacttttgttatttcatggagaatcttttttaaaatttgacataagcatcctctgaatcagatggctaggtgctatgtcaccaagtattgctgtaagatttcagtgactatgtttgtatttttctggtctaatgaaaaaaggggtcaggcgcggtggctcatgcctgtaatcccagcactttgggaggccaaggcgggtagatcacttgaggttaggagttcaagaccaccctggccaacatggtgaaaccctgtctttactaaaaaatacaaaaattagctgggcatggtggccagtgcctataatcccagctactggggaggctgagtcaggagaattgcttgaatctgtagggcagaggttgcagtaagccaagattgtgccactgtactccagcctgggcaagagtgagacactgtctcaaaaaaaaaaaagaaaaaaggacagagacaaacccaatatataactgaggcatttgcactaagaaatagtcaaattatgtcaccacaacctgtatgatgaaaaattttacaagagtttgcaagatgaaagtggaggggaaattgcattagccggcaagtggcatgataggtagactaacattacagaaccaaatccggcagactggcagcatatgccacagttgtggaacagaggtttggttgcagcagatcttcatctgttgtgtcacggctagcttttattggctatatttagtttataaatgtgtattctagttatgaagttgtaaagaaactgcaagcataagggccaggcccatttttatgctttatatattcaagtaacataataaagataatcatattgtacttacgtaagggaatgttctcattcttttttttttttttttgaaatggagtctcactctgttgcccaggctggagtgcagtggtgcaatctcggctcactgcaacctctgcctcccaggttcaagcaattctctgcctcagcctcccgagtagctgggattacaggcgcctgccaccacagctggctaatttttgcatttttagtagagacggggtttcaccatcttggccaggctggtctcaaactcctgacctcatgatccacctgcctcagcctcccaaagtgctgggattacaggtgtgagccaccatgcccggcccaggaatgttctcattcttaagaaatgcacactgaattctttaggagtaaggaggaatgatactggccacttactctcatatagaaaaataatacccaactatatatacatacctatgtgtgtatatatatataaaacatgtaccaaaagacagagagaacatgtgcatgatgaaggaaataggggtagataaaaacaactggtgaatctggttaaaggacatgtggtagccaaagaactatagcttctcataactagaaggaatgcacttaaaagttcagatccagagttcccctaggaggatcattattagaccagtgattcgtgtggggaaagggacctgatgtcagatgcacctgggaaggctttgtcagaatgccagcaagtaccccgtctcctctctgaggatcgcggatagcagcgagccactcttatggatgaaaatgcacggcacacccctctggtattttaggatatgaaagtaaaaatcactgatgcagtgatcagataagcctccaaactatccgaaatgatcacagaaggaagtacttaatgaacactacagaagagctggcagaaaaacgatccaaaggccatgttatattgagcattatttttagacttaacttttctaaagtgcaactttacaaaaccaggagtcctcgaaatacatagagaaacagacagacataggcgacaaaacaacaactgcatttcccgtttgggctttcctgatgaaattctcccacagttgcacacacagttgctagaaagcaagagtacagtgctctttccctcactaagggaaaaccagactcaacaccaagactccaaggggaatgggcaggaatgacatcagtatgttgttctctttccagggcaccagaggacttggcactctgatcacaagtaaacacaactactccattagaggcagttcctccctattctaagcctttattattcctgggttttagagtcagtactccagaaaatggtcactccctttggtgaaacctatttgtctccctcctgtgctctggggcatgcctgcccctttgctgtaccatgcctcaatcgagtccaccttgtagatgctgatctactccggcatgtctgaatattaccggctccttttattttcatggcccacgtggcagtcagatcatcccagtgcatacaacggaggagccaggagtaaagtttatcacacgaaggagatgtaaaccaaatcatgttttttcaaactgtcggttccaatgtgttagtggatcctaaaatcaatgtaaggagccatgactcaacttctatttaaatagagtgcaaagaccagaaaagacacatcaaactgcactgtgcaaagtaagggtaaccattgtctcctctttttatttttttaaacatattttagagacagggtctcagtcgtcgcccaggctggagtgcggtggcaccatcacagttcactgcagcctagtactcccaggatcaggtgatcctcccacctctgcctcccgagtagctgggaccccgccgggtatgtgccacccatgcccacctaatttttaaattttttgtagagatggggtctcattttgttgcctacgctggtctcaaactcctgggctcaagtgaccatcccaccttggtctcccaaagtgctgggattagaggtgtaagccaccacctgagccagtactgtctcttaaaacttttggattggttatctcagtatatgtatatgaagatcacaatatgaaatggcttttttgagatggggtcttgctctgtggcccaggcctgagggcagtggcgcaatcacagctctctgcagcctttaactcctgggctcaagccatcctcctgcctcagcctctggagtagatgggactgtaggcacacaccaccacacccagctaattgtggtttttttttttttttggaggatgaggtcttcctatttttcccaggctagtctcaaactcctgggctcaagcaatcctccctcctcagcctgccaaagtgctggcattacaggcatgagccaccatgcccagcctaaaatgcttttttactgtgtgccacagtcaaccatattcaaaagccacagtattagatgctgagagaaaaggagagagaaagagacagaaagatcaggagtgggcccagctgaactagtcacaggagcaaaccccataagaggttcacttggctgatgcagaagccgaccagaagtcaccatgatcttgaggaaagaaatcataagagaaaagagtatatgagtgcaactaaacattacgttatcattaagctgacctggtttgctttcctttttttaaggcaaatgtagactacagcctagaaatataaacatattccatacaagagggccatgtgtccccattataataaaagcttgggttcttaggaatgcttacttgaaaggagtatggtaatcaatgcttcatcaattagtcaaccttcaataatcatctccaaacaaggagttagtgaatttcttggggcagatgcaaacgcaacccctgcaaaagctgctgtccttgccacatcactcacaccagccccatccagccttgctgatcatctgcatattcattcaaaagcactattccctccaccaaaaccctcaaagttttaatttaaagttattttaatctaagtgaggaagtcagcggatgcaattagatcttaaaattagaagatatggttaccaaacttaaccattttgtaaacattgcaataaaatggaatatcatgttaaagacatgccaaggtgttgttttatacattagcaccaagcaccttgccctcccattttcatcaatttaccctatgaagaaacagctggaggctggcacagtggctcacacctgtaatcctaggtgtgaggattattttgggaggccaaggcgggtggattgcctgagctcaggagtttgagaccagcttgggcaacatggtgaaacccctcctctactaaaatacaaaaaattagctgggcgtggtgacacacgcctgtagtcccagttactcaggaggctaaggcacaagaatcatttgaacccgggaggcagagattgcagtgagccgtgatcgcaccactgcattccagcctgggcgaatgagcaagactctgtctccagaaaaaaacagctggaaaaaagctgggacttcccagcaccagtattaccaatcactgaaaggagaggttcctcaagcacaaggaagaacagcaatctcaagttgtatttccattcagtaccttccagggttaccctagacactgattacatcaatgtctcatgagcagtggaatgattattttaagtaaatttatcccttccaggccatccagataagcaactattgtgttactacaaaaccaccattttactatttattttagctctacagtgtactattgaaatatttcttttattctccactagtagacatactgaagccttaatactatcaggtattatagactcaagtcataataggtactgttcccttcaaaatgctgaaacaataacatcctcaaaaatccccaagttttcagttctccaggagcaaaggaaaagagaatcatttaggtcaccttgatgagctgggaaactgatctcaagtagtagaacatttttctgtttgtaataagaggcccaaatcagattacattcacaaggcttttttaaagtgttgaggagaacgttaacctcccctaaagtctgagagcaatttacaacaaaagctaaaatagaattaatgtagggcagagaaagctgagtcaggctgaatcagcccaagtaagtctaagaaatccactgaaagacatcgaaacctaatgttcaactttgtctataaattgtatgacttttcacacacttacataataatacataactaatgaattaggtaacagaaaatacaatgcctggttttcgagctcagcatacttgagagtggtacacataacacaagagtaagaaaggtttcccaaaaatgttaataataattgaagacatctttggacttttttcctctcattcaaatgtaaaaaatgatcctaagaagctgaaaccatgatacagggattctagaattatgccagcccatctctaaagcaactggagtcatttgagtcaaaagaatgttcggctaggcatggtagctcacacctgtaatcacagcagtttgggaggccaaggcggatggactgctggaggccaggagtttgagaccagcctgggcaacatgatgaaaccccatctctacaaaaaaaagaaatagaaaaattagctaggtgtggtggcacacgcctgtaatctcagctactcaggaggctgaagcaggaggattacttgagcctgggaggcagaggttgcaatgagctgagatcatgctattgcactccagcctaagtgacagagcaagttctgtctcaaaaaaaaaaaggagaatgatctaggataaagtctacagtctattttctgattgttagagccttataagcgaatttatcctcattcttcaaaaacaccaatgggctgtgttcaacacagaaggaaagtaagagttcctctttcccttagcagtatcgttttgtttctccgaaaacagctctcccaaaccataggttccaaagggagtcttgcatctacattaccagctgtgcttgtccccacttctatacattttacagccataagcgtctgcacacaaacatattcatgagtcccatgaaggcaggaactgtcccttctttatctttatatgccccttatatataagggttcaatcatcactcactaaattggaaactaggtaggcctccaactggaacagaatgatcaaaagaggagacaagaaagtctttactctccccacttaaagacacaaaaggttaccctgaggtaattatttctatttttcattgtataaacagtattttgttttattattcctaactaaagttgggcattgtaaaagagagaaattcaaactactaccttatataaaaacttctaaactgactatattggcgctcaacaaagtctgcaaatagctattcaaatcagccacttctccagggtcgtcactgctccctacagtcttacagtggctgctccctgccctggcaccagcccgccccacccctttttctcccttcacccccaaaaactcctgagctagatccaagctggtggtaggcctgacacgatgtcctcctaatcctcatcagatcacatagaaaaatcattgcttaggtaccacattttaggaggggcactgccaagcctgggtaggtgaagacacagcaatgagctcagaagacatccccgacacaggatggctgacagctctggagagaggtgatatgcaattgtagaaagtcatatttcttgcaatcttagaggaataaaggagttttgttgttgtttaggtaaaaagccttcggcctgagctgcctctcccgagctccaattcctcagattcccatttaacatccttgaacttcaatttctttagtaaggaataattatacctcaccatcaggtggttatatcctcacaacaatcaaaagctaagtaagtgtgaattatacaagaggttgaaaaaaccttactagatacctcacgcaatcactggtagaatgatgatcttgtaggggtggtggcaggagggtgggaagacacagacgcatgatgataaggtttggatatttgtctcctccagatctcatgtaagaatgtgatccccaacgttggaagcaaggcctagtatgaggtgtttgggtcatgggggtggatccctcatgaatggcacggtgatgagtgagttctcactctactagttcactcaagagctggttgtttaacagagcctggcacctcttcctctttcttgcccttcctctcacatgtgacatgcctgctctccgtcaccttctgccaggagtaaaagctctctgaggcctctccagaagccaagcagacactcatgccatgcttgtacagcctacagcaccgtgagccaattaaacttcttttcttaataaatcacccagtctcaggtattcctttacaacaatgtaaatggactaagacacatgttaatacagaagactgggagaagccctatcagaagccaacaatgtgccaggagagagggcaaggcagtcccaaccaggagtcaaaagctaatcagtaagctcagtacacacgacagcccgttaatcctcatcaacactttgtaggtaggtattgttgctccatgttactaatgagaaaactgaggcttagaaaaataaaagtctaacagccagtagagaggtagacctcagattttaagaacatacacttgctgtctgccaatccaggaaggactaaactggaaagagctcatcttcgagaacttataatgtataaaacgtcaacctaaatttttttgttgttattaatattttagtgcttagaaaaagaactgttcctacatgaaacagtaattcttacaatattgtttagcaagtaatcttaactttgaacaagaacgtttaaaaataaatatattgttgggtgagcaggaaaatcactttaaaatgttgtagaataatcttccaatattgttcctttcacccatccctcaaactacactaatgaacattttttttctcccagtatttgctctttctcagcaatgcaaacataattttcatgactgttttccattatgacacatactgtacatttccaacgacataaatgacgttcgatgattttttttcccatctctagctctctgctggtcaattagtctatcaactaacacatatttatctcaacatctgagacacataaggagtatcttcattccagatcactgatagtaacctgagaaggaaagaacgacctacaattaacggttcaaactctagcatacaaagttaaaatactgattaaggccagacgtggcagctcccgtgtgtaatcccagaattttgggaggccgaggtagacggatcatttgaggtcaggagtttgagaccagcctggccaacatggtaaaaccccgcctctactaaaaatacaaaaaaaaaaaaaaaaaaaaaaaattagctgggcattgtggcaggcacctgtaatcccagctacttgggaggctgaggcagcagaatcacttgaacctgggaggtggaggttgcagtgagccgagattgcaccactgcaatccagtctgggtgacagagtgagactccatctcaaataaataaataaattaaattaaataccagttaaataccagtacccacacttgagtccacgagtttgaaaccagcctgggcaacacagcatgatcccatctcaaaaaaaaaaaaacaaaaaaaaaaacaaaccagtatccatagttaagtgccagttaaaagacttacatgttcttgaaaatacaaatgaggatgtgaagctgttatctctaaggaaaaccaccaaaattaacagcaaatagccagaaaaccatgtagagaagcatgtaattttgttatggagcagaagacaagggatcattaaagcacttaagctattttataatagactcctcacttacgtttttcgtcatcagcatgcaccagagatgctgccctggacaaaacatccaatggcgtctccattcctggttggagcctaagaggaaaaaataaaaggggaaaaaataatttaaacagaattcaaaagactcttagaatcctagtcattaacagaatgagtcctcaaccaaatgcaaatcattcttctaaggatgaaattcttcccacatgaggaaacagaatgggcttggttcagggagagagaaaagggttaaactccatttagtctactaagctaaactttgccaactacaggaagcagctgatgtaggaactaaaagaagggatattgtgaatattcatgcccatgttatttggtgcttatgtttatgtgcatgcataacatgcctgtataaacatgcccaataaaagaaaggttttcagaacaacggctgctctatgaacacagcatcactaccagtgaggtggtgcagcttaacacacgccacgtactcatggaaagctgtgtgagaaacccactggtaggttaattgatattttaagtccaataagaatctttatgttaaaacgtcatgttttgtataatggtatattatataatcaccacctatcatcaatttatctagcatcatgttttttaataagactggatttttattgttgtttccttaaattacagcatactataaaagctaaaacagcaaaagatttaaagctcgaggaaagccctggaaaaccagaatgctttttacccagtttcccttttctgggttatttaaacacacacacagttactggcacacacaccctactagctcaccagctgagaaaaacaactccttaactgtaccactttacagacacttggaatttattcagcattcttcaacacttatggagtacctactacgtatgcaccggtcacaacatgtggcagaccagcttttctttgtaatattcatacctcaggcctccaaagaaacactgatccacgaggcatggtagctcacgcctgtaatcccagcactttgggaggccaaggcgggcagatcacttgaggtcaggagttcaagactagcctggcgaacatggtgaaaccccatctctattaaaattacaaaaaattaggtcgggcgtggtggctcacgcctgtaatcccagcactttgggaggccgaggcgggcaggtaacctgaggtcgggagtttgagaccagcctgaacaacatggagaaaacccatctctactacaaatacaaaaaaattagccgggtatggtggcccatgcttgtaatcccagctactcaagaggctcaggcaggaagatcgcttgtacccgggaggcagaggttgcggtgagccgagatcgagccattgcactccagcctgggcaacaaaagggaaactccgtctcaaaaaaaaaaaaaaaaaaaaaagaaaaaaagaaaagaaaagaaagaaacatagatccctgatcatgcaatatgacttcattcagtaaacgttaaatatctacaaggagctccaggcgggaaaaataaacaaagcccagtagctgccttcgaggagctttcaatctgcacgggaggcaggccaccgagacatctagtttaaggcagcattcttccaaagcattctgcactgggtgttcatattttgtaagaaaaaaacgtttttctatggtaaataagtttgaggaagcctggagtaaaccaagctaagcagcgtattttcctccccgtgcctttaatctcccgttgtggggacagaaagccctgtacacgcgaaacctcgtagacgtcatgagccattttcaacccaaaacgcatctcagggaacatctggggaaaatactgggttagggcaaaatgtgcaaagcgtcaaaacagtgctagaaacaaagtcctacagaaataacagatgaattctgaaaggctttgtgaagaaaacagaacttgagcggaggctttgaagaacgaatataaaagttcctcccccagaagggaagaacagaagcagaatcggtttaacaacacgctgcccaaatcgcctacaagagtaaaatggggacagaaagtaagcgacaaggttggaaatttagattgggaccacatcgtgaaaggactgagggcttcgatgggaccgcggcttgacacgcattaaggagccactgaaaactccatctaagcagaaaagcggcttagtcatccatgcgttctgggcaagttatcctggccgcaccacgtggaacggagtagatagagctcgggaagctgagcgcagggcggacaacgggaaggccagagccgtgggcaagcacgcggagggcagcgaggggcactggcaccggagccgcggggaggcaggaaaacgcagaggcggagctcactgagcttggcaggcagagagaggaggggagggccacggaagactaagagtggcagggaggcaacgacctcctaacacacgcacatgtcttctttttcagagaggatgggtaaaagcagcggtctaagagggaaaacctaacagtgctcacattcctgatcttctttgtaaaaacagaaaagaccatctcctaagaggaaggatttgtgaacttgttcaacaatggagaaaaccaacaagaacttggaactgactaacagaaaaaagtctgctgaactcccaagaactaggtaatattctcttcacccaagccagcttcctattcaggaaagatctgggtttaaagtcttgtgatttggtcgagaccatcctggctaacacagtgaaaccccgtctctactaaaaacacaaaaaattagccaggcgcggtggcgggcaccgtagtcccagctactggggaggctgaggcaggagaatggcatgaacccgcgaggcggagcttgcagtgagctgagatcgcgccactgcactccagcctgggcgacagagcgagactccgtctcaaaaaaaaaaaaaaaaagatcttgtgatttggggtagtaactgctgataagcatcctactttgcaataatacagcatttagactcataattctctaaattaattttaccccattaagttgaaggacaatgctttcaaaattctagacctaaatagattaatacataccttaggttatataaagtatgcacagaaacaaaatatcaaagcataaaagtatcaaatgacataaggtagacccagaattctagcatagcggaatattagacatttaagtttatacagatgctatgaaatcctaaacccccaagcaacttacattcaaagtaggtagataagataatgggtattaaaggttcatccacaaggcacctgccatctgctgcaaccttattaatgaaatcaaccaatgtttattacacaattattctaagctcagcaaagtgcccagaaaaggttaaggagaaacagaagatagatctctgctttcaaggagtcacgctcttgttcggaaactaaattttataagataggataatgacaggcaaaatcaaaaagaggataaacaaagactaaatattatttaaaactaaaatgggtacagtgtcataaaagagatcaatgtcagctaacgtgtttgccttgtgcacatctattttttgtttgggggtggtttgtggatgcgtgtgtgtttcaaaaagccacttggaaaatttccttccccggttgccctgccccaggcagtcactctcctctctggcctccctcaccttcctggatcgcactgtgtttctgtatacttcctaggtgcaaggaccctgtcttatccccagtgcagtcatcctgagtcaacaacagtctgagaaaaggcacaggggcaggaatgagcacctgggacaggtggccagacctgactagctagaactgaaaatccacgttaggaagcagcagaagctaaattcaggtgagcctgatgcgggtggccttaggaaagagctgacagctggccttcaggttgatacttaatgtcacaggcaacaggcagttgtcatcatctgtccctgagctggcccgtgacatgatgttcacactattttagtttagaagttccatgcgtctaggcatgtggctcacgcctatagtcccagcactttaggaggctgaagcagaataattgcttgagctcagcagttggagaacagcctgggcaacatagtgagaccccatttctaaaaaaaaaaaaaaatttaaataaaaaatgagctggaagtggtggcatgggcctatggtcccagctactcagggagctgaggtgggaggatcacttgaccatggagggttgaggctgcagtgagccgtaattgcaccactgcactccagcctgggcaacagagccagaccctgcctcaaaaaaaaaaaaaaaaaaaaaaaaagacgaagaagttctgtgtaggatggtttgactggagagggtgactccagaagttactggaggtggatgagttaagaggcttctgtaggaagcaggtgcaagataaggacaatacagctgggacatgagggacggggaccaagcattatctagccatggaagaacaaagcaaaggtggaagataacagttattaaaaaaaaaaaaaatggtcttccaggtgggtgtggtggctcagccatgtaatcccagtgctctgagaggccaaggcaggaggatcgcttgagcccgggagttccagaccagcctgagcaacacagaaatttggaaatttactcatttctacaaaagattaaaaaattagccgggcatagggacgtatacctatagtcccagctactcgggaggctgaggtgggaggctcccttgaagccaggaggtcgatgctgcagtgagctatgatcacaccactgcactccagcctgagtgacagggtgagaccccatctgtaaaaaacaaacaaaaagtcttctgcattttatgtcttatatacatcctatccacagcactaaataaacccaataaaacatattgataatgtgggaggaaaaaccatggctacagtattagatggaggatcacaccacattgacaggcaaatcagcatcatgattatttcagcatcaaattagcatcaggattaatatgaatccaggtaaaccacttccaatctatgtaaccctgggaaatgacaacctctgtgtgtctatttcctcatctggaaaatggagatattaatattacctccctcatacggttttctgagaagtgaatgggccttataggtattgaaataattatttgccaaaacttatgcaaatatattgaataaatcacaaatgacagtaaatgtactgaaaatgacagggcactgtccactactttagctagcgtggtctgggaagatttcgctgaagagaagaatggaagttgagacctaaagaatgagaagaattagacccagaaagagcagggagggtgggaaaaggtgggagacagcagcacatgctgagaccaacacacaaaaaagctgggcaggtgatgtggggggcggccagggtggctgccctgaagtcagcaaaagggaggcctgaggtgggcagcacagggccaggtcacgtgtgcctggagggcctgcaacaccgatattttattttaagtccgtgaaaagtcctggaatggcccgaaaagcttcaagcaaggaagtgacaagtttattttatttcctttatgagccacaaattatcctctaccttacacaaaaaattatgctgcatctgaaaaacaaatctaggtctatcccaataatgtcttatttctgtggtagttttgcattaggatatagtgataaccaaaaataatccattgaggaccaggcatggtggctcacacctgtaatcccagcactttgggaggctgaggtgggcagatcacttgagggtgggggttcgagactagcctggacaacatggtgaaactcagtctctactaaaaacacaaaaactagccaggcatggtggtgatggcaccggtaatcccagctactcaggaggctgaggcagaactgcttgaacccgggagacgggggttgcagtgagccgagattgggaaagtgcactccagcctgggcaacagagtaagattccatctcaaaaataataataataataatccattgaaatgctgacacctggaacataacaacatttaagtgagtggagtgtggctctagaaaaagatacagagggccaggtgcagtggctcatgcctgtaatcccagtactttgggaggccaaggtgggcggatcacaaggtcaggagttcaagacgagcctggccaacatagagaaaccccgtctcttctaaaaatataagaaattagccaggcatggtagcaggcacctgtaatcccagctactcgggaggctgaggcaggagaatagcttgaacctgagaggcggaggttgcagtgagccgagattgcaccattgcactccagcccagggaacagtgcaagactccgtctaaaaaaaaaaaaaaaaaaaaaaaaacagatacaaagtacactgtgtgctccactgcactgcaaaccagtttctggtctatctattcacctttttcgtggttgtcaaatgtgaagttaattcatcatgaatagacatatattttgttgttgtggatttttttttttcaggtaatggtcatatattttctctgccagtccacatgcctttcctcacactcccttagcctcaattcatatgttcttccaaataactaaaggttgagaattagggaacaagaggtatcgattttaaagctacaaaaacttaggggcactcagtgctaacggcaagctcagctataaatctgacagccattttttggccttccacaaagaactgtccctttttagtcaacaaggggacatgagtacctatcttggtgtgttagtccattttgtgtcactataaagtaatacctgaggctgcgtaatttataagaaaagaggtttaactggctcacagtagactgtataagcatggtgccagcatctgctcagcttctggtgagacctcaggaagcttccaatcataatggaaggcaaagcagaagccagcacatgacatggcaagggcaggagcaaaagaggcaagaaggtgccacattcttttcaacaaccagatctcccatgaactaccagagaactcacgcatcaccaaggggatggcactaaaccattcatgagggatcgctcccatgatccaacctctcccaccaggacccacctccaacattgaggatcacatttccacataacatttggaggggacaaacatccaaaccaaatcacttgggaacagcactgtggggtatattagattatattgtttttcaagcaatggaacacaactccaaaatatgttatggaagttttccaagaagatttgcacaataaaagctacagcaccaggcatgttcactccatgtctgtcccatggcagtggctagatatgatatactttaggtaagagtacgagaacatggagcaactaccttgtctagatgtggaggccaggggggtgagcatcggaggaatcacattcaaactgccaggtgttcctgccacacacagtaacagggccaaaagtcagaaacagacagacatcactatccttaaacacctgatggcctctccaacttccagatgcacacaataaaataccctaattcctgttggccctgttccttcatgagtccaaactctggcctccccaggaccactccctgagctaaaaccaatttggtttcagctaataatatacaatggtaggacaaacccaaaagtatgaactatcacaccatggcatggggtgtacttcttggccatcaagaatttagagatgtggctgggcaccgtggctcatgcatataattccagcactttgagaggctgaggcaggcagatcacttgaggtcaggagttcgaaaccagtctggccaacatggtgaaaccccgtctctactaaaaatacaaaaattagctgggcgtggtggtgagcacctgtaatcccagctactcaggaggctgaggcaggagaatcactcgaacccgggaggcggagtttgcagtaagctgagatcgcaccatagcactcagcctgagcaacagagtgagactccatctcaaaaaaaaaaaagaatttagaggtggctgggcacaatggctcatgcctgtaattccagcactttgggaggccgaggtgggcagattacctgggcccaggagtttgagaccagcctgggcaacatggcaaaacctcatctcaacaaaaaatacaaaaattggccagtcgtggtggttcacccctgtaatcccagcactttgggaggctgaggcgggcagatcacaaggtaaggagatcgagaccatcccggctaacatggtgaaaccccatcccggctaacatggtgaaaccccatctcgactaaaagtacaaaaaattagccaggcatggtggcaggcacctgtggtcccagctactcgggaggctgaggaggcagaagaatggcgtgaacccgggaggcagagcttgcagtgagccgaggttgcgccactgcaccctagcctgggctccatctcaaaaaaaaaaaaaattagccaggtatggtggcgtatgcctgtagtcccagctacttgggaggctgaggcagaaggatggcttgagcccaggaagctgaagctgcaatgagctgagatcacgccactgtactccagcctgggtgacagagggagaccctgtctcaaaaaaaaaataaaaaagaatttagaggtatttactgggtatctcctctattaaaacactgtatttagacgttacaaaaaaggaaaagtaaactccctgcccttgagcaccgtacaccaaatatggatgatactgggtgatacactggctgtcaggctcagtgagaaggaaaactgaatgagaatcagaccaaatgtcaccagattctggtggcgacatgcaagcacagtttcacggttttaaatcctccagctctttctcctccccagagtgtccggtgatgccccaccaacttcgtgcagcacatattcttcctgttaacatcccattctcaaaccacccctctctgctcttcttgctaaaaatatctctcatttgagtaatccttttttcttctcgcactttaccatctgttaagtcaacagagccaggactttagcatcaggaagcccaagtttgagccctactttaaatctttcactcattcagtcaacaatccctgaaagcctattttgctctaggctttgccctagatgtctaacacttaattgtatgggccagtcatttaccctctccaggccctagtttcctccttaaagaaaaaagtaaaaaacattgcctaactaacttcctatgatcacaagcttatcacatagattaaacgatgtaactgagaatgtcttacaaactaaagagagaaacagattttattagtctaccaccaccatcttccaggtgtatagcatacatgttttcaaaatacattcacataaatgacctgattggattctcacaatcaaattattacttaggccaaatggccaaatatgattattatttttcttctacagattaaaaaaaaagaaaaattgaggcaccaagaatggaagtgacttcctgaagcaactaagactagaattcaagtctctcaattctccctccaatgctatttttactactcttaagttgatcatgctaaagaggttttagtgacaagcacaattatttagcctaggtcaaagcaaaccttccattagcaagcacgacttctagccctgtgctctttcctctacaccttgagatacctatcaggcaataatgtgaccgtttcaacagcgagcaaggggaagcaagcccttacccgtcaggaacacgcaaaccatggtatatttgaaattcttctaacagaggtaggcatggagtcacattaatagtaaccaaggcaggtaagaaaagaagactgtcacaccaggtcaattgatgctgagactgtggccaacaatgacaccggcaacaaactaccaagacatagcgatttctggggccacagccacagaggagtcaagctaaaaccctgaggactttgagatccacgaacaggtacagtagtaggaaggatggtgtcaacttcaccatgctcaggaagacctgtggtcaagctccaacggctaactgttaaggttcagtgagaacatttttaaaatttcaccttggtgctcgaactgctcacaaccttaaattgtatgttacctttctaaatagaagccagcccttattcaaaatattctctcaatagtcatattatcaaagaaagagcatgaccagacggatcatttgctattccagctttcctcacagaggcatgtcccaagcaggtataactgactcacgctgccgtaatttgaagcatcaatgccagaagaacttggctgcttctgcttgcgtcaaattccttacttctacacatgatcactcctgaaaattcattagaaggccaaacgttctaatatttgaacaatatatcttcatgttctatatctacctcctgagaactgtgtgtatatatattatttatatatatatatatatatatatctgcataaaatccctaattaggattttttcaggtacctgccaacctcaagtgtgagccccagatcacaccctttccataaggcttagcacccctcctgtgaaacctctgcaggagggaggtctacaggctgggcagctgtcaatctcttaccctccaatgtaggctggaggctgtatagcaggaacaggtaaccttaggtgcctccacctcccatgacctcaacagaaagtgagacccccattaactcagaccaaataaagggctaacactctggatggaaacactgaatgaatgctctgctcaaccactcaaggtttcctgatgctaacgtggctcagggcttgagtctataggacttctcagccctgcaggagggcaggggtacgatacttagtcatcacaactaccctggcaacaggagctagcagatagtgccaccacacagtgacaaaaatcctcggttattgtaatacagtttggtatcagtgtaaactatacaaatgcacagactgtatgaaagttgatcatgtacccggtgaggtacatctatacaggctctgggctgcaaaacccaacttacattacaacacatttcacggccctatgcaatgctgcctgatgctggtgcaaaattcttactgctggctgaagtccacccatctccctaaagtgtcccatggaaagtgactatatggtgggcccacactgaaactactgttatctaagggggacaaataaaaatcaagtctgaactttctgagcagactaccaattcccaacatttttcaacactgttgtcagcacaaataaaaatgaggccaggcacggtggctcacacctgtaatcccagcactttgggaggccaaggcaggtggatcgcttgaggccagaggttcgagtccagactggcctacatggtgaaatcccatttctactaaaaatacaaaaaataaaataaaataaataaataaaaatacaaaaaaaaaaagaaaaaaatgaaccatgtttttctttctcattttaggatattatgaatctctctctcttcattttcaagaccgcagccttatacagcaaggcatatgaaataacagaaactctttggcatttttagtttcctctggatatgcttgctcttgcatttatttgaagacttaaaatttgaatacttatgtgaatagttagtatttcctattcacaagtgctaaagcgacacatattcttagggacctattactcccaagaataaaagatgaatttgggctgggcgcagtggctcacgcctgtaaccccagcagtttgggaggctgaggcgggcggatcacgaggtcaggagatcgagaccatcctggctaacacagtgaaaccccgtctctattaaaaatacaaaaaattagccaggcacggtggcgggcgcctgtagtcccagctactcgagaggctgaggcaggagaatggcgtgaactcgggaggcggagcttgcagtgagccgagatcgcgccgctgcactccagcctgggtgacagagcgagactccgtctcaaaaaaaaaaaaaaaaaagatgaatttgcatcacagcccaagttagcaagcttcccagaacagcccaggtctaactctccatggttccaaaataaaatctcagccctcagcctattaaagccacataaagtcatctaattaatgacacagtgcaacattaggtagcactgtagttattaccatcagtaaatattattggttcttttttttattttttgagatggagccttgatctgtcgcctaggctggagtgcaatggtgcgatctcagctcactgcaacctccactttccgggttcaagcaattctcctgattcagcctccctagtagttgggatcacaggtgcccaccaccatgcccagctaatttttgtatttttagtagagacggggtttcaccatgttggccaggctggtctcaaactcctgacctcaggtgatccacctgcctcggcctcccaaagtgctgggattataggtgtgagccaccgggcccggcccagttcttgttattcatagtagttgtgttctgtaaaatctctgtgaacattgaattagtggatattgaaccagtgttcctaggggaaatgagagtgagattccttccggcttctggtcacatttttgcaaactgatcaatacacaaccttgttttacgtatgtttctgtttaaagacaccttatttaatacctattgttgattcattaatgttgaactcaaggccaacagcaccgtaactcaagcctgaatgaagctcatctaacatgtatattttctccatgaggctcatcacagccttcttggctgaggaacattagacagcattttagcaccatacttacgggccactgtaaatagcaaaatccccaataaaaagcacaaaaatgggcagggtgcagtggctcacacctgtaatcccagcactttgggaggccgaggcaggcagatcacgaggtcaggagttcaagaccagcttggccaacatggtgaagccccgtatctactaaaaatacaaaaattagccaggtgtggtggtgggtgcctgtaatcccagctactcgggaggctgaggcaggagaatcacttgaaaccggaaggtggaagttgcagtgagctgagatcgcgccactgcactccagcctgggcaacaagagtgaaactctgtctcaaaaaaaaaaaaaaaaaagcacaaaaatatataaaaacatgttactaaatagactgcaaaaagcacacttgtttacagcatgagagctcaaacaagaaggcagggtagtgccttgtctgagctctactgggaacatgtgcattgggaggctcaaatttttccccatactgcacatgtccacaaatgtcgaagaaagtgtcagaggcattgatttggggcttacaaataaattttagtgagtagacaaatttataaacatggaaccacgaaaaatgaggatcgactatatctggctattagacctgaggcatgagacacagaaagtacattctacaaagttttctctctttgcaaaagtgctattattctgtatttcaagaaggtataattgttctggttttagcacctcctacattccttttcctaccttggcagtttgtatctgccaaatcttgcatcaagattttgcaatctagttcttatgatactgggtttttttttgcgggggggtggtttatgtggacagatcctaaatgctacagattagcagcattcactttactcttctattaaacacccacccatagcttcattaactttaggtgagttccctgaaagaagcacaaatgagcctcagttaacatacctcgaagaaatttcttaactcacacacacaaaaaactttctctttcaccaggttctcatagctgcaacagctcatctcacacaagcaataagcagacacattggtatgttaaaatcaccacaccaaaacaagaaggcaataccctgccttcttgtttgagctctcatgctgtaaacaactgtgctttttgcagtctatttagtaacatgtttttatatatttttgtgctttttttttttttgagacggagtttcacaatttcagtgacgttaaaattttcccgtgtattttatttttccttcctgagcttacaacttttagtacttttgttaggtcatgttcaaagttacaaaacaacttttattgttaacctactcattattttactaaggcaaattaaaagctgcacagcaaaactctccaagacagatacctagaagagacacgaaataaactctccctttggatttgttttggcaaccaccagagactggtaacagggctgcctccataaggagttaagaggaatttcccactacagattttttttttttttttttttttttggtacagttgggagccgggagtctctctgttgtccaggctggtctggaactcctggcctcaagcgatcctcttatctcagcctcccaaagttctgggattacataggtgaaacaccgcgcccggcccagaacatttaaaagtgaaagtttttacataattatcatgtctgtaagaagtgttaaaatcttcagataaagtcataattttaaatcagttgggggatagcagtaacaactgtgtttatgtagctctttcaaagcttcaaagaatttataaataacacaaaatactttcaaagcacattattctctgtaattcctgaaactctgtgatgtattggaactaatattaccacccttttacaaaggaaaataagatacaaagtttgagtacgagtaacatttctggtcataaatctagtcagtgacactgataggactagaactcaagtctccagaaataataacccagagctgtttttactacaacattcacagttttggaatgtagtccatagttatttatagcagaattatcttcttaattgtattgtgttttggtcaacataaaaattagtttgcattcacttccaaatggaaagcaaaggcaggctgcccagaagtgtgaaaaaacggtggccggggaaattagcctgggattaaaattttgccaaagttaaacaacgaattgaagggtttacatcatttccaccgtgggggagatgacttttcaggccagatgtaacaggaaatacaagaaaaaattcaaaactgtcttgagtgtaagacaagaaacttctgaatcaagtatttctaaatcctttatttaaattgagagcattgggacttagagataataaataacttgtcccaagatcacaccacagggacagctttactgctccgaccccaaaggtctccttaaactgcccactctactccctcccagtcatgcgcagactcttcattagatgcaagcaggaaacaatgaacagtacaagtccgtggactcagcgagtagagaaagagttaaagtttggtatgctaacatggtatgcaaaactgaccttcaaatcctaataggcaaattaattttttttttgtctttgactatttagaggaaacaactgccagactccttctgagtagaggtaggcttgggtatagaacaagatattaaaactccacaaactgggagacagtgcctttcaaagagagggcaaccagctgttgataaaacccagcagaaccgcctccacttccccacacccctaccctcccgcgccaggctgctggttcttattaatcacagagaagggactacaactagcaaacatacagcaccgacgatcaaagtgaaaccgattttttaatcatctaacttaaacagacgaacacatgccagcaacgtacataaatacgaatagccccagcaagcactgtcttcataacctaagacagttaaatgtctcagggtgatgaatcaaaggagacttcaagcaaaacaaaaagcgaacagccctgtgctcttccgcgaggcctgcactgggtgcagggagagtgtgcagtcctgttttggggaccgggcaggaagcacaggaagagtacggtgccccttcccgcagtccacatcacagccctccctgaggccggcggggaccgcggggtgccaggcgcgggcctcctcgcccgccccgagcctccgactcccaggacgtcctccgggagcctaggcgcttccgctcccaccggcgcctcccgagcggcccggcaaggacccgccacctcctccctcccgcagggcatcccggttctgctccgacagcccaccccaaggcccctctcaggccagccctcgcccagcccgggtcccgccccgccgaccgggtcaaccgcactcaccgcccggcggctctgggcgcgcccgcctggggccggcctggccctgcgggggacccaggggcggggacgggacctgggcacgcggggcgcaccccgagggcgcgcagacgcacaggcgggctcgcgcccgagcccccgcacgggcccccgccaaacacgcacacgcacacgcacgcgcggaccgggccggcggacgggagcgcgggagcgcgaggaatccctggaatgaggcaccggccaacctgagccgggctccgccaggccagccaggccacgccctcggtcacgcccctcacggagcaggtgggggctgagccaggtgagccgggagggagataggggcgaggcctcccgcggcagggagaggccgctttccctcccccgccagctgcgcgcccggtgccagctcgcacctcccgggccgatgccggcgcgctggggcagtgaggtttgtcggggcgggcgctcccgagaggcgccagcgggcagggcgagtggacatggcgcacactgctgtggacacggcatctcgcacgcccccgcccccgaggccccgccaggggacacagcgccgtgcaaatgtacaaacacaaacgcacatttcgtgcgcgcccaggtgcccgccgcgctccccacgcgcgcacagtaggtccctgctcccgggggacagcgcacgggacgccgacgttcacagtccaaccagacccgtcccgcggacctgctgcccttcccgccacacacaccccgccaagcgcccggagttcagccgaacctgcggcacccacgccgccctccgcttcccccggctcgcgagcagccggataagggcgcaccacccgcccgcgccggttcgccgtccacacccgctcacccccggaacgcggcgcaccttccgtcccccgcctcccgggccccgtcgccccctctcggcacccgcatgcccgagccgcgctccccgacggccgacggccacgcacctgaagggacaggtcacaccggctgcgggaggggctgctcggcgccactgcgctcagaacggccgcggcggtcccgggcgctccgacgccgctgggtttcctcccattacagcatgttgcactccagcgctgcacttcacactcgcacacgcgcacacgcacacgcgcacaactccaggcgctcggcggcgtccttcccccgcctcgcccggaggaggaagtcctagtaaatcaaaacaggctgggagggagggagatcggagtggaaagagtccccttcagccgctcacacaccagtgtttgctgtgtttggcaaactcctggcgtccacaacccggactgctctgaaatgtgcccggggaggggcagggaggaggaggtaaaacgtttctaattggcgcaggttcttatattacagcagcagggcagacatgtgaccacgaaaagaaaaggcctgtctttaattttttcctgtctttctctggggatttggtggtggggggccgggggatagaggcctgatacccgccccccgccatccccagcaacccttgccctgttgttttcttgtactgccacaattaagaaaacatttgcttaacatatccagcggctaacttcataaaataaatagagactggacttcctctggtttgctttaaaaggcttcatgttgcttgccttctggctgttctcaaacctcagtcattattaggagcccctaccgtaagggctttccctgggagagggctctgctgaaagggaatgataacaatgaaaacaaataccagcttacattcgtgctggaaaaaaaaaatgctttgcagttttcaaactgttttcccatctgttgcctcatctgatcatatcaaggaacagcacggtgtctcactggatcttagcccctgttggatatgcaaagacaggtatgcgtagttccatgtttcagtgagattaaatggtttacctaaagcaggtggaggtgttgcccgaaacttggggccccttgtgaaatgtactctcctccagtccatacagggcctctggagatgggacaacccaacttacaagtcaacctaggaataggtcccctggctttcctgattcctggataaatattcacagattaaagctcggaaggttcccagtcttcccaaaggtactcttacatagactccgttttagtccatcagtagtctcggactaggaaaagagaaatcctgagaaagactgtaaataggagattcatcctgccaaactcagacagggaatgaggaaggaatgaggactgcctgggcagattccaggaaatatggtaagacagaaaaagggttttagattcagacagaatttgaatccaaactccgcctctatttgttataggatttggggcaagttatcaaacctcagttttctcatccgtaaaacagagataatgcttcttcgaagagccggtgtggggttacaggcttcgcagagacgtttaatgaatactcacatcttccttctcttctgacttaaatccagtccaggtgggcaccttatgaacagaggaaaatgaaatgcccagacaacgcaaatgaataatgataacaataatagtgcaactgcatatttataaaaatggcccaaggtttacaaagtgttcccacgtattattatctcatttgatctttatgacaacattgccatttgtttgctgctaaatgatttccattttgggtcagtgcggaggtcctaaagctgcctctttaatttccatcactgcttggagcgaaccttactctgcaaataaatcatggggacagaagaccttttctcatggatgtgaccagtcttcgacctttgcaaggattaatctcactctttgccttacatcagcattagcgtgacttagctctggcaacatctaagcctggtcgttttagtctggctcttttagttgtgcaaaggagagacacactcaagttactgtaagaaaaaggggggttgttgtaaaggtctagggggactggaagtggaacgtggcagacacatagaatattatacagtaacctaaattaaaatgacttacagtgacctcaacaatacagatgcatcttgacaatgttaactgaaaaaattaagtcccaaaagattacatacagcataatactctatttgtaatgttaaaaataaaattaaaaataattttagtggtacatatatctgcaataaaatgatataaaaaataagtcagggccagcctggccaacatggcaaagcccatctctagtaaaaatacaaaaaaaaaatggtcaggcgtggtggctcacacctgtaatcccagcactttgggaggccaaggtgggcgaatcacgaggtcaggagttcaagtccaggctggccaacatggtgaaaccccgtctctactaaaaatacaaaaattagccagatgtggtggcacgctgctataatcccagctactcagcaggctgagtcaggagaattgtttgaacccgggaggctgcagtgagccgagatcatgccattgcagtccagtctgggtgacagagtgagactccgtctcaaaacaaaaaattagctggggatggtggctcacacctgtagtcccagctactcaggaggctgaagcaggagaatcacttgaacccgggaggcagaggttgcagtgagttgagatgacaccactgtactccagcctaggcgacagagctgagtctcaaaaataaaataaaataaaaacaaaataaaataaaaattgaggggatgatgatgccaggattacctgggtgggggtgggggcaggcatgggattggatgggagaaaaccatttggttaaacattgttgtctaggtcctagcttggtaggttcacaggttctctattaaaataactacctaggccaggcgcagtggcttatgcctgtattcccagcactttggtaggccaaggcgggtgcattgctttagctcaggagtttgagaccagcctgggcaacaccgcgaaaccccatctctacaaaaaatccaaaaattagctgggcgtggtggcacatgcctgtaagtcccagctacttgggaggctgacatggtaggatcacctgagtccaggaagttgaggctacagtgatctgtgttgataccactacattccagcctgggtgacagagtgagaccctgtctcaaaaaaaaaaaaaaacaaaaacaaaaaaaaaacttaagtgatggttttacagtagtgtgaatgtacttaatgccatactgaactaaacacttcaaaatggttaaagtggtacattttgtattatgtatattttaccacaagtttaaaaaatgtataaggaacataactgggcaaatcaaaaagaaaacaatactgcttaagtagctaacaaataaaggtaggctgtacatagaccactgatgagaatatatttcaacccaaggattttataaatgcgccagaagtgtattttaaaaacaaaataatcaagggggtgactgagtggaggtagcaaagacacaagattggcccagagttgatcgttgttgaagctgaggatgggtacagaggagggtgttgaggtagcccctcagtgggggatgggggggggtgacactactctatctgctcttacatgtttggattgtttcatagcaaaagattttattttattttattttatttttatatttttatttatttatttatttattttttatttttgagatggagtctcactcttgcccaggctggagtgcagtggcatgatctcggctcactgcaacctccacctcccaggttcaagcgattctcctgcctcagcctcctgagtagctgggatcacaggcatgtgccaccatgcctggctaattttgtatttttagtagagatggggttttaccatgttacccaggctagtctcaaactcctgacctcaggtgatcaacctgcctcgggctcccaaagtgctgggattacaggcatgagccaccgcacctggcctattttttatttttatttttatttttattttgagacagagtctcgctctctcacccaggctggagtgcagtggcataatctcagctcactgcaacctccacctcctgggttcaagcaattctcctgcctcagcctcctgagtagctaaggtagcaggcgcctgccaccacgcccagctaagttttgtatttttagtagagacggggtttcgccatgttgaccaagttggtctcgaactcctgacctcaagtgatcctcagtcacctctgggtgattctccacttctgcctcccaatgtgctgggattacaggcatgagccaccgcacccagccctgtttcatagtaaaacattgtaaaaaggaaaatgaaaaaaaagtgcagagtaggaaggacgcgttgtggctgtgttgtgctctcacccatcgactgcacagcttctcagtttccctttcgctctgtttctttgtgcgtcctccccaatctagttctttctcatctctctgccaaggactttcctcacagctttggctcccttattgctatctctattaccccttttagcttttgcccccataggtaactgactccttccgtatcttcatagttcagattgctcagagaatctgattcttctctttcttcttcctgttcttcttcctcttcctctttttcctcttcttcctcttcctcttacacttcctcctcctgcccctcctccccctcctcttctcctctctcctcttctccttcctcttctcctccctccttgttctcttccctcttttgctccctcctccttctcctcctccttctcctccctctcctccttctccttctcctccccctcctccttctccttttcttcctccctcttctcctccttctccttcttctcctcctcctttttttcttctcctcctcctcctttttttcttctcctcctcctccttttttttcttcttctcctcctcctcttcctcctccttctttttcttcttcctcttcttcttcttcttcttctttcctcctcctcctcctcctcctcctcctccttcttcttcttctcattctgtcacccaggctggagtgaagtggtacaatctcagctcactgcagccttaacctcctaggctcaggtgattctcccacctcagcctcctgagtagctgggactacaggcatataccaccatgcccggctaactttttgtatttttagtagcgatggggtttcagtgagttgcacaggctggtcttgaactcctgggctcaagcaatcatcccacctcagcttcttaaagtgctgggactacaggcgtaagccaccatgcccagcctgactcttccctttccactaatccatagaaatgattgccggctgatctccctggaagccacacagccatgagggtcagtgaagtcaagcacagtccagtgatgagaaacatggtccatgtgggcgtggggtggaatggctttaagatggccacaaccaatgacacgtgtggaaggggctaaggagttcagttcatcagttaacaatttcttaaggctgttcaatgggtgagtgttataaaaaaagttttcccttccacgccaattgccaataagtagtttgtattccagtttgtcctcccatgtcatacttctaaggggcaaataaggggaatatcaacggctgccaatctgaattgctcgtagtacatatagacatctactgttcccctcattgcactaacctggctgtggaaaatgtgtttttctagtctatatccctttgcttatgatgtactttcatgaatctctcctgttttcttctcttcactccgacttgttccacaaaaagcactgaggaatctgaagatgtgggttctagttcacactcctctctaggtgacaaagtgagtcattctatacctctgcatattccaagtcttcccctctgtggggagctgagaccagatcaagttaggcaaacaggtttccttttgagcacctgctctgcctggagccctcttttgagaagggctctggcagcacagttgaggcttagtgacaaagtgtcgagattgattattaatgtatgctatgggcagggaataaaaatgagtgaacctggccgggtgcagtggctcatgcctgtaatcccggcactttgggaggctgaggtgggtggatcacttgaggtcaggagtttgagaccagcctgggccaacatggtgaaaccccgtctctactaaaagtacaaaaattagccaggtattgtggaatgtgcctgtaatcccagctacttgggaggctgaggcaggagaattgcttgaacctgggaggtggagtttgcagtgagttgagatcgcgctgctgcactccagcctggcagcctgggcgactctgtctcaaaaaaaaaaaaaaaaaagaaaaaagaaaagaaaagaatgagtgaagagtgaaccagatgtttgccatttttggtggaggagcgctaaaaatcccatctagtaataacttctttcttttctcatagtgtgagaacaggtgcatttctacttttctgggaaccaaagaactcagtggaaaaaccaaatgatcttatttcagggagagaggaaagaataagaaataatctaaaataataataataactaatgtttgaggagcactcactatgtttcaggcaccactctaagtgctttacaacaagtaccgaattttggcctcataacaattctattgtaaggtaggaactgtaggcatcctccttatgcacacaaagaaactgaaacatgcagacattaaattacttgtccaaggtcttaaagacagtaagaatgcaactagaattaaaccctggtggtccaattccggagtccacctgcttatgcccctcactcctcaggattgcctgcagactaattgcatccagcatcccctgagagcctgctagaaatgcaggcttgcaggacccacccagacctgctgaattggatctgcatttcagcaagcttcccaagtgactcatattcacagtgcactgagaagcaactgcttgcttacagatgttactattattattattatttcagacagggtcttgctctgttgcccagactgtggtgtagtggtgcaatctctgctcactgcagcctccaccgccagggcttcagtgatcctcacacctcagcctcctgaggagctgagactacaagcatgtgccaccacagtaggctaatttttgtatttttttctagagacaaagttttgccacgttgcccaggctggtctcaaacttctggactcaagtgatcctcccgccttggcctcccaaagtgctggattacagacataagccactgtacctggcctatttctttttttttctaatttaattttttttttttttttgagacagagtctagctctgttgcccaggctggagtgcaatggcgcgatctcggctcacagcaacctccgcctcccgggttcaagtgattctcctgcctcagcctcctgagtagctgggattacaggcatgcacctccacacctggctaatttttctgtttttagtagagacaagatttctccatgttggtcaggctggtctcaaactcccaacctcaggtgatccgcccaccttgacctcccaaagcgctgggattacaggcgtgagccaccgtgcccagcccctggcctatttcttataatcacatgtgaatctgcaactatttcaaaaaaaaagaaagtgaaattttatgtaggttttatttttcctgcttttgttgttgaggaaacagagctttgaagaagctaaataagcagcccacttggtaattcaacctatgtattgaggccccacctgctgtgtgtaagacactgctttccgcactgaatttccagcagtgaacaaatcttgccctcgttgagctatcattctagtgggtactcagttcaaacccacatctgggtgccaagtcctctactgctcagaaatatggtcacagattcagagagtagtaaataataaagctacacaaggttcaaatatttgcaaaatgtctgtacaagtatatatgaaagcattaacagtgctaggtacacagtaagcactcaataaaaattaatcctcttcctttctttcttgcagttgcctcagagcctggaaggaagctcatctccactgtgacccaactggatggggtccacgatgggcccattgtgagtagctgtgacctgagcttcatgcccctctggcgattagtcgaagagctgtgattgagggcgatgttccaaggtctggagatggacccttttaaacctgacagggaggccaggcacggtaactcacgcctgaaatcccagcactttgggaggccgaggcgggcggatcacctgaggtcgggagttcgagaccagcctggccaacatagtgaaaccccgtcgccactaaaaatacaaaaatagccaggtgtgatggcaggtgcctgtgatcccagctacttgagaggctgaggcaggagaatcgcttgaacccgggaggcgaaggttgcagtgagccgagatcgcgccattgcactccagcctgggagacaagagcaagactctgtctcaaaaaaaaaaaaaaatacaaaaacttgccagggagtcggtgatgtgtgttcctgtgaatgtcagttcttttcacagcatggttctgagaaagtgcccttaagcaagaccaaatttatggccagaaggattgctcagacccagacatctgagtggcatctaacactattctaaagattgactttgtcctcatgcaaggaattttcctttaaatactataagaacaattcaacatgcaatatattcttgctgtctttcctataaataaatttcactgggctgggacgggaaataaaagcctttttcaacacactaaaaaattgttgcagatgctggattcaaggccagtcagaatttggccgctgctgtcagacagagagtggtttgaatgaggaagcttaccgagaatgaatgtgtgttttcttctgtaggtggaatacaacaacaccccagagtgaaattcttccaactgggattgccctgttaccctgtctttttctttctttctttctttctttcttttctttctttcatttttttttttttttttttttttttttttttttttttatgagacagagtctcactccgttgcccaggctggagtccagtggtgccatctcggctcactgcaacctccacctcctggttcaagcgattctcctgcctcagcctccaaagtagctgggattacaggtgcatgccaccacacccggctaatttttgtatttttagtagagacagagtttcaccatgttgcccaaactggtctcgaactactgactgcaaggaaggaaggaaggaaggagggagggaaggagggaaggaaggagaaaggaaggacaaggttattgggtgccaagtgtgtgcagtgttgaacattctcatttaatgcagtgtgatcctatgaagaagattgtcccattatgcagatgagaaaacaggggctcagagagggtaggacatttgcacgggcagtgcaacactaggatgcaaaccagctggtcctacttctcattgaacaatctttcaataataccactaaattcacccagaaaagacctttggagaatctctaaataaataattgcatttggcagggcgcagtggctcaagcctataatcccagcactttggggcacgatggctcaagtttgtaatcccagcactttgagatgccgatgtgggtggatcatctgagatcaggagttcaagaccagcctgaccaacatggcaaaaccccatctctactaaaaatacaaaaattagccaggtgtggtggcacacacctgtattcccagctgctctggaggctgaggcagagaatagcttgaacctgggaggcaggatgcagtgagccaagatcacaccactgcactccagcctgggcgacagagcaatacttcatctcaaaaaaaaaaaaaaaagaaaaagaaaaaagaaattggctgggcgcggtggctcacgcctgtaatcccaacattttgggaggccaaggcaggtggatcacgaggtcaggagttcaagaccagcctggccagcatagtgaaaccccat

SEQ ID NO: 376 - DNA, 119294 bp, Homo sapiens
gatgagattggtttttactggatgaaaattgaatagtgaaaaacttaggctacgagaaatgtcaatgctgatttaatctgtatagaaaggtgaccagagaacgtgcatcagtacgctctaagtaaacgcctctgaattcccatttaaaatgtagctgtttctttcttggtaagatggctcccaaataacttgttcaggaaccatcagggcactccccaacccaaaagtgaatgtcatgtttgtagcttaattcttaaactgaaaaggtaagcaaatacttcaaccctttctaattaagtagcatttgcttattcaaaatatctatttaattgccacaatacatctgattttcattccaaatgtttaacagagtaaaaaaatagtaattttctggctgggtgcagtgggtcacgcctgtaatcccaacattttgggaggctgtcgggagaatcgcttgaggctgggagttcgagaccagcatgggcaaaatgaaaaagaaaatagtaatttttaaagttggaacacttggcctgaatgggaaactggtaaataacctgctaggtatttttcaaagataagcaggattctaatttctaagcaattagtagctcccaagaatctcatttgcattcgatatttcatgtttaacagaatcaccacaatgtaatctagtttttctcctattgcagcatatgtcaggaaagcacttcatataggtgaacaactaggcttagttttcagtggaaaaagatgctttatttttttcaaatattatgaagtagacaagaaacaataaacattatgctcaaattaatataaagcatggattggataaatctctcaaataatttgatgtggcatctgcactcctcaaatgagagacagtacaatcagcctgcctttactcccaacatccttatttctaaactcagtaataaatcctctgtggcaataggatttgacaattcgatattgtacgtctcgttagcgccacctactgagtgctggtcacattttgtaaatctcagttaaaaatcactggctgaaaatgcagaaggaaccaaatcaaagtaacaaaaggatgacaatagaatgattacatctccagctttttattttcatcaatgctatttaagtataggtacagttaccagagcagtgaatgtcatgtcagaaaaagaattaattataaattacatttatataaatatgataattaatttgattaaaagaggatttacattgacaaaagcaaatattattaagccatacctgccttacccatctcacaaagttataacaaaaattatacaaaataatttatgtgaaaaatccttgggaaccacaaaacattaaaaaatgtaaaagcattattccataatgcaatagcattttcattttataatttttttcaaaaattttttaaatgctacaactaaatttatgatacatgctagatgctacttttaggctcaattaagcttagcatttggaaaagctgaaatatatactttcaaaggatggaaattttctacactatatgatttagaatctcttttatattgttttctcattcctataaaatagacaagctattttatagcctaaagtcatatttatttttcagttctgaaaatagattgaatcatacacactgagagtggcatatgaagacttcattaataaaaataaagttggtgattcaaacttctggttttgctgaaactgctaaaggattcatgaatcgcatgaggaacttaatgtggttaagtatcaagtttattgacattcaactgttggtgaggtttataaaatagatttattctatataagagatgttcctctcacaagctttgactctttcatcacctttctgtaggtcttgactgaaataataaaacaatataaaataattaaaaataaaaatgaagtgattccatgtatctgaataaatatattcactacatttagtctttctatcatatacatagtgcaggtggaacacaagctttcaagaatcaaatgatgctcactttgaatgttttcttatccacaatagacaagaatatcaagcagccttaccaaatttggaagcaactatttagttgctttacagatatttatttacagatatttatttacagatatttatctgtaaacctctaaatgattgtcataaacataaaagataactgcctgaaatgttaccttttcatagactaggctttgacattttgtaaatataaatgtagccaaaatattgaagtcaatccaacttcccacatgcaaatatattaatgtgtaacagaaatcatccttttgcccaattccccctacgtggcatctttatgtccatcccccaatcccccaggggtttctcagcatgaagagcccaattacaaaataggaaaagcgccactcaaagcctatatatacatgcagctgcaaagtgttctggagaggttaaaagactgatatgaatttggcccactgcatataacctggagcaatattgccagaaaagaggatttgaatgagcccaggttggaaaaataaattacctttatgccttgaaggcaatctccatgggtcaaggctaatgcctttttctttgctattgtgtgagataatcatctctatcacctttttttcttttcattttttttaaataactaggtggttttgacatttttgtggttggtaatctaatactttttcacaaattttctttcaggaaatagaaaattttttcagtaattgaatgagaatgatggatcatgctaataaatgtctttctcaaaacctgtcataactttaaatcaaagtcagggtattaatatgagactcctatattcctcatatttatttcatgtcagcatgtgcctagctgatgtcaacagcagaggaaaataacatcagggttcaagaaatgtggtaccattaacatttacatgacgtattgacttgataatgaacatcagtaaacatttcagccaaatataaataaaaatgtatttgtgtctataactatatttaatatacagaaactttaaggagaaaaacaagtgagccttgagagtaaaggtggtaacataacacataattgtggtaatggtcaatgcaatttaatgattagagtttatgagccagatatcaagctgctaatttactttcattatctcttatcatattcatagcaacactatgaactccatattattattcccattttacagatgacaaaactaaatctagagcagtaaaataatattttcaagcccactcagctagatagtgacagtaaagagaactgaaacttagcagatctctaatcaataagtcatacatattggcaagaagctaaatctgcaaagattgagagagacttttttctaattcactcagagtgattgtttgctcacgaagctgtgtgccttcaggactttctgctcaaatcgactggtttttctaatttatgcaaatacgtcaagtgacctcatattagcctgtgtgttgccaaatgttctaaaatttcaaaaagtttgcttttactcagttgatcaggaatgagatcatagagaaaagaaatttaaatttaacctaaaaaataaataggattttaatggggaagatggagagtatagtgggagggtaaaagaggatctttttagaacatgcaaaggatccacatgcagaaaaaaataaggcctatttgaggtataggagttaggattggctgaagcatagattttctagcaagatgggagatcggactagaaaggccaacgtgtggaacactcagaatgctaagttaaggtgtgtagtcaatggtcatgaagctgtggagaattaggaaggaaacaacagagtcaaaaataggattattactctggtgctgggtgtagatatttttgagcaggtaatatgacaataagaagacaatggagaaacttttaaggctagacctgaactacactagtgtagaagtggtggaaatggagaagagaggtaatctatcactagacatgcaagtattattctttcttcccgtgaacaatagttgtttttcggttcctagatttaatgtttgctcctgtggtcatcaaatttaaacactaaaatgttttggaatttgatatagttgtgaaaattatctaatgactttgaattatgattttaagagttcaatcaaagaatgaactttaatacctgatatgctttggctgtgtccccatccaaatctcatcttgaattgtaattcccacaatttccacgtgttgtgggaggaacccggtgggaggtcattaaattatgagggtgggtctttcctgcactgttctctgatagtgaattagtctcatgagaactgatggttttaaaaatgggagtttccctgcacaagctctctttttttacctgccgccatccccataagatgtgacttactcctgcttgtcttccaccatgattgtgaggcttccccagccatttggtactgtaagtccaattaaacctctttcttttgtaaattgcccagtcttgggtatgtctttatcagcagcatgacaatggactaaaacaataccccttcttctcttcaccctcttagtctcccaaaaagatacccaaacacatatacccacatcgacacaaaaatacctcttcagcctacagttactgtaggatgcagtatatagaatgtttggctctaagagggtatgtagagttattaacatcttgtttggacacaaatagaggccctcaaggagctctattttcagagacttttaggaagaactcaaggataaattactaggaccatacatccactaatagcagtattgaaaccctacaagggtattgatgcttttgagtactgacatcttgacaatcaagagaaatcccttatatcatatctgtgatatcatttgattcccaactgttctgtctaccaaattcagggaattcttcccagcagagtcttcctttttgtaaagatctttttgtatcatttgacaactgataagcaatttttagccaggtattatttaggcacattctttttatttcttacctattcatgtttccgttaaaatttgttataaatttttgccaactgatttattggtataaatcatctttcagcttattattactgtaaatgttattcactgttaaacaaataagccataattattatcattgtcattagcataattgctttttaccaattattaactcctgctagtatgatcatgattaatattattagaaatctgccacctcactgaaaatgttaagaaatcctatgtttattttatagataaaaactattattaaaaacttgtagcaccttaaactcatgtcttaaattgtttccattccaatcccaataacataaataataggactggcttccatttatttgtgtgtacaataatgcttgcgatgataaggtcactgaaggtcaccaagacatttacaggagctttcactacaccttgaaaagtatatagcccaaacatatagagctagagaaatcacttcttttggaactaccagaaaatatgtgatggatttaatagttttagttcatatgactccaaaaagtcaaataattgtagttagcagcatattaacataatcacctcacatatagttttatattttaccagctccaataaatctacacccctagatctatattaatattttaaatataaattagcacatctcaatacttaataagtagaaattcaaggaataatggacattaaattttcttataaaagggagcaaaggtgtcttataaattaggtgttcactacagggaaaggcattaatcagctttcaaaagctaaatttgtctcaagctcattattattcaaagcagtgaattttctctggtaacatgtcacagagggaataaggaacggaaattctaatgatagcccagcaatttaccatgaggttttaattaattaatctggagtttatgcacataagactgattatatgaaccaaagttcagttctacaagtatttcccaaattaaaggaatgctacatatttcaataatgtcaaatatgaaaaaatcgtacaaaatatgattcagtatataccaaaattaagaagcagttatagtatacttctttgccaaacaaggcaatcattaatttttctcacactaaagtacacaacaaaagtatttacaatttatcattacatccaacattgaaaaatgataacaaagtgatgacttatataatttatattgatgaaaattgggatgacatgaggaataagcactgacaaaggtgtagtattaaacctgggctttctgagtttgactcttgttacaaataatttcacaaaaaccattgattattagatgtatatgtccctacacagaaaaaaagaaaagaaaactgggcatgcacaaattttaaaatcagtattttccagaaagatgagtataattttcctaccaataaatctaattgatccagttctggtgccataatgttcattaactcctttggtattaaagtgattggaaataacataaaaacctgagcatgttgaatggtatatgctaacagtccagttctaatacacttatatttgtggtcattactaacaacattattcacatacacatagccaaccttaatgcaaacgtttcacatttgctaatgacagtttttgattacttcagaagagaggtccccaagttaggtttatatgatgcagattgtctcataatcgaagaacctgttaattgaagaatcacacttatatcccttcagttttagctaggaacatctgaaggactgatgactaagttgcctagagctatcattttttgaatttcagaaggcactgtgctagttgcctctgcttctacactttctctataacctttctttctctttaagctcttactcagcaggcatgaaatgtatttaggaacacatgtattataaaagtctttcagattaaaaatagaaaacatttacagacttgttaagacgatagaaggttgtggttaagaaacccatggaaggaaggacatagaaatcatcttagcagttgtacaactttttatctcagtacttctaattggcctatgtcaagtctcacaaagggtgagagtagcagattgtcagcattcagaatacagcattctcttatttgtgtgtgtcttacattcatgctccccaagtgtattagattgggtccataggaaaagattctgagataataagctctctgcagaaagtttattgaaaagtattctcaggagttgcctgcgtaaagaaatgtggaaggcaggactgaacagaaacacctgcaatgtcattgcaactgaagtcttaggcaatgccaagggcagccctgcaaatggaatggactctgagtattgttctgaattgagatgggagtaggctctatagcaccacatcagccagttactggttatgcgtcagcctctaggaaatgacataagctggctgaaacatttccctgcaatggagggctatgctcagtgagtgaaatagttgtacactgtcagcagccaatattcccagcagcagagaaatggcacttaggtgaaggatcagagcattcaccacaccaggatgggacatatgactgggtcaggatacccccatctaaataggaccatatcattaggcttggcttattataccaagcctattcatggttgccattggctggtgccccaggagctggtccaaccagttaatgccaagtaaattggtctgttctcacccaaaacataaagtgtgaaggattgccaaggactctaggtgtggcagggatgtaaaggtttacaaactcatcttcaacataacaaattaccaacttctcaataacaacacagaaacagcaacaatataataatattttatgttaatttggtatttacagtctagatactatgctaaatactttacacaatttatctcatttaatcttaacgggaaccctatgaggtgttattattttactgttacagacggaaaattgaaacccagaaaaatgcagaaaatgtatccaatacaataaaaataataagtcatagaccttgaaacaaagagtttcagagtctttcgttttaagaattttactaaacaacccacagagtctggcttattaatgaccgtatactacttgtcacttgcatggaaatctgttggcttcattttaagtataaatcattttaagtataaagtcatatgtactatattacaaatattgcaaaaattgacattgtacttgttggatttgaaatctgttggcttaattttaagtaaagtataaagccatatgtactatattacaaatattgcaaaattgacattgtatttattcagaggtcctatatccaatgatcttaactcttaagaacattattgagaaccacaagaccagtttaagagacttttgtgttctggtagaaatggaataatggggattgaataatctctcctgccctaaacaactagatgattggacaaaacctataacaatcattataaaagatgagactgctgttggaaagcaagtatcatgggactgtaatctctgagaaaaaggaaacaaattgagtgagccctgaatgcatcagctcactccagaggcagtttcacaccaccttttaggaagatgggaccctaacagagcccagtggtctcactgaattgaagaaccagagatcaatgttggaggaataaagatggttagaatttgctaagaggaatatggtactatagaggtagaagctaaacagggagaacttcagagatctgcagaggggtctacttgaggctctgagtattgacctgttcatgtgtgacaagaaaacacccaaggccagagaaacacttaaaaacatttgaaatacaaacagggctgaaagtaatttgtgtctccagagcagagtggaaagaccttgtaatgcaagatctatcctgtagagtactcacaagtatgttaccttggttgtcagcctaaatttgccctatgcgacaagctaatctaaacctaccttacaaatacttaaataaagcttcaaagatatctacctgattcctgcagaataagtgcatgccagaacaaattctaacattatttaaaattcagcaaacaacaaaataaaatttacaacatcagacatccagtcaaaaattaccagttacagagttacctcattttatcgtgtttcattttattgtcctttgcagatactgcattttttacaaattgaaggttggtgtcaaccctgcatccagcaagtccatcagcaccattttcccaatggcatgtgctcattttgtgtctctgtatcacattttgggaattctcacaaaatttcaaaagttttcatgattattacatcttttatgatgatctgtgatgagtgacttttgatgatactactgtaattttttcaggacacctcgaaaactgcctatacaaaatggtgactttcattgacaaatgttgtgtgtgttcttactgctctaccaattggctgtttccccacgtctctacatatcctagggctccctattccctaagactgaacaatattgaaattaggccaaataataacccaacaaaggcctctaagtgttcaagcaaaagagtcacaggtctctcacttgaaatcaaaagctagaaatgattaagcttagtgaagaaagcatgaccaaagccaagacagactgaaagctcgacctcttgctctagttagccaagctgtgaatgtaaaggaaaaattcttgaaggaaattaaaagtgctactccgattaatacaagaatgataagaaagaaacaatgccttattgctgacatggggaaaattatagtggtctggatagaagatcaaactgtaactcagtagcttagcttcaaaacacattttaaaacctttttttttcattttctgttttctccctagtctcaagatgtaaccttgaagcaaacaacagaaaccttttattccctccttagccttaaaaaaatacgctaaaacatactttaaaactctgtttccctccctttcccactctacactatgttacaccatgcacatttacctaactatatacttgtatttaattacgtgcttacttagaagttccagtggctaatcttgagacagaccaggaatggagcccaagctgcaaaattctagagattacctcaaggtggtagtcaatatgcagccattgttgatatgatcccagaccacactccaggtggaccatgactcaagatagctaccagaacaagacacacagacattgtacccagcactactccccacatgcctctcattcccagttccctttttaagcccctctcctcagcataaagtttgaaatggttcctttaaggtatgagccttggccatttctcccactgctagctctggaataaagtcactttcctttcaccgcattttgtccatgttactgactttgcaagaagtgagcagctgagtttgtattcggttacaaaaccagccacaacattcccttaagccaaaacctaatccagaaaaataccgtctcttcagtcctatgaaggctaagagagctaaagaagctgcaaaagaaaagtttgaggctagcagagattggtttatgaggttggaggaaagaagccataaaaatataccttgtaatgcaagatggtatatcaccataccatatcatcataccataaaaatgcaagatgaagtagcaagtgctaatgtagaagctatagcaagttatgcagaagatctaaaataattgatgaaggtggcaacacaaaacaacagattttctatgtatatcaaacagctttatactgggaaaagatgccatctaaaactttcatagctagaaagaagtcaatgcctgggttcaatgcttcagcagacaggcctgactcttgttaggagctaatacagttggtaacttaaagttggagctaatattcatttggaattcaaaaaatcctgtagcccttaagaattatgctaaatctactctgcctgcattctataaatagaatcacaaagcctagatgagagaatatctgtttacagtatagtttactgaatattttaaatgcactattgagacttactgctcaaaaaaaaaggattcctttcaaaatattattgctcattgacagtgcacctagtcactcaacagctctggtatagaggtacaaagagattcatgttgtttctatgcctgctaacacaatatctgttctgcagccaatgggaaaaggagtaatttcaacttttaagtcttattatataaggaatacatttcataaagctacagatagtgattcttctgatagatctggtcaaagtaaattgaaaatattttggaaagaattcatcattctagatgccattaagaatatttgtgattcatagaaggaggtcaaaatatcaacaggaatttcaaaagaagttgattccaaacctcatggaaaactatgaaagtttcaagactgcagtagaggaagtaactgcagatgggatggaaagagcaagaggattagaattagaagtggggggcctgaagatgtgactgaattgctgtgatctcatgataaaaccaggagttgcttcttatggatgaggaaagagagtatttcttcagatgcaatctactcctggtgaaaatgctgtgaatattgttgaaataacaacaaaggatctagaatatctcattaacttagtacataaagcagcagcagggcttgagaagattggctccaattttgaaagaagttctattgtgggtaaaatactgtcaaaaagcattgcatgctacagagagatcttttatgaaaggaagtcagttgatgtggctgacttcattgtcttatactaagaaattgccacagtcaccccaaccttcagcagccaacatcccaatcagtcagcagccatctacatcaaggcgagaccctccacggtgaaaatattacaactccctaaaggctggggtgatcattagcatttttaaacaataaaccattcaactctgaccctgtagcaaaaagcaatcatagacaatatgtaaatgaaaggatatggcgaggctgcaataaaaccttatttcacaaaagaggtggcacacccataagccgtagtttgccgaaccccttcctagagctaaaaataccacatcggatatttttttaaaagccataaataggattaacttcagatgagattctgtagcagaagagattagtgaaattaacacggtaactattcacaatgaaatataatgagaacgaagatggaaaaggaggaatatagagaggatcagttaccttcgaaaccatatcaagcagtctagccgaaaaattggagtccctgaagacagaaaggggacagaaaaaatatttgaaaaaataatggctgattatttttcccaaaatttattgaaaacaaacccacagatcaagacagctccagaaaccccaagaagatgaggaaagtaggcttagacttgttaggtaatttttccaagacttttttattacaaggtatgtaccaattcatgtttgttgattcaagaacccaagtttatacctatttggtacactttctcccaagcttgccagaatgagtctagtctccataataagagtgaaaatattgtttttagagaaacccatgtgtatcaggcactgtacaagatattatctcatgtactatctcatttggtcacaacttatctagtagataagaatcattttctccattttacagatggaagaactgaaactagcagaattaacattgtgtgtttaaataattgccagtaaagtaggggaaaaaatgcactctcaagtcttctgtatttccaggcagggctttcctatagagatatgtggatggcatatcccccgccaaaaataatagctgtagatatgcgaactattcaaaaaagaaattgttatatgtgttatacaactagaaatcatgcagtttaggaatatttgaaatatgaactcattgaaaagaaggaaaataagaccttcaatttaaccattaggtcaggcaattgctggcacatctaaattactgacaataaatctcagagcaagtacaatacttctaagtatggttataagaattagaatcataaaaccatagaattgtgaaattacttacacatcatagaatccaatcccttctttttggagaaatggaaacataccccagaaggttaaatcatttgcccaaaataacatgattggttgttgaccctttctactaagccatccccagttccactccagaaaatataaattattcatgcagaaagacaaacttaattttggcaggtcagagatttcagaaagatgtgaattggctaagggttgtgatttatgaatctaggcagctattcagattgccttatctcagctgtccctctgtgaaacataccattctgagtacctaaattgacctctattcaaccccactttaccatcattgggtatgtcatgagaagaagggtaaattactctgacccaatgcaaaatactgagaatcaaaaaatggtagagaggaaacatatatagagattacttccccttgttttccagatgtaaaataagccaagacagtttgtgaccatactctgaaggattaaatataaatcatcctttattttaagcaaattatcagcagcatacatttcaaccatatacacatatacatgtgcatgcatatacacatatacatgtgcatgcatatacacatatacatgtgcatgcatatacacatatacatacatacacaattactcatgcttttatgtaagccccatggaggcaagggctacactgttctcacaaatttctaacaccttgcacagtagctggtattatatatagatgctcaacatttattcaaaagaaaaaaggggtgaataaggacaaacacatagaacagcacagctctaaagcaatgaatgtaacttgcttttttattttcagatttatcatggtatacctaacaaataattataggtatttaaggtgtacaacttcatgttttgatattcatatacattgtgaaataatgaccacagtaaagctaattgacatatccatcgcctcccataattatctttgtgtgtgtgataattacctgtgtgtgtgtgtgtgaacatattcacagtgagaatatgtaagagttacctcttaccaaatttcaagtatacaatacggtattgttaaactatagtcacattgctgtacattagatttccagaagttattcatcttgcataactgaaactttctagtctttgaccatcttcccatttcccactccccactagcttctggcaatcaccattctactctctgcttctatgaatttgactattttagagattccatatacagtgaaatcatatagtatttgtctttctgtttctggcttatttcccgtcaacataatgtccttcattttcattcatgttgcaaatggcaggattttcctcctttaagggcttaacaatattcctctctctctctgtgtgtgtgtgtgtgtgtgtgtgagatttctttatacattaatctgtggatggacatttaggttgtttccataccttggctattgttgaatcaggctgtagtgaacactggggtgcagatagctctatgagataatgatttcattcccttcaggtttatacctagaagtaagattgctgaattattaaggtagctctatttttaattttttgaggaatctccctactgttttccttaatgactatttcaatttacactcccaccaacagtgtgtacaagtgctcccttttctctacatcttaccaacacatcttttattttataatagccattctaacaggtgtgaagtgatatcttattgtgattttgatttgtatttccctgataataagcgatgttgagcactttttaagacttattggccatctgtggttcttcttttgagaaatgtctatttatttttccgcccatttttgagtcaggttatttgagggattttttttttttttttttttttttgctgttgagttgtatgagttcttcatatattttggatattaacccttatcagatatacagtttgcaaataatgttctcccaatctgtaggttgctcattcaatgttgggttttgggggggtttatttagttttggttttgaaggccttttacttttgtgtgtgtgtggtttttgttttgttttattttgtttttgctgtgcagaagctttttaattcaaataacttatctgtatttttgtttttgttgtctggcttttagtgtcctatccaaaaattcatgctcagacccatgcgaagaagcttttgttttatgtttccttccagtaattttatgttctcaggtcttacacttaaaactttaattgatttggagttgatttttttatagggggtgaaataaaggtccaatttcatttttctgcatgtggatatccagttttcccagcatgatttgttgtagaaactatcacttccccactggattttctttacattcttgttgaagataagttgaccttctggtggacttattttggggatcccttaatttccgtttgtctgtgtgtctgtttttatgccaatactatactattttgattactgtagtctttatagtatatttttaaatcaggaagtatgatgcctccagctttgtttttcttgatcaagattgctttggttatttgggatcttttgtagtttcatataaattttaggattgttttttctatttctgtatagaatgcagaattgaggtttcagtagggattgcattgaatctgtagatcactttggatagtgtggacactttaataatattaatttttccaatacatgcatatgaatgtctttccatttatctgtctttttttttcttcatcagtgttttataattttcattgtacaagtctttcgcctctttggttcagttaattcctgagtatttttttctttttattgctattgtaaatgagattattttattaatttctttttcaggtagctcattttttgtttgtgtacagatatgtcactgatttttgtgtgttgattttgtgtcctgcaactttactgaattcatttgttagttctaacaggattttttggttgagtctttagtgtctcctacttgtataattatgttatctgcaaacagagataattttacttctttttttctgatttaaatgttgatatggtttgaatttgtgttcttgtccaaatctcgttgaattgtaatcctcaatgttggaggtgggacctgtgggagatgtttggctcatgggggcagatttccacctcagtgttgctcttgtgacagtgagtgagtgctcgtgagatctggttgtttaaaagtgtgtagcagctccccacgctttctctctctcttcctcctactctggctgtacaaataaatgcctgcatccccttcgccttctgccatgattttaagttttccccagccatgcttcctgtacagcctgtggaatcataagccaattaaacctcttttctttataaattacccagtctccattatttatttatagcaatgcatgaacaggctagtacagatatctttttgggtccaattgctctggttatgacttctagtactatgttgaatataagtggcaaatgtgggcatccttactttgtactggatcttagaggaaaagcttgcagttttttttccattgattatgatgttagcagtgggcttttcatatatggcctttattatgttgaggtaagttccttttatgcctaattagttgaaaggttttatgaggaattgattttgaattttgtcaaatgatctttctgcatctattgaaatgatcatgtggtttttgtctttcattttgttaagttggtatatcacatttactgatttgcaatgtattaagcaatccttgcatctcagagataaatcccactggtgtattattcttctatctatgttgctgaatttggtttgctagtattttatggagggtttttgcatctgtactcttctgggatgttgccctgtagttttcttgtggtgtttttgtctgactctggcaacagggtgaaaatggcttcataaattgagtttggcagtgttcctcttcaatttttcagaagagcttaagaggaatcagtattcattcttctttgaatgtttggtaacttgttgcaaactattaaattagaccagatgtcaatgtaataatatataacatttatgcattaatttgcatgtgttaatcatcatgcataatgctttaactcatttttatttattttgatcctattttgggttctgaacaaaatttaccctgtttcttgtttacaccacaaggtcttaaatgcttttaatctcagaaagaagttttaggacaccaagaatgtctaccaaaagattatacattactcccagggtttagaatagtactggcatatagtagtgattaataaatgtcagcaactttttgtactaatagtagtagtagtaaatctgagctcgccttccctcctttatctgaaactaaaaacttcaagcaaatttgagcaaacacccttgtattggtgcctcaaattttgcccacttactcagaaaatttataaatgtatcctggtcattttaaaaattttagggctaaaagaacaaaggtatattttaatgattaaattaactaacagccttaagtctttctggggttcactcccactagtccttgcttacaagtagatgtcttggtatcttgatagactcaaaaggaaaatgcacttattttccaagtagagacagagagagagagagagaaaagacattgaaaacagacatggaatttgcgtctgttatttattcttccctgaaacactcttactctggccaacacaaaggttctttaccctcaaggaagtagtgactcttctttgcttaaggagtattaatttgttaatatatagtagtctgtataacaaggagaccatagttggtccacggtctcattaaggacaggataaatgttctccgaatcctttcataatccacatacaacaatcacttgaggtaaatacgattttcattgccagtttgagaaactgggattcaaggacgtgaaataatctgcttgagacctcaaatctctgattccagagcccgtgatcttaggtactgtgtgctccctcctactcacattaatgccattcatttatatggggttctttgtatttctcaactacacccctggtatgaattgtacttggttagttctctgcttggcctttgctcttcgcactgagatctgctgaggagtgtaaataagggccaggctctgcagcaccatccaggtgctatgtaccccaataattttctgagctcttcagaggagaaaataaggtcaaagtttatttccccctcacttacccatgtttcagcaatcaatctacattaccttgcaaagagacctagagatgagtttgcaggaaaaacttggagaaaatatagagaggtcaggactggctacatgtgatttttttttttctaatttctagtctccctagccataaaactttctaatgtaagaaatggtcttagggtaaaagtcaaattaatggtgtggctataatgtcctttgattagactttttaaatatttaaggcatgactaatgactatctcaattagacaaaagatttctagatatcttaagagcacttcagaaaagcctaatccaaaaatagctgtaaatgtatgtgtagagagagatatttctttaattatatgactcttactaaaactaagtatattaaatctattacacagaaagccaaagagtgattaagagggttgtaccagcaaaacaactattactttggcttaaaaggccagatattggtcaaattataaagaagatttctggccccccagcttttttctagcaagaagcagtctgagcaagttatttactcaagcatagtcatttctttttttaatgaaaaagggaagacactttcggccaagaacacagagaatggagctacaggccactgacaacaatggaccagggaaccacttccattaagcagaagagtatagtatactgcagaacagctttcagggtaatactactgtgccttaatcatggaatgttccctgcctccagagtagggacaacaggcaatatttttcctagcaagatttcagaattgttatggaccagtgaccgttacatatctcctgtttttccacttttggagtgtaagtgtctactgtagtcatcctattcctgtatcaccattgtatattgatgtcatgtagaacataacttttccctttgtttctccagattctagatcaagagtagccacatccagatataatgcaaatcacaaaatcctggacttcaatcttaattctataattagatgacagttttggcatcctgtaatgaaagtgaagacatgcgggaggcatgttaacatttgtaatcagcaggcacattgcaatagaatatacagttgtcaacaaatattttcttttcatacacccacacctctgcaatgtgacttcacagatccatcaagaggtagaagatgtttctcaaatctaggttcattttgaaactttctttgcctaatgtaacattagcaaacgtaaagcaagcagagtcctaaacaatgcttatgcattgagaatcgccctttttctgcttttggaacctgcagctgttagcatgcaagaaacacaggttgtcactccaatatacacccttaccaattgccatacatttgagatcagtctcactaaggatcatattttcctaaagaaataagcaacatccctcctcagcctaatctttatgtgtgatattttggcccacgtatggtttattcctttgttttattacccaattggatcagaacatgtaagagaaagattggcattatttggccctcatagatctcagcaatgacaatgatgctgcactcccttcttctacacatgcaattaaggttcaagacaattctatacacccctgaaaggagacactgatgatttctacatgtctgacaattgtatacagttgactaaacaatagcattcactactgtacaatggtaaaagccaaagcactattccttcttatgcaaatggttgttagggcttttagatgtcacttcttgggaatcaacacaaagcaaacctgaaattctgattctgagaagatgggaatatacacaaatatctcttatctaaccattctgagggatcattaagttgtccatgtttatttgttcctatccagcacagtactcctattcaatgagaacactgtcccctgtttattggttacaaatacatgtatcatgcagtcacttctccacttgctggaagaaagcaatgacattgtctggagttacaatctttggcagatcacaagaaaatgagaaaggcaagtgaagaaagcaaatataatcaatgattagctgtatgacattataggtggatggaagatagtaagcagatatgtaagtcagaaggtagttactggtctgtcttggtgcctgctggtcctcaacacccataacaatgtcttacagatgatgtatctgctgaaggacaaaagaaaggatgggaaggattgttctcatgatatgtgctagctcctggccttgccttaattagtagttcgctatctttttccttagcccagagatctaattacagatttttccatgtctgtggcaagcattcaacaactagacaaatatagcaatacatcaataatattcaataatgcaataactattatatcctgtgttaacaatttcttaggatttcccagaaattaattatactctatggaagtaaacaataaagaatcaggaatatttcccatgtacttttcctttaggacacacctaaataaaataaaaaggaaaagaaaaagattacttcaacattatcagagaaaactccaagctaaagagcccactaatttagatacagtccatttttaggtaattgcagaagcgttgagtgctcagaacctttgtgggggtggcctcttgctttgctggcactcctggctggctggctggctggctatgctgacagtgtaagtcaagggattattagattggccacatgctctctgcttttgtttctttgtttttgttttgttttgggacagagataggaaggttgaatggggccccagagatctaagagtaaaggaggaggggagagaaatttgtagtgatgagtgttttctgctgtaagagtcctgagagaatgtaagagtttgattctggcagaagcaaactggcaatgtgggtcaagaattaaccaacaggaatgccaggataacatctcctgagacatgtctctaaattacatcaaaaacttctatgaaggatgtgtaagtattatacaaacaaaaaatcaattgtatgagtcttttctgagtattttaccctgaattgcataagtcttggtgaataaattctctacatctatggagaatactgttaagtgtcaaccatatacttcaaaatattctgaatttaaaactataaagagaaaaattcaggaagtgtctttagatgttggtgttttagtgtggctcactctctcaattccctaattaagaagcagaggaaaaaagctttaactacaattaataaacattatttggttgttaagatagtgtacggactgagcttactactggattttttatctaattttcaaaaagaagtattagatattctgattttatttcaaagggattataatggtggggatattaattgaattcaaagctgtataaatatttccaaaattacacatttgattagccacatgtccctatcaactattgcttttcatattttaagagtgagaaatctcataatgcaggaattatatttgatttgatgatctctaagggtctatttggcttcaaaacttcttgactcttacattttttaaatgtgatataaggatttttttaaatgtcctcctttaatgtttgtgtttaaaagattttttttctcctaaaaccataacaggttaaacctccaactgtgattggtcaattccacacccttttctttggatcgatccgaatattcttcctcggggtgctaggctttgcagtttatgggaatgaggccttgcacttcatttgcgatccagacaaaagagaagtaaacctcttctgttacaatcagttcaggccaatcactccacaagtaagtttttctgtgtgcacataaacattaactctacaacaaactcattttctctttaaatgtaaaataatgtcataatatgagaaataccctaacaggttttttgttcctaaggattatgttactttttctttaattagctgtatatttcagataaattgagttttggggagtttcttccaattctggcattttattatctactaatgttatcattattctccagatctatatttgggatatagactagctgtctaataaaataaactacttcatcattatcagtcattgagaggcaattacagtaatatatgactatgttttcacaataaatatgttcaacattactaccttcattatattaagacacatataagatttttatgaaacttggaatttttaaattagactctgttgagagttagtggggtttttttagtgtattttagttacatattgattaattgatttactaagatatttctgacatactttaggtgttctaggcattacaactagttattgtcctggttcctggagctcttttccacctttatgctgcatgtaaaagcatcaatcaagaatgcattcttcaaaagcctatctacactataatttatatactctctgttttattaagaattagtctagcggcaatagcattctggcttcagatttacctctttggtttccaagtaaaatctctttacctgtgtgatgctagatctcttggggaaaacatgattataagatgcatggttccagaacactttgaaaaaaccatttttctcattgcaataaatacatttacaacaattacaattttattatttgttgctgagatttttgagatcatatttagaagattatactttccattcagacaatgaccaaataattacctattgtcatgctgcagttatttatcatttttatttagttttatcttactcagtgagtacaatttcaaaacaaacttacttcaatgtgtctgaaatttttgtctactataaaatatagtgcctggttgtaaggtaaggattcttgaagaaatatttcattttaattttgatcacttttattagaaaatatacacagaactactgttaatttatttttaaacagtgcttttacagagttctctcacatacatgttaattgatcagtttttctgtggccagagaaacttttattgtctttttttacgaagtggaaaattgatgctcatgagggttaatttaggtggtcaaagtcataatccagatatttatatttccctttctgtggaactatacagttttaaatttgagggtgtaattattttgcattcatgtaaaatataacttattaagcacaaaagttggaaattaattattaaagagtaattacatagtttgaccattaacttgaagaaattgaacaattacatttttaaaattttattcaatcggttttcttttcttttatttattattattatactttaagttttagggtacatgtgcacaatgtgcaggttagttacatatgtatacatgtgccatgctggtgtgctgcacccattaactcgtcatttagcattaggtatatctcctaatgctatccctcccccctcgccccaccccacaacagtccccagagtgtgatgttccacttcttgtgtccatgtgttctcattgttcaattcccatctatgagtgagaacatgcggtgtttggttttttgtccttgcgatagtttactgagaatgatgatttccaatttcatccatgtccctacaaaggacatgaactcaccattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatagtcctttgggtatatacccagtaatgggatggctaggtcaaatggtatttctagttctaggtccctgaggaatcgccacactgacttccacaagggttgaactagtttacagtcccaccaacagtgtaaaagtgttcctatttctccacatcctctccagcatctgttgtttcctgactttttaatgattgccattctaactggtgtgagatggtatctccttgtgcttttgatttgcatttctctgatggccagtgatgatgagcattttttcaagtgtcttttggctgcataaatgtcttcttttgagaagtgtttgttcatatcctttgcccactttttgatggggttgtttgtttttttcttgtaaatttgtttgagtcattgtagattctggatattagccctttgtcagatgagtaggttgtgaaaattttctcccgttttgtaggttgcctgttcacgctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaaaccatcttgaattaatttttgtataaggtgtaaggaagggatccagtttcagcttcctacatatggctagccagttttcccagcaccatttattaaatagggaatcctttccccattgtttgtttttctcaggtttgtcaaagatcagatagttgtagatatgcggcagtatttctgagggctctgttctgttccattgatctagatctctgttttggtaccagtaccatgctgttttggttactgtagccttgtagtatagtttgaagtcaggtagggtgatgcctgcagctttgttcttttggcttaggattgacttggtgatgtgggctcttttttggttccatatgaattttaaagtcgttttttccaattctgtgaagaaagtcattggtagcttaatggggatggtattgaatctataaattaccttgggcagtatggccattttcacgatattgattcttcctacccatgagcatggaatgttcttccatttcttgtatcctcttttatttcattgagcagtggtttgcagttctccttgaagaggtccttcacgtcccttgtaagttggattcctaggtattttattctctttgaagcaattgtgaatgggagttcactcatgatttggttctctgtttgtctgttattggtgtctacgaatgcttgtgatttttgtacattgattttgtatcctgagactttgctgaagttgcttatcagcttaaggagattttgggctgagacaatggggttttctagatatacagtcatgtaatctgcaaaaagggacaatttgacttcctcttttcctaattgaataccctttatttccttctcctgcctaattgccctggccggaacttccaacactatgttgaataggagtggtgagagagggcatccctgtcttgtgccagttttcaaagggaatgcttccagtttttgcccattcagtatgatattggctgtggtttgtcacagatagctcttattattttgagataagtcccatcaatacctaatttcttgagagtttttagcatgaagcgttgttgaattttgtcaaaggccttttctgcatctattgagataatcatgtggtttttgtctttggttctgtttatatgctggattacatttattgatttgcgcatattgaaccagccttgcatcccagggatgaagcccacttgatcatggtggatattcaatcagttttcttgaaagtttcaatattaaaatgatatagaaatatagttaccaaataaataaaaaatgctatggattatattgcgcatgggatccttgtttcttcttggggaaaaaaaaaacctttctgtgcccacagatgtcctgcaactataacttctatatttatcaaaagggaacactgtgtttatattaagttagacttcctcaatagctatgaaattatttcagagacaattttatattgatttagtgtatttctttttatctgcctgccttaccaacaatcatttgattcatttgatattatttaaaatccttatgtattactgccttatactggtaacttagtagggaaatcagtatagtcaaatactaaggttttccatttttcctcaagctttatgcagcctgtgtttgatatcatgaatttctggatctaaggttttcatcattgaggttttctctacatgaaagcacaggagaaaatccaacttatcttcatttcacaaatagctactgatgtctgctatttaacaagtactgcattaaaaaattcgtataaaaagatcatcaagatttaatacctttataaaatcatactctagcacgtgagctataaaatcatactatagcagtggcatgccaacagggtggggactggtaaaaattgtccactctacaaataaaggatatttattgactttctttatttagaataactaacaattggtgttaataaacagcaaccttgtttaatattttatccttatttttaaattctctatagataacataccccttgattgcctgcattcaaggtggaatgctcccgccaatctgctgacaaacatacacattttcattatgggtcctatttttcctgcaactttgcaaggctggtacttttttattgaatgtcaggcattgtgtgttttatcctgttggatgccaattatttttcttctcataaatattcttcaacttagttctggagcacagttaagttacttggaaacagatgatcctttctgcttccttttaagctttgttatatatgaccagtgtagtacttactgaaaggccagttttgccccaatactaaggaagaacttttctgtgtgctctatcagatgtctatttggtggtttggaaatactatcctttcactagtctcaaaaatcttgaattctaccctcctgctggttgactgtggtggtgacacaaattgccactgccatatgaaacaggttctctccgtgtccaaggaaagaaaggagatggggcaaaaggaccttcttctggtttgcctctcaggattcttccccagggaagatcacttttccaaaaaatcccacagaagacttccccttaacattattgcccaatcatagataaacgcttggatttattcttactctgattcatcctttagggtagggcattgtcaacgtatatccctttattaagggatttttccactctgactttgggaacagcaactattctcagtcttgtgtgaatcttgagtattgttccttttgatcctttcaattagttcttttcctgtaaagatatttaaagatgttgcactgccatcaggactcacttaaatgccctttgcagatctctggagctctctcgcttttccagctaccttactgtagcatccattaaagccaacttcctcggcctccctgagctcttgatctcttcaactgacaaggtggaaggatggcatctctaagccaccaaagaaactttgcttccctctacttctttgaactaaacactacatattgttatgtttaaagatagagataagacgagacaggtggtttagacaatcttgtaaattcactaccgacctactatgatttcattttattagtaactatatcagaattgttagcacacagctatatagtcctgaataataaatgctatatatcaaaattcatattccaatataaaaactaatttttctgactaaaatgcaaatatagtaaaaattaataagagcatcaaaactaaacaatatctaaccatttgaaatgatatttaaaagcatttcataaaaagctctttggtgaaataaggtaatttaaactgaagcttttccgactatttatgtgaacaagaagtgggatgctacatattaaaacctatgagatatgagcaaattcgtagtgcactgaaaattgacagctgaaaatacatctattatgaaaaaggaaacataaatgtaattcaaaaagcaaacataagaacttattaaacaaagataaacaaaaataatttaataaggatataggtaaaaagtaacattttagaaaacaaacaaaataaaataaataaatcccagatcactcttgaaaattacaataaaattgataaacctcggcaaatcaaatcaagtgtagaagtatactattataagattcttgtaatatatgtaaagtatattatcagttgaagtatgctgtgataactttaagttgtatattataaaatataaaacaaccagtttaaaaagccaacacaattttggcttaacaagcaaacaaacaaaattaactggaatcataaaacattcaattaatataaaaggtggcaggaaaggaaaaaagagaacaaaagcaggtgaaacaaatagaaacaataacaaggtagtggaaccaaacccaaacatatcaatggttaacaataaatacaaaagatcctggcactccaaaaacatagagattgtctaaatgtatcttttaaaagccagaccaaattattaacaagaaccccactttaaacatttttaaatatttaaaggtttaatattttaaaatcttgaatattttatagaaaataaatgggaaaagatgtatcatgcaaatcctaagcatcagagagctcaattggctatattaatatgagaaaactcaagtcaattttacagcaaggaatgatgacagagattaaagagacatttcataatgatgaaagtataatttcatcaggaagcataatagttgtaatatgtatgccaccagttaatagagattcagaatgcatgaagcaaaacctgatagattgaaaaaagaaatatatcctattatagctaaagatttcaacacttctctctcagtaataaactgacaaagtaaatagaatatcaaaaaggatatagaggattataaattattaataagcaacttgaactaattgatatttatagaatactccacccagcaacaacagaacagatgttcttttcaagtgtgtgtgtaacattcaccaaaagagatcatttgctggcccataagaaagtctcaaggatagaaatcatacagactatagtctctggtcacaatggaattaaactagaaattaataaaattaagatatcagggatgcatctaaatgtttgaaaaattaacaacatacctttattaacccatggatcaaagaaaaaattacctgggaaattaaaaactactttaaacaaaaatgcaaatacaacttatcaaagtaagtggaaagcagttaaaacagtgtttggtggaatattagaagttctaaatattatgttagaaaagaagttatattgtgattttaactgctcactttctgaagttgtgttgctttgtttttttttttttttaagatggagtctcactctgtctccagggctggagtgcagtgttgcgatcacgactcactgcaacctctgcatcctgggttcaagcgattctcctgcctcagcctcccgaatagctgggattacaggcacccgccactacacccagctaattttttgtatttttagtagagatggggtttcaccatgttggccaggctgtctcgaactcctgaccccgcgattcaccggcctcggcctcccaaagtgctgagattacaggcatgagccaccacgcccggcctgaagtttttaaaagataatttaaatacaaattaaatagaaggatgcaaataaaaatacgagtacaaaacacagtgatataaaacccaaagacaatagagaaaatcaattaaaccaaaatctggttctttgaaaagattaataaaacttataaatttctggtttgataatatgagataataagggagaaaatgaaaatcatccataagataaatcagaaaagggacattgtagtaaaaccttgaagcgattgtaaggaaacatcctgaacaatgttaggtcaataagtttttgatacttagatgaaaaaatttctaaattccaaactactaaaaattgaaagacataaacaaaaaatatgacttatccatatatcgatttttaaaattttaaatccaaagctttcccataaagaaatgccaggccctgatgaattcagtggtgaattccactaaatgtttaaggaagaaataatactccaaaatcttttttaggaattagaagagaatatttgccatttcatgtaaggaggctagcataatgttgatattaaaaattcttagcaaaaatatatttacaaataggatccagcaatatatataaaaataatacatcacattaggcggggtttaccccgggaatgaaaagttatattataaacacccatttataatgaaacaaaccaaaaaccctaaacctctcactttaaatgagatctacctaagcttgataaatagcatctaaggaaacttacagaaattaacaatttcccctgtagtctcaaaacaggcaaggctttctactttttccatttgtgtttaacgttgaactggaattcaataagacaaaaacaaaataaacatatatatataaatatatatttatgcaataagtacaataacacaaacaatatatgaattgcaaaataataaatctttattcacagacatggtcatgtacatagaaaattctaaagaacgttccaaaaaattaaatttataggccaagcactgtggttcatgcctgtaatcccagcacttttagaggtgaagccagtaggatcgcttgagtctaggagtttgagattagcctaggcaatatagcaagactccacctctacaaaaaataagaaaattagccaggcatggtggtgcctgcctgcagtcccagctactccagaggctgaggtaagaggatgacttgagcccaggagtttgaggctgcagtgagctatgattgcaccactgccctctagcctgggggacggaacaagactctaactttaaaaatatatataaataaacttatgaggaataatttttctatagagtaataaaaaataaaatttaaatgtaaaaaatcatttacaatgcaataaaaaatatgaaatgcatagtgataaatttttcaaaatatgtgctagacctgtacaatgaaaactacgaaacagtgatgaaaataattaaagactttttaattttaattttattttttattttttgagacggagtctcgctctgtcgcccaggctggagtgcagtggcacaatcttggctcactgccacctctgcctcccgggttcaagcgattctcttgcctcagtatcccaagtagctgggattacaggcatgtgccaccacaccctgctaattttgtacttttagtagagccggggtttctccatgttggccaggctgatcacaaactcctgacctcaggtgatccactctcctcggcttcccaaagtgctggaattacaggcgtgagccactgcaccattttaagtggaaaaataaaccatgtcgagtaaggcttggcagtcttactcatttgtaactttagtcattataaactgatctgtaaattcaatataattccagtcaaaatcctaggaaacttatatagaaattgacaagctgtttctaaaatttatatggaaatacaggagatgtagaatagccaacacaattttgcaaaagcaaaggaaaaaaaaaaaacagacagaggacttacactacatactctgaagacttctttaaaggtacaataatcaaaatcatgtggaccgggcatgaagataggcatatggaatgggaacaatcaagagactggaaatatgtttgctcgtatatagttagcttattgttttaaatgtgctaatgcaattcacatttgtgaatacattatattcgtatatagttagcttattgttttaaatgtgccggaacaattaaatatccgtgtttaaaacataaaatgcaatgtttatagtgtctacatgtcccagccatgggcggatggggtggcaaatggtcctggccaagttttcagggtcttccctatcattcttctgcggaaaatttaaggaaaaattatttctacttgggggggatgctaaaataataggatgttagtctcatgatactggaagccaaatttctaccacatacagtatcttaaaaagatacagctatagatatatatattatcctgattacattgactgatgccctgtcatttgccaacaagatggttctgaccaaacggacacagaatatttttattgtcagatgatcacacatacatgtgtgtatgtagggtatggtgtaaaacattttttcccatcaaaacacctgtcagctctagtttctctccattttcttcttcctatggttgccctcaccccctattttgttctacagctctgccctccccttacttgccaaggttctagcccagtcctagagggtgatgtcagatccttcagaaactggtctgagatgaatggagaagaagaatgtaggtctttctagtaaaatatcatagtaaaacaagaaaaagcaacctcacagtcattaatatttgttttatagcataatttcaatgtgtgttacactaacactgtctctgtactgttctccatcaaatcaattatcatctcatgaaagggttagcatatttagaaagaagagagcatgaggctcttgtctgtaatctcagcactttgggaggccgaggcaggagtatcacttgagactaagagttcaagacctgcctaggcaacaaaataataataattagccatagtgttatgtgcctgtggtcccagttactcaggaggctgaggcaagaagatccttgagcccaggagtccaagactgcagcgagctctgatagtgtgctgcactccagcttaggtgacagagtgagaacctgtctaaaaaaaaaaaaaaaaaaagaaagaaaaaaagaaggaaggaaggagaaaagaaagaaaagaaaagagcatgtgttggcagatcagagagtaaaatccaactccaaccatttcactttcttatttttccctcagtcctgctcatgagggtatgcaaataagagtacacatgaatgtatgcaaatgagaaagagtggcaaaattcacttctgaagggggagatcaggagagtaacaggagggtgcagccttctaccaggaagaggaacatttgtttctcagacataagatgatggaatagagaaaagataaaacataagatctagaaagacatcatagtcaagtagtaatggctaggtgcacaggctctgaaaccaaaatacctagattttaatgtggaatactcatccttcctggctgtgacctagtgcaagttatctagattctatgtgtcttatttttctcatctgtaaaataataatgatatgttcctcatagggttgtggtgcaaattaaataaattaatataaagaccctagaaacatgcatgatacatagttgatgctcagcaaatgctgctagctagttattattactttaagttgtggtagaggcaaggcaaaataattcatatctggtggtggccttaatctcaatagcaggaaatgctgttgtagaccaaggaaattggggctgagtgcctagcttgaatagagcgagagaagtttgaaacaccatctgtggactacagcactggtccttaaccctagacgtaacattaaaattacatgaggaccttttaaagatactgacatttaggatcccacctagaacaattaagtgagaatgcctggagtgggctttaaagttgatctttaagggcagctgcggttgagaatcaagaagtaataggaaacaaataaatgaaaagttgtgagtatagaaagaaaacagttatggttatccaactctgcttttcttcattgatttctctaccaatctagcaacttttgactggaaagtccaaatagtgggagtaagagaaagagaaagaaaccatacattctccagtggtaggaaatatgccgctgagattggggaagaagacagaactgagtttcaggctgagtaaaaaagcccgacccagaataagatgatggactttgcaaataggtctaggcaacgtatgtggagtgggataatatgaggacatggagcggtttcttctgggggtgagagagtgatcagaaaatagtaggcagaggggaatttccgagctggagattttggctcttggggatagtgtgatttcagtgaaaactagttttaagatgaattgtcaaaactgaggactgagataaaataaagaaggttattggaggaagtaaataaagtgtacagtcctgaaagatataagtaagggatggagaggagaggaagagaattgaagtcattgagggtagaaggaaaagtgatgcctactgtacaatggttaagagttaccagcgttgaaaacgtcccaaacaccctatcttacattaagacaagataataaatatgaaaatactttacaaattgttaatcactctccagaaaaaaaaaaggtgatctacagattattcattcactaaaatacgtactagccagctgagaacaaaagttcaatcttctttaagcttcatatgtttagcttaatttggcgcgaaatctgattattttatccagtatgtcaacatagaaaaatttaatttacaatttaaacacattatttctctctcatgcaagtattgaaattaaagtttctaaaatcaaaaaggcttctaaaggacactgctatatggaatattaatgtggcatattaactggaagtggtaattcctgaatgacgccaaaggcaattctcgcctttatactttctcccagtcaacatacattattttcttgtttttccttttctatccttccttttgccacaaacaacaaaccaaacaaaaaagcaaaacaaaacaaaaacccttcctcctaccagcagagagcgctagcgccatgcgcggcataagcgccaaaatgctcgggtcttctgtgggttctaaccgccgagagccaagcaccctgaggttgtcccagctggggatccgtagttgacttgacgtcgctgagcaacggaagagtgggcagcatttgctctgaacgctcgtgcgcgctaccgcccagacggaagcggaagtgccggtggagcgcgagtaggaagtggtgagttcggagtagagatggccgcgcttgcaccgctgcccccgctccccgcacagttcaagagcatacagcatcatctgaggacggctcaggagcatgacaagcgagaccctgtggtggcttattactgtgagtctttccgagtggccgcgccctttctttcccagttgcattttagggcccacacacctccctgaggttcttggggcatgccccgcccccctcgctttaaacctgagctttgacctcgagcctacccagggaactccctgggttcccaccccctggcagtaggaatcccaaaacaccatggtgtccactgcttctcctatcttgtgcttaaatgctccagtactgactacacaggctcttgaactgtggaatataatcttccaaggttttctctgtgtgtgtacacacaagagcttcttgtctcaaataggaatcctgaaaataaattgagttaggtttaaaacgaaggtgagtgtccgaaagaaggagtgatgtggataaaaggacgatagactagttgaaaacatagtaataagtgaatattatttatgacagcatgcaagcccaatcagaaactcatttggttaaatggggagtatctgctactaaataagcagttgaatttgacctttccccacccagctgctctctcctaccatgcagaatttttagttttgacttctttgaataatacccgctgttgagacctttgaaagcagtattttcactttgagtgttatacgttgaatttacagtttgattaaaaaaaatataggttaactctgctcaaacttgtagtgagtaaagggagtgccagtaattctgtgttaactttattttgtattctgtactcttaactttactgcaaataaaacaagtaactggacaattataattctgaaaaggatatttagagttgagaagttggatataatgcgtccattgttgtgtatattgtaaggttagctaaaatctggtcactgttatctctgccatactccaaatgtaccctgtttctcaaatgtgcaaggccttttcagacctaccatcttccactctcttggaatgtgcacctttttcttgcacttggcaaactcatgattcaagatctaacccaaatgtcaccacttctgtgggcagcaaattgattattctctgtgcattacttcattttgttcaaattttacagcatcatttttattatacttgttcttcagtttcctcaagcagggtccatattcattcagtatgtgttcattgagctacctttgtatcaagcattagtaggcgctgtgactacatttgctgcatttttggagcttacatacaatggaggtagagagtttcaacaatatagagtctatcatacatagagtattaaaagcttatgaagacaaatagagcaaggaaaaggaataagagtatcaggagtagtggtggcagggagtgcagatgggatttcagtttcatagtggtcaggaacacttcactgaattgacatttggggaaataaaagagtgaaaggcataccttgcaccatctgggaaagagtattctccatagaggttataaaagtcccgaagtagaggcttgctggaaggaggagtaagtagactattgtgactggagtggatggggcttgggagtgatgggataaggtcaaagaatctctcatccctaaaggaaattcctgttcccgatccctgtatcatgtatctttgtgacaaaccagggacaccttactcactgtcgtcctttccctctagatttttctaaacctaatccagtttcctttatttaaaaatataacataaactctcaccatatcattccctaaagttgcagctctgcttttccagccttataggtaagtttgaaatagttgtccataagttagctttacgcctttatcttgtagagcctttcagcccatgcagtctggttttcatgcccagtatttcactgaaactgctctcatcaggcttatgaagaaatatttttattgctcaggtgacacttaacaattttagttatgaaacatgtacatataaaagcatatgtaatgtgcagacagtttaaggaataataaaatgaacactaatatgcctatcacatttgatgttattaaactttttaatttttgacaatctggtgggtgtgaaatggtggtgtctcattggagcgaaatctgcaattctctgagtcttaatgaggtttagcatcttttcatatgttaattaaccatttgtgattcggttttgaaatacttgtttattgcttttgcccatttatctgtcacagtcttgtcttaataatgttagatgttaatcctttgttatatgtgttgtaaatatcttctcccatttcagtttgatttttcactctgaagacctttgatgttcagaagttcttaatttaaaaatgttatcaatcattgtatgaatctcttaggacttaaccttctgattttataggctttcatttcttttcgtgtatttgtttgggactttggctttctacatctgtagatgggtgtttttaatcaattttggaaaattttctctactattatttgttcaaatattgcttatatttctattctctcataaaagtttgattagacatgttttgcacttctcccatttaacttccttgtctcttgattctgtcatttttttttatctctttgtctttctgtgctgcattctgtgtaatttcttgaggtttatcttcacctccctatattttattgtttaacccttttattgaatttctactttaattttttattttagtgttctcttttggttttcatattggcctggccatttctgatagtttcttgttactgatatttttaaccactctatttctgtgaacactttaaatatatggatttatgtttgctgtttgataacattgtagctgctatatttgtgggcctgattctgcttttcaacagaacactgctcttggtgacttctttccttacaattgtgggctagtcatgctagaccagcgctctccaaactggagtaggcaaataattccaaaggaatcaattttccaattcttgacttccatgttttccttccaaaaactgttcttaacaaagctcctgtggtcagggtagcaaagtagtatataatatgctgcttatcttttcctacatcctgttcacaattgtccttctcccactttaatgaagaacggcatactctcacgcatcctgagtgcttttatgttgtattgccttgaaagagaaggtggaaaatcctccagggtgtccagacaaaagagacaattcaaattacccatgttagtgaagcctccattaattaaggcattggatagaccttcctatctttcctggtcttacattgaagaaaaccagccagagcaaaaaataaaccttcattcgggagttcaagaccagcctgaccaacatgaagaaaccctgtctgtactaaaaatacaaaattagctgggtgtggtggcgcatgcctgtaatcctagctacttgggaggctgaggcaggagaatcacttgaacctgggaggcagaagtcgcagtaagctgagatcgtgccattgcactccagcctgggcagcaagagcgaaactccatctccaaaaaaaaaaaaaaagctaagcatgaaaggttccaaaagagcattctaatttgaggggaaggaggtagaactttgtataagggggatgcagggagtcacctggaattgtatatgggggatgcagggagtcacctggagtttgtctcttttcaggaacagttggtcagtggatctccgaagagggaggagttattctgcgatattagcagccattgttaggtcatcttggattttatcaagaggttgaggaggaacagtttggggccaaggtcatgagcaagatgatgtgaggaagattagctgtagggacagggatgtggagggaccacagtgggaaatctcagtctttcagagtctcttacatttatacatgtatctgttaagggtaatgccttatgttaaaaccggtcctgtgttgcagtattctgaattctcaaaatgataaaaattttcatgagatgaccttactgcctcattctgtattcattattaaagaataccaatcttgggttgagagcaaaaccaagaacaaaggagaaatactgaagatgagagtaccttgtttcatccaaacaagctcctgcaaggctctgcagcttattgctattttataattagaatttagaaataaaatggggacatgagttgacattccaactggaatattgtatttctctgaaaaagtaactcttacttggctgattagtttggtgttagcaactggcattgccattaaacagtgtggtagacattctctttaaactaaatgagctaaaatcttcggctctgaggttttttgttttgttttgttcttctggaagtacatttaaaacagcttggccgagcacggtggctcatgcctgtaatcccagcactttgggaggctgaggcaggcagatcacccgaggtcaggagttcaagatcagcctggccaatatggtgaaaccccatctctactaaaaatacagaaattagctggatgtggtggcaggtgcctgtaatcccagctactggggaggctgaggcaggagaattgcttgaacctggaggtggaggttgcagtgagctgagatcgtgcaattgcactccaacctggggaacaggagcaagacttcgtctcaaaaaaataataagaaaaagaagaagaagaagaaaataaaacagctgatgagattgaaccttatttgttattactattttttttttttcactgagggatgttggaacaagtatttcaagttttcccaatcctttctgcatcctacaataaataagaaggctctgattgaaagaagatgatgaatctttataatatctttttgcatacatcacaggaattgagaaaatgagtaatgatggggtaacaaatcctttttaatttttaaacaaattttaaagtgggcctaatttaattgtcagcttagaatttatttaaaatatttgatgataggtggttatatggtttttagcctgtaactcagaaataatttaaagaatttggtgattttgctgtgtaacatgggaaaaactgggatttggggggattgttttttgtgaatttaatttataaaaataaaaaataacaacagaaccccaatagtctactcttcctcattatggcaataaataatattaatacataaatatttgatttaattcataacaatgtaaaatttctgttaaaaaagtactttttgtattttaaaatgtgataaatatcaagttgctatgatagtttagtttcaaagatacaacttttagatgtcaatatttgatgtagtatagaaatcacattttttatacctgtttaaccttctcatgaaaaggtgtagacatcaacataaaaacatgttaagggatacatttctataatcttagagcatataataattttataaattcctagagcagggaaacttttttttgtgagaaaaaaattcaagagtattttgctaaactacttgctgattcataaaagctccatgggctatgtgctaccctctgccaggaatccttctgcattcctattaatttgactaacttactgactcagtgcagattttacttcttacagattatttttcatgacctcttaaagatgatctagaaattgttcttgtgtgcccctcatcacatgtgttataatataaacatctgtttatctttcaatcttgattctcctggaggacagggattatctttttctttttttaccacctgacacataaatggaatttacaaattcttaatgaatgcctcctctctaaatattactaatagtccactaaaatgtaaactctatgagaacaagaagtatgtcgtgtgatgatcattgaatgtccacctcctaatatagtatctaagacatgttagataacctgtaaaacttatctgtcgattgagtaaacaaactatacagtaattcatagcttttttttttaatgttctaccacaaatcaatgacaaaatagaatggaaacaatcctagtactctaactcattaccttactatgtttataatgaattttagattgagtcataggtcatattatcatatgatttacaccttgtgccctatcctttctagtatttatatcatttccaaaaatgattcacttctggccttaatgggaattttctagtgttttatcactttttaaaattaccttaatattcctacatttcgaagttggttggtcttttgttttctttttaaatcaggaatgaatgttgaaataatgtatatcaaattacttttggccgtctatggaaatgctaataggcttattgtttatgtgtttgaactttttaatgtaagtagcagcaaaatagtaaattctctcatatttgaaacatccctccatttctggaaagaatcccattagtttttgcattttcttttaattaaactttttcttttgaaatagttgtaggtccatgtgcagcacatgtagttgtaagaaatattacagagagattctgtgtaccctttacccaatgtcccccaatgataatatcttgcaaaactataataatgtaccataaccagaatattggcattggtacaattcactggtttattcaggctttgtcagttttacatgtatttgtgtgtgtgtgtgtatatttagttctaaacagctttgtcaggtgtacattcctgtacccattaccatagtcaagatagagaataattaagaattccccttgttgcccttttattaatataacctgccttctccttttcgctacctcacccccatcccctggtagccagtaacttgttgtccatttctaaagttttatcatttaaaatgttctattaaatgaaatcatatataagcttttgggattggcttttttcatttggcataatctctggagatttatccaagtttattccttttttaatgctcagtagaatttcaccctatgtgtatactacagtgtaacagtttaatcattgaagacatttaagtgttttaaatttgtgacaattatgaataaagtgaatataatcacgtatagtttttgtgtgaccctagtttccatttccctgggataaatgcccacaaattcagttgctagatcatatggtaattgcatgtttagttttataagaagctgtcaaactgttttgcagagcatctgtaccattttacactcttattggcaacacatgaataagtgatagagtttctcttcattctcaccagcattttgtgtcactatttttaattagtcattcttaataggtacagtgatatctcattgtggttttagtttttatttccctgatagctaatacagttgaaaaccttttcatgtgcttatttaccatatgggtatcatcttcagtaaaatgtcttcatgtttttgctcattatttttgagtttgagagttcttaatatattatagttacgttatcattttgagatttttagtaacagcgttactctggtttcttagatattgttgagaaaattactccttttcctcaaatgtgagttggattaaaaacgcaagcagatttaccgctttctttagatttaaaaaaatcattgatacagcagaactttgtgcttttttatatttctcaatttcttccattagaaaaatattttcctcttgagccattcttgatatagtagttttctagaatatctttcatttctactgtattttgaaatttattagctagagttaagcattcatcctagttagtaataaatgtaaattaaagtggaataacaatttttgactgtaaaaatatgactcagtacaaatgagtacgcgttcagatccttgctgacatggctgtgtgattggtacaaagtttggaaagcattttggcaaaatgtagagtatctaattcagtaattccagtttggggaaacgtgttcaggaaataactatacatttagtaagacctttatgcagaatttcctgaatgattatttatacatttatgataagctcaaaataacctaaaatatatatcattatggaaatggttaagtaaattatgttatatccactgcatagaaagtaatgtaattgtttaaacattacaaagcatcttttataacgtgagggaaggtttatatgaaagtgtggaatacggaattattatacatgcagttccatatgtctatctgaagaaatctttgtcttcagtgacccctcatgatttgagttctgaatcaccttttgtagttttaatcaaattaatttcattttgttactagaacattaggcacttggttgtctccaagccttttaacattctactttatctgccttgacacctcttctcttccccaccacactcactagatttttatcctttgggtactagcttgaaagtcactttctctgggaggccttttcttaagtctcctagttttaaggtgtttctttttgttctttatgccttggtgtagctttaccgtaattgctttttcatttgcttgtctttcttctagactgtaaactgaggaaggcttacactgtgctaccagtttttattcatttactctgcctggtagtgctaggccactagagatatttacataataaagaacaggtgctcaaaaagtgttagccaaattgacctgaattttaaggcagttgtggtccctagagggaagtatggccatacagttgtcacctaataaggcagacaactagcattcctgtagctgattggcattttaacagtgctttctttcaggatgtctgcctcacagtctttctggtccttctgttactaagtgatagaaccaagactcgaataaacaaagtcagattaaaaaaaacggttgaatgaaaaattgttggtagtagctagtaattagagaaccagttattgagtgagccacagagtaactgaggggaaagggactagtacaatccatggcaaaagaaaaaggcaaaaaagccagtgaaaaaatctcggagattcccctaagtggagagtggaaaatgaaggagatgctttctgttaatagtatgtctctgagctccatctctttatttttctttaatgaagccggaaaatatttgaatctttactaaaagtgggcactgttagataaatattttgattctgccaggtttggtgctgtagataaagctaaactcagaactttccccttcctttttcagtttgccgtgagtaaatgtataaaatttcaagtttcaatttttaaagcttcctctagggggtgacattgtaaagttaataaacttccagttaaagtatacacacagtctcaagagtcttcatttgttgatatcatcatcagaaaattaaatacagtatagttgttcaggaagctgtaagtatatataaagttatttcagttctgagatgttacaggacataccagtagaaaatgttaatttagtgtaaatgctaaataacaatggatttctttattgatagatggtaaactacatggatattagcattaacaatcacttgcttatgcctgtactcctagcactttgggaggcccaggtgggcagatcacgaggtcagaagttcaagaccagcctggccaatatggtgaaaccctgtctactaaaaatacaaaaattagccgggcgtggtagcgtttacctgtagtcccagctactcaggaggctgaggcagaagaatcgcttgaacccaggaggcagaggtggcagtgagccgagattgcgccactgcactccagcctggtgacagagcgagactccgtctcaaaaaaatgataataataataacttgcctcttactattttttgttgggttaatcacatagaaattggattttaaattcattcagacaagtttaactaaaccaataaagagaagcagttcctttcagtctttgctggttcctgaatgatagactagagtctatagtcttattgcttgattacttacttttttttattaataagctttctcagggtactttactgtagcattgacaataaacacacagaatgttggactactgatttatccattagccttccattcctcttaagtttgtttttgtgaacatatatgcaaacatgagttttattttgtaaaaattatttctttcctttttgagtaatgtcaactcattttacatctctttagaaaaaaccgtaaagttgaaggggctgtggagtcagataacagattcttaactttcatttcttttttggcattcatacaggtttaagcatctttgataaggtttgtcttctatgacaattatatttggttgttcaaagtggaagcttatatactcttgaacagtcaaggtatatatatagtagatttcaataactatgcttgatataagttcctactttcactgaaattcttcattgggctgttacatttacattttttatgtttttttatatttatttttctgtggcttgtcagatttttatgtttttactattttgggttttttttttttaacctcaatttattattgtttctacttggtgacccttaacaagtcttggaggagcaattctttgttgtcagggctgcccagtacctttcaggatattgctgttttaaatggtaatagtacccccagacattgcattttaaaatagaagttaaaaaaaaaaaagcctccacacttttgtagctcccccgagaggcagtataattgaaaatctaaatacctatcagtatggaaagtttatattatgtaactgttaaagatatatggagttacatttattacaaaagctgccatagcccacagcataatgtaaaaatgaagggtgcaaacaaattacatgttgcaatgtatataacatttgtggttatatataattttatatgtgtatatgaagagagacatcttgctggatgcagggtaagactctggagccacactgcctgagtcaaatcctaacctatcgtttatggcctgcatgaccttatgagtttcaggttttttattaacatactcaggataataataagatcaacttcacaaaattttttggtggattaatcaatttttctatttttatgtgactaaatgaatacatgatccatggcgattactcgtttgatattagttattatcaagttattattattccagttcagtgggatcttatcaatagtatattgctggatcttatgtttttatccattataacaacctctaccttttaattgcaatgtttaaaacatttataattaatgtaatgagtatgtttgggtttaagtcttgctattggttttctatgtctcatttgttgtttgtttcttctttctcctttttctgcctttttgataatcgaagttcttttagaattctgtcatacctccactgtgaagttactagatattcctcttttatttttttagtggttgctctagaatgcttaccatagcttatcatagtctactgtctcataatataccacctaatatttaaggaaagatctttactgtcttttcccctctcatatcctttgcctatagttgtcatacgttgtacttatacgtataccataaaccttatatattttttaactattctcttttaaagaaatttataaaatgtaaaaataaaaatttttatattttgcgacataaatatcattttcagtactcatcaagatccaagttttaaatctggtattggttgggcatggtggctcatgcctgtaatctcagcactttgggaggccgaggtgggtagatcacatgagctcaggagttggagaccagcctaggcaacatggtgaaaccctgtctctaccaaaaatacaataagaaattacccagacatggtgtcccgcacctgtagtctcagctacttgggaggctgaggtggaagaaccatctgcgcccaggaagtggaggttgcagtgagctgagattgtgccactgcactccaacctgggcaacagaacgagaccccatctcaaaaattatataaactactttgggtagtttatattgcaatgttccagagtttactaatcttttcttttttggtgtctatactattaatcctgtccactgaatttttcatttcaggtattattattattattattattattattattattattattattattattattttgagacaaagtcttgctctgttgccaggctggaatgcagtgatgcaatctcagctcactgcaacttctgcctcctgggttcaagcaattttcctgccgcagcctccctagtagctgggactacaggtgcctgccaccacacccagctaattttttgtatttttagtagagacagggtttcaccgtgttggccaggatggtctcgatctcctgatctcatgatccacccacctcggcctcccaaagtgctgggattacaggcatgagccaccgtgcccggccgatatatattttacctctagaagtttcatttggattcgtttgtgtatattccatttctcctttctattcatggttttctttaaatgctttctatagttctctagtatgttaatgtcactatcttctgtttttattattttgtcattgtttgatctcatactgttggcttatattttttcttcttatggatcacattttcctatctgttggcctctttagtaatttttgactggcagtagggcattgtgaattttacattcttgaatgtctggagtttgtcatctttctttgaagggattcaatctggccaacaagtaatttggagttcagtttgattcttttgtgtattgtttttttgtttatttttagcttttcagggtaggtctaaagtagcctttgctctagggagagtttaacaccgctacaaaagtatgcccatcttggattctctactgaatacccagggtaacatatagaactcttcactctctctggttggagcttgaatgcgttctaaccctgtgtgtgcattgggaacattcaacttattgaacaggttttgttcattctttggccttgaggagcttccccctgcacaccatatgttagtattcagctgagtctccaggttacccttcttcagatttctgggttttttcctgcatagctcccttttctttagacctctgccccttaatgtacaactgcctcagtctccctgaattcactccagtgtgttttttcaactcaagaggactgttttctgcttgggactcctcttcctgggccttagtttggcgtgtgcctccgggcagaatgctgggctgatcattggtgccacctcatttgtttcctttctccaggtatcatggtcttcctctatctctgttgtctgaaaacttgttacatatattttgttcagattttttctgtttacagtgggatgataaccatagttacttcatcaaggccagaagtagaatctgtgttctcattttaataatcaaatcatcacttagtgttcgccatgtgtcagcacaataatatcagaatcccagtgattatctttttattctttggacaatgaaaaagccagatattcttaccctatactttgattttcattacatcatttaataggaagtcaggagtggctttttcttaaaattgttgttacgacaggagttccaaaagtatttatttaacgaagggatgagtgaagtaagtattctttattagcaggcattcattcatgcttccttccttcccccccccccctttttttgggtcaaatagtgtgcctaaattatttaatttggaaagtagttagatatgttttgtacaaaaactgtataataatctttgacacagaaatcccttcacaaaggataatactaaccatatagaaaagatctgcaatatatttaggaatagaataacattcagttctattttttggaataaaatttgcttttgtgtatcaatatgtattctattgagtgccacattttttaacctatcaaagcctcactcctcacagttgcttttatatctttttgcgtgtgtttttatcatgcgtatttcatagttttatgttcttatggataagcaaggatgtgttagaatgttaatgttcaaattctaaggaactttggattacatataccttcagaattagtaaatgtttgttttctaaatgtctcacattaaattaaattcaagttggaaagtatttaatccttttgcaaatatgcctcattactcatcatcaaataatatttattcataaagataaacacatttccttgatgaaataaatcaaatatattttcttatagatgattttagctaaatgtttatttgttctgtttttgtaggtattttccatgttagacattaatttttcatcgtattgctgctgctagaatgaattgcttgtctcagagttctttatgaaagagatccttttttcatccctgtggcaaaaagatgttttagtgtacttaaactgagttttcttaagtgaattcaaggaattttcctttttattaatagtagaaaatgtatcttatggtaaattttttgtacttaagaattctttgcaatgtaagatatttagaaatataaaagccaggccaatttttgtcctaaatcttttaatgctgagaggatccaattcttcaattaaagatattaccatataataatgtccttgtaattgcaaagactacatatgcacacaaactaagaaaaaaatgaatgtaggccaggctaattaaactatattataattacactgtgtttaactattagttatctggattaggttaacttctaaaggacaagaagtgaatattttgtttatatttgtatgtgctgcgttaattatctgcatgtttgcttaatggttacatcctgagatggctgtcactaaagccaagggcagtcttaggaatcaaccttatttctctactgtctaggttgttccctatatttcttcccaaaattgatctatcaagtagctaactctgctccatgaatggtaggcctcacatagtgttcactactatggttaaaaagagagaaagacctgtggggagatgacactgtcggtaccatccttcaaattattattttatcatattggccagtgtacatttagatcatgaataattacctgatgtgtatgtatgattgggtaagttggttgtcttcgagattaaagtgtgtttgaaatagtcatttgggatgttgggaaagcaagtatcaagcccatttgagactgataattacgatatttgtaatgatgacaatctgtcgtcagtttctgctgcttggatgcagatatagagaaagaagatagttgggtttatgtatgagtatgcttttgccagagggatgtaataaaaaatttagaggtagaaggagatagtaaaataaagttcttaaaatgtaacatcaaagctagttgcagagggaagttaaaggggagaagactgatcataatgaagaagtagtaagaagccagggaactggaaacctgtagtaatgtgcatagttgaatgttggaagaagaggagattatgtttagagagtgggcgcttgatgtattgattttggcagtagtttgaggtggcagtttaattatagaatggccactgagtgaaagagagcacataaaattgttggaggtcaggggtcaataagaattgagaacatgggctgtgtttacatttgaattcaatttacttgcttattgcagaaaatccaaaataacaatggctaagtaaagtaaggatttactctttcatgtaaagaaagtctgatgttggcagtaccctatgttagtacaccaattccattaagtcatcagggaccccagctgattgcagttcaaatttaccagccagcacacttccaaggttgctttgtagcccaagataggtactagggcttcagtcatctagtatttatattctaggtagtagggaggaaaaaagggagagggtctgcaagatctttccctgctgtcattcccccttttatggagacattgcaacagtctttcctaactatttctgggaatataatattagtcttggttacatggccatattttgctttggagaatactgggaaatgtactcttttggctaggtatgttacaactccttagtaataatatagcagcttgccagtcctaaagaggtatgtgagaaatttttttttttaagttactaaagaagactgcaaatacaatgatttcttcaagtgacaactgcttttagttaagacagagaaggagaaggaatcagaaaatgtagaggagtatgctgatgaaaagcagtggttccacgagattttggtagaaggcatgggggtgtggggaagaggcatgggctaggttggggcaagaaaacatagttcataattgagaggagtgaggatgccataaagcagcaagtctcaaccttttgatcacctatccatatgagttagaaaaaacattgaatacaaatctgcaatatgttatgtaaattatttatgaattacatttacatattgatgtactaatactgtattataagagatatataaaatagaaatttttaaagaattagataaaatatcaatataaatgctaatattttattttccatactctagccaattgttttgccaatccctgggatcatatgggactcaaaggcctagctagcttcagtatagcatagggtgttggctctcttaggggaatatgagccacctggcatggagctgatcctactttctgctagaagcatcctcttaaaaataagagaaaagatacctaatattctttgggaaattttggcaatacagtaagatacagtaagcttaaatttgaggaggaaagagcatattaagatttatagatattaccttgtaaggagataacatttgatctgagatcaaattagcatccctttgtatgtcaaagtgatcttcagtgctagttagtgtgcagtgaaagcaaagtgcactacgctggtagtgcagtatatctcggttacacttttggaactcttttttttttctccttaatacctagatggatcgaattcttaaaattgatatgtggttatgaatacattattaaattaaacttcaagctctgtaatatgagatagccctcaaagcctaagcactaaaaagcagttcctctggacaaaaccattaaaattaaaaacacacagatatgataaataggtaactgtttcgtgtgtatattaatttttaaagagaatttttgacatgtgaccataattgaattggtaattctgagagtaacagatattcaactttgttataaagctctagtaaattaaacaacggtagacccatagaataacacagcagggtaggcagtatacagagttgggccctattatcccatggaaacttaatatattataatgaatgataaaaatgacatttaaatcagtaggacagaatgagctattctttcattcatgtgtttgtctattcagaaaatgtttatcaagggccaaccactgtcctagatgccagggatacatcagcaaaccaaatagactaatatccctgtcatcatggagtgtaaattctagttagggtacagacaggttaaatacatagaagattccctttggtgggggaacgttatatctctacttcatacagtataaagaattgttacaagtcaatttgtttaaaagcaaaccaatttgacagaagattattttattttgatagctatccttaattcataaaggagaatatggagctattcagtaaatatctaacagttttttagtggttaggaaaatataaaatcaaacagagtgtttttagtcttcagattgataggaatgtaagtttaataagttttttgtgagtttaggcaaaatgagtgcttgtatatgttgcggatacaatggtgtattgatacttttgttttggggggcagcgtaaccgtaggtctcaaaatgaaacaggcacagagactatgacccaagaatctcacctcttggttcccctgggaactctcttgcattatgcctaaggaggtattttgcaattcaggagttttactatcaatcttcattcaaaaacttcgttgcattttgttgttgcatttgtgcacaacagttgtaatgaaaatttgagagctacctaaatgtgcttttgttagcatgatgcattcatgctgtagaacattagcactgacacagatctctaggacatattgttgaatgtaaggggtaaattacagacattgtatgtaaacatcagtggtaacagcagttaccactagaactgttcacagttcttatcactgggaaagctactgaaattgtggtgacagctatttaggtttagccttatctcagttgtttttattaactttttaaagagaaggtatatttattcaaagagagagtatatgtaaaattactatagcaattctttctataaacctcagttcaagtctcatttcccactatcccagcccattttgaatattttgtcagtatcacttatttggcacttggcaggtgctcttgtacatatggttgtttgctgtgtgctctgtcttaccaattaaattataggtgcctttgacagcttaggacatacctagtcctctttttttttttttttaacataataccaaaagagaaggccttatttgataaaaaaatttatcatgaatgtcttgcattctttggataatatttttgtgctttttaggtttataacttccatagtaaatcagttttatttctaaatttacttgaatttttaattatttattagcaattatattttaaacactcataaacatggatgtttaaaaatgaaattgttcaaattatcttacttttctttctaggtcgtttatacgcaatgcagactggaatgaagatcgatagtaaaactcctgaatgtcgcaaatttttatcaaagttaatggatcagttagaagctgtaagttaaccactgatcatttattttctggttatggttaaaataccattttattcatttgcgtgtctgtgttgtcattttagttctttcccttggcaacaatcaaacaaagccattatacctgaggaaaaactagtaataatttattttcatttatttgctgtatacttccagagaggttatgagtgttaattaaagtatgttcaagtatctttgcatatgccatcatatcttgttccacattattatagatggcctttggctcctccttttataggtgaaaaacccctcctttttttttttttaagttgagacagggtctcactctgtcacccaggctggagtgcattgcagtggcgtgatctctcggcttgctgcaacccccacctcccaggttcaagcaattctcttacatcagcctcccacgtagctaggactacaggcacacgctaaacgcgcccggctagtttttttgtatattttggtagagatggagtttgaccatgttggccaggcctgtctgaaactcctgacctcaagttatacactcacctcagcctcccaaagtgctgggattacaggcatgagccaccatgcccagccgtgaaaaaccctttctaaccttcccttgcagtcacgtggatgattaatttgggaatcttaatatttcttataataatgaaataatgggctgtgtatttagtgaaaggaacaatgaaggaaatgatgccaattacttatcctttcttcctccctctctggggtcccagggcaagatattcttatggtttaggcatccttccctcctagcaggaatgtcgtaggtgactaattagtcaccttcttgaacctaatataacgtcacagatcactgtagaggtacttttggagaagtgcctattggattggatgtcagtgcataaagaaggcagtgccaaccttagtagtcacacttagtaatgaggactctgtcctgtaactcctggacccagccatacctggtttctcttttaacaaagtcagggtacactcattaattcatctcctccaagactgttacattaatagtcgtgacttactttttatttgcttatttagatatccaacctcaggagaattagaaacctattctatcagttgtattattttgcttagagaaaatttagacaaataaaaaccaaaatgaaaacacactagtcagcccagagctttttattgttttcattgtttttatgtattgttaggaggttatgattcaaacaagacttatgcgaagacagaacttcctacctagttgtataaagcagccatgggcagtagtgttctctctcacttggtgtggctgtctggcttactgactcctgtcgtctgctactgttaactacccaaaatcagcctcatggcagcactgaggaaattcagctgttctggagcctatctggccttgcatttctacagctgcttctatggatacaagataaatttgagtactctctttctagggaatgggttggggtagaagggagaatgtttctcacacatagcagtatatttgtaaaatccaactctagcattttgtatagtataatgtctctttattaacttcactgtatagcagtagtagctcagataatagttcttgggtaagacaaaattcaaacgttttctgaagtgtaaaatcacatttataaagggactcatcaggaatttatcactatctgcattaaatgacaggtaagataaatgtattccatggtaagggcacactgtggtgtttgtattacagttttaaaacttcaagtatattatgtttttgctgtcaggtattttctgatgaagatgagatgaagtggcctactctcactaaaattgttctacaatgaaatctgcctttacaaatgattttgcagtttggatacacaaattactgttatctgtggggattttttttttcttttttctgttcttgttcaggataaacatagataaaatttccttaaatttcagcattaaatcttttctggaccataagttattctgtttaattatgaaagtatttactttgctgattttatgaaaaatcctggggcttcttttaatttaattttttactttataacatctttgaaaaaagcagtttttaattaactagtttgatgctcagatctgatactccagagagttattttattcctgtattgtagtctgagtaaaaattaggaactttttttaaatgctttaaattattgtgtctatagaaaagggctaaaaatttacagatagaagttgcattgattgcaggtatatatttgtctaatttttaaaagcttccataatttgattctgagtttgtcatcttataccttactttgaattagatcttttttgtttttcacactatgtgctctgagagatatcattattattattattattattattattattattattattattttgagacagagtctcgctcattcgcccaggctggagtgcagtggcgcgatctcagcccactgcaagctcctcctcccaggttcatgccattctcctgcctcagcctcccgagtagctgggactacagctgcccgccaccatgcccagctaatttctttttgtatttttagtagagacggggtttcactgtgttagccagaatggtctcgatctcctgacctcgtgatccacccgcctcagcctctcaaagtactgggattacgagtgtgaaccactgtgcccggccgagagatattattttacgacatgatgaaccttctagtcttattttttttagatttgacagaaattgaaatgggaataaattaaaattttaagttatatatgcctagaaattattttctaattctatttttagggtaacttatagtttgggtaataaaacatgattttgaaatatttgatgcttccttcacatggataattggatatattatccttttatgcttggttattttgattgttagagctaaattatattttcagtttatcataagtgtgtttcttcaaagttgtaagcattggattttgttttaaatgcattgggctgaggcatagcagctctttttgcaagatttcattgatgacatcttttattgaaatgaatgtaaaataatttacttaaaatgattattagaattgtttgtaattaagtcaacacttctgagagtccaaaatcataagctatgtatctgattttattttagctaaagaagcagttgggtgataatgaagctattactcaagaaatagtgggctgtgcccatttggagaattatgctttgaaaatgtttttgtatgcagacaatgaagatcgtgctggacgatttcacaagtaagtaaagagaaaaataaaaattattttattaattttgtaactgtataaccaaaattaactagttttctctggaacactttctaacctgctgattgatttaggtttttttagaaaaaaattatcaaacctcacggtgattttagattacaaattcgggcctttctcttataagaaaatggctgaaagaagaaatacccagggcagatttatttacttagtaaatatgctctacttagctattttttaacatttagtaaaatctgagttgattttagccaaaatcacagccccgcctgatgattttgattttgaaggtacccaccccaatcaattcaaatgatttatcagtataatatttacatttaaagaaatacattatggtttgatatggagtcagataatactataattacatttttctaaagtcaaaaacatacaaaaaatcttgacgtagcgcatttacttgtaatgtgagtcttgttactttctcatagtaacagattagaaaaccatttttgttattttcttgaaatctaattttatttaaaacatgaatttcagagtgcttttataaagataggaattttttttcttatagctaaatgacaaaactacattttaatgtgtttcatatttaaactagaccgctctcttttctcttccagaaacatgatcaagtccttctatactgcaagtcttttgatagatgtcataacagtatttggagaactcactgatgaagtgagtgtacattctttattgtcttattagctgaagatcagtaatgtttctgtttatcaatattgttattgcattgtttatttacagcagaatgtctgtcagaaattaatgcaagcaaaaaatgtaattttgcattttttattagccatttttaaaaagtaaattatttccaataatatattttaattttgtactaagttctttatttttatttttgtatttgttttttgagacaggatattgctctgttgcccaggctggagtgcagtggtgtgatctcagctcactgcagcctcagcctgcccgggctcaagcaattctcctgcctcagcctcctgagtatctgggactacaggcacaaggcaccatagctggctaattttgtatttttttgtagagacatggttttaccaagctggtgtcgaactcttgagctcaagcaatcttgcctgcctcagcctcccaaagtgctggaattacaggtgtgaaccccattgcacctggcctgtaataagttctttaaatccagcatgtattttacacttcagcatatgtgtgactactgtattggacagcacaggtttagagtttgatcttactaagtattaacatattactaatcctgtatgttgttaagtttttacactgtaatttgttgaacatacttgaggtagaatcatttttttttttgagatggaattttgctcttgttgcccaggctggagtgcaatggcacagtcttggttcactgcaacctccgcctcccaggttcaagcgattctcctgcctcagtctccctagtagctgggattacaggcggatgccacgacacccagctaatttttgtatttttactagagacagggtttcaccatgttggtcaggctggttttgaactcctgacctcaggtaatccgcccaccttggcctcccaaagtgctgggattacaggcatgagccaacacactgggactggaggtagaatctttttatgactttttttctgtttaatttctagtcagcattattgttaatggtttgtttcccttgtaaaatgcatataagacttaatattttataacatacttcctgttcattctatctatttgattcccataatgatttaccataaggtaagcaaagcacataacctttgtatacatgggcaaatggggctaaatgacaaatttactactttaagttcagtatcattttcaccataacaggctttaccattcatgtggagaatttattttctgagagggaatatattaatctagaaaaaggaagagttataaatgagattgatacatatgtgttatatgagtgatttgaacactatgggcaatgttttttttgtgattaaacttttttttcaaaatgatgagtagctcttagtaaagtcccaaacaaaacagagtacaatcactgtataaggcatttttgtaaaagattgtatagcaaaactgcaaaaagttattttttgtttatattcaaaatgaagttactctctaagcttgatgagtataagcaggggttttgccagcatgaaagttgtacaggacatttcaaagttgtgacaaatgaaggacttttctttttttgtgagactgagtctctcgctctgtcaccaggctggagtgcagtggcacaatcttggctcactgcaacctctacctcctgggttcaagtgattcccctgcctcagcctcccaagtagctgggcctacaggtgtgcaccaccacacctggctaattttttgtattttagcagagatggggtttcactgtgttggccaggatgatctcaatctcctgacctcgtgatccacctgcctcggcctcccaaagtgctgggattacaggcatgagctaccaagtccagccaggacattttttttgtaatgtgactgtccctttaatttcaaaacatggagcaattttggcccttgcctgcacactgccagtagcatttcccagtaattgagctaactagaagccacctgagatatttcaaaacagccctaccctagggtatggggcaatgcccatttagagccactgctctcagatattttatactcttatacagagtcatataaaggagaactgatacccggagtgtgaaaacctgaactattactcaatgggtattacctttttatattctgatggccttatggatccacctttttaactcccttttacctcatctcctgttattaatgatccaaattttcttttcttctctgttttactagtgtgaggcactatgctaaatacttggggatacagaggtaatataaacatgacatgatggaaagctttgagtggttcagtagaactttggagagtaccaggtaggtgaagaagaatagtgagaattcagattagaagagtaagtcataagccaggtcagacagatgatggaagacctacaatcttcagtttgtatttttgagtaaagaactatgccttggggtgctttgtataataggagcctgtacaatgaactgaagtgagggagaactacaaaaccatttgacaaaaaaaaaaaagaaaaaaaaactggttgatgattaactatgggccttagttgagaggtggaaaactgtacatgatgagttgtttttggtttgagaaacaataatatattgaaacttagactttaaaatttgaggtgcaagtatgacagccaaaaaggaattaccagaagcctcttggaaataaataagcaaaagacagcaaagtagaggggacaattcaagttataagattagacaaacccttcaggtaagtggattgttttgaatgagagagatgactaaataaatacccttggtaaacacttatttttgcagtgtaagaggaagaagttaataaacacattcgtagatgtgaatggaaattcaagataccagaagagaggatcatgataaggcaaagtaacagatcagaatgccacatggtttattgtgctctgggcctacaggcgtgcgccaccatgcctggctaattttttgtattttagtagagacggggtttcactgtgttggccaggatggtcttgatctcctgatctcgtgatctgccctctcctagttcttatttggggaagctaccttcccctatgtattttagaagcaagcacataatcctttaaagttataactgctaacaatggtgaatccagccaacaggtaaagtaatagtcataggaaaaagaacaaaatttccagaactcttaagtgagtaataggttctcttcacttaaggaatatgtaacacttccacatacataagctacattaatttatctgtatttcaggagaataatctaggtttacttttagctaccattaatgaagaaccatcttccttaattttttgaacatagtaactagggcaaaactgtaaatgaggccagtgagaaggcttcatgtgagattggggtgatgggatgggatttgtttagatattagggttactaaagagtaagggtaaagggatttttttaccccctatctcactacccaacctgctccctaagcccctttgccttgcactggtgctagaataaagtagcgtctttgttggtggataaaggattccagatagttggaggggtctggaatgggatcccacacacagtcccacctggatcactgcttagtggagctgtaggagcgggactgccaccacccagacctacctgaatggtagagccactggcagcttgcaccctgagcctggaaaaggtgcagctttcaactccaacctgtgggagcagccacaggggctgtaccctgcaaagccataggggcagagctgcccaaggccaccacttgtaccagtgttccctggatgctggtcatggagtcaaggattattttgaaactctgaagtttaatgtctactatgttggtttttggacttgtgtggggcctatcgtgcctttttttgggcagtttctcccttttagaatggggatgcttacccaatgcctgtaccaccattctttcttagaaataaataacttgcttttaatcttacaggctcacaggtggaaggaatgtgccttgattcttagatgagattttggacttttgagttgatgctgcaatgagttaaatctttaggagactattgggaagggataattatattttgcaatgtgaaaaggacatgagatttgagggggcgggagcagaggtggaattgtatagtttggatgtttgtccctgccaaaactcatgttaaaatgtgatcctcagtgttggaggtgaggcctggtgggaggagtggtcatggggatggatcttttatgaatggcttggtgccctccccatggtaataagtgagtttttgccctgttatttcacgtgagaagtggtggtttaaaagagcctggcgtctctcttgctgcctctcctgccttgcgacacgctggcttccttttgccttccatcatgagtaagagcatcctgggcctcaccagaagccaagcagatgctgggcccaggcttatgcagcctgcggaatgtgaaggctcttttctgtataaattagccaacatcaggtattcctttatagcagtgaaaacagactaatacaagatgtaaacaacctgaataaccgaagccttctgtgtgatatctgtacatgatgatttgggatattctaattaagttatttttacttaaaattccatcccttttcaaaaaggccactggttcacaagatgaattatgcaatttacataactaattcatcttattttgagctttttttccctgcagttcgttcttctgtcattgaagaacctacaggaacttcttatttcctaacactgcaagtccaagctcctctgtcagattttcaggttttctgtcatgctccgtactctgcttgctgccctatttgccagtcctactttgtagaccaggctgctcactgtcttctcatttttcacctttggaaatgtgtttttagccggctttgcctaagttttatcttctcttcaggtctcacctatattattctagtccttacatgaatttctccattctctcagctctcccccacctgtatttagagttctaactttataaatgtattgacttcatttttgtgtattgtatttttgaataaattatattgcaagtacttgaagagggggctttgtcttcttgattagtttctgcttgaaaagttgctatagtgtttcattttttaacctgtagatggaaaaatgccttacacttgtttatatataacttattttatttcataacttttctaaaatgtaatagatctcatttactcaatgataattttcttggtcatttcttgatttttttttccttttaatttcatgtcattactcacttgtataaaactaaagtctattttctttagtccttcaacatttttgtttttttattttttaatattttgtctgccactattctatttctcagttatcttatctctattttaggtatatgtatttagctcttttaactgtgccttattatcattccatcacaacattttaattaaatttgctgttatgtaagcttctagctctgttgttacataaactgtagttctcttggaatcagtgcccagttttagttatagagtcaacataaatattttctttttctgctatagcatcttgtataatctgtttgtggccaatattattgataggcttcctttcattgtattttagattcatttcactactagcagtgtttgaggaacagataacattttactatttttcattcataatctttggttaagattaatactgccaagttaggtagaacatgaaaattacaggtgaaagataatgctattcttatatatggagtttttgctatttgagggaatgagatgaatatgttttctgccctcgttgagcttatgttctaacctggaaagagaaacagaataactctaatgatacatgatgtattaatgaaatgtagggaaggtatgcattggcagtacctaacattagcctggcactatgcttagacaccttgtttcatctttcacaactctgaattatagtgagaaaactgagggtcagaaaaatataaagtgcttggccccagatacatagcccaggacaatatttctcaaactctctgtgataaaggttcagcctttttttttttttttaaattttcaattctttgcagatgattttgtaaaatacaaatgcaagtaataaatgaattacaaaagagaaaatttaaaaaggcatacagatagatatacagcataatttgctatgtgtgtttcaaatatttctaaatccagtttcagtattatgttgtcacaaactcgtaagcagttttgcagaccagcagtgtttctgggaccacattttgattggcacagatctagatcttttttggatcctgttatggtcctcctggcttgaaaaacagggctgcacatttactgaggcaataaggcacatgaatagctggctgtgagaaggtggtctgtttaagggtatccgtgtgtactggaacgtttcaaagtgagcaacatcttattattagcctagaaaaccatggtaaagcagagatattttccaactacaaaagcatttattccttacatacaccatactttaggttttcatgttcttactgtatcctgaaagtctcattcttagcaattatcatagtagataaatatgagagtagagttatgtctaattacagtagaaattccatgtgtcttgtactcacttgtatgataattgccaagaacaatgtcttacacctaattgatgagttgtaaatgaatgaaatattttttcatacagtattagtataaagtaattaagagtgcaggcattgggcctccaaattctgtcactccataactgcatgactttgggtaagttaacttatgtaagcctgtttcaacatacgtaagatgatgaaaattgtaatacctgttttgtcaagttgtcatggagatcaagtgaggaaatatatgtaaagcctttagcaaagtgcctagcatgtaagtgctttaaaaaaattggctcttgcagattctagcagtagtaaggagtatagcttgagaaggccgattaggaagcctttatgaactagggtaaaagattaaaaacttgagttttcagaaaggagatcagagagtagggttacgttaaaaaaaaatatgctaaatgtgctttttctgttggaaggtaatttttttacacacaaaaaaatcagttcgtgtagtccattctaagtactaaatgtgtattcattgctagttttagcctgtaacctgagtctgaagcatatagctctatcatataataatgtttaaaccatgttttaataatattttactgggctgtatttagagaggttgtcagcaaatacataaaatttttcatggaaactatcctaaactgatgtggcttatatatttactttgtatttagatgagcttattcacgggcattaatgtattattgctactgtatttgggagtctaacatgtacatttggagttccaaaaggagtacaaagaaaacgagtacaaaaagatatctgaagaaataatgaccacagattttccaaattgagtaaaaaagcagctacagattcaagaagcacagtggacaattaggttaatataaaggaaatcacacctagaaacattgtagtcaaaccactgaagtctagtgatggaagagaaaatcttgaaaaagcagccttgagaaaatgtgttacacacagggtaacagtgttgtgagggatagctgacttctcattttttaaaaaattggaggctggaggataataaaatgacatatttaaagggctgaaagaaaaaaaataaaacaaatgaacaaaaaccctgtcaactcagaattctatatacagcaaagctgtgcttcaaaaaatgaaggttttaaaaaaacatttttaggcaagttaattcattgctagcaggtctgcactaaagatccaaagaactaaagaacagctaaaatgaaggaagtttttcaggcagaaggaaaaggataccaagtaggaatttgatttacaggaaggaatgaacaacactggacacagtaatgtaggtaaatgtaaaagactatatatttttaatttctttaaaagatacatgactatatttgtaaaaattattttaactgtacatatatatatttggcaaactctaaagaaggcagagaaggggaagagaaggaaacataaacaggtgggaccaatgcaaaacacatagcaaattttagacctaaatacagctatgttgttacataccataattgtaaatggactaacacccaaattttatagtagaggttttcagactagatttttttttaaaagcaagccttaactgtatactgtttctaagagatactgttcaaatacaaatataaatattttgaaaatgaaaatatggaaaaagatgcttaatgcagatactaagtaaatagaatctcaagtggccatagataaaataggctttgagtagatgtgttactagaaataaaaggggccattttataataatgggtcagttcatcaagaagacaatacagttacaaatgtctgtgcacctaataataaaactttcaaactatatgaaacaaaaatcaacaaaaaaagaaaaataaggaaaaactcataatcataattggaaattttaacacccccattagtcatcgatagaataatttttttaaatcaataaaataacacgaataacgagtggccacataaattgttgtctagaatgtgaaaaaccaagcgctttcatacattgcttgatggagatgttagatgttatatccactttaggaaaagagttggtcattttttttttaatgctaaacatactcccttttacccagcaattcctattctggtttttatccaagaaaaataaaaacatatgtcctgaaaaagacttgttgaggagtgcttatgggaagtttattcataatagcccaaagctagaaacaaccctgatgtccaccaacaggggcactggtaaacacattggggtattagatacaaaaaggaactgactgctgatataacctacaacatggatgaatctagtagacattatgctgagcaaaaaaagagccggaagtatacaaactatatgattcccttcatatacatatgtgtgtacatgcgcgcacaccaaaggaagttgatctgggaagggatataaatagaagtatggtttacccaggtatattaatctgtttgtcacaatattaaattgtgcactgaagatgtatgcatctcaaagtatgttcgttttactgcagaagttgaatgttgaactattttattgataggtttggtttatcttagtatgggttgacagttctaaacctgcttattctatattctaagagtgaccaaatgattaaatatattgagggagacagttttctcacttttggggaatttagttacaatgtggaatgagagaagactagattgtgttgtgctgttaggttggaattgttgtaatcttaattcatgcttttaaatatattacactagatgaatagatctatttatataggtataatatgtatactatagtttgtgtatctgtatactctgctaggagcaatgatgcagcagtagcagtgagcacacagtgagcatccctagtgcctgattttctgttctaattttattctgcataaggaaccaggactttcgtaaaaagtgcttaatctagggctaagtccaggaaggctacagataaggccagaccttcttgtgacagaaaggaggaaagtgttatcataatcataggacccagaagccgacttgaaagggttcccattgtccaagccagggacagtttgagcataaaaataagaatgatagtaatggatgataactcattgaataaattaagaatctgtataggtccagactgatacatatgaagaaataaataaatgaataaataatagaagagcagagaaggctctttgtcatagtattctaactataaatatacaaatagtgataaaattaaattattagtgggctttaaaagtagtaggtggaaagtttgataaaaagaagtatatttacatgtctctgaatatcttaccaaattgcttattgatatcagaggaaaatagtaattcaataatgagaaaacttgtaacacacctctttaggccaagtcattaaacctaacaccactaatattgggacagctcacgtcatgtgcatcctaataagatgatctgaaaaagacaaacatcgcttcagtgataatgcttccaaaaacgtataacccgaacgtaatcatgaggagacatcagacaaatcaatagacattttacagcttggttggtattttttaaaaagtcaaggtcaagaaacactaatcatgctccttagattagatctgggcctggggggaaaataactacaaaggacgtgattgggacaattgacaaaatttattgggactgtggatcagactgtgtaactattaaattttccgatttttgagattgtcctagattttggaaagtgcaatgaaagggtaaggggacaccgtgtcttcaatttactcttaaatggtacagaaaaaaaaaaaaaaaaatatatatatatatatatatatacacacacacacacagacacactttttttttttttgatacggagtctcgctctgttgcccagggtggagtgcagtggcgcgatctcacctctctgcaagctccgcttcccgggttcatgccattctcctgcctcagcctcctgagtagctgggactacaggtggctgctaccatgcccagctaattttttgtatttttagtagagatggggtttcactgtgttagccaggatggtctcaatctcctgacctcgtgatccgccttcctcggcctcctgaagtgctgggattacaggcataagccaccgtgccaggcctgacacacacactttttatattttatatatatatatatatatgtatatgtactttttatacatttatatgtagaaataaattgataaaaattaaatagttggagaatctgagtagaagatatgtgagagtatgttgtgctatttttaaaactttctgtaaatttgatgaaaactatatttttttttcaaaaaataattaacattggtttcttttcttaccccagtagattaagtattaaacagttaccgaccttaccttgtttggaaatcttttgtttacttggaacatatattccaatgttatgatattttaaaaatagaggagttatatttaagtctttgtgtattaagttatagttatgatttggggggtatagttttactctcccttttaaaaacttgtttgctgaaattatagttgctttgaaaaatataaaaggattaaaatgttgaatgaatatcaggaaatacatgtaatctgtgactataaatatttcagtgtctgagtaattttgataataaatttgtttaatatgtttttcaagcatttctcattataccacatctcagtgttctgggagttatgtggaagtcttgtttatataataacttgggaggttgagggactaagagtataaatgtatttgtgatgttgccacaaagttagagattattaatcccatttttatcactgtctactttgaaaatcttatgaaagctgtggattctcatgctaatgtgtattgcatttttgcatgtaatttggagggtgttccaggaagaggcaagagagagtgctacatttttgagactacagtacaagctacctattcttgttcaagaaataacaaggagaacaatgtggcagaatccagaatgagaaggagtgataggataggagatgagaatgagggtggtggggggaggattcaaacagagaatttataaaatttgacttgtatttttaaagtattgttcccttctgtaatggacaagagtggaaaaggcaaactcattagtatgttattaaataatcaaggtaaaagataatgcttgctaggaccagagtttgccaaagaggacatgttgagtagtggttggattctggatatattttgaatgtagagctgacaaaattttaacagtttcattggcagagtgtaaaagatacagagaactcaaaaatgactccaagggttggacctgacaactataagatttttaaccattgtggccatttatagagttggtgggggaaaatcaggagttggttttgaacttggaggagcttatcaaacatacaggacaaatatggaattggatgtatacttatacaagatcctaaggttcagagaagtctgaacagaagatataaatttggaagttggcagcaaatacacctcatggtatttaagggtggtacatttaaagccattagactgcgtgagatcatcaagtgtagaaagaagagacaaggaatccaagagctgaagcctgaggtactcctgacactgggacatgaaaaaggacaagtataaaaggactgaaggagcgcgcagcaagggagaaggaaaacccggaggtcttgataaccaggaaagcaagtgtaagggggggcatcaaggaatggggtgggaaataatcacctgttcatgctgataggcgtcaaggaagatggcatgtaagccttgaatttaggtggcaaaaatcacaattactttcacaccaacctaatagcaatatagaagtaatctgtaaccttgacaaaagctgttgcagtgactggtggagattaaaaacttgcctaggatgggttcaatataaaatcaaagaggaagaattagagacagctggtgtaaaactttgtctttcaaggtgactttttggtatgctaatggagaataatttatatcaaatttttcatagctctagccaggaatttattattacactcttgtgagtcttacaggtcctaagtttgaaaatccctcctcccgcctatggttgctgttgtctaaccagtcatgcttcagtgtagcaagtgatttaaaaattaaatgaaaattcatgctaattcttaagtggccaaaatttgcagttgtcagtgattctcatcaatctaataacaaaacaggaacttagaggccaaggacaaaagtaaaagttctttttgcagttcctgtctcttagaaaggatgtttaatcagccaaaaggagttaatgaatttcaaaaatacatcttgaaaatttccttttaaaatattgtttagtatccagcatcctttacatcctttattttaaagaaaacaacattgaaaagtgaattagtggaattacaactgccggaaatttctgctaaatagtatatgcagcagtttgtaggaatagggatgttttggaaacaggatgaaataaaaattaaatacgttgctttactaaactgagcccttttcaacttagtttcttaaatttcacatactaatgcagaaactcaaattggtttaaacttctctacactgctcatgcttagatattaggactgaaagaaccttctaaagtcattacaacttttctactaagtctttagacaggattaaattatttcagatagaagaaaatttagcctaattttaaagaccctcaaagaaggcagtttaaactttccttagcaatttcttcatttacttgtaaaatagttttcttcgtaactaccaaaaggtacattctgcattgataaacattaagtagctgatctttaaggcttattttctgttatttcatctattttaatctgagttgcaaattgcagcgtggtaattgtagtttaccaagatagacctgaatgagtggctaactttactactaaaacagtatgaccttcagtaaattactttacttttgtaatgacatttcttcatctctaaaatgataagattatagaatcccaagaaagaaggatgaagaaatagggacttcagataagacacgtgtcacatttagggatgtcagttattgcgtggtttcacattagactctaaaactcatgcttgactcattcatctcatgtatccccagcacttagcatagtacctgacttgagtaaataataaataacttgacttactggaaatgagggtgcttcatagggagtaaacatttgcacttagccttggaggaaaagagactgggcagaaaggaaaccatgttagataagagagaatagcataagaagagaatgcaggtaagacaggaatccaatcttgattgagggaaatggaaataagactgagtgtccacaatgtagagggccttgaatgccagattaaactgtatttacattgagccagtcttataatgtctcaaagccttagtgtgagtaaaatgtgacctgcctaaatttcgaggttttgatgaagaccaagtagaggaaaatgtgtggaaatgctttataacctgtagaatgctataaagatgtcagtccaagactttaatcttgtcttggatttatcttacgtatccaactagcatttaatatgtatcttctatccatggcatattggtttatttatctttattctccaagtatttccttatttctatctttgcttgtacttttccttctctccagaatcttgttattgcttccattttttcacatcttacccatcttgcatggccaaactaaagtatcatttcctttaccttattctgttttttctttattctctgaactgttccatgtacttactataggaaacaggtttaatacttcctactaagtgtttttatagtaacagttctttgtattttaatttcatatcgatagccagatgagtagctccctaagggtggaaataatgtattgacttattttatatatcccatattgctaattaaaggtcttaattaacagcaaacttttacagagcctaaaagtatgttgaggttaactatacataccttatgtttttccccaaagagggaaagtttaaaaatttagggtaattaattaccttcattagttttcattgctggagcataggttaataataaacattttaaaagaatgtcattttgcagatactgaattcaagtgaacatagagactcaaatctgatactaatccagcatttgtagcccttcaattctaattgctcaggattttgaaaaattaaaaataatctggaaaagtcagtgctttagcacatattctttgctctgaaaaaatgaaaaaggaagaaaaaggtgaaccacaggatattgctgtttctgtaggcctaaaacactggaaatttcaagtcattctatctaactgtatcataaacgtaacagaacttcctaaatccaatagccacttacataccacagaaataatgatctcttgtactaccacagaaatttcagttagaatcagttaagctttcatacattggagatatgtatacttcctgagcaactactgcatactggtcacaaagccaagtgcttggtataaacaacagatagactctgcttttaatgagcttatattgtaaggtatgtgggtgttttgagggtctgggaggacactttgtcagcatccttatataattataaactatgataaatgttgttttaaaaaaagatgtaagattaccggagagtctgacctttgattgggaacatcaggaaaacctttctgaggaagtggcatttgatctggcatatgaggaatgagctgagtaggggtgggttagctgggtgaggaagaaaaaagacaataggcaaacaggttgtatgggccatggcatgtgtagtaacagaaaaaaatgcatagctgggtagtagtcagtgaatgggatagggacattgagaagaggttggacaatcaagaaccaggtagagtagacccttgtatccaaagttagagtttattttgcattttaaatgaaaagattgacacgaatggatttatattttagaaagatcactgtactcagagcactagatgaggaaggtgtggtaggggctagggcaagaatagaagttgggacaaattagggggctatttcagtgaaaatggggagatgaagaccaatcaaggtatgtttcaaaaggaaaatcaactggattcttggtgaattaggtaagggagtggggggagaggcaaagtatagagagagctgttaaaaatgactcctcccatttacttgagagtgaagttcccagaggaaaggagaggtggtagggggatcaaaagaacagttttaattttaattgtatgtgagacatccaagtggtgatgtcacatagtcgggtatttgtcaaagcagattctggctagattcataaatttaagaataataaatttatcaatagtatttaaagctatgggaaggcatatgaagaggttaaaaaaaaaagctagatggcaggatcatgatgtttgtatgaatctggtaggtggtgtaatggcttaagacagccccactgtgagataataaatggcaactgatatgatgtatgaacttgagatggaggagagggagaatgaatgaacatacattatctgaagggaactgcctctattcattcagctcagataattattactaaataaatctgggcccagatatttcatttttaaaagagaagttagaaatttggcttttatgtaacttttcccatatttggatatataaaacataattcatatttaaaattctatatgagttattattgattgcgcccactattttgcactctgtcctaggacagagtatttaaaattacttgaaggtcagctagaggattaggagccaaaggaggttagagagaaaccaagagaatagagtgtcacaaaaactagagatagagaaggtttcacaaagattggcatagtccagggcttttaatatatttacagagtgtagcagtttggtaagatgatacctaaaaagtgtcccttggattttctagtgtagactaggcagttgatattagcaagagcaattcctcaaatgaactgacaacttaagtgaggaacaggctgacgcatgtgggctccctgccagtaaaagacacaggcatattcaaattccctgaccttttgtgttactggagaatatgaactatacagaaaagaaatataccctccccaccccacagagtgaactgagtggtgaagtagtgaagactaaatgtggatacttctgttggaaagctcatttgtgaagtggagcaaaatgtcatacctggaagaaaatcagaatcaatgtatagatttttaaattgaatatgtaagaggagtgtttgataaggaaatgtgatacaaatttagtaatttaggggttaatttttttttagttttctgtacagaagctgcctgtagtagtatctagagactcacattatagaatactcaactaagtatctggaccacctgctgcatttgtacttatcagtgacttcgtggatctttgcaaaaggatactttctttcttttttttttttttttttggccgggaggaggtccggagctgggctggtgcagtggcgcagtcttggctcactgcaacctctgcctcctgggttcacgtgattctcatgcctcagccttttgagtagctgggattacaggtgtgtgccaccatgcccggctaattttttgtgtttttcatagagacggggtttcaccatattggccaggctggtctccaactcctgagctctggcaatccaccctccttggcctcccaaagtgctaggattacaggcatgagccactgtgcctagccctctatttctttatttcttttttttttttttttttttttttttttgagacagagtctctctctgctgctcaggctggagtgcagtggcgtctgcctcctggcttcaagtgattctcctgcctcagcctcccgagtagctgcaactacaggcacgtgccaccacgcccagctaatttttgtattttcaatagaaacagggtttcactgtgttggccaggctggtcttgaacttctgacctcatgatctgcctgcctcagcctcccaaagtggtgggattacaggcatgagccaccgtgcctgttttcaaatagtaaaaccacgttcgctctggaacgctaatgtgcgtataaatcacctggtggtcttgtagtgcaggtgcaggctggcacttgtagatcaggttcagtagatctggggtgggcttgaagattctgcatttctaacaagttcccaagtgataacgatgccactataaaggtcagtggaaaatataaactaaaaatcactagcacatccaaaattctaagagatttttatatttttaatgcaaatttttatcttacatcctgtaacattagcatatcatgttacattagttttaagacatagaagaagaggcagctaacaggttcttcatgatcttttcagttaacccaatgaggtattatttttccctttttagaatcagggtaactgaggttcagagctgttaactagcatgtgactagttaaaaagtcaggtttacctgcctatcagtctagcatttgctttaaccaccacatcttaattttctttttatttttttcttgatttgtacagttctgtttttttgtctttagtgaaaataattcaatctattgttatttttatatttagtcttagatttctactttagcctatttctcccctgtgcagaagagttgcaaattttgctggaaggacactcctgtttttccgttgcatatcctttctgaaatgttatatgataaaagagaactgggcgtatgttttgaggacaatagcttttcatgaattctgtcaagccttaaatacttggtggattccagcaatagggtggggtattgccagtttcttttagagctgtaatctgcaaaaataggttttatctcagaaatatgatataggtcatcataaatgtttactttttacttctttaccatagtccaatgttgatataaaaatgctctcttttagaatgtgaaacacaggaagtatgccagatggaaggcaacatacatccataattgtttaaagaatggggagactcctcaagcaggccctgttggaattgaagaagataatggtatgtatttatttattctgagtaaaaggacttagtagaatcataattattcagtagattactcaaagtttttggagggaacaatacagttttgttttcatcaggcccagaatcaatgaaagttaagtataaaatcataaacttagggacagtgagaaatagaaataaaggtcaaactgctgtaatacctgtccatgtcaacaaagtgacttatctgtctcctgcttttttttttttaatgagacatagtctcgctctgtcgcccaggctggagtgcagtggcgcagtctctgctcactgggagctccgcctcgcaggttcatgccattctcctgcctcagcctcccgagtagctgggactacaggcgcctgccaccacgcctggctaatttttttgtacttttagtagagacggggtttcactgtgttagacaggatggtctcgatctcctgaccttgtgatccgcccaccttggcctcccaaagtgctgggattacaggcgtgagccaccgtacctggcctcctacttttaatcagatttcattcctgttacataggaaaggcaatccatttataatttataaaatgttttcaaaccacgaagaataccgtatcattttttgtaaatctatttgagttatgtaggttatttgcggagttagtaatacattcacatggttcaaaaaaattgtagagtatataaaaaatatgaagtgaatttctcctgtctaccacatcccccgtcttcccagatcctaccaaaactcaagtaagcatttttagttttttttgtgtatctttacagagatcattttttatgaatttactaccaagtagaaacatatatgctccattttttcatacaactggtaatatacatactgttctgtacctggctatgtttttttttaacttaatatgtacaggaaaattttaccatcacacagtgcgttttacaaattttaatcatgaaaaaataaaggtctcattattttacttggcctttcagttaatgtgtaatagaaaagggaaaccttttttcacttacttgttttttatgtattagacgtagtaaatagatggttataaagagaacgaccactgttcttggaactgagaaaattccaaacgatccttgcattttgttacacacttttatgcatttgtgaagataattatccaatgcaggcatcagtaaactttcttaaaggatcagataataaatattttcagtttatgaatgatactgtctttgttgcagctgtttagctctgctgttgtagtacagaagtagccatagataatatgtaaaaaaatgagtgtggttgtgttccagtaaagctttatttacagttaacagcctgccagcccactggccatagttggccaaccccaatctaattaatctctttagatctattattataatgaattatattgaaagattgcctattattgaaccaattttacattgtgtgataaaccccacttggtcatgatatattatttttttattatactgataggttcagttcactactatatcatttaggatttttatgttgacatttataactaaagatggtctacagttttcctttttggtatcaatgttatgatgttatgcttacttcataaatatactcagaatatttctagtctttttctgtgctttggaacagtggaattatctggtctttaaatgcaccctggaaattttttgtgaaaccaactagctgttttacttttcgggactattttagatgttgcattttaggtatattgaaatacctaataaattgtcaatttggggttttcggcattctttccatatcagtaacttctctaatcttaaaactctttaacattttgcctttgaaagtaggaagtgtgcattttgattatcacgttgatctgttttgttctgaaatggttattgtaggcccttacgattaataatgctaactaaatagattattaaatgtagacagtttttgttttccaaaagtcagcttaaatggaagttgtcatttctgttatttattttcatacatatttgctggagtttctggatagtggaaaattgtaagctacagaatactaataataaatcctctacaatataaaggagaatattttcactgcatactttttcaactcattaacttaaaacataacctgttgtcataatcagggcttaatgtcataacctctaataatgtcttctcaaagatagcctatatatctacaagatataatgtcattaaatctgattttgtgtgagaaaaatcttctttaagactttgatttgttttctttttttgagtgtagaattatattctgttgtgttttaggattaactcttggaacatagtctaagtgtaaaaggtagtatatttcacaaaaacctaattgtctattgttctggcattgaatttctagtaaaaccgtagaaaataatagatattgtacttagttaacttagataaagaacaaaagagtatacacttttgaaaacaatactatgtattaagttctagctgaataccacatcactgtgacatttgaatagatattacaaacaggcttccacttatgatttaacgtatactttttcacctttaagaagatagcaaagcaatatgcattcaatagaaactgtacttcgagaacccttacagtcattgtttttcaccttcagtacagtatttattaaattatataaaggctttgtgttagatgattttgcactaatgtaagtgctctgagcatgtttcatgtaggctaggctaagcaatgatgttcggtagcttaggtattttaaatgcattttttacttagatttttgacttacagtgggttttttgggatgtaacaccatcgtatgttgatgagcatctgtatgtagaattaatgatataaaaaaagaacagtagatcattgaaaccattcattttatatggtaaatttgttttgatacaatgttaaatttactggcaagttgccagaatgatataaagaattccagtatgcctttgatccagaattaaacattctctcattgattcatagtctgtccctctttctcaccccttgtccccttttctctctccccactccccctaccacacataaaaaacaaaggacatgaggttattttatatatttgtgtgtgtgtgtgtgtgtgtgtgtgtaaaatttcaaaatacaacctggtgtcataatctggtgttaatgtcatgatttttagcagtatctccttagaaatggcttatggcttcacaagaggatatcattatatatatattttgaagtatttattagtaaattagagatatgctcttttactgctgagtacttctgtatttcctcagaagagtggcattctttttactacagtgtacttatcaaaatcgagaagtatagtatttatttagtgtatcatctgatttccatctgtattcagattttagcagttgactcagtaataccctttgtagttttccttctcatgcacatagatcacacgttgcatctgggtgccatatctcttcagtctccttaatctggagtagctccccaggatttctagtgtttctttgccttgatgcttttgaaaagtacagttactttttaactgttcctcaatttgtttgtctgatattgcctcataattagtttaaccctatgcattttttgcagaatagcccaaaataaagttgtgtcctccctgccttacattagaagtatatgattttggtgaaatattggtgatgttaactgatcacttgggtaatgtggtgtcttctgggttattccccattaaaattatttttccctttgctattaataagtaatttgtggaagatactttgatattatgtaaatatcctatattttttatgcaacttcaccccctgggtttagcattcattgatgatttatcattctttttattttaattagttggcactctatcataaggatggactttccagtctatacataaataaatgtatttattcatttaattatttacatcagtatgggctcatgaatttatattcagtgattataattcattactcattattctttattatgatcctttatgtgactcctgttgcagcttctgcaccagttgtggcttcattacttgagcaaattaacattctttggtatctagtatacagctattgatctggccagtgcctttttcttcatacctgtccataaggttcactagaagcagtttgctttcatctggcatggccagcagtacacttcactgtcctacctcaggggtatatcaactctccagctctatgtcacaatttagtttgcagggatcttaataccttcttacccttccacaagatattacactggtccattatattgatgacattatgctgattggacctagtgagcaactactctggacttagtggtgagacatttgcttctcagagaatgggaaatcaaactgactaaagttcagggatgtcagtgaaatttctaaaggtccagtgatatggggcatgtcaagatattcatagtaaggtgatattgttgcatctagccactcctacgaccaaaagagaggtactgtgcctagtggacctgtttggattttggagtcaacacgttcctcatttgggtgtattactctgacccatctgctgagtaactcaatcttcttttctttttcctttatcttaactattctgtcctttgagtttccacataaattttagaattagattttcagtttctcttttttagaaaaaatgcctactggcattatgattagtattaaacttagggagaattaattgtctttcagtacatgaacataatgtatctttccatttatttaagttttctgtaatttctttcagcggtattttagattttttgaagtagaggtttttacctcttttgttaaatttacttcaagtattttgtgtcctttcattctcttgtaaatgaaattaattttttaatttggttttccagtcgttagcttctaataggaattacaattgatttttgtataattttttatcttgcaaccttgctaaatttacctattgattctgataattactttgtaaattccttgagagtttgtatgtagataattatgtcatttgcaaggagagacagttttgcttcttcctttccaatcctcatttctttcttttcttgactattgtgccagtggcaataaatatgtccattgttttgttttgttttttgccctatgtgatactgagaaatcttctttatttctagggtgctgagaagttttgtcataaatggatgttgaattttgtcaagtgctttttatgcacttattaaaattatcataggactttttttcttctgttaatatgagttacattgattgattttcaaatgttgaaccaaccctgcactcattggtaaacttagtcatgatgaggccttgtattatatggctgatttgattctgatactaagaatttgtgtgtctacatttcagtattggtgaggtttggtatcagggttacactggcctcataaaacaaggtgaaagtaatcccttctctgttttctgaaattgtttgcataagattggtattttttcttacttgaatgtttgatataattcactgcttattccatctaggctctgcattttctttgtaggagggtttttaaccatgaattcaatttccccaatagatttaggactgttcagatcatctctttttgggtgagttatggtattttgtatcttcaagtgatttgttcatttccctgaggtagtgccatttattggcgtaatattttcttattgtcttcactgtccttttaatgtctgtaggatgtatttgatatcacctccttcatttctcatattcataatagctgtttcctctttttcctcccagtctcttgacagagatgttttaattttttttattatctcaacaagtacttagtacagtttttttcttctttattttctattccttttattttttgctgcaccacacttggagtttaatttgcttttttttttttttttttttagcttcttagggaggaaatgtagatctttgatctttaaatttttcttttctgatagaataatttaaatctatctttcagtttccctctaagcattggtttagtgacatcctgcaaattttggtatcactcagttcaccataattatagttttctttgtgatttcttctttgagtaatggattatttataaatatattctttaatttcagaatgtttgaggtgtttgtagatatcttactgatttctaattcaattccattttagtcagagaacatactataaaagatttcggtattttgtagtttatcaagatttctttcatggcccagcatatgatctgtcttggtgaatgtcccatgtgcagttgaaaagaatgtattctgcagttattgcttatgatgttctctgttaaatctccaagtacagtggttttactagttctgccagtttgtttcattttgagactctgttattatattaggcacatgtacctttatagttattttttatgaactaacctttttattattatggaacatcccactatatcttgctgatgttcctggttacgaattctatttggccggattttaaagttagccaccccagcttttgtcagcttggtatttgtgttaacgttttaatccttatgaaatggtcctttttatctcagctaatattccttgtcattgattctatttgtctgttattaaaattagtcaccagcttttgtctgctggatatttacatggtttgtcatccttttagtttaaacaaatctagatctttgtgttttaaagtacatttcctgcaaaaagcatataggcacttttttattctgtctctcaacccctgtgtgagaaatagtgtttagttcatttacatttaatgtaattgctatagctagatttaaacctattttgccatttcctttctgttaataccatctgttttttttctcttacagtttttcccccctctggttagttttgtctctttcatttgttatgtccatgttttactttgtggccttgaacaaatttattgtagctgctttaaagtgcttttttgctgattttcaatatcagggtcattttgaggtcttttttgtagactctttttttcacattttccttttctcccctaatttttaataatttctatttgttgataacatgttgaagctcctctgcatcctgttatctttctctgcaaagtcttgattcttattccagcagaccattgacttgccagaactcaaactttgtccccctgtttcagctttaagttgcttttctccagggccccctagagtcttacctgagtgtgcataattcaggggcttgtaggtatttagttggggttcatacaaacatttcatggctcacttcttggcaactttcttttatgtagactattgactgccctcagatgaacagccacataaaatcaaatgttacctggtaagatttcctcttacccttactctcatttctaccagcttttggtcatgctctagtgcctttatgttgtggagcttttttctttcccagaatgtataaatgttagagttctccagtattggggaaagtcatgttaatgtatgtaaagtataaatacatccacaaggttgcttgataaaatgcttatctcagattaggtaaatttaactttttttcttgtttgaaattagctacattgaataacctgtttataatcagacaaaaaagttatttaaaaatgtggtaggaagcagtaagatctattctctttgatgagtctgtagctctagcttgcttttattttaagttactatgactcccagtagcggctgatggtcattttatactcaaaattcagtttttcaaagtagttttcaaattcggctcacgatacagtatattttaaaagtttgcatttcagaacttttcaaaatgaaatatctcatttctttctgcatagctaaatgcaaaatttcattcctctgtttttattagctaaatgcattgaacaactcacagataatcatttagtagctagtacgcggtaaatcttaagtaaaagtccgctgtcagaaaatggagttcttattggatagcataaatgtggcatgttttgccagaaatgtccttgagtcttcataagtttaaagaaagtttattttaaagaaaaacatattctgggtgtggtggctcacgcctgtaattccagcactttgggaggccgaggcaggcagatcacgaggtccggagattgagaccatcctggctaacacggtgaaaccccgtctctactaaaaatacaaaaaaaaaaaaaccaaaaaaaaaacaaactagccgggagtggtggcaggcgcctgtagtcccagctactcgggaggctgaggcaggagaatggcgtgaacctgggaggtagagcttgccgtgagctgagatcacgccactgcactccagcctgggcagcagagtgagactccgtctcaaaaaaaaatatatatatatatatgtgtgtgtgtgtgtgtgtgtgtgtgtgtgtgtgtgtgtgtgtgtatatgtgtgtacatatacactatatgcaaagattttatagaattaaaaaatattaacctgaaagaagtgataatcatattgtcaggtacaattacattttttaagaaaataaaaaaattaaaaatattgttttaagaatagagcttgcttctccactgcattaaatagaattgcatttaaagattccatttgtcatgtgtataatgaaataagaatacctagcacttgtatttcaaaatacctactgtaacattgtgtatatgtgatctgatagatattgaagaaaatgaagatgctggagcagcctctctgcccactcagccaactcagccatcatcatcttcaacttatgacccaagcaacatgccatcaggcaactatactggaatacagattcctccgggtgcacacgctccagctaatacaccagcagaagtgcctcacagcacaggtgggaaactgtaactgaatgatttatttaattccccttttataaagaagaactgcatttcttatcacatatgtgcctcataatgatggtcatgaaaacatgacaagttccttgaattccatttgaacccacaagaaacattaaattattttcattaaaattttaatattagttgtattctaattatttgagaaatgacaagtattatgtgcattgattactcttaaccttatattttattaataagattggtttccatgcttttcatatatattgctgtttttctttttcttctcttccctttcttttcccctcactgttgttttagaatagctcggaggtgagtggagttgatattaggatgtgtcagtcagggtctcactgtgatatctaggtttgtttcattcccttgggactatgcctctgccctgaagatgggtattattgatgatggggaatgggctttgaggcatgaaatctcagtaacaatgaaatcatagacaggtgaaagcagggattcggattttttttttttaaccttacactttaaaaaactaacaggaaagagagacctatctgtgaataaatcagtactgtatgtttatgtttttatttttaaaaatctgacaaagttagtccttagtagttaagtcagggtcagtaaagacactttgacaaaatttcagttactcttccctttaattgcattgttgacaaaatgtcacctttatctccaagtaggacacttgcagctataatttaaattttacatttaattttttcaaaaacttttcttaaaaatttacttttatcccaggtgacttatggtactaaactatacaaacactttaaaataattaatggaatgatagtcatccttcatgccctgatttctactgttcctattatgtaacacactactactttacttttatttgtcagccttattttacccaaattttttttattttacccaaattttgcatgaattacattatatgcaagttttctattttgaccattgtaacatcaagtatgattagtgtctttcctcctattttaaaacttacaagtttatattatctgcaaaaatattgctaacgttttctttaagattattgatgaaatgataattttagcactgatctttttttgtgtcttcagtcagcatatttgaccttgacttttcaatattttatggcctatgtgatgatattaatagacaaacctatttgcatttgttttggaagtaaaatttcttggaacacttttaagtattttattatgtttagaaatattcattatttccagtgtggaataatgtaagtgaaaccagctacttagatctgtttgccttagatgaatactgttcagattatacttgaaggttgaaatcctgatcaagagtcccagacacaagcattctcatagaggagccaaggggaaataaaatgcatttaggaggcaaatcatattggttatttgtttctaccccatgctaaagcataaactcagctgatatttaacttctcgtgaccttaatttttcctcttcctaatatgaaattaatcatacttacttctcatggttattttaattattaaaagggaaaaactgtaaaaatggactagtagtaggcctatcacaaaatcagtgttcagcagattagcctcctttccctctttttttcctcttccttcctatttctgtgccaaggaaagtcaaggtatttaatggcaagttaatgaacacttaaaattattatgcgaatcaagagaagtatcacaactgggggtaggatattaaccttatagaaagactgtccaaggagttttgttttagacagtatatctcaaggcagagttgtggtataggcacatcagtatatattttatatataggtacactctatgagtatacaaaagagaacacttttaacaggagggctatagtagatcgatccatatgaaattgctagttttgtgtaacaaaaatgataaagtattgatagtcttatatgttcaaactaatacacagtgtatcctggctagaatattcatgacataaagataaatattaggtggttttccattagaaagttttttgtcataaacagttcaatttgatctagttaactctagcatgagcctcttgttttctctgtcttttgttccttagagggaagaataaaactaaaaaacttagaacttttatagaatgagatcctatcatattttatacactcttgtagccttaccagtcaaatgattatcatggctaatttccacacttattcttgcagcaactatattatgtattactgtctttaacttacaaactctcaagagactaagcaattattctaagaaaacaaacatacccagtaatgacagaaccaggatttgaatccacgtttttttgacttcatgttttagccatgtgccttctatgttccttcctctaaggaactaaaatcctctcaaattaaaacctacttttctgatagtatatttccctttaagattggtttgagatgttgaaatctcctccttttagccccagatttttttctattatatttgaaacagtaaaaaaagttcatagttgcctaataaaaaacaaaataacatttttaataatataaataatagcaaatgtttcccctcttactcacgttaagaatgatttattttctctcatataaaggtccaggatgcacttttatcaaagggaaatccttaagataactgaaaagaatagtatgtactaatttgcagtttttagttcttccacaaaaaagcaaaggaggtgcaatgaggacagggatagtgattgtttaaacaggcgaagtgtttgcttcttgtgctttcaacactgcacagatatcacatgtagttgatacagtgtgtttttttctttctcaagaaacataagctttttatagttcatattacaggagaagattttagtaataaagctagattaaataatataattattttatgattaaagctagcctttcattgtaaaatgcagctcacttcatagatcaaaatgtaggctgtgtacttgtgtcagaagtaccatgtttgcattcttctgtaagctttgataacctgttgttgatactctggcctacgcatttctctcaaccctgtttctcatgattacactaaggtttcactcattctttccttatactgttactcatagacaatataggtaacattcctttcttcctttttctgtgtctctccaaatgctgtgttctttcaggagtctgtttaatcacactttctggatagtcttctctataaatagagatttgtttggaggattttaatttaggcagaaatgcaaattacttagcaatgaatgacattgatctatagattggaccattagagtatagtagatttaccttgttttttaagatgtatatgaatgatatatgtaatctacataagcctaggtacacctgtttcaaagcactagacatgactagtgtgaagatccatctcagattttacattctagcatttttaaaataatatatatttatgtgcctttcagtgtttggcaagttttgtggagaaaattgtcagatgtttataatttaaatatatttggtgagtacttatcaaaatcaagcaaaaaatagtcattgaataggtcagcctaagatttggctgtctcctcactttgcatttatacttttatacagttttctataaatatattcatatacacagtatatgagaatatttactgtagcattatttgtaatagcaaaagattggaaattaaaacttaaatgtccatcagtaatggattgctttataagctatgcatgcagagaatgggacactatggaaccattaaaaacagcaagacagatttatacgtattaatctggaattattgctaggacacattaagtgaaaaatgcataaaactaaagtatagtatgcagaacttactaccatttgcaaaacacacacgcaagtatgccttctagaagattttggtttagataagtacacaaatttcttagcagagaacagcattgacatatatatagattggattggacacacagttatttgtaggtgggtggaaaggtgtcatagaaactggtactagccctaaactttggggtaggagaggcaggctttctcctttatatttttttgtactatataaaatttgtacttcacctttcatctgtatccctgtgtactttaaaatttttcaatttttagttaaaaagcaatatttatatggcttttaatagttccaaagggtataaatacagagcgagtttgtcctggaaaacaattaagtgaggtaaataatgtatatttaaaccattttttctcttaggttggggttgagaaaaatcttaaaagtcaaaacttcttaccagaagaactttagaacttcataccagaaaaactttagacctttagaaaattttagaacttcagccatcttttgtgaaaccgttattctagaactctcagtggatatatatccatccccctagaaacttcctatttattttaacctttttctctgtttcctttttcttattccagtatttttcccactttaccctttctacaaattgcctattcgaattcagtgtattagtttggcaaacagtccatcttgagagactgtttaactccattgatttggagtaatcaacttttcctcattttattttcctgctgattgaatcatttcagtccttttttgggggaacttttaacactttttgttagttttttagatgattaataaataatcttcaacttcagtatattccttaccattaatcaagaatgctaagttattcattgatatgacagttttgaaatgttctaacaaagtcaaaacagttgtttattggataattgtttattggatatgtaaaaatatcttaaaatgtgtaaactagaaaattacaaatgttaatttgtaatttcatgcacagtgatgaaattggattcatcctctaagttaaactaaattagaattatgttctactttatcaccaaattatttaattggctgagaaattgaaaggtagggagtttgctacttctacagatatttggtaagctttaatggagaagtaatgcgaagcattagacaaaatacatgttaggaaatgcatagcccatacacatatgtaaacacttgatatcctccaacatcaactaagtatgtcaagttagaatccattgatgtttctagaaaataagcaaagtaatgaaattgcctcatgatttttaagtgctgccctgctgtataattaaaaggtgtaatacttctatgcccatttttgcttttctgatttgcaggtgtagcaagtaatactatccaacctactccacagactatacctgccattgatcccgcacttttcaatacaatttcccagggtaagtcagctgactattttgtgagatacatttatctcctgttttgggttgctgttttgtaattttaccttgacagtaccatatatttaaatgttgttactgaaatttgaatttctaggtaatttgaaataaatttccttgaatgcttatgttcactagattctcaaatgagccaggattgtttgactttaaaaataccaacatccaaagctgtccccttttgttacagttctttttttcatgcactaccggatattgaagaacaaacatggagccaaggctaccatggaagcctatgctagattatattaatttagttcgagattaccatgagttctgattgtgacttttcttatctacactgttattaaattatctaaaaagaaaggaactgaccattattaaaaataaaaatctctgaggttactttggttggttggtttataggctaagtgattggtttaagtataatctttactacttttctgatttctctgtttttttagcccaaatcaggcattgtgtttattttggtctttctcattcagacttttgttttcttcatatgtcagatgatatttaatccttttatatttaaaaggatttaaattttaatccttttatatttaaaaggatttaaatttaaatccttttaatttaaaggaagtgaagaccttttttgttttgttttgtttttgagacagtgtggagtgcagtggcgcaatctcagctcactgcaacctctgcctcccgggttcaagctattctcctacctcaacctccccagtagctgggactacaggtgtgcgccaccacacccagcaaatttttatatttttagtagagatgggatttcaccatgttggccagggatggtctcgatctcttgacctcataatccgcctgcctcagcctcccatactgctgggattacaggcatgagccaccgtgcccagccatttatttttaatagctgttatttagtttcctctgttaatgtctgccagtgtgtttttcagcttgaattttctgttctccctgtatgagtgggaactggccaataagccttcctgcctctcaaccatggaatgaggagagccttttaggggtgagctggatatcatacctaccttaagagttctagcactgcctgggcagtttgttacacagttttagggagatgctctttaaatctcttgtcaattttctcttttcacttttttcattctttctcttctcctttttaattttgtggatttatttccttctgtgttactttatcatttcattatggtttcagaaggaagaatagttaattatatatgcttagtctaccatctagaaccagaaccctagaattctttatctaaactgtcaggcaggtgttagggcaaaataatttttaaatatgtaagaactctcacattttgcctagcacataccttttttaaggaacttaactcaggatgtactccatcaagataagggtggtaatcaagcaaaatagaaatatgaaatataagaaagggtgaaatatacttctttagatactccaaagaagaaagattctatgatagctttcccacctgcttggaaagcaattgctccaaaattagaataggaaattggagaactcccctcctttaagaaaaataacatggatttcatttaatatatagaataggagcttcagaatatgaaagacatagataagatgccctagaatcctgccagtaagaaaaaaaagtgaactaaaacatctaattttgatattatacaagaaatctcagtttggaagcaaacaaaaatatgccatgattttgaacagtaatagaattatggaatataaaagaaaaggatttcatttgacttagacacaaagaacattctccttcaaaaggtaaaaggcttatgacaaaacatagagtacttcactcagaatgaaatataaatatcaacactgacattttaacatcatactgaaaatcctagctagtgcagtaagaaaggaaaaagaaataaaagctataaagataggaaaagaaaaaataacactgtctttgttcatagatgacatgatggtctgtagaaaatctggaagaatcaatcaaaaaatacacttagaactgataagcaattgtaactggattgcagtatacatgattaatatgcaaaaattaattgctttccacatagcagcacaaaacaagtgggatttgaaatttaaatacacttgccattgtgtttgtatttacataaatacaataatcaaaaacaaaataccatttacattagcattccaccaaaaatattcaggtataaatgtaacaaaatacattacaagatctatatgaggagaactacagaatgctcatgaaagagtcaaagaattacataaatggagatttcgtgatcatgcataagaagactgtattctcaagatgttagttcttcccagcttggtctatagattatggacagttcccatcaaaatcccagcaagttatttggtgcatatgaactccaactatctaaagtttatatggagtggcagaagacccagaataatcaacgtagtactgaaggagaagaacaaagttggaggactggcaccacctgacttaaaaacataatacaaatctgcagtaatctagatagtatggtactggcagaagaacagacaaatagatcagtgagacagagtccaaaaatagacccatacagaaaaagtcatatgatctttgacaaaaggagcaaagggaacaccattgaaaaaagatactcgtttcaataaatggtgctggcgtaacaggacagccacatacagcaaaaaaagtgaatctagacacagaccttccactcatctcaaaatttaactcaaaatggttctgatgcctaaatttgaactccaaaactagggacttccagttccaaaatggcagtgtagaagcatactggcttcattccccaccaacagaaaacgaaaaacaaatatacagcactgagattgacaccagcaacaacccagagcccaagtatgaggatgaaatagttcctggggccacagagaagtggaaaaactccagtaggagaatcagacttccactttcatgatgcttctgccctacccttatgcccacacagaaaatctcccccacctcataatttctacactgaaagaagtaaaattgaagtggtcaaccatcttccccacctccttgggttccctggcaggagatctgtccttgccttaacccacaggtagcatcatgactgcctgcagggaaaatatcactgaagaccagcagagactattattcccagccccagaaacttcactgtgcaacttggccaaaggagacaccaaatcagaatggctgttcagcagtaccatgctgtaggaggtacatttcccaggtcctgtaggcacaaacccctacctagcctgccttcccacactgccagtgtaatccatttgggacattcagcgctccaaacatttactagagctgaggcaaacctgggcttatggcgccacctagagctgaaaaggaggtagcgacctagcagtgaagatttgttgagcaaatatatgcaataaaaaccaaaacaagctggacagagaaaactggaataaataactaattcttccagtgcaaagacataggaaagacccacaagaaacaacagcaaacagggaatcatgaccttctcaaaaggacaaagcaaaaatcctggccgggcactgtggctcaagcctgtaatcccagcactttaggaggctgaggtgggcagattacctgaggtcaggagttcaagagcagcctggccagcctggcgaaaccctgtctctactgaaaatacaaaaaaaattagccaggcatggtggtgcatgcctataatcccagctacttgggaggctgaggcaggagaatcgcttgaacctgggaggcggagagtgcagtgagccgagatctccccactgcactctccagcctgggtgacagtgagacttccatcaaaaaaaaaaaaaaaaaaaaaaatcccaaaactgaccctaacaagacagcagtttgtgagctctctgaccaagacttcagaataacaattttaagaaaactcattgacctctaagataatacagaaaagcaataaagacatttgacagatattggaataatttttcaaaaaaaatcaaatcttggaactgagaaatacatttgctgaactggagaactcttttgaggctctcaacaacagaatgaagtaagcagaagaaaaaaatcagtgagctcaaagaccagctatttgaaaatacacagtcagaagaaggaaaaaaagagaatgaaaaggactggctacaagatatagaaatctacctcagaagaccaaatctaagagccattgatgttcaagagggagctgagcgagaggtagaaagcttattcaaagaaataataacagaaaacttcccaaaacttgagaaagatataaatatccaggtacaggaaggtcttttaacaccgaacagattcaacccccaaataagactacctgaaggcatgtagtaatcagatgctaaaggccaaggacaaagagaaagtccttaaaacaccaagagataagaagcaaatagcatataacagagctccaaatcgtctggcaacagccttctcaacaggccagtaggtattggaacattttaaaaaaaaactgtcatctaggaatattgtgtccagcaaaattgtcattcaaatatgaaggaaagatatagtctttcccagacacaaaagctgacccatcctgcaagaaaagctaaggggagttcttcagtctgaaagaaaacactaatgtgcagaagaaaacatttcaaggtgtaaaatccactggtagaattaatactatgtatataattttttagtatagagcaattttatagtatagagaatagagcaattaggcaaaagaaagaaataaagttcatccaaattgaaaaggaagaagtcaaattagccttgctcacagatgacatgatcttatgcctataaaaacctaaagacatcttatgcctataaaaacctaaagactccaccaaaaaaccgttagaactgataaatttagtgaagttacaggatacagaatcaacatacaaaaatcagtagcatttatatacaccaacagcaaataatctgaaaatcaaattaagaaagcaatcccatttaccatagctacaaaaaaatataaaatacctgggaaccgatctaactaaagaagttagttattaataactaactataatattccgttgtgtatatacactatgtgtatatattaataactaagaaaaactatataaaattctgatgaacataatacaaaaaatgtaatacaaaaaaatataaaatacctgggaatcgatctaactaaagcagttagttattaataactaactataatattccattgtatatatacactatgtgtatatattaataactaagaaaaactatataaaattctgttgaatgtaatacaaaaaatgtaatacaaaaaatacaaatacaaaaaaaaatacctgggaaccgatctaactaaagaagttagttattaataactaactataatattccattgtgtatatattaataacagaaaaactataaaaaattctgataaatgtaatagaagtagacacataaaaaatggaaagatactccatgcttatggattggaagaattaatattattaaaatgacaatactacccaaagcaatctacagattctgtgcaatccctatcaaaatgccaaagacattcttcacagaatgacattttaccaaaaaaaagaaccctaagatttatgtagaatgatagaagaccctgaatagtaaaagcaaaactgagcaagaggagcaaagctaaaggcatcacactatgtgacttcaaaatttactacaaagctatgataaccaaaacaacatggtactggcataaaaaacagacacatggaccagtggaacagaatagagaatcctgatatacatttatgcatttacaaccaacttatttttgacaaagatgccgagaacatacaatggggaaaggacaattttttcaataaatagtgctgggaaaactggataactatatgcaaaagaatgaaagtaaacccccatctctcatcctacacaaaaatcaagtcaaaatggattaaagacttacatctgaaacctcaaatctaagacctatgaaacttatagaagaaaacattagagaaatgctccaggacattggtctatgcaaagatttttttgtgtgtaagacctcgaaagcataggcaaataaagcaaaaatggccaaatgggattagatccagctaaaatgcttcagcatggcgaaggaaaaaatcaacaaagtgaaaagacaacccatggaatgggagaaaatatttgcaatccatctatctgacaagggattaataaccagaatatataaggaactcagacaactcaatagcaaaaaacaaataatgcaattcaaaaatgggcaaaagatctaacatttcgtatatgaagaaatgctcagcatcactaatcatcagagaaatacaaatcaaaatcacattgcattatcattttaccctagttaaaatggctcataccaaaagacaggcatagagaacagtgcagaggtttctcaaataactaaaaatagaagtaccatatgattcagcagttccaaaggaaaggaaaacaatatccaaaagaaaggaaatgaatatgctgcgagaaatctacactctcatgtttatcgcagcactattcacggtagccaaaaaatggaatcaacctaaatggctatcagtggatgaatgaataaagaaaatgtggtgtgtatacacaatggaatattattcagccaaaaaaaggaaaagaattctgttatttgcagcaacatggatagaactagaggtcattgtttgaaataaaataagccaagcacagaaagacacatatcgtatgttctcactcacatgtgggagctaaaaaaggtggatctcgtgaaaatagaggtagattagtggttaccaaaggccaggaaggaaagggggaaggagtggaggatgaaagtggaaaaaaaagaatatacgtgtttttattaccactgaaatgtatgctttgaaactgtaaagatggcaaattatacatgaatattttaccttcataaaaaataaatgtaaaaagtaaaatacaaaactataaaacatgtaaaagatagcataagagaaaatccagatgactttgggttgagcaatgactttttaaatgcatgacctataaaagaaagaaatgataacgcagatttcattaagattaaaattttctgcccttctaaagatgctgtcaagaaaatgaaaagacagatcacgaggtcaggagatcaagaccatcttggctaacacggtgaaaccctatctctactaaaaatacaaaaaattagccgggcgcggtggcaggcgcctctaatcccagctactcgggaggctgaggcaggagaatggcatgaacacgggaggcagagcttgcagtgagctgagatagcaccactgcagtccggcctgggcgaaagagcgagactccatctcttaaaaaaaaaaaaaaaaatgaaaggacaagccacagactgagagaaaacattgcaaaaggcttatctgattaaggactgttaacaaaatatacgtagaactcctaaagaacaataacgcagacaaccctatttaaaaattagcaaaaggcctttataggcacctgactaaagaggatatacaaatggaaagcagacatatgagaagatactccaccgcatatatcatcaggaaaatgcaaattagaacaatgagataccactacacacctattagaatggccaaaatccacaacattgacagcaccaaatgctggtgacgatgtggaaccacagaaactctcattcattgctggtgggaatgcaaaatgatacagccattttaaaagacagtttggcagtttcttatttaactaaatacatttaccttaggatcctgcagttgtgtccttggtatttacctgaatgcttttaaaacatatattcatatgaaaacctgcaagcaaaagtttatagcagcaatgtttacaattgccaaaacacagaaggaaccaagattatcttgctgtcggtgaatggataaataaactgcagtacatctagacaatgggatattattcagtgctagaaggaaatgagctatcaagctatgaaaagacatggaggaaacttaaatgcatattacaaagtgaaaggaaccaatgtttaaaagctatatactgtataattccaagtatgtgacattccgaaaaaggcaaactatagagggggtagaagatcagcagttgccaagagttagggggagagggagggatgaatgagtggatcacagagaagttttagggcagtgaatctattttgtatgacactgtgttttagtctgttctcatattgctataaagaactacctgagactgggtaatgtatgaagaatagaggtttacgactcatggttacacaggcttaacagtaagcatgactgggaggcctcaggaaacttataatcatggcaaaaggtgaaggagaagcaggcatcttcctcacatggcagcaggagacagagagggaagggggaagtgccacacacttttaaaccatcagatctcgtgagacctcactatcacaagaataacaaggggcacatcagcccccatgatccagttacctctctccaggcccctccttcaattcaacatgaggtttgggcagggacacaagtccaaatcatatcattctgttcttggcccctcccaaatctcatgtccttctcatattccaaaatacaaatatctcttctcaatagtccaccagtcttaactcgtttcagcattaactcaagtttatagtccagactctcccctgagacaaggtaagtcctttccacctatgagcctgtaaaatcaaaaacaagttagttacttctgagatacagtgagggtgcaggcactggataaatgctcccattcttaatgggagaaattggccaaaacaaaggggctacaggccccatgcaagtctgaagcccaccaggaaagtcattcaattgtaaagctccaaaataatctcctttgactccatgtctcacttccaggtcatgccaatgcaaggggtgggctcccaaggccttgggcagctccacccctgtggctctgcagggtacagcccccttggctgctttcacaggctgatgttgagtgcctgtgacttttccaggtgcatgatgtaagctgtcagtaggtctaccattctgaggtctagaggatggtggccctcttctcacagctccactaggcagtgccccagtgggcatgctgcatgggggctccaaccccccatatcttctctgcactgctcttgtagaggtgttccatgagggctccaccagtgcagcacacttctgcctagacatctgggcatttccatacattctttgaaatctaggcagagattcccaaacctcacctcttgccttctgcgcacccataggcccaacaccacaccttggtgtggccatggcccaagccacaccttggtcccttttagctatggctggagctggagcagctggggtgccatgtcccaaggctacacagagcagctggccctgtatctggctcatggaaccattttttccttctagatctccaacctgtgatggcggggtctgctgtggtggtctgtgaaatgccctagagacactttcccccactgtcttggctgtgaacattcaactcctctttacttatgcacatttgggtgatagacttgaattttgccccagaaaacagggttttttttttgtaccacatgatcaggctgcaaattttccatacttttatgctctgctttttaaatataagttccattttcagataatctctttgttcatgcatatgagcctacacttttagaaacagtcaggtcaactcttgaatgctttgctgcttagaaatttcttttgtcagataccctaaatcatctctctcaatttcaaaattccacagatctctagggcaggggcaaaatgcctccagcctctttgctaaagcatagcaagagtgaccttactctagttcccaataagttcctcatctccatctgaaaccacctcaggctggacttcattgtccatatcattatcagcattttggtcaaaatcattcaacaagtcacgtggaaggtgaaggggaagcaggcaccttcttcacacggcaataggagagtgaagggggaagtgccacacacttttaaaccatcagatctcatgagaactcactgtcacaagaacagcaagggggacatccatccccatgatccactcacctcctaccaggcctctcctcctatttgacaggagatttggatggggacacaaatccaaaccatatcacactgtaacaatagatatatgtcattataaatttgtccaaactcatggaatgcacaacgtcaagagtaaaccctaacatagactctgggtaatactgatggatcaatgcaggttcatcgattgtgacaaatataccactcaagttggggagtttaataatggaggaagctatgcatggtgaggaaggggagataagggaaatctctgtaccttcctctcaactttgctgtgaacttaaaactgctctaaaatataaagtcttttttaaaaatagtgcatttataaccactgtcactaccattactactgcttctagtacttataccccttttctgctacatatttctccttactgcttagtatttaatcaccttttaatgcatatatgtgtgatattaatgtatattaaatatattgtaatgaatttatggctcactctggagaatggaattggataggtaggtatttgaagcacagtgtttacttttttacttttacatctctgaatagtattagagtgtcaatgacaacttacctgataaagttttttgagcattggccaggcgcggtggcacacgcctgtaatcccagcactttgggaggccgagatgggtggatcacgaggtcaggagattgagaccatcttggctaacacggtgaaaccccgtctctactaaaaaattacaaaaaagttagccaggcctggtggtgggcgcctgtagtcccagctacttgggaggctgaggcaggagaatggcatgaacccgggaggtgaagcttgcagtgagccgagatcatgccactgcactccagcctgggcgacagagtgagactccatctcaaaaaaaaaaaagttttttgagcattaagtgatataatatctgaatagtatttagcacagcacttgacataatgaaattctgcctgtattcataactactattgttggaattgttaagtgacatgtctcagcaatgcctgtatgtatgaaggttcagtctgtgtcctgtgtgttccatccaagtcaaaggataatagagtataccagaatgagattatccaaggcctttgacataagaatttctagaactatctagttaaattggaaagagctgctaaagactcattttggaaatatttacaaataagtgttctatcctctcttatgacattagatatatcaaccttggaaatggatgcttatgtcaactgagcacgcagtgatttttctttataccaagtgatgttatctttgatccagtgctgacccaggctctctttgccactgtagtagaggatttaactgatagttctagctctcttctgcctgatcttgtcctgacctctgaagaggagatgaagccctcttatatatagatggtcttgtctgcagctcgtctgtaacttataagctaagatttcagaagagagatatattagacaacccctctaatctttgaagcatctttaaggtccacttgcaccctctcttgttctgattatggcctctagtaaattttaatgatagaaaaaaaaaacagcttttattttggtgcattaagcttatattgacctttttgagtataaagtcagataaactgaaatttaacacttgttctctttctgaaatgtgtttacccttatatatttttcgcttactctgttgagtttttaaatactaattttaaagactcataattaggtgacattttatttttactcagtttaagaatttaattcatattttattaatgaatgtagactagtatactatattttcaaaataaaggagagcctatgtgttacaaaatagcatgtaacatgattttttagcttaatttttcattgttgaaaataaatatctctatatgtttataagttacattttggatctaaatctgtacattggttgttacttagttcttgtattttatatatgagttacataattggttatgcatgtctgtaagctttatgtattttatatctagttatatttttctgttaatttcattcacattttttaaatattgaaattatttcacaaaaaaatacagtatttgtgttttaaaataatttaatccttggtagataagtttataaaacaaaaatagtaacagagttcttgccattatacacgttttaccttattaataagtgatatgtcagccaaacagtgctaaagctaatggtgtaaaaataaagattaatctgaccattacagccttctttcagcatgtccagtaaattctggatggatgccttgtatatttaaaagagtgccctgagataggagagacttaaagcacaaaaagtagcgttaaggtaaactcaattttcaaagatgtttcctcacctagacagcgtatgtagtgtaaatatattttgaaaaaccattaaagaatctggtaggtatttttcaagatcagaaatatgaactggagcatacctgactaaattgtcaacagaacttcaggatagttgatgtttaggtttaatgggcaacaaatgccaagtcagtaacttctgttaaaattgggatcggtaatccctgattcacaacagtgaaggccaaattttatgtaatcttaaatactactagttcaacaaatatttgaagacttactctagcaccctacactagtaagtatatgtgtattttaaaatctgcaatttaattaatgtttaattctatatgaacttagttttaaaatgtgggaaataatttaaaatacagctttttcatattcatgcagtgaagttactgagcacctgcaggtgcctggcactgtgctggaaacagtagcatcaattgtttcagtactctttttgaaaattttagaaaataataatttggatcagaatattgtatccacttgcctggagttgctacctagtttgaaatctttgcctaggtgatgtcaaatttttaattttatgctgcgtgtgtgtatttgtgtatacacacacgcagcataaaatatatacatatggcaaaattaaaagcaactaaacgaagtcattctaagtacagccttgtacttatttcaaacagaattgaaatatgttgtctgcttgttatagtctatgcctcccagccttctgattagtactcctgagaattctcataaaaatttccaaagaaaatggtggttatttcaaaagacaagatacaatgtccatttttaattttgtctttagaaatatatattcaaggaaattcgtatcttagattaaatgaaatgtttttaatgttttttttttaaactgaaattgtttagttgggcactacatgttaatcatatgtataactagaaaacttgctaagaataaattttagagaaataatatgtaatggttgtttacatgtttaattgtatatttcagtgatataaaatttaagaaaccttaagaaatttttacatggatggcacaaacatgtaaaatactctcatgcttaaaacaagctaagcaacctggttttctttacataaagtttgttattcactttttttttattgaaggtgatacttacattccagctcaaatgagggttgaattggtttagtctgtgtgtattgttccatgaagagagaggctaagtgattttagcatagacaccaaagctgctatccttgtttgtccttattgcttcttgaaggaaaatcttaattcatctaagttattatgtattgccgtgtctgtggtttatattagtaataaaaagacaattgaaaagaatgaagaaaatgtatcaaagttcatgtgagattgactaaaactactgtttttacatagccttaaatatgttttttaatcttaagcataagcatttgcccaaccttacagaacactttttatattcttataaatatcccaattgttctttttcttctaggggatgttcgtctaaccccagaagactttgctagagctcagaagtactgcaaatatgctggcagtgctttgcagtatgaagatgtaagcactgctgtccagaatctacaaaaggctctcaagttactgacgacaggcagagaatgaagcctttgtatgacagacccatgtatttttggcatgaggaactaacagtccattactctatcttcagcctatcaggatcacagttttaaggaagacttggttttgttgaatatgacaatgaaatctgtgtgtatcagatttttattgaagcattcatcagcagcctcaaccagttttcattgtccatttactagattcaatcgtctctgagtatatagggctgatgttagcaagaccctaaaaatgtccattgaaccctgcttcaaaaaatgaaaacacacctctataaaatgtgtactgggaataagctttgtatttacatacattaggggaattttttaaaatctgtaatgtttggacaaacagatgatattactttgctataaaattataaatgtaacttttaataaagatagccagaatattctaaattagaaattacgtttttgtttccctcaagacataaaacaaatataaacattctaaactgctggatgaatctgaaaagacattaagttcaaattttaatttattctcatattaaatataactccattaaaagtttaaaatttcatgggagaaaatataataaggtaaagaggtagaatcactttcagacttaagaataatgttgatttcccaagtgctttaccttatctgttaaagcgtaagatgaattggtatttgcttcataggcagtttgactgcatgtattagagaatgaaaagaagatatttgtagtaatgcctggaaacttggtgctttaaattaaggtactcctctgctgctgtagaatggattccacacagtggatagctatgggtgattcagaatattatgtttagattcccatttgttaagtttataagttttgtggggaattatgaacttactgtgtactacctgcatttgtgctgtgtgaaaaataaatacaaggattcgtttagctaattcaacttactacaaagacaaatgtctgtttttatttgcctgctaggattgtcttttttaaaagtcatttttatttataggaatatgggtgtttctataggaagaaacaggttttttgttttttgttttttaagataaatttgacaaagttaactgaaatttatctggtccattttattcatgctactaagatgggaatctttaaacacaagggtcagcaagctttggcccatggattggccacctgttacgtaaataaagtttctttgaaacaagcctacactcattcatttatgttttgtctgtggttgctttccacaactgcagagttgtatggcttgcaagtctaaaaacatttactatttggccctctaagaaaaagttaagacacctagtctaatggccttttgggaaaaaacaaatcactaactcataatcatttatatccattattttctgcataaatgtaatgctattgtacagggtttggtagaataaatattcagactgactaaactgttctaaatcctcacaaaaaagtccccaaacaacatgcctcctaaaaaacattttcctatcttttacaagaggtatgaacatttgtagggttccacatttgcatctagaaatccaatgctctttagaatgttattacgaatagaaagatggccaggatgacctttagtgttacatgatgttcagcaaattttaattcaaaccttgatatgcctggacactgaaaagtaaacgcatcacctcctattttataccctaccttctggttcccaattgggagagcacatagagggaaggagacaatatagaaactacggagtccgctggtagtgggctgcatggtgtgacagagcccttctctgtaaaatggaaatgacaccactagccatctcaatagttacaagaattaaaagagatacagtacctgaagtgcttagcgcatggtagcatttcataaatgtttagtgtcaatactaatgctctaataatgtaaattgttaataatttatttccctaatatcaggaaatcccagttgtctatgtggcccagtgcttaaaaacgccttcttgcatgaggggattgaactatacaatgtttgttaactttgtatttgtattttttcctataaaatcttaaaataaaattaggagatgtgttctgatgtaacagtaggattagcaattttcatttattccttccatatatatttactgaatggctactatatgcctggtattgttctttgaaagcagaaacagcaggaaaaaaagtccctccctcatagagtttacattctaaaagggaggaaatagataataaaatatacattacatttaatcagtggctctccgagtgtgattagaaatacaaattttgggccccacctgtcctacccaatcagaaactctagggatgggtcccagccttctgagttttaagagacacttaaggtggtccctaaagttcgagtggtttagctctacccaaatcagaaatattgcaagtctgagaaaagagattctcctcaaaccggttctcaaaggtgtctctggacgaccggcatcagcatcacctgcgaacttgctagaaagttctggggaccacactatgggaacttctgtattaaatagtgataaatgctatggaggaaacattgaggacaggataggagatgcttaggtgtgtacagacatatgcatatttcaatagaatagccaggatagacctccctgaggtaacatttgagcaaagaaggaaaagagtaactagtatgcagatacatacatggaggaagagcattcccaacaggtagacagaaatcaggtcagagggtaaaagcaggagaaaggctggtgagggagctaaaagcttaggatcataaagcttttttgtaagacacttgactgggagctatatggaaaggttttcagaagaaacgtagcctgatgtgacttaacttttgaaataatcatattggctcctatgttgagaatagaccgtaaggtgggtggtaagtaagggaggaagctgggagaccagttaaaaagagtattaacaataggccgggggcggtggttcgcacctgcaatcccagcactttgggagccaaggcaggcggatcatctgaggtcaggagtatatatttattaatatataaatatgtatttatatataaatcataaatatattaataaatatataatatatatattagcctggcatggtggcacatacctctaatctcagctactgaagaggctgaggcaggagaatcgcttgaacccaggaggcggaggttgcagtgagccgagatcgtgccactgcactccagcctgggcgacagagcgagactccttctcaaaaaaaaaaaaagtattacaataatcaaggtgagatattatgatgtcttagtccaggagtagccttggaggtaataaaacgggattggtttctggcggcttttttttaggtagagccacaggatttctgtaaactggatgtgaggtacgaacataagagaaggagtaaaggttgactccagatttttcacctgaatgcctgaaaggaatgagtaatcatgtactgcagtagggaaagttgccgaattcctctctcacttagactgaagtacaatgtttccaagtttttgtgaccagcccaagtgaaactgataacggtgttttgtcaatgcggcagagggagaagaagaaataaggttctgctgacaatgattgccacagatatctcaccaaatcactgctgaactggagctgcaagccaagaatagttcccatggttagcatggcctaggaagtttactgacatcaggactacaccaagaaaaagactccagttatgggtcttgaaaattaatatcctcagatgtttttagaatttatatatgacttgtaattctagaaatttgagaattctatgtatgcattgaaagattatatactgtcttttctaaagaaacaccctaatagcagcattgtacaaatattttcaactctaaaagaataatagctaatggagttgatgggttttggttttcatatgagaagtatccttccctggttggttgtaatctttgaagtctatgtggaattctaagactgcaggcttgttcattggagtacacttaagtaggacaaattctaagtaagcaacacttcaataataatcataatagctaacatttcaatgtttactaaatgtcagatactattctaagtattttgcatatattaattcatttaatcttcacagtggtcctgagaggtaggctttatttctgttttaagatgaggaaagggagccacagagtaacaaatttgcctaaggtaacacagctaatatttatttctaagctcagactgcctgtttcagatcataagaagtatcatccatgtcagtaagtcacctgttacattgtaagtacaatgagatgttatgagttccacattatcaaggtcattggacagttccttttattagtgaggtgttagcacctaaatttttctattatctgggccatatgttccaattgacagtgctaggcagtgaacacagggtatgaacttgaaaatctgattgcaccctcaatatctggaatatacactgatctatgacctgaaattgtatggactgcagcaatccaaggggacactaagcagggtttgagtaatgctacaatggatttataggtcattttggagaaggtgttccacatcattagggagtctgggtttcccagatgtgcctgttttatcctttttattttaaataacatcactgtctttcctaactaaaaattcttcatcttcaggaaataagattgagatacggactgaaaatataaaattagcaataatgtttattattagatacttcctcaattaaatttctccctgaaagtcttaggcaaaagcccctgtctcttacttcatatatcaagtttggagggaaagacataattgcatagcagtattccatgaatataacttaatggggaactggcttcagagttcagcaatattgggaagtcttgtcaaatattaagtcattcatatgttcaaaaatattaatatgtattgagcatctaccatcaaatatttaatatgataatgccatactggatattatatacgagttacaataattcttcctaaagtcagggaaagcttcacagataaggttgagctgaaggtttggcaggcagggaagcaaggagaagttagcagagagaaaagcacaagcaacaccatggaggaacaaatgtgggcaattcaggtaactcgagtaatttagtgttactatgcatatggcctatggaggccaggagtgtaaatgtattatggctggggcggggggctagggaatgtgttatgactaaattgtatcccttcagaattcatattttgaagcactgatctccagtgtgtctgtgttcagaggcaggtcccatagggaggcaattaaggttacatgagatcataaaggtgaggccctaatcctataggtctgctgtcattacaagaagaggaagagccaccggagctggctcattctgcacgtgtacagagaagaggccatgtgaggacacgcagaggctcgaatatgctctcaaccctatcagttgcctgctttaattcatcccatggaattgttttgtcttttcgacccctcggctatgttatttgtattgtgatataggggatattcggagtcctctgagacgggacaaggacactggacggtctattgtgccatgcttatatattttctgtatacaatgctttctgtataaaaccagtaatacctgagaaacaacagtaacttgacaaaattactattgatcacttaactttatgtatcacgtaagttaaactttatttatttacatgtgtctccctcattagatgctaagttccttgatattttatacatttgtgaattcctggtaattcacatgaagcttgatgcattgtaagtattctgacctggtgaaataaatatacgaatgggcaaaaaaatatatactaaaatgatcaaataaaggttgtgttcagaaacctctgttctattatatcatagtgatttaagattataataattgcatcaaaacgttctgaaatcacatattaatcttacttatcaaaaaaatccagtccatgccacccagcaagtctcgattcttaattcgaatgcatggttctttatcttttgacaccatgaagcatgatgtcaggtatgctcaggacattcttagaatatacactaataacatcctagtcacagacatatatgatacttgttagcagcttatatgttcttggtctgtctatactctggcagagattaatatattcaagctcaatggagtgaagaagtagcaatgtgtatcttaaaaatgggagaaaatatttagaccacattgaaaattgaaaatatttatggtgactgaggaaattgtaactggaagattattgctccagatgaagagacaagaggaagtttaaaattaaagccaccaatgacatctgaacattttgggaaagtcagaactcatttgatttttttttcctcaatagttaatcttttcttctgcctactggttcaaagataagcaactgaaaaaaaggtgtgaagatgagaaaaccataggcacagaacgctgtcacgcagaggggtctgttctgagtcaggaagctgatgttctggtacgctcactgtggcaatctgttctgtctaccagaaaattggcccttctgaacctcctgtgagctttagttttcccacaacaaccaggagcaggcaaaactagatttctacggtgttttggagatctaatattcaagtctctgaataatacttagacttctgcaaacaaaatttgggattaggtgtgtggcccttgaaacgccctcattttaactagacaaattataacatgtttttaaaacttaaatcttgacagtcatcctattctgtgattaaatatcccccgaacactttctgttaatatgccaagaattcagtaaataaatccatttgaactaggttaaacgaaagactgtaattgcaaaataattgctgtttctatgggcagggaatattcttctgccagtgtaaagattgtcaacgagcacaaacctgacgaagatttaagagcaaagagcattaccaaagataaacagagtcatttcataatgatgaagtggctcaatcaagaggatataacaatcttaaaggtttatgtgcctacccacagaggtttaaaatacgtgaagcaaaagccaatacaactgcaaagagaaaaacagattttgacaccctctcaataactgatggaaccattaaaaaatatgactagcacattggatccaaaataaattggcccttatgaccctgaatgacacgttgttttttttcttcagtgaactattgttgggggtgactccgagatagaatggtataaaaataattcactgatgtttttctcctgaatggagattttatttctacattgatgaagattgcaaacaacatgtctgccttttttggtcctgaatttaaagggaaacacaagaggtgtttagttatttacaaacaagtatatattcttgttgatccttttttcaatactatcttgagatactgtttgtaagtatcctcctataagtatttccaaaagtctgccaaccaagcagcttagaagaatctattccaagtttctatagaaaaactctgagatgaatttattattttttggtaccatttatgagaaaaatctcagctttgaaggtagaatagcatacagaatcctgttaaatagtatatttgtatatatgtctatgtatgatatatatcagatatatacatatgtatcagtaatccctctgaaaatgttgttttaattgtgtggaacaaaaagcaaagtaaatcagcgagtaacttattttctaatctcatctgccaatgttggagatgacttttttgttcctgtcatactaggtagttacgtctctacaaaatcactgcaaaagattgaaccatttctgatgaatgaactttgacctactgcagagacacggtagatattcaattaatatcagttcaacacactttggttaagtgcaaagcactgaggacatgaagttttcattagaggtgtctgccgctcaggagcttaacgtctatttagggacacagatgtgcacaaacataattgaaggcatagttaaaatgccaaagagaaggcacactaatgcattgctatcgaaacttaaatatttttttttccaaactgtggtaactgcgtcattacatttcactgggatgacagcatctgagttgcaccttacagaatgagtagaatttcaatagggaaagtgagatgggtaattaaggtaagaggaggcataagaggaaaaatatgatggtgggaaagcaagtaacttgtgtcaatagcagtgaaatagccatgttagtcctaaggagaggctgtttagttatatatccattcaatatgtcaatgaatatatttttgaaacaaattactccttgtttacatgttttattaatttgagttttaaagtttagcctactaccttgtcttagtccattcaggctacaacaaaatacctcggactgggtaatttataaacaatagaaatgtactgcttacaattctggaggctgggaagtccaaaatcaaggcaccagcagattcagtatctggtgagggctctctgctttatagatggtgccttcttgctgtgtcctcacatggcagaaggggcaaacaagctcatcccggcctcttttataagggcactaatcccattcatgaaggctctgccctcatgacttaagcacttcccagaagcccctacctctatttttcttcttcaactgttactttaacttcaggggtacatgaacaagatgttcaggtttgttacataagtaaaaatgtgccatggtggtttgctgcccagatcatcccatcacctaggtattaagcccagcatccattagcttttcttcctgatgctctctctacccccaaccttccaccatcagcaggccccagtgtgtgttgtcccctgccccctacatgtccatgtgttctcatcctttgattcccacttataagtgagaacatgtagtgttttgttttctgttcctgcattagtttgctcatgataacggcttctggctccatccatgtccctacaaaggacatgatagtgttcctttttatggctgtgtagtattccatggtgtatatgtactacactttcttgatccagtctatcattgatgggcatttgagttgattccatgtctttgctattgtgaatagtgctgcagtgaacatatgcatccatgtatctttataatagaatgatttatattactttggatatatacccagtaatgggattcctgggtcaaatggtatttctgcttctagatctttgaggaaacaccatactgtcttccacaatggttgaactaatttacactcccaccaacagtgtagaagtgttccttttcctccacaaccttatcagaatctgttgtttgttgactttataatgattgccatactgactggcatgagatggtatctgattgtggctttgctttgcatttttctaatgatcagtggtgttgagcttttttcgtatgtttcttggccacatgtatgtcttattttgagaagtgtcctgttcatgtcttttgcccacttttaaatgaggttgtctggtttttcttgtaaatctgtttaagttccttgtaaactctggatgttagacctttgtcagatagatagattgcaaaaattttaccctattctgtaggttgtctgttcactcttttactgtgcagaaggtccttagtttaattagataccatttgtcaatttttgcttttgctgcaattgcttttggtgtttttgtcatgaaatctttgcctgcacctatgccccgaatggtattgcctgggttttcttctagggcttttataattctgggatttacatttaagtctttaatccatcttgagttgatttttgtatatggtgtaagaaaggggtccagtttcaattttctgcatatgactagccagcacttccagcaccatttagtaaatagggaatcctctccccattgcttgtttttgtcaactttattgaagatcagatggttgtaggagtgcagtcttatttctgagttctctatcctgttccattggtctctgtgtctgttcttgtaccattaccatgctgctttggttactgtagccttatagtatagtttgaagtcatgtactatgatgcctccagctttgttctttttgtttaggattgtcttcgctatacagactcttttttgcttccatataaattttaaaaaagattttctaattctgtgaagaatgtcaatggcagctcaatgagaatactcaatgagaatagtattgaatctataaattactttgggcagtatggccattttcaccatattgattcttcctatgcataagcataaaatattgctccatttgtttttgtcctcgctgaattctttgagaagtggtttgtagtgcaccctaaagaggttctttatgtcccttgttggctgtactcctaggtattttattctttttgtggcaattgtgaatgggaattcattcatgatttggtctctgcttgcctgttgttggtgtataggaatgctactaatttttgcacattgattttttttattataccttaagttctaaggtacatgtgcacaacatgcaggtttgttacataggtatacatgtgccatgttggtttgctgcacccatcaactcgtcatttccattaggtatttctcccagtgctatccctccccctgcccccacgctccaacaggccccggtgtgtgatgttccctgccctgtgtccgtgtgttcttgttgttcaactctcacctatgagtcagaacatatggtgtttggttttctgtccttgtgatagttggcttagaatggatgctttctagctttatccatgtctctgcaaaggacatgaattcaaccttttttatggctgcatagtattccatggtgtatatgtgccacattttcttaatctagtctatcattgatggacatttgggttgatcaagtctttgctattgtgaatagtgccacaataaacatacgtgtgcatgtgtctttatagtagcatgatttataatcctttgagtatatacccagtaatgggattgctgggtcaaatggtatctctagttctagatccttgaggaattgccacactgtcttccacaatggttgaactaatttacacccccaccacagtgtaaaagcattcctttttctccacatcctctccagcatctgttgtttcctgactttttaaatgatcgctattctaaatggcatgagatgttatctcgttgtggttttgattggcatttctctgatgaccagtgatgatgagcattttttcatatgtctattggttgaataaatgtcttcttttgagaagtgtctgtttatatacttttcccactttttgatggggttatttgtttttttcttataaatttgtttgagttctttgtagattctggatattagccctttgtcagatgagtagattgcaaagattttctcccattctgtaagttgcctgttcactctgatgatagtttctttggctgtgcagaagctctttagtttaattagattccatttgtctattttggcttttgttgccattgctttggtgttttagtcttgtagtctttgcccatacctatgtcctgaatggtattgcctaggttttcttctagggtttttatggtgttaggtcttacatttaagtctttaatccatcttgagttaatttttgtatacggaagggatccagttttagctttctacatatggctagccagttttcccagcaccatttatcaaatagggaatcctttacccattgtttgtttttgtcaggtttgtcaaagatcagatggttgtagatgtgtggtgttatttctgaggcctctgttctgttccattggtctatatatctgttttggtactggcaccatgctgttttggttactgtacacttgtagtatagtttgaagtcaggtagtgtgatgcctccagctttgttctttttgcttagaattgtcttggctatgcgtgctcttttttggttccatatgaactttaaagtagttttttccaattctgtgaaggaagtcagtggtagcttgatggggatagcattgaatgtataagt

SEQ ID NO: 377 - DNA, 55050 bp, Homo sapiens
cttttaagtcaatgcacctgtaaaagatgattgtgaatgtatttttttccgtagagaaaggggcctgcaaaggcagaagtgctaggactggtcacgtcatgtggctctgtttggatggtgccaccctgccactcagggcccaaacctagggtctgcctgcctcatccttcctatcctccccatggccattgggctctagcccttctctcgcctttggctgcatgatccctccagctgggtcaaatccctcactctgtgcccgtgctgcacctgaccttcctgtaaacacatcgtataagggtttcaagcacaggttctgaacaccagtgtctgggttcgaatccagctctgccactgatcagttgtgcgcagatgatgaattcttaatctctccgaccctaatcccttgtctctaaagtggggattgcaggagaacctacttatcagagttttgatggatgaatggtgactgttttaaaaccactcaattgttaatctaagactcagtttccttatctgtgaaatgggggtgatgatagcgcttacctagaagagttgtagtaggttaaatgagtgaatattcttatttttgttttatttatttagtttttgagacagagtcttgctctgttgcccaggctggagtgcagtggcgcaatcttggctcactgcaacccctgcctcctgggtttgagtgattgtcttgcctcagcctcctgagtagctgagactacaggcacatgccaccacgcctggctaatttttgtatttttagtagatggggggtttcaccatgttggccaggctgatctcgaactcctggccacatgtgatctgctcccctcagcctcctaaagtgctgggattacaggcatgagccaccatgcccggctacagtgattatttttaaagccctcaaaaccatgtatggcaccaaatggtgccatctgagtgattattaaaaatactgattaatatctggcccttctgtgtggcagtaagccttagaggggctgcggctgggcctggttttactctccttggtgtcctcaggcatgacacatagtaggtactcacgtatttgaatgaatgaatgagtgtactctgctcctcctcctcatgccagtatgtttctctctgctggaagtcgttcacactttagtatgaagtacaaatgaatgctacctgtcccctttgcctgatctgatcactatggaagaaaggttctatctccctgggaaaggaatgtgaggcctcagtgcccaggtcggggcgttttatcggcggtagagaagaaggatgttttcctggactctacacctatgagcgtgtcctctgcctccttagagcaaggcattgaagcacttgtgccctttatatttttaaagataacgaccaggcacggtggctcacacctgtaatcccagcactttgagaggccaaggtgggcggatcacctgaggtcaggagttcgagaccagcctgaccaacatggagaaatcccgtctctagtaaaaatacaaaattagccaggcttggtggtacatgcctgtaatccctgttacttgggaggctgaggcaagagaattgcttgaacccagtaggcggaggttgtggtgagccgagagatcatgccattgtactccagcctgggcaacagagcgagactctgtctcaaaaaaataaaaataataaaataaaataaataacgaaataaagataacatttttcctcttttttctgagggacagaagcctttggcgggcagcagaggtcaaaccccagagcagaggagatgagaggcccggccagttccgaggccttcccagaggaaacctcgcccacagatctgcaggaagttgaactaatgagttggtgagtccccaagaggactgcccgctaagttgggatcaagttcaggctgccagagctcagataaactagaagggcctctgccacttgggacatacagttctgagcctggcaggaagccgggaaggggtggtggccctgaaatcatgatggcacgcaagccctgggtagcaacatcaggccccagctgggagcatccagcccggctgtcaggctgcgatcctgacttgtcactgatcaaaggaacgcagctggtttcccaggcggatttgttctgtgtttatttctcctcttggaacttttctcctcgcacacaagacctgcagtgctgctgtgttctccgagtagttacctttcgtgtctcaaaaacttcagaaggtggttttataagttaatgattgtgagaaattaactgaggggtcactgctcggcatcctgggtccctgtggtctgaatactgctgcggagtggatggctcaatagaagaacatttattgagtgtctcatgtaccacgccctgtgtatattgaggaaagcactttggagttcagtcactagctgggactttggaaagagcccctaaattctgtggccttccatctctttatagaacagggatcattcctgatggggccatgatgatgacattgattctgtccatcggtccaggacttactgagggctgatgctgcccagtccctgtgcgaggcgctgggttgcaggcagtaagagacatggatacttgaccttgcagagcctatatcccacttgtgggtataggaccttcctctttttttttttaatttttaatttttttttaacagggtctggctttgtcgcccaggctggagtgcagtggggcaatcttggctcactgcaacctctgcctcccaggttcaagcaattctcctgcctcagcctcccgagtaactgggactatgggctcccaccaccatgcccagctaatttttgtatttttcatagagatggggtttccccatgttggccaggccggtcttgaattgctgacttcaagtgatctgcccgcctcagcctcccaaagtacgaccttcctcttgatgctgtaacaaatgaccataaacttagccacatggatggagctggaggctattatcttaagtgacctaacaaaggaacagaaaaccaaagaccacatgttctcacttctaagtgggagctaaacgttgactacaagtgatcgtaaagatgagaatgatagacactggggaccactagatggggaagggaggaaagggggcgtgggctgaagaaccagccattgggtgctatgcttagggcctgggtgacgggatcattgggatctgaagcctcagcatcatgtagtttagcagttgcgaactcaacaagttcacaagtctatgattttacagttctgttgattagaagtcccacctgagtcccactggggaaaactctaggggtttgcaggactgtgctccctctgaggctctaggggagaacttcctttgacttttccagcctccaggggctgcctgcattccttggctcatggtcccttcctccatctccaaagccacagcgtagcgtgtcaaatcaactttcccttgacttccacccccacccgacttccaccattcatctcctctgactctcactctctacctccctcttacaaggacccttgtgattatgttggtcccacccagataatccaggatactctccccatctcaagatctttgctttaatcccttctgcaaagtcccttttgtcaggtaagaccacatgctcgcaggtcctggggattaggatgtggacatcttttaagggcccatgattctgtgtaccacagggaaagagaccatcagtggtaaacataataagtacatttcataatttattagaaggtgatgaaactatggaaaaagaaagcaggacaaagggggttgggaatttagggtggtgtaaaagaggcagatggtgattttaaaagctcagttggggtaagcctcattgagaaagcaaaattggagcacagactggaaggaattgagggatcagctaagcaggtatctggggagagagcaactggggggctgtgcaaaggccctggggtgggagctgtcaaggaagaagctagagcagagtgagcacaacgaagaagtggagatggtgatctcaagagcccagcactgtgccaggcatatagtaaatgctcactaaaagaggttcctgtccatgtcccagagaaagcttcggagatggacaacgctcagccctgtcctcaaaaatttatggtcaagtgaggacagaggaacatgtacaaccgtcttctacatactactcattcaacactcacgacaaccctgtgagacaggtatgttactcccattttacagatgagtcaaccaaagaacagagagggcaggtgacttgcccatggtcgcacagctgggaggtctcagagcaggtgtctgtgcccgagcaagctggctgcagagtccgtgttcttcttttattaaatttcaacttttattgtagattaaagggtatatgtgcagatttgtgacacgggtaaattacatgctgctgagccttggggtcccagtgatcccatcacccatgtgataagcatagcacccaacgggtggttcttcagcccacgtccactttcccccctctcccatctactggtccccagtttctgttgttcccatctttatgttcacatgtattcaatgtttagctcccgcttataagtgaaaacatgtggtgtttggttttctgttcctgcattgggccacgtaggataatggcctccggctccatccattggagccctggctgcaaagggcatgattttgctgttttttatggctgcacagtattccatggtgaacaagtaccacgttttctttatccagtccactgttgacgagcacttaggttgattccacgtccttgccgttgtgaacagcagtgtgtagcaaacatttgagtgcatgtgtctttatgatagaatgaattactgttctttgggtatattcccagtcgtgggattgctgggttgaatggtaattctactttaagttttttgagaaatctccaaactgcattccacagtgactgaactagtttgccttctcactgagcgtgtaagtgttcccttttccccacagcctcgccaacatccactgttttatgactttttgttttttgagacggagttttgctcttgttgcccaggctggagtgcaatggtgtggtttcggctcactgcaacctccgcctcccagattcaagcgattctactgcctcccaagtagctgggattgcagacacctgccatcacactcagctaatttttgtatttttagtagagacggggtttcatcattttggccaggctagtctcgaactcctgatcccatgtgatctgcccatcttgtcctctcaaagtgctgggattacaggtgtgagccactgcgcctggcctgttttatgacttcttaatagctgttctgactggtgtgagatggtatctcagtgtggttttgatctgcatttctctgatgcagagtctgtgttcttaatgttacttgacgttgccatgttgacctcacccacagccatgactttggccttggccttgacttctatcatgactaatatatatacatagaaaaaaagaaaggctacgttggttatctctggatactgatactagatgtatgtattttaaagattttgtttattctttcctctgttttcccagttctctgctaataaacatgaattatgctattaggggaaaaaaaccataatataataacttttaaaaattctgaattaggctgggtgcggtggttcacacctgtaatcccagcactttgggaggctgaggcagctggatcacctgaggtcaggagtttgagaccagcctggccaacatggtgaaacgccatctctactaaaaaaaaaaaaaaaaaaaaaaaaaattagctgggtggtggctggtgcctgcagtcccagctactcgggagtctgaggcaggagaatctctgggacccaggaggaggaggttgcagtgagccaagaccacaccattgcactccagcctgggcaacaagagcgaaactccatctcaaaaaaaaaaaaaattatgaattagagaccagataaagagaggagtaaggtaggtattagcagtgaagtgaaggtttgagcttgggtgtctggttagacagtgatggccttggctgaaccttagagaaggagtttgatatctcagacaagcaaaacttaatagaaacataaggcaagccacatgtgtaattgtaaattttctagtagccatgtgaaacagatacggagccgggtgcagtggctcatacctgtaatgtcagcactttgggaggccgaggcaggtgtatggcttgagcccaagagttcaagatcagcctgggcaacatagtgggacctcgtctccaaaaagaaacaggtacagttaatgtaataccatattatatttaacccaatatagcataaacattagtagttgaattagcagttgaatgcacgaccaacgtaaaaactcctaatgaaacgttgacattttttttttcctgtctccagccaacaacagatgctggtgaggctgtggagaaaagggaacgcttatacactgtcggtgggagggcaaactagttcagccactgtggaatgcagtttggaggtttctcaaagaacttaaagtagaattaccattcaacccagcaatcccacgactgggaatatatgcaaaggacagtaattcattactgtcataaagacacatgcactcacaggttttccaaatcgggtctgcattttatccttatgacagatctcatttcagaccagccatgtttcacagggaagcatgggtagagagcgacagccacgtcgagccatcgagctggtagatgaaatgtgttaagcacaactcattcattacaccgtctttactgagtgtctactttgcaccaggcactgcttagggatcggcgattccaaagtgaacaaacagatccccagaagctgcccccgtggagctgacatcctagtgtggagacatagacgataaacgaagaaagcaaagttagtaaaatacagaatatgtcaggtggagatgagtacgaagaagcataaaaccaagaggggcaccgtgagtcccagtggtatgcaaatggtggttttcaatcctggggtcagagaggaccacagcaagaaactgacacgtgaacaaaagtctggaggaggtgatgggtgaggagtgccgcagctgggtggaaaagcattccaggtggagggcgctgcaggggcacagggctggcgccttgcccagcaaggaggctgagagagggcatttggaacctcgtctacccagagggaggggagtcatactgttggcagaagtgaggccacccagggagagagagagagaggcaggaaatgggccaagactgtaacatcaatgggaaacgcctacattttaaggggaaggtggagatggaggatgagcaagaaccacatgggaggcgttagctgccttaggagagcgcagggccccaggttccaagcagcaggaagtttctcaaatggaacctgggccaaggttccgctctgcctggagaacagggtgcgggtggaggaggcccaggaggcggtgcctcagaacgctcatctcctaacagcaagcatgtgctgagcctagatcctcgcctaagtgcagctgggcctcatggcaaacctgcgagtaagttctgactccatacccctgttttacagatgagaaaacagaggcagagagatggggcaggacctgttccaggtcgtcctggtaagtaggggtagcagctccatcatgtccgtgggtggctcctggcttctaaataagcagccttgccctgcagggaggggcattgagactgcgtcccataaagctgaaagaagagggagtggagcacgctggaccatgcccccataagggctcagccagtagtttctggatgaagaaatgaaggaatattctagaatctagggcaaggtaatgatcagggctgggcctagcgggaggcaaaggaggcatctagggtctaaaatgtaaaaagactctcacgcttgggctcctgggtttacaggactctgatggtgaacttaaattttgcattgctcactgggcaagtgtcttaacctctctgtgcatgggatcctagacagcacctgcttataaggctaatatgagacctaaaagcattaaaatgcaggaagtgcttcaaacattgccgaacacacagactgtatggcttttaaggttttttttttttgatacagggtcttgctctgtgacccaggctggagtacagtggcgccatcacagctcactgcagcctcaacctcccacgcttaggtgatcctcccatctcagtctcccaattagctgggactacaggtgtgcatcagcacgccgggctactttttttattttgtattttttgtagagatgaggtctcactatgttgcccagactggtcttgaactcctgggctcaaggcatcctctgcctccctaagtgctaggattacaagtgtgagccaccgtacccgacctacacagactatatgtgtttgccactattgtcattcactaaaaggccaagaggggttgatgatacctgcccagggcattctgaaggctgtgctggccaggaggtggggggtgagggtccccagggagggaggaaccaatctttctggagcactcactctgtgcaagtgctgggcacagctggcaccctctcctgtagccccacatcgatctcaagaggcagagactttcacatgcccatttcacagatgagagaactgaggaccatgagcaagaggctttccagcatctcgcagaggctgaactgggatcaggcaggtgcgtcaagcctagtgcttgggtcccttctgcttcgcctaggggggtgccacagggtctgacctacctgggttccagcctcctctctgctgctgttgcatgacctcaggcagccccctctgtttcctcatctgtaaagcgggcatcaaaacagtgtctgttttggggccgggtgtggtggctcacacacctgtaataccagcactttgggaggctgaggcgggcagatcacttaaggtcaggagtttgagaccagcctggccagcatggtgaaacccagtctccactaaaaatacaaaaattagccaggcatggtggcacatgcctgttatcccagctacttggaaggccgagacaggagaatcgcttgaacccgggaggcagaggttgtagtgatctgtgatcacaccactgcactccagcgtgggtgacagagcaagacccgtctcgaaaaacaaaacaaaacaaaaaaccagtatctgtcttggaagtgctgagaacagacaagggaatatgaagtttgtgaaatgttgagcccgctgtgctacattcctgtaaaacacacacgtgcacatgcacacccacgtgcacacacgcatacacataaatgcacatgtgcagatacaccggctgacagtgacagcacacttatgtgtgtgaaatgctttatgtgctcaatttcttttaaatctcacaggaaacacacgctatgaggaactacccacatgcccacatcaggcaggaggaccccggcgggtgcaagggtggaagtcgtctcttcatggctgcacccttggccagtgccagtccagcagcctctttcaaagaagcttttataggcagatagtttgtcagcccagctcgaaatgtgaacaaggtagcagccgagcccccacccatccggctgcactcccctgcatgtccagccccgagccctgtgtcaagcacacctccttgggaggagaccgccccagcctgcaaggaagtgctcattatggagagtggagagtgacaggccactcccggccacgtctccaagcaagccggtgccccctcctcctgctgccaccgcccactgagctgcctgggctgcagacgccctggttggagcgtctggggccagatgttatagggcaagctaaaaataaccgggcaggccagccaccatcgaggaaggggcatgtgctggacgcggacacatgatccgagggaccctgctgggtggaactaagaaagtccagcagactgtgcacgctcctgtccccactcacaggcccacgcagcgaggggggcccctcttctgtgtgcgtctggaaggtcgctgcccagggaggaaatgcctttaaccggcgtggggccgggcagctgcaggaggcagatcatccgggctctgtgcctcttgctacttctcctccacgccggctctgccaagaatatctggaaacgggcattgcctgcgaggctggccgagaaatcccgtgtaagtgcctgggatggggaggctggggcagcctgtgtgggtgggagtcagccttgaggagaggcgatccctagacactgccttctcctgtaagtgctcccccaaaacgtggcaaggcaggcgtcttcctatccgtgtgtgtctgagttgtgtggtgggcagatggggctcacccccaaaaaaggacccttatctgtgaatcaagaggcaaaagacacatcacaaatgtgccaaagaatcgtgccttacttttgccttgttacaaaagtatgcttgctcctgaaagacagcatctcatttcggaaccccaggatttaaacggagcattccgtctccctgatcagtaccaaatgtttgtgaaatacacttatgcattcatgtggttgtttattcattcagcaaacagaatgaatacactctgttaaacagaatttagcagaaaccgctctggggaaggcactctgtggggtcctgtggatacaagataaaggaggtaccagcccccatcctcaagggtggcgtggccgaggtgcagaggcagttgggtgacaaacgatggcagtacaaagagaaggcatgaggcagtgagtggcaagaaacacatgccctggggccagatgtctgggtgtgaatcgggctctgctgctcattagctgcgtggcttctctcaggcaagctgcttgacgtctctgaaccccagcaatctcatctgcaaaagacagagggatgcatttcttcacacaactatgtctgggtcgccactgtttaccaggtactgtcctaggctgtggggatacaggcctcacatctctgcctggggaactcaatggggggctgggggcagcaaagaataaatgagagagatctcatttattagtatgtgcagattgcaagtgctgaggaagcaataaagcaggaagggaactaggagagagaatggggtggaggaggctatcatttttggttcctcccaccccccagagatcacagatccgcagggacggagtgagccaggacgatatcagcacacagagggctcaagaaggtaatgctggcacccacagcacctgtgtgaggattgaatgtctcagtatgtagaacgtctttgcaacatagcaagctggcagtgcatcttggcagctttcaatcaaataattgtgactttgtttggtgttgcctaacagggtagcatgtaggttccttggggtagggcagggttctgtttcactaatgtgtgcccctggtgcctgccattaagttgacgcctggtacattcttgtgggtgaattatgagcggctgcagtggtagcacgggatgcgtgtgcagctcttccccaggagagtcagacagggtttttagggttggggacagtggacctgtggctttaaaggataaataggagtttgccagctggagaagagggaagggagaatgattaatgaccccaggcatagtggggtgcctgaaactgtattgagacaaatctgggcctccagggctcatattctccatgttcggcacatgctcgtggcgggagacaggaggacttcgagaagtggaaagagtagtagagtgacatgatgaggcgcttggagaagggaaagctcatgtgagatggtgtagtcacctaaggcttcctggaggaggtggagaccttgactggatcttggggaaggattaggaattaggaggaggaaggaaattcctggaagaaggctcagcatgagccgaggctcacaggcagaagtggtgcatctaagagctgcttgggagaccagacctggccagaggggaggcattgaggaggggtgagagactcttctcagattttattgactcctccatgctcttctctggtgcaacaggatgatttaaccctcaactgtagttagtagcactttggttctacaaccatagagagattgccaatatgtcatctgattttatctccaccatgtcccaagatgtcataggagccagcactgtgacatccacataggagggtcagggttgatatgcgcgggggatttgggggagtctctaaaacacaggcctgggtgggctgcaggagctgattcacttgtagccaccactggtcaggatgcaagtgctttgaattggctcctcgctgaattgaaactttccctggttatcaacagatattggcctccttcctcagcgcctagacataggtgaggtttatgcagaacaactgtgccagccaggcacggtggctcatgcctgtaatcccagcactttgggaggccgaggcgggtggatcacctgaggtcaggagttcaagaccagcctgaccaacatggtgaaaccccatctctactaaaaatacaaaattagctgggtgtggcggcaaatgcctgtaatcccagctactcagaaggctgaggtggaagaattgcttgaacccgggaggtggaggttatagtgagccgagattgtgccattgcactccagcctgggcaacaagagtgaaactctgtctcaaaaaaaaaaaaaaaaaaaaaaaaaaaaaactgtgcctcagagaaagccctgggcgaagacaggctgttcgcctgtggctcagaggacagggagggctgggaagagcacctggcctggaacttatcacagtgaaatctctaatgtgctgtgcaatcttggaccactcgctgcccttctctggtcctcagtcctcacctgggaaatgaagatggagaacctatgactttcatggccctttcgttcgacagggacttacggatgataggaagcagcccccacatgcacaaagtcgagacttccccgtgaggcaccactccctcaccctacgctgagtgagaccttcagccttggccctgaccctcaagggctatgggctcgtcagagtgaggagatgctggctgtgtgctgaactggcttgcaccccctctggagagccagttttgttccacacagccatgatcacaaactaagttatataaacttacagttaaatcatttgtattaaaaagaaaggaaagaattttttttttttaagacagagtcccgtggtgtgatcttggttcactacaacctccacctccccggctcaagtgattcttgtgcctaggcctcctgagtagttgggattacaggcatgtaccaccacgcctggctaattttttgtatttttagtagagatggggttttgctggtctcaaactcctgagctcaggtgatccgcccgcctcggcctcccaaagtgctgggattataggtgtgagccaccgcacccagccaggaaatacttcttgttagaaatgcatcactttccaattgtattgctccgttttgctattctcttggctcctggggttttatgtcttttgcatccgtgtggtatgaccaggagagaagctactccacatctcttcccactcccattcagtggcctcacgtgggttgcctgaaatcaaccatgctgggagtatttacaccttggaaattggccagggctacatgaggagagctggtggttcagtcctgaccaagcgcagggctgcctgtagcctgctctagtctctcaaagcctcgtcccccggcagagtgagttttgtgtagcggactggtctcttagagtggggccggttaatgtcctgagtgctgtttatgcttcttggtctaagcatgcagagacagtgccagagatgagcacgcttgccttccattcccgtgggaggcccttaggagaagcttctaatgagaagtgccgggtctcccgccttctatctctaagaccttcaggagtttccttctcctatctgagcctcggtttcctcatctgcagcacgggacacagtagtgcctgctttgcagggctcagtaaaaagaccatagagcccacagttccctgactggcacagaactgcattccctacatgtgcactacggacagatttaaaaacccattccaggccgggcacagtggctcacagtggctcatgcctgtaatcccagcactttgggaggccaaggcaggcagatctcctgaggtcgggagttcaaaaccagcctgaccaacatggagaaaccccgtctgtactaaaaatacaaaaaaaattagccgggcatggtggcgcatgcctgtaatcccagctactcgggaggctgaggtaggagaattgcttgaaccctgggaggcggaggttgcggtgagccgagatcgtgccattggattccagcctgggcaagaagagcgcaactccatctcaaaaaacaaaaaacaaaaagcaaaaaaaaaaaaccaaaaaccccattccagaaccaaatatttatgagaatgaataaaacagaagcagaacgtttgtaaatagtccaataacctttccatggagctcagtcggttctgtggacttggtgtttttggtttttctttcctggcattagatgaaactcctgagaacaatgatttactgagcgcttacactgtgtcagggcaagagtttgccacgtattcgctcttgggagcctctcgacaaatccaccgggtggggcccatggcagccaccatgcgggcctcggtgctatgcagcccctggcctgggcaggctggcccctactgtcagtgtgactgtgggtctgttttcccctctaagcacccctccagggcagctggaaatggtggttcagtttgcaccctgcccagagatgcctgtcctgctgaggggggctgggaggggctagagcagccaggagctggtgccactttctctttcaaatgcatcctgccagacggggggagggaggggagcattgcattgtctatctggaggcaccccctgtgctaatagcagtaggggactgtaggagccagcagtggcccacaacttgcattcctcagttccccatctcctttcccccattatttctgtgagctcttgagagccttccaaacatccttttattttttgctgagatagcaagagtgggagaagcagatggcctggagctgtgctttcaccattccatgagttctgaccttcaccttcatctttgtaccgtaagcatctgtgtctgctggcctgaaggctttctctggctgcaggagcctgctcagcccacacacagtcaggccaaggtgccggggaggtaacacctgtaggagcaaatggagctggagcccgatggcccagctggcttctcaactttggtgggacacgagtgaggagtgttccacacggtttctccaaggtccactgggtttgagctctagtgcccaggcagccacctgctcattaacactccctgaagggcgccttccctttcctgcccagcttcccactccccagctggggcttcctgggatcccctcccaaatgtactccctgcactcgaatcctgtcggatccatgctgtgggttgaactgtgtccccccaaagatatatccaacccctaacttctgatccttgtgaatgtgaccttttttggaaacaggttcattacaggtgtaattagtcaaaataagatgaagtcatgctggaggtgggtggttccttaatatgaaccccgttccttataagaaaaggagaaggggccaggcatggtggcccacgcctgtaattccagcactttgggaggccgaggtgggcggatcacccgaggtcaggagttcgagaccagcctggccaacatgctgaaaccctgtctctactaaaaatacaaacattagttgggcatggtggtgcatgcctgtaatcacagctactcaggaggctgaggcagtagaatcacttgaacctgggaggcgaggtggacgttgcagtgagccaagatcatgccattgcactccagcctgggcgacagagtgagacttcatctcaaaaaaaaaaaggaaaaggagaagagacatagaatcagagacacatggagagaaggccatgcaaagacagagggttgcagaggtcagagtgatgtatctacaagagacacatgagggaccagagaacatgagggactgccagccaccactggaagctgggagagacattgaaaggttttctccttagagcctccacaaaggaaccaaccctgccagacacctggatctcagccttctggcttccagaactgtgaaagaatccacttgtgttgttttaagcccccagcgtgtggcattttgttgcagcaccctcggacacgaatacagtctgctctgggcatcaagggagtcagcttctgttggttgcaaccggcaacgagacatttcacagataaggaaactgaggccattgcagagaatgacttatctgtgctgttttggctggggacaagtggggctatcactatatccccagagtctgggagctttgtctgctccttgaaccaggtgagctcacaccctgcgggacttcatcatcaagactatgaagatgcctacgtcttgggggtcagcgggtgctcagtaggctccggaaacccccagcagcacccaggagggggtcttcaaggctcatggttgagaaccccagaaaagccccggagctgcctgggtgctggagagaggggatatgtcgtactgatgtgaagcaaacttactgtaggcttggccacaccctggtgtctagcccagaacctggcatggaggggggactggaaggaatgaaaagtccatgaatagctgacttttgagggggaccttaggcaaatcactttctcctcgctgggactgagattcctcatctgaggtcccagccctgaaattccaggtggaaatcaacgagtaaagaagcatcccaggtccctgtgtggttatcactcgggagagggagacaggaaagcaggacacctctgtgccagcactcaccgcagccacagggcagaggcagatggatgcccatggggtgagcacatcgcacctgtccactcaggggactagaactcagccatagaaaggtacggagcctggacacacgccattgcacagatgaacctcgaagacatgatgctgagtgcacaaaggccacgggtgtgtgacactgtttggatgcaacgtccagaagaggcaaatccagcgggacgggaaggagattcttggttgccaggggctgggggagggaggaatagggggcagctgtctgatgagaacagaggttctgcctggggtgatggaaaagccgcagaaatagatcatggaggtggttgcacacatcgtaagtctaattaatgccgccaactcgcacacttaagatggctgaaatggaaaattgcatgttatatatattttaccacaataatttttctaaaaagcagcgagaacctgaggcacctctcgggaattctgcgatggcacatagagtccttgtgagtcctctgtgtccccagcaccgagaggcagcctctcagcaagtgtccgctcacggtgcccactccggctcgtgggtcatcgtagcttcacgcccatctcctccgaggcctctccctgaatgccccattatgatttcccttaaatgtttacataagagcccagctcttccttcttagcatttagctctgttgttgttattggcatgatttgtttaggtttctctctaactgcttttgcagatgaccacaaaaagcaattcgttcgccttatctgtgtgctgttgtgtgtggtgtctctgacttgtcctgaaacagccacgtgaagtcagggccaacgtcttctggttcaactcggaactccccatttccagcccagcgcccgaaacccagtgggcctgggaattatgaatttactgttgaatgaatgaatcaattatgttaaaaccttccggaacagaatagaagggatggaaagttctagaggactctcgggtgcactgactgacaatgacattgttgggaagacttggtcgactttgccgtctcgtgaatttctttctttcttttttttttttttttggcctccctctgaggaagtcccattaaccttgtgccaaattctgtccccagagcccagtgttaagggccccgggcaccaggaaatggcattcatctacgcacgctgaactctaagcccactgttccggggagcgacatatttttagatgtttgacgtccaaattccagaggaagagcaagtaatgcttagaggaaaactggctttcttcctccaccacgcaaaccagtgctggggtgcatttttattggtctggccgctaagctgctggaactttccaaagaagggtaaaagctcctgcatgtggaaggaagggggtggtgagcactgagggaggcatgtgggtagctttggtggcagctctggagattggattctttttccctaaatggaagtggtttataaattcttctactgattattaaaagaatgatgtttactgtaaaaaaaaaaaaaagtcaggcaacacagaaagttataaattagtagaaatgatctgaattcttcctccaagatgtaaactctggtgacattctggggtgtctgtctagattgtttcatgaagcagttacacacagcacacgtgttttctcttagtggtattttattcgtactgattcagatttcttttattgaaatgaaattcacatgacagacaattcaccctttcaaaggtacaattcagtggtgtttagtatactcagagtcatgcaaccgtcctaactgcctagttttggaacgttcccatcaaccctacaggaaaccctgcagccattagccgtcagtcctccttccctcttcccgcagcctctggcaactaccaatccactttctgtctttatggatctgcctgttgtagacgtttcatggaaatggaatcatccagtatgtgctatttggtgtctggcttattcacactgttttatatgttgcattttcacttaataatctgtgggaagtatgttaacatggtggatcgacatcttcctttctaaggcctgcctggtgttctctgtgccttcacttatgtatccagcctcttttggttgcacatccagcttgtttgctttaattgaatctggacttggacttgctgaattggggttcccactgctgcagcccaaaatgggcatttccccacctgcttcctagggatatcagtggcagaatggctttgcaaatctatttttgttcatctatatgaacaaaaggtcatatagtttcactcttgtcacccaggctggattgcagtggtgccgtctggctcactgcaacttctgcctgcgtggttcaaatgattctcctgcctcagcctcctgaatagctgggattataggcacccgccaccacgcctggctagtttttgtatttttagtagagacgggtttcaccatattggccaggctggtctcgaactcctgacctcaggtgatccacctgccttggcctcccaaagtgctgggattataggtgtgagccaccgcgcccggccaggaatcatttttatccaggtaaggcatacagaaccggagggttcttgtctaagttgtaccatgaatgtgtgctcagtggctactttgaaatagacttactgtacaatccctgagcaggaatgaaaataaaagctggaaatcacgggttgctctggggttttcaggaaggtgtcgtccgtctggggtgagtgtcctcctttctcagggatttcatgtggcattattttgttttcatctgagaggcaacataagctgggagggaagggctgcaaagagggggccaggacaaatgtgtacctgggggcccccattttgactccaccctgagctggggctgggccacaggagggcagagggaacactttgggagggggagagagcccctggactgaaagaatgggaagaaattgacaggcaccattgggaagcaactcccagttccaggctcctgggtcaggaacgcccatggagtaggacagacccaggttcgagtcctgcctctgactcttctcagctgcttgctcttgggcaaatgcttttagtttttttgtgcctcagtttcctcatcagtaaagtgggtttagaatagcagcagccccagagggtgatactgaagattcagtatgtgaggacccagcacagcattggcacacagtaagagcttactaaatgctgcctcccttgccataagcatgaatcacacagcccaggctctaagcctggtgtctgtgtatggtgactgtgtgcctccgtttcctcacctatgcaatggggacagcagtggtacctactggggagggctggaggcgacttcaggtggtcctccgagggcagtgctcttgcacatgctgggtggctgtttccgcatggccccttctcttaggaactctgcgagttgtttgccctggtcttatccagaaatgatgaggttatatccaatcccacttttcactgttgctggtgggtttctcgtacgtgtatctgcagcctcagctggactggagctccttaggtttcttctgcatctgctgagcatctaacctaacgctatggagatggtgggcgttcactaaatcatctgggagtgaattgagggaggatacagcggaaatgaagaaagactggaagatatgaagaatgaagttactatgggacgagaggcttctgagtccattgattaaaaataaaaggagccaggcgtggtggctgacgcttgtaatcccagcactttgggaggctgaagcaggcagatcacctgagctcaggagttcaagaccatcctgggcaacaaggcaaaaccccatctctactaaaaatacaaaatattagccaggcgtggtggcgggcacctgtagtcccagctacttgggaggctgaagcatgagaactggttgagtctgggaggcggaggttgcagtgagctgagatcgtgcccttgcactccagcctgggtgacagagtgagaccttttctcaaaataataataataataataataataataataataataataataaaaggaataaaaatcaggtgaactatggattagcattgcccgtgctgagccgagcacacgcaggtgtggtctcttttgatcttcaccacagacatcggcagcaggtattacttttgtgtccattttgcagatgacgctcagatacgttagtgattttcctgtatgatcgcacagccatggggttcaaacccagacgcgtcagactcctacacctgagcccttaatccctgtgcaaagcagcctttgatgtataagagatcatgagcttcggtcccttccatcttgggatatggctcctaagttcttgccccaaaggatgtggaggttcagctgtgaaaaagagttaggaagcgttccgagtagaaggaacagtgtgcggaagcctccaaggccaggaggagcagcgaatcctcagaaactgaggatggccgagtccagctttacattttgaaagcatccttcctcatctctggagtgtgggatatcaagacccactcccctaattcacatccgcattaagtgagcataggagtgtgatgatgcttgcccatagcacagccttacacaaacaaaagggctgcccccacacctgtgcaggacccctgctctgcagaacccactgcacagggcccatgtgcagatcagcgagttaatgcatgttaagcacttagaagggtgcccagcaaactgccagggtgtgttgaccaccatcatcctcatcttcatcatcatcatcatcatcacagcttttgttccacccgaagaatatttactgagtacttgctatgtgccaggcactgttctacgagccagggacacaggtaagaacaaaaccaagttcctgtccctaggagggagaaaaacagcaaacaaatgagttcataatacacagtccacccaagggtgatgaggtgtgtgaagctccacaaagcagggagagggggaagggaaggctgtatgagcagatcccaggtaggtgagagccgggcagatatggtgggtgggcggggaaagagccagtgcaaaggcccagaggtgggactgggtggctggagagaatgagtaaggaggggagtgctggaagagaggtcagagacgtggagggggtcaggggagtcaattccagtccgacctctaggccaagaaccttggctgttaactcctttaacccatggggccagggataaattggagggtaagctgttcatgtctctgagtaaaagctatttcccagaactccagaaaacgccctgtgtttagaaccctctttgagtgtcaccttgcgtgacatgaaatatttttcaaaacatgtaatcctttaatctgggcctctcagtgaaatcagtgctttatcactcacgaccatctgttgtttcagtcacgcagtaaataactcgggagatgtggcttctaaggcgcttatctctttgttctctccaaattctgagaaatgacatttgaattttcctctgagacggcggcacagctcaaattgatctctgcgtaccctcccatctgggactgccattaaggaagtcccaggactgggaggcatttgtggtgggtgaaaagtgttttgcttctgatcaccaggttccattaaatttcataaatgaggcttcatcgaaaaataagctgggcggaaaaataagccgccccctcccgacgacgtacggtgtattcttaaccaccctccgaaggaggctggggcgcctgtcatgttagattaggattaaaaattgcggaccccaacatgggtccaatgtagttaattctgcagcaagtgaactgagagctaatggcgtgggattatgcacctgctgcggctggaaagttattggtggtggttacaggggtgagggagattgggcggagaaaggggtgataaaaggtgataaaaggtccacgctctggtctcccctctgtctttggggaaaaccattcacctccttaaggcctcgtctccatatccaccaaatgccagcttagtggtcattttcacttttcgtgaatttaacagccaatgtttacaagagtaaaaagaagggttctctgggtgaagcagggatgggggccaggggcccccctcccaggctttcctgccgcaccaccccccgctcctgcttggccattcctgctctctgcccctcatgccctcagtctcaggccctgaggctccctgggggcagctgaaaacctctggccttggtgattccaccaattcccaggggcacccggcccggacctgttcccagggacctggtgccccctgcagggcactggtgacaccgtgtgcaatttgcagctacccagataggcacgcaggaaggactgcgctcggtcccagccaggcagggacagacacagcctctgctctcagtgtggggtggcgagggcctaaaaatgaagaatcatactagaaacatcccgacgagtctggggaaagctgccctcagaaggctgtttaagctgaggactaaagggtgatttggccaattgaagctgatgggaggccttccaggcagaggaccagcacgtgccaatgatgatcggtggcactgtgctagatgccagcctgagtgtagatgcccgcctgggtgtacactccatcctgagtgtagacaccagcctgggtgtagacgccatccttggtgtagatgccatcctgagtgtagatgccagcctgggtgtagacgccatcctgagtgtagatgccagcctgggtgtagacgccatgctgagtgtagacgccagcctgggtgtagatgccatcctcagtgtagatgccagcctgggtgtagatgccagcctgggtgtagacgccagcctgggcatagatgccatcctgggtgtagacaccagcctgggcatagatgccatcctgggtgtagacaccatcctgggtgcagactcaggataccccaggagggaagttctgtagggagaaactgatgcttgcccaaggtcacacagcaagtgagtggcagagaggatttaagccctagagccgggatttgaaccaaggccgttagctgtggagcccgctctggttgcccgtctgctctgccggatgagacaagctcagctggaggaaacggtttgaagagatgaatgtgcttggagggcgaggggaggagggagggcagtttgctggcatgtaaggacaaggagggtcggggcgatgagatgaggccaatgtatcctatatctaagttattaaatcgaaaaagtaacatgtacctggttggcgcagggctcggaggtcgagtggggagctgggactttgtcccgagggtgctgggaagcctctggggccttggagcacagaggtgaccaaatccacaggtgcctttcataaagcctctttgggctgcagtttggagaatggatggatttggaggcatcgaggccagggacgaggccactgtggaggcactgatggggacttgggcctggggtggggttcatttatagaatgtgcctggcagagggacagatatcaagtttccaggggccgccgtaacaaatgaccacaaactggggtgggaggggtggttaagccaacagaaatgaattgtctcatggttctggggccagaagttcagcatcagcttcactggactgagatcaaggggtcagcagagccgcgcccccccaactccagaggttccttccttgccaatccctgttccggtggctgctggcaatcatggtcactccttggtctgtagacgccatctctgcctccctcttcacatgactttcttgtgtgcatgtgtgtgtgcgtgcgtgtgtacatgtgtgtgtggggggggcgtgcttgtgtgtgtgtgtgtgtgtgatctccctctgctcccctcttctcagacacttgtgactggatttagggcccactggaaaatgcagaatcatctccccatgtcaagatccttaacctaattgcgtctgcaaagaccctttttcctttgcatttaggattccagggagtagggcctggtgtctttggggacctttattcagccaactgtatgtgcaggaggagacacaggaggctcgaggccctcccttgaaggggtcgctcactggttaaatgcgatggcggatttctattaagacaccgagaaagagtgacaagggagggtgggtgtgggacatagaagcgggggtggtgtggccctaaccctggcctgggagggctggtgtcaccgaagcacatcccagccttgagcgctgatttgagtctcggggaatggtccctctggaagacctgaaggaacgggcattcggcagaggatcagcacgggcaaaggcctggaggtgacggcgcccacactgtcatcaaagcagcttcagtagctttgtgaggttctgtgagtcaagtctagattaagccaggacttggatgatgtgccctcgctctgcatggagactgcctttaaattgaagaagaatgtgtacatggtaaaaagacattgaaccactgcagaagggtgtacaatagaaagaaatctctctcagctttacaccctattcttctctccaaaggcacctttcctaatggtttcttgtgtgatcttgtgtatccttccaaaaacgttctcagcctatgcaaatagatatatatatgttacatctgtgtgcatttttttaaaaacacagatggggcagagcctacacgctgttccgaaccgtggttttcttcatgagccgccatatcctggcgatctttcatatgtggcacattgagtcttatttcattttttgccaacaccttaaaggcaggttttcatggctgtctactattccaatttgcagatatgccctatgtactgggccagcacaagggggccagattttgaatatgttgggggaggacttgtggggaggtaagtaggtgaagcattttagattaaaggaacagtttaggcagaggccaggaggcagcgcaagccagggtggtttttttccaattaatctatcctgtatctaactctgtgtgtgtgtgcaaatgagcacaaactgctcaccacgcaccccattttcatagaagcagaagagtgttactgggcctggatggagtctggtgtcaggggacccagggcagtttgcctggtggcttaaactttctcggtcttacctttaaaatattgatcttattggtcactcacccatattcctatatgttaagtacagtactatatcttttttttttttggagatggagtctcactctgtcacccagcctggagtgcaatggctcgatcttggctcactgcaagctccgactcccaggtccacaccattctcctacaggtgctcgccaccacgcccggctaattttttttcttttttttgtatttttagtagagacggggtttcaccgtgttagccaggatggtctcgatctcctgacctcatgatccacctaccttggcctcccaaagtgctgggattacaggtgtgagccactgcgcctggactttttttttttttttttttttaacagggtctcactctattgcccaggctggaggggagtagtgcgatcacagctcactgcagccttgacctcctgggatcaaaccatcctcccgcctcagcctcccaagtacctgggactacaggagagaatgagcatgcctgactgctttttttttttttttttttttagtggagaaggggtttcgctatgttggccagcctggtctcaaaacttctgagctcaagtgattcacccaccttgacttctggaaatgctgggattatacgcttgtgtgccacagcacctggcccctatatcttatttttgaactttttattaaaacataatacttcgggccaggcgcggtggctcacacctgtaatcccagcactttgggaggctgaggcaggcggatcacctgaggtagggaggtccagaccagcctggccaacatgtagaaaccctgtctctactaaaaatacaaaattagccgggtgtggtggcacatgcctctaatcccagctactcgggaggctgaggcaggagaatcgcttgaacccaggaggtggaggttgtggtgagctgagatcgcgccactgcattccagcctgggcaacaagagcgaaactccgtctcaaaaacaaaacaaaacaaacaaacaaaaaatacttcaaagcgtataaatcctacgtgttcagctccatgaattcccacaaaataaacacaccatgtaaccagcccccagaccaagaaacagaacagagccagtcccaagaccacgtgttcccagccagtcactgcccaccagattcctgacttctcatgccagacatcagcttggcctgtttttgagctgcaaatataagtggaatcccactgtggtgttctcttttgatctggcttttttcctttctttattttctgagatgtagcgatgttgttgcatggatttaatgattctgtgtataatttgtaaattctcaaagctctatataaacatggattctaagaaatccacacatatgtacatatacatatgtacatatagacatatgtgtgtacgtatatgtatacatgcagacatatatgtatatacacatatataccacatatattatgtattatgtatcatctctctctcacaccgggtagatacttaagtaattgtccttcagcaaacacaccaagatttgcttatccttttgctctgggctttcagttatttcgtgccgactgttataaaaagatacatggtatcttctgaccttctgagccgccctccgaggctggctctgcctgcttgctgtttctcacaagaggaaacgcaggctcagagaggcccggcgcactgcccacccccttgcaagctccgggtggcgccgggactcgaacgcgcgccccagagctgctgacaccgccctctccccgcaggccgaggaggcgggcgcgcccggcggcccccggcagccccgagcagaccgctgcccgccgcctccgcggacgctgccccccggcgcctgccaggccgcgcgctgtcaggcggactccgagtgcccgcggcaccggcgctgctgctacaacggatgcgcctacgcctgcctagaagctgtgccgcccccgccaggtaggtcctgggcccgagggagggggctgagggaggaggacaggtgaacagagctgtcccgggggaggggaagaaaggagctgggcttaaagctgggccacctgggcgggtctcgggcgcctccactgcgcacctgtgaactgggacgggcgctccttgagcaggcgtggcgctgctgtgcagctgctgtgtgtcccactgcccctggggacttgcgttgtaggagatgcccttccagagaaaatgccacttcctatgaaaatgggatgggggcagggaccctagatgcctccagggagccacagtccagcagacacccattcccgggaaaatgcccgctgataggatgcgggtgcagtgggatttctcatttaaaagatcaagattcgaggcttttctttaaaataccggaccatgttccctgggctgccaccagctggaacctcaggtgcccctggatgaggaggtgtcctctagcttcccactcaccccatcaacccaccaggcccgccacacttctcatgcctggccctggggtatttgaggtggagaccaggagcttagcaatccagatggggcgtgccccagagaggagcgggtgcgtggcttcagatccaccggccagctgtcactttcttgagtctcctctcctgtgaaatgggtggatcacctgaggtcaggagttcaagaccagtctgggcaacatgctgaaaccccgtctctactaaaaatacaaaaattagccaggcgtggtggcaggagcctcaaatcccagctacttgggagactgaggcaggagaatcacttgaacccaggaggtggagcttgcagtgagccaaggttgtgccattgcactccagcgtgggtgacaaagtgagactctgtctcaaaaaaaaaaagaaagaaaaagaaaagaaaagacaacgtgcagctcacggtggacctgccactccaaagtgctcagcactgcgcggggctgggagcagataatgagatgtgtgttgaatcacgatgccaacctctcggggagaaacaatgttcagggattcatcattggcaggacggagtttcagatcccttttgaagagaaggtttgggaagggaaggaggtgaccccgtcggggacagtaagtggggagtagggtagacaagtagctatttcctggggaaaatgtgcccttgggtggggaaaatgtgcccctaagcgggtaggatttgcggcaaggaagtcttctccaccctcggctctgctcagggtgataacaacagctgtttggactgtaccttccacgagaggctgtgggttcccatgggccttaattagggaaggcggctcgagaaggtggcccagcccctcctcccaaggctgagaggagagtcagagatggcaaggatgacctcactttgttttctttggggtgaggtcacagcgatgacaggggactcagcacacttaatcatgctcataattacagtcttataatgctcatcaagacagacagggactatttcagtactgcctctgggcaggaactggccgctgctccaggccaggcagcctcctactcagccttcataagaaaacctaaatgttgcccctcatggtggacaagcacataaaggcactcccctctgggtggacttatcaaaaatggtgccccttcctctggaatgtgacctgacatagggattctagccttgcctcctgcctatagcaggtgcttttgagcagtgcacagatgatacaactgtacatggcattcccaatagccttttcatacatcatctcgtttcacgctcacacagcttgatgagatgactgttatcagccctgtgtcacaactgaagctcagagaagctgaatcatttgcccaaggtcacacagcaggcagacctgcagtttccatccagttgtctgactgtagagaagtgttcattgccttaggccgtgagtgtgggaatgtggagcccctgccctggcacctgtacccacgtgtggggtccttcattgccaggaatatcctcccccagacatcccatggctcacttccttgcctcctttagacctatttccaaaggccacttttcaggaaagatttccctctctcaatgacagcccctccttggccatttttaaaccctccatccctgtttaatttttctctgtagcgtaatctggaagactgtgttttacttgtttgttcattgactgttctctccccacttgaaggtcagccccacagggcagggagtttgtctttcattcactgctgtaaccccagcatctaaaacggtctctgggcatataatactcaataaatattcactcattcattcattcactagccagcaggaagagcaatcatactactagtgagtaataacaacaatgctgtctaacaccagatttcacaatcttggcatattgacatttgggattggttgattctacttgctgggcaggggggcgctctcccgtgcactgtaggatggtcagcggcttccttggcccttccccaccagatgccagtagcaacctctaccccaagttgtgacaaccaaaaatgtctctaatctttcctaaatgctctctggggaacaaaatcgctctgcattgagaaacactggtctaactcaggccctgttccaggcaccttacttcttcattgccatctggatttgggtctgtccaaagcagacccagagacaaggacttgggcccaggttgtttatttgggaggtgatcccaggtagttccagtgaggtcatgaagagctgagaccccagggccaccaggcctttaagggtcttcaactagagtaatggggagcccggaccaagtttcactactccaaacatttgcttatttccctgctgctcagaagcctttgatcaaggcaaaagagaatacaaacagcacatattactacgtttcccacctgaaaatgtttcctaacacgtggtctgatgtggtggtggaaaggagggaagaaccgaaaggttgcgtatagaggctgaagaaccatcgcgtcattcctgttttggaggtcacagactgctggctcctttctctgctgttccaacttccatgtcattataatcagtataatcagcgagtgctcctttacagaaaaagctaaccagcatttttaccagtacccatcaatatactttaaaagatgctaattatttttctattctctttataaagataaatattagtaatttttatttttgtcttactttggagtcaaacgaatgcagaggtcacaagcaaatgtgatcccagaacagttttgatctccaacatgcttaaagttttctgcccaggcacggtggctcacacctgtaatcccagcactttgggaggccaaagcaggaggatcacgcgaggccaggagtttgggaccagcctgggcaacatagggagaccgcctatctctgtagaataatcatcatcatcatcattagtaaaaaaagttttaaaattacttgtcaacacttaaaaaccagaagatttctatttttaaaaatacagacttggccgggtgtggtggctcatgcctgtgataccagcactttgggagggcaaggcgggtagatcacctgaggtcaggagttctagaccaccctggccaacatggcaaaaacccgtctctactaaaaatacaaaaattagccaggcatggtgatgcgtgcctgtaatcccagctacttgggagactgaggcaggagactcgcttgaacccggaaggcagaggttgcaatgagccaagattgcgccattgcactccagcctgggcgacaagagtgaaactttgtctcaaaaaaaaaaaagaaaaaaatacagacttacagtccgggtgcagtggctcactcctgtaatcccagcactttgggaggccgaagggggtggatcacttgaggccaggagttcaagaccagcctgggcaacatggcaaaaccccatctctactaaaaatacaaaaattagccaggcgtggtggcacatgcctgtaatcccagctactcgggagactgagagaggagaactgcctgaacctgggaggcagaggttgcaatgagctgagatcgtgccactacccttcagcctgggtgacagaacaagactctgtctcaaaataaataaataaataaataaataaataaataaataaataaataagaagtaaataaataaatagaataagaacttacagtaagaaaaaaaataaaacagtctgggagcattggaaatgactggtcagggctaaccagcagctgattcatccaggcaggaggcactctctgctttgctgtggccctgcctggtctgttttcctgtcccctagaggcatttgagttttcgacccctgccttttgaaggccttcccataaactgtgtgggtgactctttctgttaaaaccaggtatattggttatacctgggtgatgggatcacctgtacaccaaacttcacccatacaccaaacttcagtgacatacaatttacctgtgcaacaaacctgcatgtgtacccccgaacctaaaaattaaaaaaataaagtattagttagagaacaggctatgctgctgcaacaaaaagacccataaatacagggacccaacctgtgaggcattttcttctctctcagctattagtgcagagacagacatttgtggtaggcaggtagctctgctcgcaaagccatctagggacccagcttccttccttcttgccactctgcagtctgactgatgtccttgtccacatggtcagaatggcccccagcctgcaggaaggaaaagagggagggagaggagcagagagccccgattggagggtgagacaggaagttgcatggtcactgctgctcacatctttgtagctgcaagggaggcagggaaggctagtccccagctttgtggcccagtgcccagcccacagtgaaaggttctatcactaaaagcaaagggtgaaggtgtgccaggaaccatagttatttctcccatggggagcctctgtgctgtcatgaagttggggtgcccccagcccccaagcctgggcgtttctcagctgcttgaggagggccctgatctgaccccgtattgtgttagtcttagactggctggtgcagccgaaacctcgatggcttggtggcaatggctggctcctggatggccctgaggaggtgttacaaggtacctgccgggtaaagcccagaccctacatccaagcctcgatccctccttctcagctgcttccagaaagctggcagcaccaggccggctgtcccccatgcacgggcccttcagccaaacactcagccctctttgatcctccccaccccagcgaagaagggctgatggctgggggcttggccagaatcaaagcccagtacagaataagggcttcgactctccccaagaatggagcctcctcctggatggagaattgaaggggagggggcttagggttggttttcaaattcctagaattctagggggttcaccgctctctaatgatgaagcctccctgggggtgggggaggtaccaggaggcagagggcaatttctggaaggaacagcatgcaggtcgggggcctggaggcctaggaggtgcgagcgggcacccttgcacacctgcggctgtgcttctgactccacgtccatctgtgtgttgtgtgactgtgtccgctagagtgtgcggccgtatatgcaactgtgtggctgtccttgtgcctgtggctgaatatttgtgtgtgtgtgtgtgtgtgtgtgtgtgtgtgcatgcaaaagtgtgtgactgtattgtgagtgtacatgtgtgggtaagcgtgtgtgtatgtgggtgtggatatgtgtgtgcaggatttgtgtgtggggatgcgtgcgtatatgtctgtgtgtatttgtgcgtctgacttgcttgtgtaaatgtctgtgtccccatgcgactgtagggctgagtgtgtgtttcagggtgtatccgtgaacatgtctatatggatgttgctgagcctgtgagagtatgtttgggatcaggtgagcttggactgcctgtgtttgtgtgcgtgtttgtgggtgtgcacgtgtgccacatgccgctgagtgagacccagggcctagcctggaacctggggtacagaggcgaggccgcctctctgggtgaggtgcgttccctgcacccgtcccgggagtctgccttctagaccctagcatgtgcacctgtcctgggagtcggccttctagaccccagcgtgtgtccctcctgcagcagaggcgtgcagcaccacggaggatggggccgaacccctgctctgtccctcgggctatgagtgccacatcctgagcccaggtgacgtggccgaaggtatccccaaccgtgggcagtgcgtcaagcagcgccggcaagcaggtgagtgtggcaccccagccctgatcctggctcctgccccagtccccttctccctgtaagcgcctctcacccgcatggacgacctgccccaggaagcagccccagcacctgggcctgactgagagctcctcacatcttccccctgcccggctccttctttcatggcccctaccctttccctgtcacactagcatgtgaccgaagctcttgagccagcagactggctgcaaaccccagctctgcacctcccagctgggcgacactggggttaatttcttcctatctctgagcctcagtttcctcatctgtaaaatggggctactacatgctgttgtggggcgtgactgaaatcataagtgcagagcagtcggagcagccctaaggaatagtaggtggtcagtaagcactggatgttttatatccacgtatgtgtagatggaccccgacttacgatggtcaacttaagattgttagactttacgctggtgcagaagcaacatgcattctgtagaaactgtacttcaagttcccatccaaccattctgtttttcactttcagtatggtaatcaaattacacgacacattcaatattttattataaaataggctttgtgttagatgactttgcccaactctaggctaatgtaagtgttctgagcacagttaaggtaggctcggctaaggtatggtgttcagtaggttaactgtgttcagtgcattttgacttaagatattctcagcttgtagggggtatatcagtacataactccattgtaagtcaagaagcatctgtatctgttttcaaactgcattgaattagaattgtctgagaatccttaacttccagaacttctgccaggactgttcagtttgacttaatttgtgttcgtctttggacacaaaggcaataaatagatgagtgaattgtgttgctctcattggcataattttcccaagaaaagaaagaacaatggcacagcgattcctggtggtatctaaaaccatctcgaaccccactcaaggcaatcaagttgaaagacttcaatgtgctttttggcatggagtttggatgaactgtgtggtgagccaggaatctgggacttcagggtggccaggttcaccttgtcaaagtcagtgtcagtcagactgagaccacacccaggggcccctgtccccgcttcggcatctcatagccctaatagctaaggacaggaccctcagacaagattggtgataattacagtgaccctatttgccgaaagtatactggggagtgcatgatctgccaaaacctctttttttttctgatttgagaatgtttttctctgaagtgtttcaagaaaggcatagacgtaaaatcagtcatgcatttaatgtcattatcattgcagataaagtgatgcaaatcccggaatcctgaactttgaagaaattatctacaaaaggctttgaaacaaagagatgcctttttggtttcctctacattccacttgctatttgcagggctttgtttggggttatagggtggcttctccagccagatagcctgggctgccacagctactcagccccttactgctgtgggcagcaaataacataaccttttcaggcctcatttgccttttctgtaaaatgggttcataatacttgaggtacttcacagggctctttgaggagtgagttaatctgtgtagagtgtccatcaattcacaagcacagtaaacaaccttcactgttttatcactgcttgtctctagacactcaatcctgccgtgggtgggtggggtgtatggtcctttggaggtaaaaccgcaagggcctgccagccactgtgaggctgctggagtgtggaagggatagccttttccaaaagagagctgtggggcgagttgtgagttcgttgggctatgccaccatttataataatgacggcataataggaatgccttgggcacttgtctttttcatcccctgatcttttcattcagccctatgatgtctaagaccaaggtcaaaccaagtcaaactagttcttaagggttcaaaccagttaaaaaaattcccatttcaagacagagctaagcaaagagggtcagtcattcagtggtgaccacaccagtgatgcctactgttaacatgcacctttggagtgctctctttaaattaagctttgctgcaagcctgcaaaaggagaagtagaaccaggaggcagtgctgcataggtttcagagtgcaggctcagaaccacagaaagaagtccaaagcctgtaactttcttcctccgtggccttgagcaggtcacccaacctctcttagcctcagttccttgatctgtaaaatagagatggcgatggtaaccatagtgactacttcatggggtagttatggggcttgagtgagagaaacacgtatgaagtgcttagaatagcacctggcccactgtaggtcctcagtgaatgtgtgccaccatcatccctgtcttcgtaaagggaggatatgagttcaggaatttacccaaaagatgcagagctggaagagctggaattccaagactgtccaccagcctcagagcctgtgtgtgtgtgtgcgtgtgtgtgtgtgtgtgtgtgtgtgtgtgtgagcttcccctcccaaatgaacgatttgaggcttccaaatggaactgtaagtggaattccccctagccttgttctcagggggctgacacttagcaataattactggtaatttactggtaattatatataggtttgaaaacattttgaattccagcaacttcccttggagcaaaaatctcaggggaagggtggcccccttgtcccagccttaccaaggaagaagctttttatttaagtttttaaaaactgcatatttgaaataatttcagacttataaaaatgttgcaaaagtagtaccttgaatcccccacccagattcaccagttgttaaaaaactaccgttacattttcctttatgctctctccccacttataaatctacgtgtgtatttttctggaccatttgagagtaagcgacaggccctgtgccgacacctaagatgccatcctcccgtaagagaggcttctagcgggtaccaatagtccttcaagtttgaccatccagcacctggaaccaggcatttgaggggttcacattttatgcaagaggaaaatgaacactgacatgtatagtaaatctggtttttcagagagtgggttcagggaaaatcggtgcatttttctgagtaggtttgaggtcacacagaagctgagctgcgggggctggcccctccttgtcctgcccaagacactgcttgagaagaatgaagtggggcttgtctagccttgagtgggaggcaatttgagaaaagtgacgagtaatcatttttggtaataaattataagtgattatatttggcctgaggagggggtccggggtccacatttacctctgtctccttgtggtgttatgggccagaattcacccccaggtaaagggggagcaggaaagttttggggagctcccccagcctacaaaaaccttagccatttgctttggaaaatagttattgctgcagttgctgatcagcaggcgctgacccaccggagggcctggagcggttccatggagcgttagcaccttgaccgataaatgtccgtgctggtcccaaacagcctgatgatttttagtatggccacaaaacaaaagaaaaagaaaatgtctggctaccgcgcatatgtgcttgattaaccttatagcagaaaaggcagcgctgatcaccaggatggagaagtgagctaaatttgagagagattgccacattcaagcatccacatgtcctggtcacattcctgtcagcaaatgctttcctgctaccatggggtgggtagcacggctagtcatgggacatgcatgaaattgccagcagttgaccactttttacacacaaagatagaattttcatacggctcatcctaatactgcatagatatgttttaaatgaaattgtttcttttaatcctcacaataactttaagaggtactaattttatgcctatttttaggagaggaaactgaggctcaaagaggacgagtgaggattcatactcaagttactttgtcatttgcagtaatgacatcagagtgtctcttgggcagactcaaaagagtgtcatctcttccccctgtgaacatattttgtaatgacatttactcaacagtgtgttgaaatttggcttccagttcatctgttaagacaatggttttggccgggcatggcggctcacgcctgtaatcccagcactttggcaggctgaggtgggtgaatcacctgaggtcaggagttcgaggccagcctgaccaacatggcgataccccatctctactcaaaatacaaaattgactgggtgtggtggcgcatgcctgtaatcccagctactcgggaggctgaggcaggagaatcacttgaacccaggaggcagaggttacagtgagctgagatcatgccactgcactccagcctgggcaacagagtgagacttcgtctaaaagaaaaaaaaaaaagacagtggttctgaaactttttgctctcaagaccgctgtaccctgaaagatgttaaggagatctcacagggctttcctttatgggttgatggctctggatattatcatattagaaactagagctgagacattacaaatgctcatgtagcctctgaacaattccattgtacactagtgagatggggagactgaaaaacacaagtaattcctcagtgttattatgacaacagttttggccttctaaactcctaaaagaagttttttcctctcacttgttttccagatgggcgaatcctacgacacaaactttacaaagaatatccaggtaaaagaagaaactgttctttctttccagagggcacaaaaaaaaggcagtgaaagtttcttatgtgaagaaaaaaataaaagcccagggctgagatatagggaacaaaatgggacctgggattaagaaacaaaatagaagacctgtggtctgatggtgggcagggagttgtgagtcacagaggagctcatggcaaacatgacctcatgctgaagagcagagcctggaactgctcatatttaagcctctgctactttcattcagagaattggaaaacacgcctgataccactcttccattcatccatctaatcatccattgatccatccatctctccatctattatttcatccatccattcatccctccatccatctacccacccatccatctacccaccatccatccatccatccaccgattcatccatccatcctctcattcatccattcatatatccatctattctttcattcatcttcctgttttttcatccattcattcctctatcaatctattcatccatctattcattcttccatccatccacccattcatccatccatccacatattcatctatcttttcacccacccatctatccttttatccacccctttattccttcatccctccatccatccatcctttcatttacttacctattcaccaatcatccattcatctatccatccatccattcatacatacatcctttcacttatccatctatccacccatctaccttttttttttttttgagatggagtctcactctgttgcctaggctggggtgcactggagtaatcttggctcactgcaaactctgcctcctgggttcaagcagttctcctgcgtcagcctcccaaatagctgggattacaggtgtccgccaccatacctggataatttttgtatttttagtagagacgaggtttcaccttgttggccaggctggtcttaaactcctgacctcaggtgatctgcccgcctcggcctcccaaagtgctagatttacaggcatgagccactgtgcctggccccatccacccatctgtctatccatttatccatccatccactcatccatccacccacccatctatgcatccacccaccatccatccacccacccattcatctatccattcactcattcatccattcatatattcatctaatctttcatccatccattttttcaagcatgcatccatccatccattcctccatcgatctattcatccatctgttcattcttccatctatccatctatatattcatctatcttttcatctacccatctattattttatccacccttctattcctttatccctccatccaaccatccttatatccactcatctatttgcccgtacatccattcacccaaccatccatccatctgcccattcatccattcatgcacatatccttgcattcattcatctatctcttctttcatccattcatacatccatccatccacccatccacccatctacccatccatccattcacctatgtatccattcatccatccacccatatatccatctatctattcagccatccagccagccactatccatccatctatccatccatccatatatccatccgtccatccacccacccatctatccatccatccatccatccatccattcatctacccatctatccatctatccacccacccatatatccatgcatccatccatccatcatttatccattcacccattcacccatccatccatccatcatttatccattcacccatccatccatccattctcccatccatctgatatgtctttatcaataatttacagcacatattttctaagtattactcatcagtctgtgctgggggttggagctacatttgtgaacatgacagacccagtcgctgctgtcatgcagctaatatcaagcagaaaattcagacatgaatatagcccaagtggttattttatgagaatagtgacaagccttcctgacatcacatgctggatactatgaggacaccttagtccaggttgtgagaaaaggcttcctaaggaggagacatgaaagctcagcctaaagaataagaaatagtgggcagcagaatggcatgtgtgaagctcttgaggtcggaagcaatttggccatccccaaagctggagtgtgtggtgagctgtggaggtggtgggaggtaagaccagaaacatagacagagctggtgacaccagctggggggcctggggagggagaggaggcactgcaggtggggactgagtgacctcagctgggggagggaggagagggccaggtcaccaggcttcatttggcagttcctggtgagccacggggggcattagagcaggaatagatacatctaccccaacagagctgtgttcttttcacagaaggtgactcaaagaatgtggcagaacctggaaggggacaacagaagcactttcagtaaagcaacggcaagcaggtgagtgggcagagagcaagagtcatggccagggtaaatgtgggcagccagtgtcctggcagctttcaccaccaggttgaggagcaggagggtgagagtagcgctttccctactggtagaatttgaaattcccttctgcagtaagtcctcacctaacgtcatcaataggttcttggaaactgactttaaatgcaacgacatactatatgcactgtatgccatagaagcttaactcatttgtttgtttttttaagagatggggtctcactctgtcacccaggctggagtgcactggcacaatcattgttcactgcagcctcagactcctaggctcaagccatcctcctgcctcagctttagtctcagtagctgggactacagacatacaccacctcacctggctaattttttttttgtattttttgtagagatgagttctcactatgttactcaggctggtcttgaactcctggcctcaagcagtcctcccactttggcctcccaaagtgctgggattgcaggcatgagtcactgtgcctggccttaactcttgtttatatccattagcctatggtaaaattgtttttgttatatagtaggtcattttgcttaaagttgcagtttccaataagctatccatgatgttaaatgaggacctactgcaatttcaaggcaggaacgtaggagaactttgtgtgtgatcagaagcagaagcaattctgtatccctctgaatcaaaaatccaagaccagactaggtcgcaactttccttttcattcctttgccttgatgtctccaggaagtcttgtctatctcttctcatttctgtcaaacaattctgttgggtgccaactatctgatagtcatggttccagcctcttggttgctcagcggtagttcatgccagggtggtatagtgaacaaatcccacagagccgctgccctcagggaggccacatcctggtaggggacggctacacaagccaacagatcaatcaatacaaagacaggtgtggtgaagaagtgaacaggcaatgtggggcagagtccctgggcaggagcagagcctggggcaggggctgcttcgtttggggtcagggaaggccctgtgggggttgaagtctgagccaagatccaaggtgagaaggtgctgcttggggagggtctggaggataggcgcccaggtggagggagttggaagagtgaaagtactgaggcaggagggacgctggctttggggagccaaagaaggcccctggggtagacgcaggaaggtggcagggaggctgactccagaggaggccgcaggtgaggcacaggcttgccctcacgtgccctcaaaggtgaggcgtaggtgcatgcaaagggctgtggagttgcagccctaaacctgaaaatctacccagcccctgtgaatgctggatagccacagagggcaaaaaggagcccctaaaagcaggtgacagcctcccaggacgtcgctgaaacgcaaatgtcagattgcaggttccagaatcctcccggaaaatctggagcccgtagggactgatgccagcacgtctgttacctgctgatgacaggagccgtccctggagtaggtcagatgcagctgaggactgagcttctaacagggaagaaggaggccagtggatgaggacgagaccttgggaggcagttgaggatggcagtttggaagttgaggcttttgggtgggcgcagcagctcccgcctgtaatctcaacattttgggagaccgaagcaggcatatggtataatcccaggagttcaagcccagcctggcctggccaacatggtgaaaccctatctctacaaaaaaaaatacaaaactacccaggcatggtggtgtgcacctgtggtcccagctacttgggaggctgtggtgggaggatcacctgagcctagggaggttaaggctgcagtgagccatgtttgcaccattgcactccagcctgggtgacagagtgagaccctgtttcaagaaaaaaaaaaagtacagcctttggagcaagctaggtctgggtttaaattcttgttccagcactgtggatttagtaaataatttcggctctccaagcctcagcctcctcatctataaaatggaactgatggtaggggaggagttaggaactaaataagatgatgccgtgaagacgtcacagtgagttcagaattgggtcttctcagaaaggggcatcttcctggtgtttctgatggtggcggtggcggcggggagacgaaagatttgtgactctgtggtctgccctgcagtggttcaccctgacccttctttgtctctggtctgccctgcagcggttcaccctgatccttctttgcttgctttccagctaggttgcaagaacattcctctactttctgctaagccttggaaacagttgggaaaagtagtttgaccctcacagttcacattcagctcagcagagcaagaccccagagatgcttagagacaggacacctggccatcaaacccagtttggcccagcctggttgggtgactttgtgggagccacttaacagctctgggtccctgttttaccatcctgggagcaaggccctgcagctccacgagacctttaccccgggaagaagccgccacccatgaaagcatttctgaagcccctttctaagacaaggctcagcatcttgatatttttgacagattcctcccaagtctggctctgggaggtatgtacccatctcaaatgttcccaagataaattcatccttcaggaaatggaaatgaacttgcttactaatgtgtgattcctagttgtagccaccggatgtgctgaggcctaaatgttagcaggtgggaggaggccacagaacaataaaaacaaccaaataagatgccgagtctctggtgttttgtgatactttgtcactgtttaattcaggggtgggaagcagcgtgggtattgctgggatgaggtgtcagctaggctctgctcctggaaccctgtgttagcatagagcccctgaagcagaccttgggagggggatttgttgaaagtgattcattagggcggttcctgggaaaaactggcatgagagtggggaagcggaacaggaggagacagtcagacgagggagaggtgacgagggcccatggagggcacctttgctgcaatccctctgggggtcttggaggaagcctgagtcccaccagggctggctccagggctgtgcatccagaaggaccctatgcttggtttaatgatctgctgtcaccatttaaaaactcttagtcattgttgaacaaggggcctgcttgttcattttgcaaatgatgtcggtagccctgagccacactgtggagtcggtcccactggggctggacagcggaacccgagtatgcgtaacgcttccagcacccatcagtgggtggcgaggctgcccctccccctaagagaggaggcagcccacctgctgccagggagggagaggcacaaaggcacccaaggggacatcggcagagcccctggggcaccccggggctctcccattaaatcatgggtgccccacctgtgctagacggcttgctcgcactgtcctggggttggctgaagtccccagggctcatcagagctgaggacagaggccctaagggactgtgcacccccagctagccacatacagtggaagcaaataattacaagcagcagagactccagggggcctggcaacgtctgtgcatctctcagatgaggaaactgtggatcttggagatctgaaaggacccacccaaagctgtgaagtcagtaagagccaaaaccaggattccgagcaggcagtcccaccccacactcaggctccagacagcctgctcttctgctagcctggcctgtcggagctgactccctcccgccactgaggtgtagaagggacgcctgacagtgtgccatcctgcggaggactctggagtggaagggactgggctgagctcatccctactccctggagggctgctcactagatggggtggagacactagagcctgttcagcctgagttccaatcctgggcaaggcacttgccctctcagagcctcagtctcctcttctctgaactgggtgtaataaaagtagctggctttcagagttcctgtaggtattgcgtgagatgctacatagtaagtgctgagcacacagggatggttataattattatcattagccgggcacaatgcacactaattctcttaatacaaaacctcgtgaaaagagtatgaacatccgcattttccagctgtagaaattcagcctcagagaagttaagcaagttgcctaggctcaaaaagaaagcaaatgacagagatgggctttgagcccagagcttctgatgcccaagactagacaggctggtcctaccttgtgttgagtcccaaccaccagctgggcggccctcacaggttactgaacatgccccagcctcagggtccacatttctaaagtgtcaacgagaactccaacctcattatgattattactgtgaactcagtcacgatcatatgaatgggactggactgtcaagatgcaaataccaaggcaggaaggtggtcgtatactgccaagtggtcaaaaataagacctgctttctgctttcaaggagcccaagtccttgagggagtgagagaaatgagagagttatgatccagggtggggaaggcacagatgggagcaggggccggaggtgccaagagagcccagtgagggatgctaagccaaggcagaaggcagggaaggcagtaatcagggaagacatcctggaggtggtgatgtgctagttggtcataatatctgaacacttctgggaacgtgtgcatttcaaggggaactgctgtccctgtttggcttaaggcagaggttctcaaccttggcactattggtgttttgcgcaggatcattctttgtggtgggggctgtcctgtgcagtgtaggatgttgagcagcaccccagcgtctacccactagatgccagaagcaccctcccccaagctgggaccaccaaaaatgtgactttgccaaagtcccgtggggtacagttacccggtgagaacttctggtttaagcccaaaataaggaagctcgactttgtatcatttcacccgtcagcaagttctcccggggcactttcccttaggctcacggtaattaacttttccactcactcatcacttgttcatgcactgactcatgcactcattctctcaagtaatattcccaggcactaaccaccttttctttaatcaaatctgaggcaccattttttttttcaccttttgacattcctgaagttagggcttgtcttatggccagtgtcctccaggcccagacacgagggaggcatcattgcctgtacatgtgaatatcaaaacatgtaggttgggtgtcagcagcttggtggaaacttccagaaacaacagaggaaccaaaaattctgcatcaccaatgctctcagaaagaagtcctatgaaataccttatctcatttattgcacttatatttttatgtgatacacacataagaatgacgcatcatgaggccgggcgcggtggcgcaaacctgtaatcccagcactgtgggaggccgagatgggcagatcatttgaggccaagagttcgagaccagcttggccaacatggcgaaaccttatctctgttaaaaatacaacaattagccagctgtgctggcgcacgcctataatcccagctactggggaggctgaggcacaaccagggagacagaggttgcagtgagctgagattgtgccactgcactccagcctggaggacagagcaagactctgcctcaaaaaaaaaaaaaaaaaaaaaaaaaaaaaaaaacgcatgatgaaaacttatgtctatgtaagtctaagaaaggcctttaatgaccttgaaatcaaaagggaaagagcaagatggccaaataaaagcccactccattcatctcccctgcaggaacaccaaattttagcaactaactacacacagaaagcctcatgacaagaacaaaaaatcaggtaagcaatcacagttcctggttttcacttcgtgttgcagaaaggggcatggaagaggctaggaaagacagtcttgaatcgccggtgccacccctccttcatcccgcagcagcagccacgaggcatggggaaatctatgcacttgggagaggaagactgcagccactggggggcttcacattgaactcagtgttgccctgtcacagcagagagcaaagccgtggtggcttcagccagcgcccatgcacagagggagcatttggaccaaccctagccagaggggaattgcccatcccagtggtcggaacttgagtctcagcaagccctgccaccgtggactaaagtgctctgaggtactaggtaaacttgaaaagctgtctaggacacaaggactgtaattcctatgcaactcctggtactgggctgggcttagagccagaggacctgtggggcacatgacctagagggacaccaggcttcaaggctaaggaagtgcttgaaccacccctcctccaactccaggcagcacagttggcagcaatgaaagtgactccttccttctgctcagggagaggagagttaagaaaagaggcctttttacgttgcatcttggagtccagctcagccacagttggagagggcactgggcagagtcatgaggcccccatttcaggccctagctcgtgggtgacatttctaggtataccctgggctagaagggaacccactgccttgaagagaaggacctagtcctggcaggattcatcacctgctcactaaagagctctcagatcctgaataaccaacagtgatccccaggtaatatgctgtgggccttgggccctgagaggtgctggtgtcaggtgtgaccagtacattcccagctgtggtggctatagggagagaccccttctgtttgagaaaagtggaaggaaaagtaacggggactttgtcttgcacattaggtaccagtttggccacggtgggatagagcaccaagcaggcccttagggtctctgagtccaggcctaggctcttggacagcatttctggacctgccctgggccagaggggagcccagtgccctgaagggtgagtcccaggcctggcagcattcattacaagctgacggaagagcccttgggctttaagtgaacaccagcaatggcctggcagaacccccgaccatgggccagtggtgacagtggccacagggagaggctcctttgcctgtggaaaggggaggaaagagcaggaaggactttgtcctgtggtttgagtgccagcttagccagagcagaatagaacaccaggtaaacgtttaagactgtaattcctggctctgaggcagcatctctgggcctatccagggcctgagggaactcattgccctgaagggagagacacaaaccttgctggcttcaccacctgctgatcatagagccctagggccttgagtgaacataggtggtagccaggtagtggttacagtgggccttgggcaagacccagtgctgtactgccttcaggtctgaaccagtgcagtcccagtggtggtggctgcagggatgcttatgtcccccagtcccagttccaggtggctcagcacagatacagagactccatttgtttgggagaaagaaagataaaagaataagaattgctgctggtaatccagataattcttccagttcttatctaagaccaccaaggctgtacttctatgagtctgcaagaaccacagtgttactgagtttgtggccctaagtcccttcaaacacctggaaagtcttcccgagaaggacaggcagcccaggcccagtggctcacacttgtaatcctagcactttgggaggccaaggcaggcagattgcttgagcccaggagttcgagccttggcaacatggcaaaaccctgcctctacaaaacatacaaaaagtagtagggtgtggtggcatgcacctgtagtcccacctacttgggaggctgaggcaggaggatggcttgatccccgaggtcaagcctgcagtgagctgtgatcacaccgctgtactccagactgggcaacagagtgagaccctgtctggaaaaaaaaaaaaatatgaagaggaagaaggacaggtacaaacaagcccagactgtgaagactgtaataaatacctaattctccaatgcccagacaccaacaaacatctacaagaatcaacaccaacaaggaaaatatgacctcaccaaatgaaccataataaggcatgagggactaattctgacacctcaccataaataaggcacgagggatcaattctggataaacagaggtacgtgatctctttcagacggagaattcaagatagctgtgttgaggaagctcaaagaaattcaagataacgcagataaggaattcagaattctatcagataaatttaacaaagggattgaaattattaaaaagaatcaagcaaaaattctagagttgaaaaatgcaattgacatagtgaagaatgcatcagagtctcttaataacagaattgatcgagcagaagaaagaattagtgagcttaaagacagactatttgaaaatacacagtcagaggacagaagaagaaataataaaaaagaatgaagcatggcctacaggatctagataatagtcgcaaaagggcaaatctaagagttattggccttaaagaggaggtaagtgcctacatcaaaaaagaataaaaacttcaaataaataacataacaatgcatcttaaagaactagaaaagcaagagcaaaccaaacccaaagttaggagaagaaaagaaatcataaaagccagagcagaaataaatgaatttgaaatgaagaaaacaatacaaaagatcaacaaagcaaaaagttcattttttgaaaagacagataaaattgacaagcctttacccagactaagaaaaaaaaaaaatagaagaccaaaataaacaaaatgagagatttaaaaggaggcattcaactgatactgcagaaattcaaagaatcatcagtggctactatgagcaactgtatgccaaccaattggaaaatctagaggaaatggataaattcctacacatatagaacctagcaagattgaaccgtgagttgggtgcagtggctgatgcctgtaatcccagcactttgggaagccaagacaggtggataacctgaggtcaagagttcaagaccagcctgggcaacatcttgaaaccctagctctactaaaaataccaaaattagccaggcatggaagcatgtgactgtaatcccagctactctggaggctgaggcacaataatcgcttgaaccgggaggtggaggttgtagtgagccgggatcacgccattgcactccagcctgggcaacagaacaagactctgtttaaaaaaaaaaaacaaagattgagccatgaaaaaaatccaaaacctggctgggtgcggtggctaatgcctgtaatcccagcactttgggaggccaaggctgacagatcacttgaggtcaggagtttgagaccagcctggctgacatggtaaaaccctgtctttactaaaaatacaaaaattaggctgggcacggtggctcacacctataattccagcactctgggaggccgaggcaggcagatcatctgaggtcaggagttcaaaaccagcctggccaatatggtgaaaccctgtctctacaaaaatacaaaaattagctgggcatgagggcaggtgcctataatcccagctactcgggaggctgagacatgagaattgcttgaactgggaggtggaggttgcaatgagctgagatcacgccattgcactccagcctgggctacagagcaagactctgtctcaaataataacaataataatacaaaaattagctgggcacagtggtgcacatctgtaattccagctactcagtagactgaggcatgagaattgcttgaacccgggaggtggaggttgcagtgagtcaagattgtaccactttactccagcctgggtgatggagtgagactctgtcccaaagaaaaaaaaaagaaagaaatccaaaacctgaacagaccaataacaagtaacaggattgaagtcataacaaaacgtctcccagttaggaaaagtgcaggacctgatggcttcactgctgaattctaccaaacttttaaagaagaactaattccaatcctgctcaaaccattgtgaaaaatagagaagggactacttccaaactcattctacaaggctagtattaccttgatatcaaaaccagacaaagacacattaaaaaaaactataggccaatatctctgataaatattgatgcaaaaatcctcaacaaaatactaggaaattgaacagcatattaaaaagatcattcatcatgaccaagtgggttttatcccagggatgcaaggatggttcaacatcctcaaatcaattaatgtgatacatcatatcaacagaatgaaggacaaaaaccatatgatcatttccattgatgctgaaaaaacatttgataaaacacaacatcttttcataataaaaaccctcaaaaaactggatatagaagaaacatatctcaacataataaaagccatgcatgacagacccatagctagtgtcactaaatggggaaaaactgaaagccgttcctcaaagatatggaacatgatgaagaggcccactttcaccactgctattcaacacagttctgaaagttccggctacagcagtcagacgagagagaaaaagggcatccaaactagaaagaaagaagtcaaattatacgtttttgcagacgatatgatcttatatttggaaaaacctaaagactccaccaaaaaactattggaactgataaataaattcagtaaagtttcaggatacaaaatcaacattcaaaaatcagtagtttttttcttttttttgagacggagtctcgctgtgtcgccaggctggagtgcggtggcatgatctgggctcactgcaacctccgcctccaggttcaagcaattctcctgcctcagcctcctgagtaactgggactacaagcacacgctgccacacccggctaatatatatatatattttttgtattttagtagagacagtgtttcaccatgttgcccagactggtcgcgaactcctgaactcaggcaatccgcctgcctcggcctcccaaagtgctaggagtagaggcgtgagccacggtgcctggcctaaaatccatagtatttctatacaccaaaatgaacaatctgaaaaagaaatcaggaaagtaatcccgcttacaatagctaaaattaaatacctaggaataggccaggcgcagtggctcacacctctaatcccagcactttgggaggccggggtgggtggatcatgaggtcaggagttcaagaccagcctagccaacatggtgaaacgctgtctctactaaaaatacaaaaattagccggacgtggtggtgcatgcctgtaatcccagctactcaggaggctgaggcagaagaattgcttgaacctgggaggcagaggttgcagtaagctgagatcgcgccactgcactccagcctgggggacagagcgagactccatctcaaaaacaaacaaacaaacaaacaaaaaaaacctaggaattaaccaaagaagtgaaagagctcggcaatgaaaactttaaatcactgatgcaagaaatggaaatggacccaccaaaaagagaaagatattccacgttcgtggattggaagagtcaatgttaaaatgtccaaagtatccaaagcaatctacagatttatgcaatccctatcaaaataccgatgacattcttcatagaaataaaaaaaaatcctaaaattatatggaaccacaaaagacctagaatagccaaagctatcctgagcaaaaagaaaaaaactggaagaatcactttacctgacttcatatcatactacagagccatagtaaccaaaacaacgtggtactagcataaaaatagacacatagaccaatggaacagaatagagaacccggaaacaaatccatacccctacagtgaactcattttgtttccacatgtacccacaaaaagtttaaattaaaaaaattaactctaatattttttaaggtgaaagcattataatatcagactggttagttgtgctttttcttttaattgtgtataaagttgcacatgagttgtggtgtctgctgcctgtcgctgttccagcctggaacagcctagaaaccgcccctgctgcctatagtctagtgggacacagtacatggagaagcagggatttgaaccatggcctgctgattcccaggggctctccccttcatcatgctgcccctgggatggctaaagagcctcccttccctcctccctggcctttcctgcttcctccctgcacgggaggagagacacagatggatcagtgatcgcaggcagatggtgtgtgcctggcccgtctggtctgggaagcagctgtatgtttttggctttgaacctagtacagtttccccttgagatcctcccttggacctgactgttttggagacagatgacagtgtctctctcctgagctgaaatctgagcagacacccggctgcctcaggttgttggagtgctctggactggagctgagttccatggtggccctactggtccttagctgcgtatccctggacaaagagcttagccaccctgatcctcagtttccactgctttgaaacggggggtaacatctgccgtgccttccataggaccagatgagatgagggtgtgaaaacggtcaggaaacttacaaggctgggagg

SEQ ID NO: 378 - DNA, 87939 bp, Homo sapiens
tgataaaaagtttgaaaacgatctgtatgaataatgcccagaatgcttttagactaaaaatgcaagtgctgttggaaacctttgctttctgttaagaactctgacatgtaaaaagcaacatgactttttttcctcttaaactgaagttattcaattcctgtacttgcaacctagtaacaaaaatacaagaacacaaagcattccaacttcacaagtaactgaaaagtacattgcaaaaagctgtttaatgatgccttaaatataaatatactgacattaaaaataggagctggttaaaaagcagtcatctttaggtgatgtgacatactgcttattaaaaaaagtattaacttgagtaataaggtaaaaataactattccaaatcatgtttaattaaggcagaagagaagcaaaaaaccaaaagaaggcagacagaaaggacatatactctttttctactacctaaatagttcctagatatttattacagcaggccctcaataataatgttaacaaaattcactggggcatttccacctcttactatcttctgaaatgacaattagtaaatcagctactgttaagactctccaactacagtgacatctaggtcagagctctggtttagaaaccaatcttaaacaacagactctcctcccatccaaccatcaaggggccccaagtgattaggtataagaaaaccactcagtagaaaaacgtctcagccaagtgtggtggctcacgcctgtaatcccagcactttgggaggccgaggggggcggatcacaaggtcaggagtttgagaccagcctggccaatatgatgaacccctgcctctactgaaaatacaaaaactagctgggcgtggtatgggtccctgtagtcccagctactagggaggctgaggcaggggaactgcttgaacccaggaggtagaggttgcagtgagctgagattgcgccactgcactccagcctgggcaacatggtgaaaccccatctctaccaaaaatagaaaaattaggcaggtatggtggtgtgcacctgtaatcccagctactcaagaggctgaggctggggaatcacttgaacccgggaggtggaggctacagtgagccaagattgtgccactgcactccagcctgggcgatagagcaagaccctgtctcaaagaaaaaaaaaaaaaagcaaattcattaattcatttaaaaagcaataagaagtatgggggtgtagtttcccagatgtactcttttgaagtccctcactgtttaacaattaaaatataaaccagagcccaaaattcgtgtcaaagagagaatcaaatggttggtactatgatgtactgtgtccttgtgtgcctctgagataaattattatttctaggcctcagtttccttatttataaaatgaggatgctcagtgagatcagtggctcccagaatgtgagactggctacactgaatcacttgaaggacacattaaaatatctgattcccattgcagatccactgaaccagattctttgggtatttttaacaggttcttcaggtgatgatgatataaagataggctggcaaccatctgactaaacgatgtttaagttcccatcttgtgccatactaaaactattcactgaactttttatatattgtctataatctcagaacagccttttttttttttttgctacctccctgttggtggagatactcataacagccttgaaagacacgtatattactgtcacagttcttttttttgagacagagtctcgctctgtcgcccaggctggagtgcagtggtgcaatctctgcaagctccacctcccgggtgcacaccattctcctgcctcagcctcccaagcaactggaactacaggtgcccgccatcacgcccggcttattttttgtatttttagtagagacggggtttcaccgtgttagccaggatggtcttgatctcttgacctcgtgatccacccgcctcggcctcccaaagtgctgggattacaggcgtaagccacagcacccggcctatttcaagtaacaatttattctatggttctattattattctgtagggtaattaaaacttgtattaaatgttttattttaaatggggaaaaatttcaagtgtgttatgggagatgactgctaaaattaagttttgcacaggaagctagagtacaagtggcaaggcaagataaggttcacatcacatcacctcagaaactggaacacggagagacaatacccaccttaactgtgccatcgtcactgccagtgcagacaagctgagggcctctcctggctggataacaggaattcacaaaggaagtatgtccctttagccttttaaccctctcacctgtttcactatcccacacagccacggttttatctgtggatgctgagaaaagcatactagaaagtaagagaaagaataaaaaagaaataagtgaagataaacagtaacaatctatctttcctacttgacaaaaggtgccaaatttttcaagatcactgacctgctgtgctacgccagtttgcccatgatgctggaatgcctcaccctaccaaaatcctatttgtcctctaggcccagatggcccagataaaagatctacccctgtgaagtttaaaaaattccccttctttgagtccccatgacatacatctaatgtagcagtttgctctatcttttcctcttttgtgatagctaacattttaaacataagacaccctctcacttggaaatgtttaataactccctggtgctgcagagatcagacagactgtggtaccgacctgacagctgagtgactccaatcttttctctttaccaaagtttttcttttgtctctgaggacaatttctttctttcattttttttttgagatgagatcttgctctgtcacccgggttggaatcatggctcactgcagcctcgacctcctgggctcaagtgatcctcccacctcagcctcctgagtagctgggaccacaggtctgtgccaccatgctcagttaatttttaaaaatcatttgtagaggcaaggtctcactatgttgcccaggctggtcttgaactgggctcaagcaatcttcctgcctcagcctcctacagtgctagggttataggcgtaagcaaccacgcccagcctctgaggatgatttctaagttataactgatcttataatgctttcttttttcattttttttgagatggagtctcactgtgttgcccaggctggttttgaactcttgggctccaggaatcctcctgcctcagcctcccaaatagctgggattataagcacatgccaccaggcccagctttctaatgctttatttaaaatgtatacaatgctatgtatcaattgatggagcaccctaagattttagaggtcagaaatgtaaaacaatgaatgtttaccagactacctaacaatgtaattacttttgtatagccagatttctatattatctataatatattctaaaataatatagtcattaaaatgacgtttatgacatcagatgttggctgagcaatgttaagagaaaaaaggagcaaataagattgtacacacagttctggccaggtgcggtggctcacacttgtaatcccagcattttgggaggccaaggcgggcggatcacaaggtcaggagatcgagaccatcctggctaacacggtgaaaccccatctctattaaaaatacaaaaaaattagccgggcatggtggcgggcacctgtaatcccagctactcaggaggctgaggcaggagaatggtgtgaaccccggagacggagcttgcagtgagccgagatcgcaccactgcactccagactgggcgacagagcaagactccgtctcaaaaaaataaaataaaataaataaataaataaaaaagattgtacacatagttctaacaaatatgcaacaactaaacagttctgagtagaaaaaaaggcattagaaaaatgtataaaattaacagtgattggccaggcacggtggctcatgcctgtaatcccagcactttgggaggctgaggtgggcggatcacctgcggttgggagttcaagaccagcctgaccaacatggagaaacccagtctctacaaaaaatacaaaattagccaggcacggtgatgcatccctgtaatcccagctattctggaggctgaggcaagagaaacacgtgaacctgggaggcggaggttgcagtgagccgagatcgtgccattgcactccagcctgggcaacaagagtgaaattccgtctcaaaaaaaaaaaattaacactgattatctttggagtggtagaaatatagactattttttcatctttctgctttttttggtttctcaaaagaaatgatttttataatagaaatagctgatttcaggccaggcatggtggttaattattgtaatcacagcatttttgggaggctgaggcaggtggactgcttgagctcaggagcaatatagcaagaccatgtctccacaaatgatttttaaaaattagctgggcatggaggcgtgggcttgtggccccagctatttgggaggctgaagtgggaggatccctcgagcaagaggttgaggctgcagtgagccatgtttgtgtcactgcactccagcctacatataaaaatcacatttattttatgtcttaaaaaaagaaaaatttgtctgggttgttgaaatgaccgatgtaacatctttatatttgcatacacagactataaacacctcacttggggtgacagtgataaatcggatactaaagtagctacccaaaattagtagtttttgatagcagggtctcctgagaaaggatgaaaggtgaaaggacgccaagaattagtatgagaagctgtccttccattatgcagaatactcacctgccatctgtgttgtaatgcaattccatcactgctccactgtgtcccttcagtgtggcatagttatcacagtcaccatagacattccacagtactgttagggagatgggttctgtgagcattactaggcaaagggtacttataaatttatcagaacaacagttctcaggtcaggcacggtggctcacacctgtaatcccagcactttgggaggccgagacgggtggatcacttgaggtcaggagttcgagaccagcgtggctgatacggcgaaaccccatctttaataaaaataaaaaaatcagccaggtgtagtggcagacgcctacaatcccagctcttgggagactgaggcaggagaatcacttgaacccaggagacggaggatgcagtgagccgagatcgcgccacggcactccaacctgggtgacagagtgagactccgtctctaaaaagccaaccgaccaaccaaacaaaaaaaactatgtagtttgtctgatgaaattaagcctatcaataattcatatatgttctgcaaagatccctaagcaatccagacgtttggccactagtaagcttaaggatcatagagccggaacatccaaatcaaaatgggcagtgaagacgggtatcatccacccggcaccgaggaaaagagttaacagaaaagagccaaataactcatttcatctcataatctggcaagaaagtagcaacagaagcatctgattttttttccttctggcttcatttgctggagtataaataaaacgactttttctacttacttctcaaaaatgggtatgagaaattcttatttctcaaaaatggaaatctggtagtagatcctaatgatgtacaggtagattatttaagggagttaccactttaggattccttccttcccatatgctagctaggattctgggtgtgaattaagaggaccttatacctttgggaaaataaaagttatttctctcctcattactgccattaacctgttatgtctagattgctaagtgccttggtaaattagctggagatttgcctctatgaggaagacattctcaaaccagaacaactcactttccaactagtaaaataatggcttctgtatttaccccatggactccaagttctacacccaagatcattcagcatgttcatgccccaattttagcatattagccatgcagcctgttatgttgccaacatagagtgataccttctgtggcacccaagatttaaaaaaaaaaatcactatctggcaggaaaaattattccagattcaaaaactatgcctcacatatcagtcggtcaaatcctgcagatgctaaggtggatccgttggggtggaacttgcagcagtagacttccccttcatgtccagagagcagcatgattggggcttgaagggaggaacatcttggaggtccctaaacaaaagagaagcacaaggtaactactgcatacagacaaaggaggctacaaaattagggggtggggagtggagggaaaagaccaagaaaacaatgattaagtgggtttcatctgacttacagaatggtagctcttctcatatgaatgcctccaacttgacactctctgaaactttccattatctacctgttataatgactctcttgttcactctctcagctcttgttgtacgaccaacttttttttggagatagggtctcactctgtcacctaggctggactgcagtagtgtgatcatggttcactgcagcttcaaactccttggctcaagtgatcctcctgcctcagcctcctgagtagccaggactacaggcatgaactagcatgccatgctaatttttttagtttttgtggagatgaggtcttgctacgttgcctaggctggtctcaaaatcctggcctccctccttggcctcccaaagcactaagattataggaatgagccaccacatttggcctggctcatttaacaaatgatggaactgactttcccaacaactctgcttggtatggagtactgggtgaaatagttttgttttatttttaattttttttgtgtgttttgagacagagttttgctctgtcacccaggctggagtgcagtggtgtgatctcggctcactgcaacctatgctttctgggttcaagggatctggtgcctcagcctcccgagcagccaagattacaggcatgcacaaccacgcccggctaatttttgtatttttagtagagatggggtttcaccatgttggccaggctggtctcaaactcctggcctcatgtgatctgcctgccttggcctcccagagtgctgggattataggcatgagccactgcacctggcctatttttatttcttattttttcatagcaaacggatcctcagcatgggtgaagtagttttgattatggtcttggacaccaagatgacacttgggcaattcatctaaacatgggctgatatgctcacttgtcaaatgggagaagtatactacccataatccccaaatctcttcagtacttcccagcattttcatatttatttatttatttatttattttttggggaaggagtcttgctctgttgcccaggctggagtacaatggcgtgatctcgtctcatcgcaaactccgcctcctgggttcaagcgattctcctgcatcagcctcccgagtggctgggattacaggcacccaccaccaagcccggccagattcatttagttttaaaaaatgttatgtgcaggctgggcgcggtggctcacacctgtaatcccagcactttgggaggctgaggtgggcggatcacttgaggtcaaaagtttgagaccagcctgaccaacatggtgaaactccgtctctactaaaaatatacaaaaattagccaggcatggtggcgggcgcctgtaattccagccactcaggaggctgaggcaggagaatcgcttgaacccgggtggcggaggttgcggtgcaccgagattgcgccactccactccagcctgggtgacaagagcaaaattccatcttaaaaaaaaaaaaaagaagttacgtgctaggcactgggcaaacagcaatgaacaaaataaacaatggagctcgctgttccagtgggaaagggggaagggagaagggaaggtgagagaaaacaagcaaactatatatgtggtgtcatgtgctatagagcaaaagaagggatggggatggtggctcatgcctgtaatctcagcattttgggaggccaaggtgtgcggattgcttgagctcaggagtgaaatcctgtctctacaaaaaaatacaattagttagatgtggtggtgtgtgtctgtggtcccagctactcaggaggctgaggcaggaggatcacttgagcccaggtggtggaggctgtactgagccagtggtcaacacagagagattgtctaaaaacaaaaaaacaaaaaaagagagagagagaagcaatgtgggttccacagtatgtggtactgcaatttaaaatagggtggtcaggaaaatcctcactgaaaaaattacatttgggcaaatattcgcaggagctgaatagtaaaccatgtaaacatttgtgaagagcaatcccacagagaggacagcaaatgcaaaggtcctgaagcagaggcttggaagagagagtaactgaagccaggtgagcaataagaaattggtcagagaggtaaagggaaagagggcaaataattacaagaattttggtttttactctggatgaagtacaaagccaccagaaagttttctgcagagtgtaatgtgatctgatgtttagaaggattcctttggttattggcttggtaacaggtgctgatacaaaggtagaaagtggaagaccagttagggtcccactacaaaaatgccagatgagataataatggcttaggccatgaggcaatgatggagatggtagaagtagcaattctagacctattttgaggacggtgccagcaggatttattgaggagatgtgaggacactcgtatttcctcgtctgagcctaaacaggacattagaagtgtgatcactatttctatcttacaaaaaatgtagttaggagcatggtttctcagttcgaaatctgcttctatcacgtacttggtaagtctgtttttccatctgcaaaatgggttaataacgttcctaacaggctgctaccaagatcaatggaaatttcatatacgaaacactttagtacaagagtcaatgaatgttagctgctatttagttgttaataatactagtgcagagaaataaagggaaaagcaacttgcccaaagtcccaaaacgagccaacacaaatcatttcccttttttcttccctccctcattcattcattctacacactcttcggaatttttgttctatgccagatccatgttagagtcaggatgcttaaacccgggtcagggttttgagcccaaggtcctcaactctaattctaatgctatctcagggcagtcgagaggctgaaaacgggcgccaaacgggggaacacgtacgcagcattcgcaggctatggggagcttttacagtgtttatgtgctttaactctgcgtagaaactctcgttctgcccccgcaatgcgggaaagggtcagggatcaccagatacagcgctctgaggggaggaagatgagctgagggccaaaggccgcctgcttcttcacttaccgcttgcagcaaggctcccggcgtcgcctgctgctgcccggctcctgggccagaccccgctcccaacagcaactcatgccgctgccgcttgactggaaccagcggcaactctgggcccttacgcttctgctgttctatcatggcggcaaccggtctcttcagcgccgccactgaccgcgctgccgctctcaggcgccacgcaattggttccaaattagtccttcctccacaacttccagcttggaagaaccaatcggctttcaatatttccatttgcaccgccctcggatagtctcttgttattgggcatatctttctgacgtcatgagagtgcgataccaggattggtggacggagctggcgaccgccctaggcgcgctgggtcttgtgggtggaaacgcgctggctgactggggtcggcgtttagttcagcgcagcgactcggggacctggagctgacgcctagtacgtatgaggaagaacggggtgggtggctgcctgagtctggaggcgacgcctcggttgtgcagtctgaacctgcccttctcagctgagggtgctgacagcaaggggtgggaggcgggccccgagtccccagctgtggtaagtagtagcctgggctccctttcggggcaggagcggagccttggggtctctggcggcaagacccagcccctgcggctcccttcttcaagagcgcccatcgtggccagtcctgtgccgggcattcccagggagaaaggcctgcgtcccagcctcctccggtgccccatttggccgaggaggctgacttgtttctgccactgattttgcagtttttgatcagggcctactgtatgcccccctgagagagacagtgatgaaggaaatgtccgactccttctccagagcacagtcttgttgagaaatttgagactcatgcccatgaacgtggtcattgcctcagtcgtcctgctgatattcatttagcagcgcgttgggggtatgttgtgaaccgggcacggtccctactctcagggcgtttaactctggtggggaaaacgttaaacaatgacctcactaatacatggaaatgcctcctactgctgcctgatgctatgagtgcctgaaataagcaggaaggtttttcagaggaaaagatgcctgcgctggtagctgcaggaagtgttgtaattaattaggtgaagaagtgaaggcagaaccttccatagagaactacttgttcagagccctgaggcacttgggaggaaaatgactaaaagcacaaagagccagtgtggctggtacaaagagaatgaagggagtatggtacaagatgaagctgtacgtgatagcggtcagaccttgcaggaatttgtagcttttattttaaaacggatgagataccactgagccgtcttcccccagtggggtgtggtggaggaggggacttgatccctcaggctcagtggtgtgaacagacgggggttggggaagccctagtcgatgtatgtggaccacttgggatatgcagtaatcctggtcagagatgtcagtgaggactgagatatgggtggaactgcagagaattggacagattctagaggtatataggaggtaaaatgggtgggacttggtgatgggttgattttagggagtgaagagaggaatcaaaggtaactcctaggtttctggcttatgtagttgaatagatggtggtaccattcactcactatcacggaatccctcaagctggatagggaacactagaagatgattagagaccagtttttttttgttttttttttttttttgagacaggttcttgctctgtcgcccaggctggagtgtggtggtgcaaccttggctcactgcaacctccacctcccaggttcaagcaattctcctgccttagcctccccagtagctgggattacaggcgcctccactgtgcccggccaatttttgtatttttggtggagatggggttccaccatattggccaggctggtctccaactcctggcctcaagtgatccacctgcctcagcctcccaaaattctgggattacaggcctgagccactgctcccagctgagatcagtttttattgattgattgattgattgtgtggggtcattcatgacatccaagaggcagtttgaaatacagctttgtgctcagaagagagatttgtgttgggaatataaaattgggcataatttgtatatacatgaattgagccataggtgtgggtaaggtcagctaagtcagaaccttgactagttccaacatttaatggtgaagaacaggtgaacctacaggagatacagaagaaaggaaggaggactggaagaatgtctcagaagcaaaagaatgatttgtgatagaaatttctagaatttaaataacatgaagattgaaaaacatattttggcttttatcatcatggaggtcacagtaaccttagcaagagttattttgttggtgtgattgggccaaaagccagatatgaggcaaggatttggacaagaaaatgtaggtagtgaacctacacagtatttttcatagatctgattgtaaagaggaggagaggatgtgctaaccgatggggataagggattatccaggatccagttgaggatccagttttgagaaatttgagaatattgtagaagatttgaaagtcactgtggagtgtgggagaatgaggttactagagaaatgtaggatgcaaggaaaaaaaaaatttttttccagcatatccagcggtttagtgcatgcatggagaaaacctttctgggtatggcaaggacatcgcttgctcaagacacattctaacctctaatatgtcttctcttcctgaaaaatctggaaaactaaaaaccattttcttgactcccttgcacctaaggtgaaaattgaatttggaactgagttaaatgtggaaagaaggagggtgtgagtcatccagttttgctgccagtcatggcagtaaatttctccagtcaatagctccctggtttggtggcttgctgcagtgatagccataactttcctggattgtggcaaaggtggtattattttgtgggttaggtgttgttcctggaagttctgccaaagtcttttattgcaatacatcccttactgcttaagtgggttctgttgtctgcaactgtccctgaccaggttagaggtactgccagagagttaaatataaagacagagttaaagggagtttagggtgttgttggaatgatgggctatggaatctaagctggattggaagaaaactgaagaaaaaggggagggctgatagattggaagaaaatagaggccaataaatcagggttctaatgaggtcaaagaacagtattctctgctagaggatttctgtttatcctaaaaggcttattcagttatctgtttaacttctctacttcccccagaccctctttctcttcctagctactacttttgtttgtttgttttgagacagtcttactctgttgcccaggccgattgcagtggcatgattatggctcactgtagcctcgacctcccaggctccagtgatcctcccacctcagcctctccagtaggtgggataacaggtatgtgccaccatgcctggctaattgttgtattttttatagagataaggtcttgccatgttgtccaggctggtctcaaactcctggcctcaagtgatcttgctgccttggtctcccaaagtgctacgattataggcataagccaccatgcctggcccccaagcttctgctttagcacttatcacattgcagtgtaattggtgttattttgtgggttaggtgttgttcctggaagttccgccaaagtctgttattgcaatacatccctttctgcttaagtgggttctgttgtctgcaactgtcccgggctaggttagacatactgccagatagttaaatataaagacagagttaaagggagtttagagtgttgttggaatgatgatatctgatatccctatcagattaggaggtctttgagaacagggactgtgttgaaaagggtggtttaggccgggtgctgtggctcactcctataatcccagcactttgggaggccgaggcaggtggatcacctgaggtcaggagttcgagaccatcctgaccaatatggtgaaaccctgtctctactaaaaatataaaaatcagctgggcatggtggtgtgtgcctgtaatcccagctactcgggaggctgaggcaggagaatcgcttgaacctgggaggaggttgcagtgagctaagatcgcgccattgcactctagcctgggtgacaagaacaaaactctgtctcaaaaaaaaaaaaagaaaaaaaagggtggtttagtggcaagtgtgtgtggcccttggaatggcctaagatttgtctctttcttgctgtgttgttttggacaagttatttcattcctgtaaaataggattacttgctttgtagaggagttttagggattgaaagcaggtttataaagtaccttatatataaacatcaatcaatagcatactgaattgatgaattaacaatttaaatggggtaaaattaaatacttcactattttagtagacaatttccatgtgtgttacactgtgctaggcactggagatttggggaggaaggatatgatgatgtgcaagacaaaggcatgcttacaagagttccacactctacaaagggaggaaaaaaatgtccctaaaaatgatttgaatcccatccccatcattcatattttgcaatcttgagcgagtttacttagcttctcttgtgtcctcatttttaaaatggcaatgataattgcctgttttatgggatagtcaagaagagaattattgaatgtcatgaagataaaattttaaaaagaaaaattagttaagagaagtaaagctcttagattaatacatggcagatatgaagcactcaaatattagctattataagactttgaagggatcttaggaataattgactgaaagtgtagtgtcgagtggtagaataagtgctgatcctggggtcttataccaatgttgctaactgtgagcagcctttgtcaaatcacttggcttcattttcagtggcctaagagtaataggtttaattatttccataattcctttaagtttttacattttctgagttcatcttttgtgtttttcctggcattttactattcctctttcctgcttttggctattttctcaacaggtccacgactggaatttgaaagcaagaagcatctatcttacatggtcactctagaatttggtgggagggaggaaagttggaccaccagtttgacatttgaaagtgtcccggccgggtgcggtggttcacacctgtaatcctaacactttgggaggccgaggcgagcagatcacttgaggtcaggagtttgagaccaacctggccaacatggtgaaaccatgtctctactaaaagtacacaaattagctgggcatggtgttgcatgcctgtagtcccagctacttgggaggcagaggtgacagaatcacttgaacccgggaagtggaggttgcagtgagtcgagatcgcaccactgccctccagcctgggcaacagagcgagactccatcttaaaaaaaaagaaaaaagaagtgttccatctgttgatctgtccaacatattaaatgggacctagctccttcttcttctatatcctttagaccagaatgtgttcccccctctttctctacctgtgcttggcatatagtgaggctcagttcactcatttaaaaaaaactgagtacttgtagtataccagaccccaggaacacaaaatcaaatgagaaatggtccttggtttcatgtttgaatgaatggatccagacgttgctcatcctagctcttccatgaatgatatccacattgattcctctaatgttgggacctagttagtgttagagctatattctacaaaatttagatttagaccgtgtattagcccattttcacactgctctaaagaactccctgagactgggtaattataaaggagaaaggtttaattgactcacagttctgaattgctggggagtcctcaggaaacttataactcatggcagaaggtgaaggggaagcaaggcacgtcttaagtggtgtcagaggagagagagagagagcaagagaaactgccacatttaaaccatcagatctcgtgaaaactctgtcactatcatgagaacagactgtgggaaactgccatgatccagtcacctcccactaggtccctcccccaacatgtggggattacagttcaagatgaaatttgggtgaggacacaaagccaaaccatattcgattgtgaattctttttgaggtatagtgcttaagaatgcaggctcttggccgggtgccatggctcatgcctgtaatctcagcactttgggaggctgaggtaggaggattgcttgagccaggagttcaagaccagactgggcaacataatgaaatccagtctctaccccccctcaaaaaaaaaaaaaattagccaagctcgttggtgtgtttctgtcccagctacttgggaggctgaggcgggaggatagcttgagcccaggaggtcaaggctgcagggagccatgtttggaccattgcactccggcctggacaacagagtgagaccctgcctcaaaacaaaaaacaaagcaaacagtgcaggctctggagtcattattctgtctctgttcatatcctagtagttttagttagcttactttgctcacaattccagcacagcttaaagataaactaaaattcctttaaattcttagggttctagtcaattagtactcaagtaacaaaaaaatctaaatccaaacaagctggaaaatgataacaacaaaaatcttgaccaggtcagtaaggtgacacattaaatgaagttccaaaaaggctataaaatgtctggccaatttaatattgttctttaaacttttcattgcttgggggataggaggacaggatgtgtagggtttttttcccagttgcatgtgtactttaaaatttttttttgaaactatcacataattatggaagcatgtacagataacatttttctgaattatttgagttaaattgctgacccaataccccaacagccctgaaaactttttttcctacaaacaaggacattctcctctatagccacagtgtaattaccaacattatgaaattaacattgcattacttctttgatcctcaggccccacctcttgatgctcgagctctgactacccattctgggctgctccagtgtgtgccttcatcaccttattcttccctatattgcagttctctttgtagatttcctcctcacccagcttagactctgacctcactctgggccaccatttcttctcctgtatcctttacttccatcccatactttcctttctctgtcccttgttttggaaagagagtggctagtaattggtcccctgttgcttccctatgtaacacagttgtttaaaacatgcaagcaaaatgctttgttctgcattcagagctattgcaaggcaactccaaatggtgtacctcaatccttgtcgacttactggctcttttaagtgtatgaatgtggtcctgtctgactgactgtatctatcttaatgttatatactcttttttttttttctttctgagacagagtctctgttgcccagggtggagttgcccagggtggagtgcagtggcatgatctcggctcgctgcaacctccacctcccatgttcaagtggttctcctgtctcagtctcccgagtagctgggattacaggtgcccaccacaatgcccagctaatttttgtatttttagtagagatggggtttcatcgtgttgcccaggctattctcgaactcctgggctctagtgatccacccgccatggcctcccaaagtgctggtattaacaggtgtgagccaccgtgcctggctcaatgttatatactcttattttttttttttagacggactctcgctctgtcgcccaggctggagtacaatggtacgatcttggttcactgcaagctccacctcccaggttcatgccattctcctgcctcagcctgccgagtagctgggattacaggtgcccgctgccacgcctggctaattatttgtatttttagtagagatggagtttcactgtgttagccaggatggtcttgatctcctgacctcgtgatccacctgcctcagcctcccaaagtgctgggattacaggcgtgagccaccacgcacggctgtatactctttaaaagtagcagaactctttttttttccaagtgaaatcttacacagaattttaatatgtaaactggatcaaagcagaatacgttgttacagtaggcacccttgcagtaattctcactcactccccctttcactgtggcccaccataaggttgggagattaactgtgaatcagtaataattgacctttgcctaattactgaggagaggcttctacccaactgctctgagtgggacttctcccagctctagtttctttgggggttctactccctcagcctttggtatggaggctcacctctggttggttgacttagaggcagcctcactggtctgggaccttgtggtgacctagatatttcagagttgactttttttttttaatttcttttttttgagacagggtttcattttgtcttctaggctggagtgcagtggtatgatcacggctcagtgcactctccatctcttgggctcaagtgatcctcctgcctcagcctcctgagtagctgggacaataggcaggtgccactatgccgagctaatttattttattttttgtatttttagtagagatagggttttaccgtgttgtccaggctggtcttgaactcctgacctcaagcgatccacccaccttggccttccaaagtgctgggatacaggcgtgagccaccatgcccggccataattttcttttcttttttttaaaaaatattttgtggagatggggtgtcgctgtgttgcccaggctggcctcgaacttctggtctcaagcattccttccacctcagccttccaaagtgctggaattacaggtgtggactactgtacctggcctggaagttgactttttaaaaataaatttggattaactaaggagcctctgagtaaccgcaatagaaccctcggtttctacagaatttgaaaaaaagttttatattccatatttaaaaaatgacaaccatttactttcctgaaattgtaaacctgttatagtcatacccccttgttcatgggggatacattccaagacccccattggatccctaaaattgtgggcactgctgaacccagttgctatcaattggaagacgtttctgtttgtattttctacccacaaatttaatgccttctccatcttaactaagcacttatcatacactgtggctataactttagcagtttgaggtgcaacagcaaaactaacatgaatgtttttttcttcctcacaatttcagacatcgaagattcattcttactatagatcttagcaaccttagcatacaattttttttttccccttgagaactttcaccctttcacttaaaggaagcagtttacagcttctctttggtataccaaaattgccagcattactactctgcttcgtggccattattaagtaaagaaaggattatttgaacacaagcagagatacttcaacagtcagtctgataaccaagatggctactatgtgactaatgggcacttaatatacactgagtgactagtgtatgcagcatggatacgctggacaaaggggatgattcatatcccagatggaacagagtgggatggcacaagatttcatcacactaataagaacaacataacagttttaagcttatgaattgtttatttctggaatttttcatttggtgtttttggaccgtggtagactgtgagtaactgcaactgtggaaagtacaactgtggatgggaggactactgtactgttatatttcaggctttccctcaaaaatgcatgccagtttttttttgagataaggtctcactgtgtcgcccaggctggattgcattggcatgatcgtacctcactgcagccttgatctccttggctcaagcgatcctcttgcttcagcctcccaagtagctgggattataggctggtgtcaccacacctggctgattttttttctttttttctttttgagacggagtcttgctctgtcaccaggctagactatagtggggccatctcggctcactgcagtctccgcctcccgggttcaagcaattctcctgcctcagcctcccaagtagctgggactacaggtgcgcaccaccatgcctagctaatttttgtatttttagtagagacggggtttcactatgttggccgggatggtctcgaactcttgaccttgtgatccacccgccttggcctcccaaagcgctgggattacaggcgtgagccactgtgcctggctgattttttttttttttaagtagagatagagtctcactgtgttgtccaggctggtcttgaactcctggcctcaagtgatcctcccgccttagcttcccacgattacagtcgtgagccactgcacctggccccagtttccttcttgaagaattgcatggggtttcttaggccactgttctacaagaggtataaatctgggagcattaaacctagctttttgtatgcttatcacagcagaagtctgtaagcaacaatgtaagttcatttctgctttagactttttttttttttttgagatggaatcttgctctgttgcccaggctggagtgcagtggcccaatcttggcccactgcagcctccacctcaccggttcaagtgattctcctgcctccagagtagctgggattacaggcgcctgccatcacgcctggctgatttttgttgtttttttttttttggagacggagtctcactgtgtcatcaggctggagtgcagtggcacaatctcggctcactgcaacctctgcctcctgggttcaagcaattcccctgcctcagcctcccaagtagttgggaccacaggtgtgcaccaccatgcccggctcattttttgtattttagtagagatggggtttcaccgtgttggccaggctggtctcgaactcctgacctcagatgatccacccgccttggcctcccaaagtgctgggattacaggcgtgagccactgcacctggcctatgacctttgtgtgtagagtaacagatgatagattaagatgtttgaagttaatttagatgtttcagctgctggtgcccctatggattctgtacctcactaatacgtttcaagtgttggagggataataaaagtctcctgatagaacctgatagattagtaactcctgttctagcatgtgaggtgagggatactggacagagggaaaggacaggctagagatgagattgtattgctatgaaatggaagaggcaggatttaaccagaatgtaaaacttggaattaacctgtttatgagctatttctcaagaactgacaaatctgcctgtattagctctgtgtacttttagtacagtaataaaaagacactttggctgacctaagcagaaaagggcaagtttagtataaggatataagattatcttagggagcttgaggacagggatgttcctgagctgtgggataatactagaacaagggtttggatgtcctgaaaggattttctttcatttctgtttcaagtgaagctgtcaatttaatggatggtcattgtaaatcgggaatacttaccaaaatcaggacatcaagtcatcctctgaaagtgaaaggaagcagtgggggttgaggagagaagaaagtatttacctgtgaaaacacaagaaaaataatttcaggtcttactggtgtcaaatgtaattgggaggaaagagaactgaggatagtaccattagatttatcttggcagtgatttatccaacagagtaaagaggcatgtttaagagccgctagattgctggtttcccctctgtttaagatcaggaggctgagcaagattatctctaaggtaagtatccaaagctgtaagttttgctacttaggcagtatcagtgtcacctagtagctggttgaaaatgcattatctcaggtaacacctcagacctactgaactgcaatctgcattttcacataattcagaaatagttaaatgaatttggtacatccaacaatggattattaggtacgtgttaacaaaaagttgtgtatgcgtatgaattgctgtagtaagaaaatgatttcatgattccattaaaaaaccacttctacatataaaaaaactgtaagaatatagatcaaattgaattacaggtgatttcattttctttattattaatgtattatctgaatttttttattatctgaactttcacagtgtgtatgtgttttaattttatcaagaaaaaaaaagtaagcccttttctctttgaagtcacttcagatttaataccttagcatagtagttaagagaatggactctggagtcagccagtttgactccccatttcctggctttttgacatgcttagtaatttaacttctggaagcctttgttctctcatctgtataatataatagtaatagaacttacattttaagagttttgagaattgttttgttttgtttttgagatggagttcgctctgttccttagtctggggtgcagtggtgtgatctctcactgcagcctctgcctcccaggttcaagtgattctcctccctcagcctcccaagtagctgggactacaggctcctgccactatgcctggctaatttttgtatttttagtagagatgggatttcgctatgttggccaggctggtctggaactcctgatcctgagatcgtccgacctcagcaaccacagtgctgggattacaggtgtgagccaccatacccagcctgagttttgagaattaaacgagattgcatgtctagtgcttagcacagtgcctggacatagtaagtgctgcattaatgtttttatttctgttattccatttttttgagatccggtcaaacatacttaacatcttttcccaccctcccccaaaattcttccccggcaaaaaaaatagcaaaaatagcaatttaaaaaaaccaaacacaacaaaattagtagcctaatggccttgggtaagtaacaaattgttgagaaataggatcaaggtttccaaaactccccacaattagaataaacaaaagagatttggataaaagtgtatggtgttaaatctagtggtattattctgtagagaatagctgtggattgtctgcatattcatttctttaatgcagatatctctctaattggtgtctgatttctttatgacaggacacttgtattagctttaatagaagagaaatggaggagccatagaatattaaggatgaattcaggaaggcctgagaccatggaaaacttgcctgctctctacactattttccaaggagaggtatattcttttgtgctttgaaaacccaccatttatgttaaaatagattaagggtgacaactgggtttgttgttcctgtccacttaagtctgtcttgagcattacagcttaaatgggaagggccagcggaacatctggcaatcacatgtgccttctctaagctccagatatttaagtgcgtagttgacatcgtcattggaataccagcatgtgtaatttatgttttaaaatgaatttattttttcactgctgtggtttgaatgtgtcccctaaaaagcatgttttggaaacttaatctccagtgcatcaacgttgggaggtaggacctagtaggaggtatttagttcttgagggctccaccctcctgaagggattaatgccaattactgaaaggcttgaggctgtgagtttgatctctttctctccttcttaccctcttaccttccaccatgggatgacacaacaagaagattcttgccagatgctggcaccttgctcttggactttccaacctccagaactatgagccaaataaatttcatttctttataaattatccagtctctggtattctgttaaagtaacacagaacatactgagacactcaaaaaattgtttctcttctagatgttttcacctcaacaaatagaaccactatcctgcaggttcccagactacacatctggccatcacccttgatttctcttcttgatttgattttgattttccctcccactccagtctatttgcaagtcctaattatatctctggtctatgtacttctttatccccttggcaccctattagttaaaactctctatctcttgcctggtctttactgggatccctgcttcatcgtagctcctctccagtctgttcttcacattgtagctagcataagatttttgtttttgtttttgttttttaattcttttttaaaaattgagctggggtctcactatgttgcccaggctggtctcaaactcctgggcttaagtgatactcccacttcagcctcccagagtcctggggttacaggcatgagccattgtgcttggcctagaataagatttttaaagtaggttggacatgttgctttctcacggctcttcagaagcttctcattacaattgaatacagacatggaccttccacagcttgcccctgggtgctctcacaatgttgtttgttctaccctgctcgtagtcaagacacactggcctccttaatagctttgaacagtctgagttcttgctctctctttaggatttgtgcacatgctgttttctttttagtctgtgctgctataacaaaatacctgagattgggtaatttataaagaacagaaatttatttctcacagttctggaggctgggaaatctaagatcaagttgtcagcagatttggtgtctagtgaagactactctgtttccaagatggcaccttcctgctgcatcctctggagggaagaaatgctgtgtcctcacatgacggaagggacagaaggagcgaactcaccctttcgagcccttttatgaggcactcatccattcatgaggggcctaagggccccacctcttgataccattgaattggggattaggcttcaaagtgaatattggagaaataccaaagttcatgttgaactttagtcccccccgtgggggtattaagaggtggtattaagaagtattaatcacttgggaagtggttaagtcatgaaggctctgcccttgtaaatgtgattaatgcccttatagaagaggctacagagagctgcctggcccctccattccttctgctgtgtgaagacacagcatttgtcacctccaaaggacacaggaataaggtgccatcttggaagcagacagtgagcccttatcaaacacaaaatctgctggcaccttgatcttgaacttcccagcctccagaattgtgagaaataaatttctacggtattttgttatagcagcaccaacagactaagacactcttccttttaactacccactttcccatcatcttgtattcatcctttaggtctcagccctaatgtctcctcagaattttttttacccatcataaataaatcggttcacactgtatttaattatatacttgtttaatgtctatcttcctcacaggacactaagctccatgagggctgagttgtgtctgttttgttgtatatctcagtcttaggtggatgggtagaaaatagtaagtgcttgatacatttttgatgaccgaatgaattatcaacctttggtagagaaggcatatttgtttcaagagcagaggctttgaaaccagacaaaatcgggattctagtcccagctctttttgcttgctatgtgagcctttagggtgtcacttaatctctttgaacctcagttttcttgtttgttaaatggaggttccatttattcacagtaattctcttccatagaattactgtgatggttaaataagctatcatctataagaatacaatgcctgagacatagtaggaattaattaatgttggctccctcctcttgaagtgaaagtaaagccaaaaaattgttttcagtgtcttacaagagcatgtagtttgcttgttcatttgtttgagacagagttttgctcttgttgcccaggttggagtgcaatggtgtgatctcagctcactgcaactgctcactgcaacctccacctcccaggttcaagcaattctcctgcctcagcctcctaagtagctgggattacaggcgcccaccaccacacccagctaaattttgtacttttagtagagacaaggtttcaccatgttggccaggctagtctcctgacctcaggtgatccacctgcctcggcctcccaaagtgctgggattacaggtgtgagccaccacactgggcctcttttttttttttttttttttcttttttttgagacaagatctcactctgttgcccaggctggactgcaatggtgtgatttggctaactgcaacttccacctcctgggttttaagtgatcctcccactcagcccccgaggtagctgggactacaggcacacaccacaacacctggctaatttttctgtagagacaaggtctcactatgttgcccaggctggtcttttgaactcctgagctcaagtgatctgcccacctcagcctcccaaagtgctgggatcaggcgtgagccatcgcacctggcctgagcctatagtattttaatggtatcatttatacttgatattcatacttggcattcatacttgctttatatggttgacaaaagttttacatcctaataatgtgaggtcttggagggcagactttgtgattatcagtcagttatagataattgtggctcttgacttctgttaagttgatcccaacttgtaatataacagtcaagatacaaagtataataccattttaacacatagcaaacagctctgctctttaaagcctctgtcctttttctttatggctcatggtatccccaaaggttagtaaggtaccggagctcagaagaaggaagtgtagcactggaggtgaaactgatttttctgatcatgaagccctcactcatcaggtgctgcccaaaagaaagggaagaacactctgccctccacagaataactcggatttctaaagtggatcctaacctacagctcgctcttttcttttctcttctcttctcttctttctcttttttttttttggacagagtctcactctgtcactcaggctggagtgcagtggtgcaatctcggctcactgcaacctccacctccgggttcaagtgattctcctgcctaagcctccagagtagcagggactacaggcgtcagccaccacgcccggctaattttttgtatttttagtagagacagagtttcgccatgttggccaggctgacttcaaactcctgacctcaggtgatccacccacctcggcctcccaaagtgctgggattacaggtgtgagccactgtgcctggccacctacagctttcttatatgagatggagcttgaattagtgcaggttttatatattactatcaaggatggatggtctttaggaatgttcagagagaactttatagttctaacttactatttcagtagcatattttgaaaagggatggtttagaagtgacttggagttagggaaagagaaatacgataaattggaaagaagaaacttttcagaatattcatccaataaacatttaatgagtacccaatatttacaaagaagaggagttacattaaaattgaaaaaaaaaaaaaaaggtgtaagcctaatctatgccagcactttcacacattctgtcttattgaatctctccaaagaaattgttaactctatttgatagatagggagactcttctcagaagttaagtaatcgcctagggattaataaatggcaaagctaggattctaaatcaggtcctctttccaagtttactttctgctaaactgcagctggggttgtgcaattgtacataaatgtgtggaggaaccaaaagacccatgagaattcttttttttttaagatggagtcttcctctgtcgctcaggctggagtgcagtgggttcaagcgattctcatgcctcaacctcctgaatagctgggattacaggcgcatgccaccacacctggctaatttttgtatttttagtagagatgggttttcaccatgttgaccaggctggtctcgaactcctgacctcaagtgatccatctgccttggcctcccaaagtgctgggattatagatgtgagccaccgcacccagccaagagaattcttttgactgaattgagttataggaggaatatagataaatttggtggttctacagtcatttgttggtacaactctgttacagcatttatcctggtctgtcttgtattattattacttgtatgtgtctctctccactactagatcgtgagttactgtagagcagaggccatgattgtctcatatgtcttggtaactacttcaaatttatttaaaatgactgggcatcccttttttaaagttgtctttatttcatagtacctgacatggtatcttgtacatagtagataggtgcttaaaatggagcccaagcctcacaggactagttgtccttgaagaaggtggtgtttcagcccatgtcccagctcttctcttgctgaacttagcagggatttgggacctagtaattaaatagctgagaagccagtattcatcctgtcatcctctgagaagcatgttggtagcagagtgcattatattaatacatggtaggaggtacgagcatagcaatgagacttgggatttggcttaggcttgccatagcccaagaaatgctgaggggagattcatgttggtaaggtcgaaatagcattggactagaagtaaaaaaaaagtctgtgttgtacttggctgtgctactatctttgtgacttttgacaagtaacttatgcccctgagcctcaaattcttcatttacattatggtgacaacaagtttcaaggccatttgccacctataatctgaagatgggaaatttactttacccaagctctaatgaattcagttgagatagttactgaattttttcccctgagctatttgactaattattcttgggacaccaggcagactgcgtgatcatctatggcaggtgtgattgcaccctaggagacacagtgatgaaaacacctggtgctagaaatctgaaacaatgcctaaacagttgagtgcatccattctggagcatattaacctttccttttgggagaggccaaattaaggtctattatattacctctaaagaccataatgtgacactggagcttcaggattgaaaagtgagattgtcttaatttatagcagtgaggtgaatttggctctaacttccagatttatttatttatttattcacttatttatttatttattgacagaatcttgctctgtcacccaggctggagtgcagtagcatgatcttggctcactgcaaccatgacctcctgtgttcaaacgattttcgtgcctcagctacccaagtagctgggattacaggcatgtgccgccatgcccagctaaattttgtatttttagtagagatggggtttcaccatgttggccaggctggtctcgaactcctggcctcaagtgatccacctgcctcagcctcccaaagtgctgggattataggtgtgagccactgtgcctgacccagatgctacttttaagtttgttggatgattatgttctttaataatgttgttacacagtatgagacttttcagccctctttctagaactgtggaacaaaagccaaagtgccttcagttggtccagaaagaagcgatttgcttttatttcaattaaaaattgggagacttatctttattatgtggccctcttttacaaagaacaaattgctttgtaaactcaggtaagcactttttatctctgatctctacgttcctcatttgaaacatggtagaactggaccagctaatctctgaagtcatttctttggctctaccttgccttaattttaagcatctgtgtgattgtactgtttctttgggactctctggttcctaacccagcataacatgttcattagtataaaacatgagtttagaacttttggttcgtaacccattcttcatgttttgtcttggagagttaattcaagtgctccatccgatgtctccattaaaaaatgagaatgaaagtttttatctatttccatcctaacattgaagtgagtaatgatgatatttggttaagtataaggcactggactagggagtcaagggaccgaggttctatccctaactttttttcttttttttttttttttttgagatgaagtatcgttcttgttgcccaggctggagtacaatggcgccatcttggctcactcaacctctgcttcccaggttcaagtgatttttctgtctcagcctcccgagtagctgggattacagacgcccaccaccagacccagctaatttttgtatttttattagagacagggtttcaccatgttggccaggctggtctcgaactcctgacctcaggtgatccacctgcctcgccctttcaaagtgctaggattacaggcatgagcctccgtgcctggcctccctaactctcaagtagttgtgtgccttcctaccagtcactaatctttttgtgcttcagtgtcttagactgtaaattattgaaaagctacactttgttgaatgtccattatgtgctacatacctatgtcagtcactttatgtacatcatttgttatctgcagcagcaaagtgagaacaaatgggaacttaggccctgaaaggcaagttgtgtgcaagatcctacaggtgggaaatggcagagctaggattagaagccacatctttcactccaaagcatgttcactttctatacctatactgttattttttttttttaaagcttttttagagatgggtcttgctatgttatccaggctggattcaactcctggcctcaggccacgctccagcctcagcctctggagtagctaggactacaggcacgttgcacagcacccagatacacctatactattccacttcatttgcaacataaggatctactgtatatgctttctaggattgttgctaggaatagataggatatcaaataccacattgcttttggccattagaattttatagttagaggggacctatgagcagctctagtgtaattaagactccggattcaaatctcagctctgctacttatttagctttggacctccgatatgttacttaatctcttcatgcatctttttgtcatctattggatgggaataatagtaccaactctgtacagtgacataaggattatgcaaagcattttgaatattattttgcatatagtgagtattcagtatatattagtaaatagcagtgcagtcaggattgttttatttactccccttgttttagttatggtgaagctgaaacagtgctcaagatgaagcagctaattgaagacactgaaaagaataaagtttatgtatgtaagattatattgaatattttacaaataatcatttagtgttaaattcagcatatagtgacaacattaccctcgatccacaggttgggggatggggtaggctacagggggaagagagagctagagcctaggttaatgatttatctggcaagggttctgggcctttcatcactaacatttattggttgcctattacatagacccatcaagcctctaacttcatcttagacaactctgcagaagactgaggggacaactctttctctctgattagatcttttcaggttctgtcagatgtgtatgtattggctttttatctagttgtcttgatgaaacccaagactcagacttggagttaaatgtaacaggctgtatgctctggtttgatttgaagttcaggtatgaggggaggaatgccctgtgtgatccatcccaaatttattaaagttctctgtattgggtttggaggcctcagtcctagctaatataaaatataactttattacctggttttttgctttttgttccttttgttcatgaaactcctctggtaatatcaatatgttccctttgttcatgaaactctgttggtgattttactaggtataggatttgggtattcctcagtatcatcacaccgtgtgataacactctaatctcccagtgtttttaatgtgtacacacatacctgtcagtctaaatttcaaaaaaaacccagaaagaatgtttgacagagcatcatttttaggcagttttatagcatacagaggcagtcaatatgaagtacagatttggggagactaggttaaatgctacagaagaaagattctcatgtatgtgacattgatttttttcccccatctttataggttgctatggtgacagactatggggcctttatcaaaatcccaggctgtcggaagcaaggtaggagtttataacttgaaattcagccctctgattctactctctgctaacactccaccacctcctaattataggctgtacatttttcagacagtagtttttcattcctttgttttctttttaatgtatagatatgaatacaagatgacagttcatttttagcgggcagagaattgtggtctctgactcaggaggaagactggggtatagctaactgggtttacttctgaaaccagctcctccttagacttcacctgtgaccctaggcaaatcacttgacttctttagacacaggatttgcgggagggcaagctacctctgtctgaggctgacagtgtgagttttctagtagatagcgcatgaaatgggaatagtattgcaagtgatacaaacatatataatatatataatgttttaagtttttttcataaagaggcgtctgttgaacatttttttgagaatcctgttataaatctataatcttatttatttaccaaaactatgttaagccgaaaaggcaggttccacagaccggttgtctgcccagagtgatttggctaggtagtggcatagccaagactagaacccaatccttctgattcctagcccctggatctttctactatatcacactgctggtggatccaaagattcaacttgctaacttcttatgctaaaataaggtttaattaaagattttaacattttaaaaaaaggcaaccataagaatactagaagaaaatctagaagaatatttcactacatgaaaattaaaaacttcactgcaaaaatcattgtaatcagagttaagtttggaaaaagaatttgtagtacatatgataaagagctaatacaaagggggtattaggaaaaggtgccaaggatatgaaaaacaactcacaggataaaaaaatattacttggtactatagtaaaagatactcattctccgtatgactaaaaagtaacttagactggtagattcatataatgggatattactcaacaatacaaaggaatgagaataaaatattcatacatgcaacaacctggatcatccctctccagaaattatactgagtgaaaaaagctaatctcaaaaggttatacactttatgattccatttatataacattcttatgttttacttgagatatgattcacataccacacatttcacctgcttaaagtgtacaattcagtggtttctttggtatattcagagttttgtgaccatcaccacgatctactttgagaacattgttgtcaccccaaaaagaaaccctgtacctattagccatcactccagattctctctatgcccccagctttaggcaatcattattctactttgtctctgtatatttgcttattttgtacatttcttgtaaatggaataatgcagtatatagtcttttgtgactgacttctttcacttagcacgttttcaaggttcatctgttttataatatgtacttaattcttttttattgccattacaaatttattgcagttccatcagttgatggatatttgggttgtttccacttctttagtattatgaataatgttgctataaatatttgtgtacaactttttgtgtggatatttgctttcattgggtatatacctgtgagtggaaatactgggtcatatgataactccatgttcaactttttgagaaactgccaaactgtttttccaaagtgaccacgccattttacattcctaccagcaatgtatgagggttctattttctttacatctttgttaacacttgttattatctttctgggtatggccatcctaatggatgtgcacggacatctcattgtggtttgaatttccctaatagctaatgatgttaagtctcttttcttgggtttattggccatttgtatatcttttttggggaaatgtctattcaaatctgatatattttggctgtgtcctcacccaaatctcatcttgaattgtagttctcgtaatccccatgtgctgtggtagggaccaggtggagataattgaatcatgggggtggtttgccccatcctgttctcatcatagtaacacaagatctgatggttttataaggggcttcccttataaaaccatcattcgctgggcacttattctccttcctgctgccctgtgaagaaggatgtgtttgcttcccctttccccatggttgttaagtttcttgaggcttccccagccatgctgaactgtgagtcagttaaatctctttccttggtaaattacccagtctcgtatgtctttattagcagtgtaagaacagactaatacaaaatccttttctttttttgagacagagtcttgctctattgcccaggctagagtgcaatggtgcaatcttggctcactgcaacctctgcctcctgagttcaagtgattttcatgcctcagcttcctgagtagctgggattacaggcatgtgccaccacacccggctaatttttagtagaggcagggttttgccatgttggccagactggtcttgaactcctgtcctccagtaatctgccctcctcagcctcccagagtgctgggattaaaggtgtgagccaccacacctgccttttcccttttaaaaatagggttatttttgtttttattgttgagttaggtgtttctcatatattctggatactagtctcatatcaaatatatgatttgcaaagatttttatgtaacatacttgaaatgacaaagttatttaaatggagaacaaattatttaatggttcacaaggattaagaaggggaaggaagtagcaatatgaaggatccttgtggtgagggacctgttctgtatcttaactgtggcagtgtatacatgaatctacacatgtggtaaaattacgtggaactaaatacatacacatacagaaacacaaatgagtacaggtaaaactggggaaatctgaacaagagccagtcgattttatctgagatgtttttccctacaccaaccaattctccagttctctgattctctaacatcaactggatgtcccaacaattcaattcaattctgacactaactacctgggaattagtgtcagattccacaaacttaagggctcagtcccacatgactaccctcacttcagatgccagccccaatattgaatcctcagattacctacacttttgtctcacttggctacaatttttgggattcccagcacttccccccaaagttggtaatttgctagagtgactcacagaactcagaaaaatgctatagttactattagtttattttaaaggataaaaatgagcagtcagatgaagaagtacacagggtgagacccaaagtgttccgagtacaaagcctctgtccccatggagttggggtgtgtcaccctcttggcacatggatgtgttcaccaactctccaaactccattgcttaggggtttatatggaggatctgttatatagacatggttgattaaattattggccttcagtgatagagctcagtctccagcccctctccccttcccggaagtcagagggtagggctgaaatttcttttttttttttttgagagggaatctagctctgttgcccaggctggagtacagtggtgcaatatcagctcaccgcaacctctgccttccgggttcaagcgtttctcctgcctcagcctcctgagtagctgggactacaggtgtgcaccaccatgcctggctaatttttgtatttttggtagagacggggtttcactatgttggctaggatggtctcaaactcctttccttgtgacctgcccgtcttggcctcccaaagtgctgggattacaggtgtgagccaccatgcccagcccaggctgaaatttctaaccctatctaatcacatcgttgatttctctgtttctgaagctatctagggacccacagtagtcacctcattaagggacttaatgaataacaaaagacacttctatcactcagaatagtccaagcgttttaggaactctgccaggaactagggacaaagatcgaatatgtatttcttataccacagtatcaatgccagcatcctggttgtgttagtgtactatagttttccaaaatgtcaccattggagaaaactggataaagtgtacataaaacctctgtattctttctttcttttttttttttgagacggagtcttgctctgttgcccaggctggagtgcagtggcacaatctcggcttactgcaagctccacctcctgggttcacgccattctcctgtctcagcctcccaagtagctgggactacaggcacccgccaccatgcctggctaattttttgtatttttagtagagtcagggtttcaccgtgttagccaggatggtctcgatctcctgacctcatgatctgcctgcctcggcctcccaaagtgctgggattccaggcgtgagccaccgagcccggcctagacctctgtattatttcttttgagtgcagatgaatgtacaattatctcaaaaattttttttcacatagggcagcaaagttatcaaatatttttaaaaaatgatttaaaacactcctaaaatctttgagattaataaatattttaaaagattgctgttaatacccagtgttagaaatggatacttttactctctatcaggagcataatttcacagactttggcaatgcctattaacatcttttatgtgcttattaccctttaatccagaaattctttgaagaatttagtgtaagtagagaattacataaattatgtgcatctgttttgtagactatgcagatgattgaaagaatgactgtatttctaagacataattatgcctcatcttaccagaaagatgccatggaaggttttcatacaattccatcacactgctacctgactgataacagttgtaaaacatcattgattatgagaagcactccaatttcagagagattaaagtgagaggaaaagaaagtgcatcttagaatcaatgaaacacaataaatgtcagtttactgacatgagccaggagtggtggcatgcacctgtaattccagctacttgggaggctgaagtagtaagatcacttgaggccaagagttcggggccaggctgggcaacatagcaagaccccactgatggcgatggaggcctgtctagagtggctgctgcaaagatgccagccatagtgggggctgtgcggccagggctgcatgttctatggagctggcaggagccctgcccccttatgagttagtggggtgggagcccaccctcatgggtgcagctgccgccacccagccctggctgcagacccaggcatccctgcactcttggaggtccgggaagacccctttcccccatagtctcagaagtgcctgctcccactgcctggactctccaagctcccggctcctgctctgattttggagcaaagtcgaagctgagcctgggcactattgcaacctggctgggtttgcacaccttggggtggtgctgccatgccagcttcctaccatcttggccccctctggactttgggtgccagtgagcacaggagggaggccaaaggggtgctgagggtggctcagcatgggcctgcaggtgcccctgggcacagaacaactgggcgtcatggacaacatgattgatggtgacaagaggcagacaggctcctgggtggaaaggggcaggtctcggtgaagccgcaccttcaagccagggatggcctaaagcataggggccaggctgtcagttccaggtggagtctgtggcccagagtgagaacttaaggtgcttttcctgggcctgcccatggaccagtcagcacacacttctgaagactgtaaaaatcctggactcagccagacttgggcagacactgggaggacttgcctgtggaaatgggttacccacactgggtctcctctccgtcaagggctgcagatgttgggatgacctgcctgcagataagagctgcccattctgggtctcctctctgctaagagctgcactcaacaggttgacctgcctgtggaaaggagctacctactttgggtctcctgagagctgtaccatcactcaataaagcaactctttgccttgcttaccctccagttgtctgcttacctcattcttcctggatgcaagacaagaacttgggacccgttgaatggcgggactgaaagagctgtaacagatccaagggctccctgagccagagctgtgacacctctttggggctttatggttcctggcctctccaagcttctgggcaccaccatgttccccagagtccacagtggaagccgcttgtggtatgcctggtccatccacagcctcacatggagctggtgcctgtgccagcacctggagctgcctgcccagccacagcagccagtgtgcctggctgtgcacagtggctggaccccatgctcactcactcatgcatccctcgccactccgagcctggctcgcccttggcaggtgtgggatctgggacggcagcatgagccaagcgcagcccattagaccaagtggatggaacaggcctagtggccccaagcaaagctgaatgcagcctgccaggccaagtgggcagaacgagcccagcaggtccaagcaaaactcgggcaaaggtgctgctggccacagcagcttctggctggaaaagtgacacctgaagaatcttgtgacaccatctttacaaaaagttagctgggtgtggtggcagaaggatcacttgggcccagaagttagaggctgcagtgagctatgattgtgccaccgcaccccagcctgggtaagagtaagaccctgtcccttaaaaaaaaaaaaaaagaaaaaactaacatggaaagaagtctaagataataaaatttaaaaacatgttgcagaagactttgtatagcatctctcttccccttttaaagcaagtgtgcatatgcctttaatatcttttttctttatatagtttaaattactgcctatgtttagaagaaaggctggaggaatattcaacagattaacaatggtcacttctggggagttggttttgctaaggaagggatgtacatggaagagggactttgacttctggaaattttttttaagttttttctgttaaaaaaaaaatccaagaggtgatctttggataataaatccatgcctctaaccttgtagactactattctgcaaattgcatctttgcttaagaaatggtttaccagcagttttcaagctggcagtcagcagtctgtaattaagtttctcattttatgttgtctggaatttaatgacatcgaactcttccccaccccacaggacattcatctctttctgtctgagcacaggttttcttgttagtatagttgccatagctgccagtgcctgaaagtcccattctaatttgggcatatgtgacactttggggactgtgtgggattaaaggcctgtgaccttccagcagtcaatcttcaactcattttatccataccctgtcaggtgatgcctctgattgtggctgacagcttacaagtgaatctgtcagtctgacagctgggctgaggcaagcctcagagggagagctcagggagccaaataattaggtggaaactctgtgagttttaatcctgagatctataggtttattggataacttgagcaattgacttccttacagtgtatcttagtttctctgcccataaagagggaagattattaagtctcagcctgaaaggactgagttagaaaataactctggtctgatcaggtcttaacatctttggctcaggtaggtagattctaatttgagctggtttcccagatgtcatgttctcagaatacttcagccaacactgagttgaagaccccttcctactattcaaacctaagctagattttctttcccctctcatagtattatccaatataactttctgtgatgatgaaaatattccttatgttctctgatttgtttcctgacaccaaccaactccccaattctctggacaccaactgggtgtccagtgactcagttcaattctgacattatttatctggagcttgtgttagatctcacaaatttaagggactcagtcccacaaaatttcccccatttcagatgccagctgcaagtcctgggccacttgtacttctgaccaatcagctgtaaacaggggttccatgaccacctacttaggtttgagactttgccagaatggcttacagaagtcaggaaaacactttacagtagtccccactcatctgtgcctttactttccacggtttcagttaccctaggtcaactgaggtttgaaaatattaaagggaaaattctagaaacaattcataagctttaagttgcagttgcagtgtgatgaaatcttgtgctgtcttgccacattccatctgggacttgaatcatccctttgtccatccacactgtgtacgctacccacccattagtcccttagtagccttctcagtgatcagatcgactgctgttgcagtgcttgtgttccaagtaacccttattttacttaatggccccaaagtgtaatactaatgctggcaattttgatatgccagagagaagccataaagggcttcctttaagtcaaaaggtaaaagttctcaacttaataagggaaaaacagggacccctagaggggggactgaggaagggggagaatggttgaaaaatttaactttgagtactatgctgagtactactgtaatgggatgattaatatcccaaacctcagcatcatgcagtgtacacagataacaaacttgaacatatgtacccccggaatctaaaataaaggttaaaaacaaattaaggaaagaaaacgtaatcctgtcctgtggttgctaagatctaccctaagaatgaatcttctgtgtgtgaaattgtgaagaaggaaaaattcatactagttttgctgtcgaatttctaactgcaaaagttacagcaacagtgtgtgataactgttcttacagtatgttgttatgttattattgttaatctatttctgtgcttaatttataaattaagcttcacagccaggcatggtggctcacacatgtaatttcagcactttgggaggcgaggtaggtggatcgcttgagctcaggagtttgagaccagcctgggtaacatggtgaaaccccatctccacagaaatacaaaaatttactggtcatggtggtgtgtgcctgtagtccaagctacttgagggggctgagggggttgtttgagcctgggaggcagaggttgcagtgagccgagatcatgccactgcactccagcctgggtgacagaacaagaccctgtctcaaaaataaataaataaataaataaaaattaaactttatcttaggtgtgtatgtataggaaaaacatagtatgtataggattcagtactattctttgccagtttattataaaggatacaacttaggaacagccaaataattgaagagatacatggggtagggtatggctggagtggagtgggatcgggtaaggtgtggtggggagctttcatgctctctggtatgccaccctcccagcactaggatgtgtttgccaacccagaaactacaaatctcatgtatgggagtttttatagagctcagtctctagctcccaaccctcctctttcttcctagaagtaggagattggtgggtgggattgaaaattccagtcctctaagccagcatggtggtgagcacctgtagttccagctacttgggagactgagacagggggatcagttgagccgtccaggagtttgagtccagcctgggcaatatggcaagatcctgtctcaaaatagaaaaagttccagccctctgatcgcttggtctttctggtgactagtccatcctgaggctatctagggatcccactctgtcacctcattaaaataaactcaggtataatcaaaaggggcttactatgaataacagaatacactcctatcacttaataaatcccaggagttttagaagttctttgacaggaaaatgaacaaatgtatttttgtattatactacatctgtgctgatacatgactttttcattttatttatttcaactaattgaaattgaaacttaaaacagctacatgactagtgactatctattaggcagtgcaaccctatacaattataaagttcttttttttttcctactgtcttctgccatccagcactaaactatgaaattttgagaacagatttttcaacattatactttcagagtttcttgcttatgatagaagctcaaatatatttagcagtggattcagtttagcaaataattattgagttctattttctgattagcttttttggtgggaacacagaggtaagagaaacataatcccttgctgccctcagattgcttacagtctagtgatgtaaacaaattagagtggcgtgtaataaaaatgagtgttgttgcacttagtccatggaattgtggaacggttaggctgtttggatgagtcagggcatagtacaatacttgaggtatagtgggtgggtgttcagtaaatctcactgaatgaatgaatgaattatagcctcagttctaccattaactggcttcttggcaagtctcctagtctttgagccttaatttccttatccctgaaatgggaatgatgtgcatattttagggtcttgagtttttttgactgggaggaccatgtttcattaacgcttggatatatttttgcctataatatagtttaagcgtttagtaaatgttttagtgaatccttaatcccaacaagaataaagggtgttaaaacactttcacgaatgtgcttatattattgtcatataccattgattgggagatgaattgacttaaactgtggagagggaattaagattacccaagggtaacagtgaccttttgttttgacatttttttggctgcagctgtcctctaatgatttgagattttcacttctttcctttattgccagtggaagttgtggaagaaattaatgttgaacctaacgcagttggggtaacggttttaaggggactataatgggctcactctgttactctcatgtggtgattgaggagctagccctttccaagttgtcaggtttcgtttttttcctgtttttaccagcagacactcagatgggactaattctgtttaagtgtcatgttgggtttattgaacttgatgatggacttgatatgcctcttgggcatttatttatggcttgatgtcagaaatccatgcacaggttgctctgaagagctccctttggtgtagcgtgggaagcaaagcatttttgtttgtttgtttctgtttgattttggagcatatgctagaacagaattagatgtactttcctctatttgtaggtaagttcatctttctcctttttttaattgtaaggataatatagattaataataaaaatggggaaaatattggtatgatgtaggagacctgataaactcatatttgaattgcacttctgttatttatcagccttgtgatcctggataatttatatgatttctagatgattttttcccatgaacctttgtcaaagaggattaaatgaatggatggatgtagtatatatagtgaggtactcagcacaaagggaaggggcctcaaatattttatatggtgtcctctactgcatacacgtcatctgacttttggtggtgtgtccatgttaacaatgaagtctctcccaagaattcagactgctttctgagaatgaatctagtcatgaatccctcccatacagagtatagtttcagccatagatagaaataaaccaggtaattgcctataaaacagactgaagagatgggagcactcaagatgcaaacaagataatctgggtgtaattccagggaaaagggattggaatgaaattgtaatttaggagactgaaatctagttgattgtatcataatattcttttttttttttctcttgagacggagtcttgctctgtcgccctggctggagtgcatttgcatgattatcagctcactgcaacctccatctccggttcaagtgattcctgtgcctcagcctccctagtagttgggactacaggcaagtgccaccatgcctggctaatttttgtattttttttttagtagagacggggtttcaccatgttggtcaggctggtctagaactcctgacttcaagtgatccgcccacctcagcctcccaaagtgctgggattacaggcgtgagccagcgtgcccgtcctgtatcataatattctaccgagggagagattatgggaacaagcagggggttgtcagcttaaaacatggtaaacatagtaaaagacaggctgagtgcttgaagttggcagagtttatcttgccttatttatggcagaaatgaatctaatgataggaactgtagagatggattttttttttttctttgagatggagtctcgctctgttgccgggctggaatgcaatggctcgatctcgggtcactgcaacctctgcctcccaggttcaggcaattctcctgccttagcctcccgaatagctgggactacaggtgtgcgccaccatgcccaactaatttttgtatttttagtagagatggggtttcaccatgttgggcaggatgctctcgatctcttgacctcctgatccgcctgcctcagcctcccaaagtgctgggattacaagcgtaagccaccatgcccggccgagatggatttttttatgaggaagtgatagtacactaaaccttcatggacaaaaaaagtatctcaaaatagttgtctcccttttgttctgattccatgtggaagcaatttctgatcactaatgatcactaatgtaattgttcaggtatttaatctgaaggcagcagctagtttacctagatgaggactgagaaccttccaggtataaggaaagtatatcttgtattgtaaattaataaactggtgtgtgtctctctctgaaccagtcactaaactgacagtctggttaatgtattttagtatataagcatctgcatgctaaagactcctgcacttatatctacagttcatacccttcccctgagctacagacttggatatgcaactgcctacctgacatttgcattcaagatcgagggcgagggctagactgtgtcttttgtttaattcactgcataagctaaggccttttggtaataagccattaatgtctcaactttaataatcctgtaccccgttataactatttttatgtttccttttggtctatgtccatatgaggcatagtttcacattatttcatagtgtatatattatttaattataaaaatatataaatttttatgattggaaataatgcatgctcatcatagaaaaatagagggaaaaacacacaatggaaaatgatcattatgtgctattactaccatacagagataggcactgttaacattttggtgtatttcttttttttttgagatggagtcttgctttgtcaccaggctggagtgtagtggcatgatcctgggttcaggcaattctcctgccttagcttcccaagtagctgagactacaggtgcctgccaccacacctggctaatttttgtatttttagtagagatggagtttcaccatgttggccaggctggtcttgaactcctgacctcaagtgatccacccggctcagcctccgaaggtgctgggatcacaagcatgagccaccgcgcttggccaacattttggtgtatttctgtatattcacatatgtgtacacaatttaatatgttgagattaagattatactgtatatttaaaatgtgtagttttttgcacgtaatggaccttaaacatttccccattaaaaaaatattttctataaacatttaatggctttattctgtcattcagatgtaccacataatcattttaagttgtttccagtttttcactgctaacgcttctagactggtcatgtttatccaggagagagctacctgtaccaaaaataaaataaaataagtacaataaaataataaaatagaatttaaaaaaatgccgggtgcagtggctcacacctgtaatcccagcactttgggaggccagggcgggtggatcaagagatcaggagttcaagaccagcctggccaacatagtgaaaccctgtctctactaaaaatacaaaaaattagccgggcgtggtggcaggcacctgtaatcgcagctactcgggaggctgaggcaggagaatcacttgaacccaggaggtggaggttgcagtgagcagagattgtgccactgcactccagcctgggtgacagagtgagactccatctcaaaaaaataaaaaataaaatacatatgtgtgtgtgtatgtgtgtgtatatatatagtttactctcactgactcttagatatactctaaagacccatggaaattcagttgtagcataaaataaatacatttatagcgtaaaagagcaaaatatttcaaattaacttgcttaagctacttaaagacaaaaaaagttcatttgaaatcttttgtcattttttcactggttatatggaatcaggtgagagaaggacaagttttgatgccattatttctatgtggtactccagtaaatagactttctgttttagggaagaagaatagtgttccctcaagtatattaggttcaacattaatttccatcataactttcattagcaatagaggaaagagatgaattttaaccagtagaggacagttgcagccaaaaacaagtcaagatgaagggcttcccctttatgggatctgaatttcctcttcaaactttaaaattaggctagttggctcattacatcataggggaaaaaaataaaccccatttgcatgaatttcaccaaatttggagattgtgtgttgatctaaaattaaaaacataatgtatataaaacattttagaggccccagagttgtttagataggtaggctatcaacctccagaatcagcttatgtaggtatgtgggatgtagtgatgatggatagagaaagtagtggctcccagtaggagctctaaacagaaagggcaggtattttgagtttcaggcatctgcaggcatccatgtgcatctctctctctctctctctctctctctctctctctgtgtgtgtgtgtgtgtgtgtgtgtgtgtgtgtgtgtgtgtgtgtgtgtgtgaaagagagagtgggagaatgagaatagaggtggataaatttcccaagcaacttcagggagggcagttattttagacaggatgactgatttttattcattcagagtaattatttatgttcattttctccagaattgaagtaatcctctattattatttattatcgaaaataaatgaaaaggttaacttgtaatactataaccactgttggcatttcaagtcatttctttctaatttttaaaatgtttttaaagcatttgtaatcatactgtataattttgcattatgcttttgttatttagtatgggaaaatgctagatacctacagtacttgatacataataggcactcaataactatttactaaagaaggaattattgacttgtttaaaaatcttttgaatggaccatcaagcgactataccataattgacctaattgttatcctttgttgtttctaaattttcctgtcttaaaaatacattgaatattttgatgtaaatcacttttcctgaagcatatagtttttcctatgtataaagttattttcttaggacaggttcccagaagcaattaggggtcaaataaagtattagaactcttggttgcaaggggcagaaacttaattgggaaacattttggccaatcttgtcaggggcttccaggataactctcagttatgtttctcagttatgtttctgccccttgtctctttcctctattgctgggacttcagcctttgctgtattgggtgctcagtttatactcccagggctttgcttcttgtttaccagtgctcttctttgcttttctctggcagactcttgccatctggtggtaaagattggctttggcaattttttgtagtttacaatcctgatttgtatatgtaaaatgtaataagcaaggtggttctcccaaggaaaggattttggacagacaggaaaaggatgtttgctataagtgttttattaaatgttattaaaatattatttgatttatttttgagacaaagtctcgctctgtcacctaggctggagtgcagtggtgccatcacagcttactgtagccttgacttcctgggctcaagccatcctcccacctcagcctcctgagtatctaggactacaagcatgcaccaccacatcctattaatttttctgtaatttttctagagatggggtctcactgtattgcccaggctagtcttgaatacctgggctcaagcagtcctcccaaagtgctgggattacaggcctgagcttccatgcccagcaattatttcattttaaattatttttattaaatgtgtaatagtttattagtattttatcattcttgatagccattgatagtgacttccaaaagtttattctagccttagtaatagttcttattttactatcctttcaccacattgaatattattttctaaatactttgctaatttaatggattaaaaatagtagcttgtttatatttccttttttaacttaacgtctatcataaatattttttgtaattaatttaaatggctgtttacttttttattccacagatttactatgtttgccatgctgttttccagttattgttcattagggttgttttatggttcttatatattttttaacctctgtaggtaataataccgcaagttatttatgtatttatgtatgtatgtatgtatttatttatttgtgagatgggggtcttgctctgtcacccaggctggagtgcagtggcgcaatctcagctcactccaacctctgcctcctgggctcaagcagtgctcccacctcagcctcttgagtagctgggatcacaggtttgcaccaccacgcccaggtaatttttgtatttttggtagagatggggttttatcatgttgcccaggctagactgcaagttatttcagctctgtaagttttttggctcttgtgagtttttcctttgaaaaaattctattgatgatattcttgcatcaaagataaacatctttatctttttgctttcaaataattttaccaacttatatttctatcagtattgtgtaactacagatattttatcacatctttactaatatggagcattacattttttaaattttttgttttttatttttaaaataagatttacaatatttaaaaaatagagatggggtctcgttatgttgaccaggctggtctcaaactccttgcctcaaggtattctcccatcttggccttgcaaagtgttgggattacaggcgtgagccactgtgcctggcctattttatttacttatttttttgaaccaaggtctcactctgtcacctgggctggagtgcagtggtgcagttgcagctcactgcagtttcagcctcctgggctcatgcgatcctcccatctcagcctcctaagtagctagagctacagacacgtgccaccatgcctggccaggtttttttttttttgtattttttgtagagactgggttttggcatgtttcccaggctggtcttgaactcctgagctcaggcaatctgcccgcctcagccttccaaagttctgggattacaggcatgagccactgtgcccggccactttgagcattattttaagaatgtttgttggttgattgggtataaaaagcagtctcaatttgcagttttaagtttcacgcttttcagtaaaaattttcatttttcccttgcattccccaactcttaccttcttatccagtttagagtataaataccagatatgccctctgctttacgttatttcttcttcttgtgcccaggtctggtccatcgaactcatatgtcatcctgtcgggtggataagccctctgagatagtagatgttggagataaagtgtgggtgaagcttattggccgagaggtaaagttctgtgcggctcccttgtggttagaaaggattaggaagagctgggatttttgatattttatgatagtgagtgtgtaaattttgttaattgtgctgataatcttatttttaaatcctgccattagaatctattctgaattcaaaccttctggtagactgtcctgcaaactcagaaggaatgatatgagctataaaagtgtggtgcaataagtgcacgtttgtaaaacttccctccctgaagtttacccatagggtgggccggaggagagaaaaaagaaccaaaaagagagaaggaaagttgacctatgggacaagtgtttatcacagacttcaaagaatacctgccagatacacttcagtttgggacaaaacaaaaagaacacagatagtttacagtcattttccctaatatctggcaccatgcaatgtgcagaaagtgaaaaaaatctgaaggaccctgttactcacttgagggtatgagggctgtgggtgtgggccgaccacaggagaaataagagcatacactgagtcctgttctaccagagacagcacaggagataggcatgaaagaactattattcaacaatatttaagtgcttaatatgtgctaggtttgggagatataagagcgaaccagacaaaaatgatcccagctattatggagttaatatagaatataagtagagacaatttttctttcttttttgagacagggtctctctttgtcacccaggctggagtacagtggtgccatcacggctcactgcaacctcagcctcctgggctcaactgatcttgccacctcagcctcctgagtatctgggactacaggcacgcaccactaaacctggccttttttttttttttttttttaatttttttgtcaagatggggtctcactgtgttactacccaggctggttcaaactcctgggctcaagtgatcctcctgcctttgcctccccaagtgctggaattacaggcatgaatttccatgcctgaccaagacaaatatacataaaataattgcaagttatattaagtgctatattgggttcaaacactattggaagaagatttctagttgtcaggaaaggactctttgaggagatagaatatgagctgagaccttaaagaaaaggaactagtcatggaagacttgggataggaacattccaggcagagagaataactgatgcaaagaccctgaagtgaagaagtgcttcatgtgctgcgggaagcaaaagaagaccaatgtgacaaatgtcttcatgcttaaagaagctctagaccaagtccagaaggagatctagtctcttgaagtattcaaaaacctattctggacttagggatatctcaacaaatcactatgctgaacttacctggaagaaaaacttttattttctgcctggttacttccacaagccatggattttttgagctaccatttttgtctttccctcagagggacaagaatgagattaagactgtttcctaaaattcttctgccacagggtctacctgttatgcttatttgtatctgcaatgttcctagcacagtacctggtccattaaagaagctcaatgttatgatgaaaacgttgactcttaattttagactggccatctaaatgatgtatttaaagtttttggtgactttttttggtctctttcagatgaaaaatgatagaataaaagtatccctctccatgaaggttgtcaatcaagggactgggaaagaccttgatcccaacaatgttatcattgagtaagtaaaaggtttggaaaggtgaaaattcttctgcctcccaaatcataaaatggtttagtaaatcagactgaactggtaactctaccatttatggactttgtgatattgataagttacgtaacctttgcaatctttggtttttagaaatgtaaaatgaagttagaccaggcgtggtggctcacgcctgtaatcccaacactttgggaagccgaggtgggcggatcacctaagaggtcaggagtttgagaccagcctggccaacatggcgaaaccccgtctctactaaaaatacaaaactagaaatttgctggatgtggtagtgcgtgcctctagtcccagctactcgggagactgagtcatgcactagagtctcttgaacccaggaggcagaggttgcagtgagctgagatcatgccactgcactccagcctggatgacagagtgagactcggtctcaaaaaataaaataaagtaataaaataaaaatagttaacaccttgctgcatagagttctaagatgaaacgttaacgtaccaagctcctggcattggagtgctccatcaatggttttgtttcctttcccttaatctctttctgtttctgccctttaacgagttagctaataagcattcatgaagaactattctttacctctctcccagtgatttctgcaggtggggttacgtgggtctcttccacatagagaccacgtggaagggtagagtaatccaggaacaactccagcggggtttagactcccacatcttgggatacactgtgctctgaaaacaacatcttactttcgttggctcttctgacctttcatttaggaatgggaaattatctatgtaggacaatgtctggcaatacaaggaatgttctgtctgtctcaagtctttcttggatttcttttttttttttttttttttttttgagatggggtcgcccaggttggagtgcagtgccataatcacggcttactgcagtcttgacctcccaagcccaagctatcctcccacctcagcctaccgagtagctgggactacaggcatgcgccaccacacctaatttttattttgtagagacagggtctccctatgttgcccaggttgttcttggacacctaggctcaagcgatcctcccaccttggtctcctaagtgctgggattacaattgttagccaccatgcccaggcttctttcttaaatttctcatcggaggttcttggatccctaaagtctcttaaagggggatcttggagggttttttttttttttttttttgagacaagtttcactcttgttgcccaggccggagtgcaatggcacaatctcggctcaccgcaacctccgcctcccaggttcaagtgattctcctgcctcagcctccacagtagctgggattacaggcatgtgccaccatgcccggctaattttgtatttttagtagagatggggtttctctatgttggtcgggctggtcttgaactcccgacctcaggtgatctgcccgtctcggcctcccaaagtgctgggattacaggcgcgagccaccgcgcccggcccttggagggtttattaactgtttttagtgttttagaaagccatccaaaattctatgtgtgtcctcaggttaaccatgctgttattttgttgcttttgatgataaaatatcacattgtttgtcttatgttaattaggtacgctcaatgacaattatgtcattgatgaatttaaaagacaagaaaaatgatagaatgttatttgagtgggatcttattggtgaaaagtttggaaagccttatgtttatagttctgagcaaaatcactttgaatttgaaggaattttatctggaagtaagggaaatgttattgaatacatactgcagtgccaggcattttatgtacattcttgggtacataacaacctgcaaagtggatgttatctccattttaccttatattcctactttatagcttggtgcctggtgataagtaacttacctgtggttacatagaaaattatcagggactcaaaactcagtctctctgaccttaaagctaatgcccttttcaccacaaaatgcttctcactcttgcatgtgacttacagaacttttcatatttctgtggtttagtctctaaatattaacatgtttgtaaggctgattattgacaaaatactgtcagtaatagtaggaatcttttataactcagagtgcagaagtgtttaaatctggctgtggttcaagttagtgttgggaaaaggaaaaagaaaaaattctgatgattgcattgtaataaatagcttctgctccaaaaaatccaatgctatatggactcattaaaaaatagtgaaatttcccaaagccacccttacagtgataaaatataaaacatgtaagataaaagagctaaccctgtttctcagaaaatgggtagggaagggaaagggctccctggttttgggctgtctctgtgtagaactatttttagtaataatcaagtggctgaaacagtaacttttgttgtaaattatgtctatagctgcatccaggaaggaagcatggcataatggaatgattagaggatttagagctagacttgaatcagaaagagtactggttctgctccaaactaatatatgactttgagcagattaattagtctatctgaatcttagcttctttactataaaaggagacagtaacatatatctaaggaatgcttgagtgatttaagtaaaatcttatttgtaaggagccagcttcatgtctagtctatggtagacatacatgtagctacttgtagttattgttttaaatgccgctttgttttatcctctaatatctgagattatagcaccttttcttttttcctcatactatggtgtacggaaccacacctttgcttttgaaagagtgtgtgtgtaagacccacaaaaacagagaccatgacttgtctgccattgtgcctgatgtatagcatccatagtattcatttagtttttttgagatggagtctcactctgttacccaggctggagtgtagtggtacaatcgtggctcactgcaactctgcctcctgggttcaagcaattctcattcctcagcctcccgagtagctgggattacaggcatagtccaccatgcctggctaatttttgtatttttagtagagacggggtttcaccatgttgaccaggcaggtgtcaaactcctgacctcaagtgatcccccgcctcagcctcccaaagtgctgggattacaggcatgagccactaccgctcagccctagttagtactttcatttactcatttgttcaacaaatataaggcaacttgtaataaatactaaaagagtagtttaaagcagttgtccccgacctttttgtcaccaaggactacttttgtggaagaccaatttttccatggatagggggctggaatggttttgggatgaaaccgttccaccttagatcatcaggcattaaattctcatagggggtgcgcaacctagatccctcacatgtgcaggtcacaatagggtttgcactcctatgagaatctaatgctgctgctgatctgataggaggcggagctcaggtggtaatgctccttcacctgctgctcacctcctgctatgcagcttggttcctaacaggccatggaccagtagcagtctgtggcctgggggttagggactccctgtttaaagaaagggttctaggaattcacttgaggaggaatagtttacttcaggccttgatggtcagagaataggtggtatttgagttaggttttgaagaacagataagatcttgtcagacagcaggggaaggaatggtatttcaggcaaaagaaatggtttgaggaaaggaatgaggcagaaaagcacatagtacatttgggaaccttgtttaaggaaagaagaggatatggtcaagtactagaatggaaggcttgaaagataatttagggtcagattgtggagagccatgaatatcagttaaagaatatgaatttttatttatttattttttgagatggactcttgctctgttacccaggctggagtacagtggcatgatctctgcctcccaggttcaagcaattctcctgcctcagcctcctgagtagctgggattacaggtgcccaccactgcgcccggctaatttttgtatttttagtagagacggggtttcaccatgttggccaggctggtcttgaactcctggcctcaagtaatccgcctgccttggcctcccaaagtgctgggattacaggcgtgagccatcacacccagcccatgaatttttttaaaaaagcctttggacagagaggcttctcgtcagattaacctccccaggaatcccattgtctggccttgccctgttatgctcagtattctcatcctgtcttcagccatccatagtttgttagccacctttcattttccataaaaatctaactcttatattcatcccctcaggtcccaaagtgttaatgagataatctaataagtgactctgtaaatggaaaggggctaaaagcagtttccaattaggcatagcctgcaaagtacagtctttttcttttttattatgatcaagatcagaattgagtgtagtatataattttttttttttttttttgagacagggtctttgtctcccaggctggagtgtagtgatcatagctcactacaacctcaaattcctaggctcaagtgatcctcctccttcagcctcccaagtagccaagactataggtccatgccagcatgccccactaatttttttttttttttttttttttttgagacaagagtttcactcttgttgcccaggctggaggcagtggcacgatctcggctcactgcaacctccacctcctgggttcaagcaattctcctgcctcagcctcccgagtagctgggattacaggcatgtaccactatgctcggctaatttttgtttttttagtagagacggggtttctccatgttggtcaggttggtcttgaactcctaacttcgggtgatcttcctgtctcggcctcccaaagtgctaggattacagatgtgagccaccatgcctggcctaatttttaaattttttgtagagatgacgtcttgctgtgttgcccaggctgatcttgaactcctggtctcaagtgatactcccaccttggccttccaaagtgctgagagattataggtgtgagccacaactgctggtccatagggtagtctttagaaaaagcacatatgacttaactctgttaaaatttttcatttgtatgtctccctccattgccagactattagttctttccagaaaagaatcatgttttgttcgttttggtatacataattattactatcactagtattagcactggcgttatccacttactagctgtactgaaaaaatgagattaatctcagaatctgtgctgggatggattggaggaagaaaactggaggcagggagaccagtgagggagttattactctagatgaaacatgatgggagcctaaactagaatgatggcaatgaggacaaaaagagagacgtgggtgactgacacatttgttgaattgagtgttaagtgggaagtatgatttggtttgtagtctggtagaagccacagagtattggaattgattgtcatgggggttgcttaagctgcaactcacagccacttgaaactcatctctacaaatagataggtgaaagcaaaaaccatgtttgtgagttccttgagttatgtcctcaagtttctgcctttgttatgggtttttttttgttgtttgtttgttttggagacagggtcttgctctgtcacccaggctggagtacagtggtgcagtccgctcactgcaacctcaatcttgcaggcttaagtgatcctcctgcctcagcctctcgagttgctgggactacaaacacaagccaccatgcctggctattttttttttttttttaagtaaaaggaatctgtactgttagaaattagaattgtgattacccttgggggaggcaggtaactagaagggagcatgagatgggcttctgagatgctggcaatgttctgtttgtttgtttgtttgtttgttttgagacagagtctcgctctgtcgcccaggctggagtgcagtggcgcaatctcggctcactgcaagctctgcttcccaggttcatgccattctcctgcctcagcctcccaagttgctgggactacaggcgcccgccacctcgcccggctaattttttgtatttttagtagagacagggtttcaccttgttagccaggatggtctcgatctcctgaccttatgatccacccgccttggcctcccaaagtgctgggattacaggcataagccaccacacccagccttaatgttctgttttttgatctgagtactggttactttggtatgttcaaattatgaaaaatcaagtgagctgtatacttatgacagacatttatatatatatatataatataatatatatatatatattagttctcacactgctataagaactacctgagactgggtaatttataaagaaaagaggtttaattgacttatagttccactgcctgtataggaggcatggctggggaggcctcaggaaacttacagtcatggctgaagggtgaaggggaagcaagcatatcttcatatggcggcaggagagaaagagagagagagcaaaggggaaagtgccacacacttttaaaccatcagatctcatgagaactccctcactatcacatgggggaaatccgaccccattatccaatcacctcccacaaggtccctcccccaacactgggaattacaatgtaacatgagatttttgtgtgtgggggaacacagagccaaatcacatcaacatatatattatattttggtaagaagtctaaaaatgttttaaaaggctatgagaaatgcaacaaagagattaattctgtctgaggggctcagaggaaaagacttgatagaaggagagctagtaactgaactgagccatgaaatgtctaggtatagtgaagtggtgaggtgagagtcaagtggggaaacagagcatttcagagagggggagaactgcctgagcaaaagcactgagccacatggataagagaaaatagacttctttggccagagcatattgtgtgagtaaagatgaggctggaaaagtagtttagagacaaactgtgaaagaccttgaatgccaaggtaaagaatttggagctgattttctagaaagcctttgaaggtcttttaaacctatgagtgacctggtaagggttgtagggtgtttagcatgttgagtaattatatattttcatcctctgtgcattagtgagatgaaggttagtctcattcgtaattgttaatttagggctatttcacatcattgcatttactgcctgtctcgttctgtcaaaaactttctttctttctcccctttccctgccaaaaacaaaaaaccaacatacaaccttaccttgtagtatctctggccatatctcttaagggggccggcagtcggtatctttttcattataggcaagaagagaggcggaggcgatccttccaggattacactgggcagaagatcacccttgaggctgtcttgaacactacctgcaagaagtgtggctgtaaaggtagggtgaagcctctgccctttccacgtttctctccttgtggatggacccttttctggaagaaggaggcagcccagtgtgagtttagtttaccctgttttttagccaagtgatggcctttgctgttttttccaccagactcacatcagagttcatggggtgatacattttctgttttcttttctgagtgctggccctaccagatactataccactaccaccactcctcccaccccacccacagcatatgccttgtctgggcaagacccccatgaactatgccaggaggagtaagagtgttggattatgattaacactctaattttatctccaaggatgatgattctgcaaaaattaagcaacttagacatatataacttaaagatccaagtcagactctcatctttatctctttaatgtcagagttctgaatacaatatctttttacaggatattgaataaagaatacaggatagtcacttctttttagctctatttcctcaggtttcctctactcttactcaaattttaaaaggtctttcagcctgatccctagttggagctataatgagagagattgccagcttctcattttcaggttgacctcaattgtcaccccttctccctagtcttccgtctaccctactgtgtgatttttctacaataactggtagcagatttgtgccctggttgaagttgtggggttttaagcccctatttatcattagcatagaggggagaaggaaaaaataaaattgagagaaagaatacctcctcaggaaaactgtgggaacattccaggtatttggaaaactctgctatatttccctgccaggtgccacccagctgttggacccagaggtacagagtactttacagatagctttttttgttgtttttaaggtagggtcacccaggctggagtgtagtgttatgatcatggctcactgcatctttgacctcctgggctcaagcaatcctacctcagcctcctgagtagctgggaccacaggtgtgtaccaccatgtccagctaatttttaaaaattttttgtagagacggggtttccctgtgttgcccaggctggtctccctgggctccagtgatcctcctgcctcagcctcccaaagtactgagattataggcataagccactgtgcccagcccacacatagctttttgattatctcatacaattcctctgtgcccctaagacaggatctaccacaaactcagacacaactagcagtgtagagcatagcatctgttaaagggcccctcagtaccactataggctcagtgaaggtgggggtcttttaaccttaaccgtgtccaacaggcattacataaagaagagaagaataatgagaggtggaatttgtcccagttagtaaaggtcaggtcaaaggtagttggttttggtgcagcagaaagcacagggcagggaggcatgagacccaggataagtttgaactctgcttctgtctatatgaccttgagctacttctcaaatctgggctttcatcttctacaaatgtaggatggatttaatgatttccaaggtgcttgccagacctgacagtctgtaaatgttcagtgcccctaggtgactgtgcctatttctctgtgtgttagcttagatgtgagtgcccacttgctaccagctacctacaagctatattcctttagggcttggcctgccactcagctccttctgctaaacatcctgctctctggagcagtctttgattgtcaggaatatgttccaaaatagatcttaaaaaattaataagccccattgttaatggagggcagtaaaaacctgcatcctcatatcctttgccatttcgagaacagtaccagtgttccccacagccctgagaccagctgctagtctggctgtggttgagtgagcagtgtcatgttgaggtggtagaaaatctaccctgaatcaaacagctgctttgaatgaactcaacaatatttcctgagccagctagcccatttcaggagacttggggaaagattcacttgctgagaagagagactacttcctttttctataccttttctacttttcttctgcaggccactttgcaaaagattgtttcatgcaaccaggtgggactaaatactctctgatacctgatgaggaagaggaaaaggaagaggcaaagtcagcagagtttgagaagcctgaccctacaaggaatccttctagaaaaagaaagaaggtgaatgctactttgcttttattttatcatgtctttttcaagttttaagatgaaaatctgaaaagcctcatgcagcagtacacacctgtagtcccagctacttgggaggataaggtgggaggattgctcgaggccagaagtttaaggctgcggtgcgctatgattatgcctgtgaatagccactgcattccactctgaacaacatagtgagacccaatctctaaaaagaaattttttttgttaaaaaaaaaagaaaaatgaaaatgtgctttttgcagaaattttagaaatactgaaaaacataatgaagcaaaccaagatcttctgtaacctttctacccaaagagactcttattggcattttgtggtatattctaatcttttttctttttttgagacagggtctcttgcagtggtatgatcttggctcagtgtaacctctgcctcccaggttcaagcgattctcatgcctcagccaactgagtagctggaactacaggcatgcgccaccatgcccggctaatttttgtatttttagtagagatggggggttttgccttgtgggccaggctgatctcaaactcctggcctcaagtgatctacccacctcggcctctgaaagtgctgggattacaggcatgagccacgacacccgtccacttttttctaggtaataataaatacagatatatatagctacacatacatgtaaatacaaaattgtggtcatactagctatagtttatacctttttttcatttcacttatcaaaagcatttcctagtatccttaagtgttcaaaaacttgatttaagagcaacataatattctaccctatggctgtatgatgatatatttaattatttttgtattactggatattttttattacttccaacctaaatttttggccacatctcttattgttttcttggataaattcctaagtaagattactgagttagggctttaacgctcttgatacattttatcaaattgccttccagaaaatacttatctgtccctagcagtgtatcagagcacctgtctcactgaattccatctcctatatctactatttatggcagagcaattcataaaacagatattattgtggtccagaaagaaacagtgcatttgtagcatgctacacagacaataaaaactattctgtaggttgatcaggaaatatttcttctatcgtgtaggatttttctaactatggccagtatattgacttttgtttcgtttttaaatctttggcaaacttttgttgaggggtcattttgtaccaggcattgtaactctaggaatacaaaaactgatgaggtccttgccctcagtggttattatctatagattaagtattatcttaattttctgggtgaggaaaagttctctataccattacaagaattagccaagtatatgaataataatttcccaatctatatattctctttctcggtgatcctatccctcctgagactttagctgcattattgacttccacattcttaactaggatgccatgggtacctcaaactttggctggagtcagtcaaatccagacttgaggctcttctgtgctatttactagctgttaatttggggctttatttttgattttctttttgttttttgagatggagtgtcattctgtctcccaagctggagtgcagtggtgtgatctcggctcattgcagcttccgcctcccaggttccagcaattctcctgcctcagcctcctgagtagctgggactacaggcgcaagccaccatgcccggctaatttttgtatttttttagtagagacagggtttcaccatgttggccagggtggtctcaaactcctgacctcaagtgatccgcctgccttcgcctcccaaagtgttgggattacaggcgtgagcctccgcgcctggcaaacttccgttttttcattttcgaagtgggattgttgtgatctttgatgacaatgttcttgcagagggatgcctgactcccaaaaataagatataaagcactgacaagtaagttcctaattagagttggctgttatgacagccctaattatcttttttagtcctccttcctaaacatacacacacacactaccaccatcaccagtaccaccaaaacccttgtttctacctttctatcatatattattacctattaatgtcagcaatactctcccagtctcccaagaaagaaaccaatgtcatttattttcctctccttttccatcccacatctagtcagtcaccaagtcctggcagtggtgccttttaagtgcatatctcaaaattgtttatcccattcccattcccactgctactgtacagtttatcccctcacttctcttacagtcagactattgaacgctgtggcctagggagttttaaaaaatacatatttgccctctacctcttaggtaccatgtttacagggcctaggtctgggcattttttttttttttaaagcaccttttttggctgggcatggtggctcatgcctgtaatcccagctgaggctggaggatagcccaagtccaggagtttgagaccaacctaagcaacatagggagaccctgtctctataaaacatagagaaaattagctgggcatggtggggcacggactgtggtctcagctactcaggaggctgaggtgggaggatctcttgggcccaggggtcaaggcagcagtgagctgtgattatgccactgcgctcctgtccgggcaacagagcgagaccctgcctcaaaacaacaacaacaaaaccacctactttatgtcactgcccacttctgttcattgttgatttctcaccctatgctttaactctgaatgttggagtgttccaagggaatctcatcctgtcctatggttttaaatatcatccctatactcataacccccaaattaagtgcttgtgtctgtattttatccaaatctgcattgctattcttgactttttctctggaactccaaatttagttaatagactgcctacttgacgtctacatctggttgtctagttagcatcaagtttaacatacctccaaaacttaattttcctagccaaagctgttctttccacatttggccctgtctcagtgattggaactcattgacccatttgataagccaaaatctgcagcctttttgtatagtgttttttgtttgtttttatggtaaaatacacataacataaaatttaccattatagaagtgtactgttcattggcattaaatacattcatattgttgtacaaccatcactgtctttgatctcgagaactctctatactcattaaacaataacgccccccattcacccttcctccctgcacttgcaaccactgttctactttctgtcttgaaaccatgtggtatttgtttttgtgactggcttatttcacttagcataatgtccttaaagttcatctgcatcatagcatatgttagaattttcttcctttttaagcccaaataatattctgttctatgtatttattttttgaagcagggtcttgtgctgttgcccgggctggagtgcagtggcacaattatgtctcactgcagcctcaacctcctgggctcaagtgatccaggagtgtgccaccacacccagctaatttagtttttgtagagatggagtcctgctatgttgctcaggctgatcttgaactcctggcctcaagcagtcttcccaccttggcctcctaaagtgctgggattacaggcatgagccaccacatcgagccccattttatgtatataccacattttgcttatccatttatttttggtgaacacttgggctgcttccatattctggctattgtaaataatgctgctgtgaacatggatgtataaatatctctgagaccccactcttctttctttttggtatatacctaatagtagaattgctggatcatatattctgtttttaatattttgaggaagcactctgtttcccattgtacgttcccatcaataatgcacaagggttcaagtgtcactacatccttgccaacacttattttctgggttttgtgttttttggagagtagccatcctaatgcgtgtaaagtgacatctcattgtggttttgatttgcatttccctaatgattagtgatattgaatatcttttcatgtgcttattggccatatgtatattttctttggagaaatggctatttaagttctttgcctattttgcataagcttgtttattttgttgttgttgttgatatgtaggaattttttatatgttctggatatcaatcccatcagatatatggtttgcaaatactttcttctaatctgtggattgtttttttactctgttgatagtgtcccttttttccctatcagatttagactttttaaaatagtggtaaagaacatataacatttaccatcttaactatttttaagtgtacagttcagtaatgttgagtatgttcatgatagtattcattgcacaaaaaaattttaatcttggttaagttaaacttacctttttttctcttattgctgatgcttttaatgtcatactcaagaaatcattgccaaatccaatgtcatgaagcttttcccttatatttttctaagagttttgtagctttagctcttacgtttaggtctttgatccattttgagtttatttttgtatatggtgtacagaaagggtccaaaatttctttgcatgtagatctctagtttttaaaacaccataggttgaaaagactgtccttttccccactgaatggtcttggcccctgttgaaaatcatttgaccaaataagtgaggatttattctatcactggtctatatgtctttatgtcagtaccacactgttttgactactgtagctttttagtaagctttgaagttgggaattgtggatcctccagctttgttctttttcaagattgtttgggctatttggggtcctttgaaagatttcatatgaattttaagatagatttttatatttttgcaaattctgatagagattgcatttaatctgtagattgctttggatagtatggacatttcaactgtattaaatcttccaatccatgaaaattggatatctatttgtatcttctttaatttcagcaacattttgtaattttctgtatacatgtctttcatctccttggttaagtttcttcctaagtatttttttctttttgatgctactgtgtgaattgttttcttaattttttttctgattgctccttgctactgtatagaaacacaactgattttagcatgttcgttttgtattctgcaactttgctaaattcacttactcgttctaacaggatttttttgtggactctttagggttttctacatagaagatcatgccatctgtaaacagaaataattttcttgcagatttagttttttttttcttttgaggcagagtcttgctgtatcacccaggctggagtacagtcacatgatcgtggctcactgctgccttgacgtcctgggctcaagccagatctagatttttaactgtgattctatttgtatgttccaagcattattctttctcttttaaccttttagaggtaaatggtacttgttacattcctaaagagggtatatggatatctcacttctgtggatctttggttgagttctttttgctgaatatattgagtataatttgttattcctttgtttctaaagctgctttgagatatgtatttcagttcacaaaaccaattactgaggctctatctgctaggtatgaggctctttatgacctgcttagtcaacctactacccagccctccattgcctttcacttagtagaggaatggtctgatgaacaatggcagtaataatcattatacattattatttcttaaaagtatctttggccgggcacggtggctcatgcctgtaatcccagcactttgggaggccaaggcgggtggatcacttgagatcaggagtttgagaccagcctggccaacgtggcaaaaccccgtctctactaaaaatacagaaattagccaggcgtggtggcgagggcctgtaatcctagctacttgggaggctgaggcaggagaattgcttgaacccaggaggcggagggtgcagtgagccgagattgcgccactgcactccagcctgggcgacagagtgagactccatctcaattaaaaaaaaaaaaaaaaaaaaagtatctttgtgtatatgaacttctaactcatgagtcctctttgattaaaaagtgttctagggagtgtagaagggtaaaactttcctcttgatgcccactatttctaccaagatagcatttagcatcgttgtcttttcacctcattgttaatcccgtcattaccttttatgcctcatatttgtttagtgcttacagtttataaaatacattgctgtttttgtttctttttatcattatacaattctatgagatagccagaacaggaattattatcccaccattttacacatgagtaaaatggagcttcagagaaattgacgtaactcaccggaagtcacacaaatataagagataatgctgaaaaaataacccatgtcttcagattactaacaatattcttttctgtatatcacacttcaaccatttatttaactcttcaattattcatttactgaacaaatatgtattatctgcttcataggtatctagcattgtgttaggtacttgacatatcaggactcatcaagtcagtttttggtgggtttttgttttgttcccagctaccgttagccatcatgtgatgttatctattgatttgtttctgctcacaactgtaaatcaagattccagccctcctgtttccttttaccctctaaatcttggattccagcaggaggttggttttccttaacagtaaaatcttctgtctgagatggcttttttggtgtgtgagtggcagatttggacacttgtttcaggactagtcagctctgggagccaaatatggaactgagtagatttgtgaaggaacatgcctttagcagtccatgctcctgagttggacagtggagagtaggaatgcctggcgtgtggaagggcatatatgatagtaactcatgtaagttcagttaatgcatttctaacagttaaaaaagtaactcatgaaataaagatcatatggtacctacactcaagcggctaatcatataaggagaaagataagcagccaagctatgtatggtggtaaaggatagaaacacattccaaggaggttatttgattttatggacatccaaggacaggaaatgcagtgtagtcaggccacctaggactagaactggaaagtctcattaggttctcatctccgtttcttcacaagtctgtttcattacctcactttttatagtctagtggaagacaatgcaaagcctctaagaagacagaaaatggtagacctgttgaggaaccaccagaaatagcccaggataaggaaaggatgtcaccttttacaaataatgcctggtacttaataggaatacatgcactaactacctgtgaatagatagacttcataatctgtgctctctgtcattccttgggtgtcttcactcagtgaaacctgccctcagattgcagagtaataggtattgactcctgctgctggcagtgggcgataatgaaaggagcaggggcaggagtaagaataacagatcttcctaaccttgagccttcccacgtcttttcattaaaacatacatgtattgaatgccttttcccacaagtccaggatgcattgatttagttgtgtgcatctggcaccatgaacaatttttgtcccagtgactgaatgttataaataatttttgttgggcataattagaataaaaggaaactgtgtgttgcaattggaaatgggctatgaagtggttggtaaaataggaatggaggttttgtagtgaatccctggataatcttctgatgaacttgtggtctgtgctttactggcctctttcattaatcatatgccatcgtaggtctttctgaatcggtgttatgttatgaagaagtaagtgccttggggaccaagctgcccactgattatagtaaactttagatatgtttgattcagaatataattttcttttgattttaccatatgattttctgctgtaccatatatagaagaacaagaaataggaatgtcattctttggctgcagtgttggctctgtcctgctgtccagagaacttcttctggtgcctatatagagaaaggttgccagtcctgagcccactcagggacacattctctgcctattcagatacagcagagagcgttgcccagtgttgcctactcagaagccttcagtggttcgctttcttctatgacataaagtctaagttcctttaagactcttcacaatctgcccagcttcctagcatcatttcccaccagtctcttcccacacactatactccagcttcattcattaatagagcttctactgtgtgctaagctctgttctggccattgcaggtaaagtagtgaacaaaacaggtaaaatccctatcttcatggcacttagattctaatggatggggtcgattgacacagataataaactggtaaacaaatacaaaatagtaaaaataatgtatcaagtagtgataagtgctatagagaaaaattaatttgattaagggagatagggagtcctagaatgaggatgtggggagcaggtgactttcattttagataggatggtaaggccaggcctttctttttttttttttgagacggagtttcactcttgttgcccaggctggagtgcaatggtgcgatctcagctcactgcaacctctgcctcctgggttcaagcaattcttatgcctcagcctcccgagtagctgggattacaggcatgcaccaccacgcccagctgattttctatttttagtagagacgggtttctccatgttgttcaggctggtcttgaactcccgacctcgggtgatccacacacctcggcctcccaaaatgctgggattacaggcgtgagccaccgcgcctggcctgggccaggcctttctcataaagtgttgtttgagtggatatcagaaggaagtgaggacacaagctattcaggtaagtggagagagagcatttcagcaaatgtaacagctgatgttgggaaagagtgtggcatgattaaagaacattaaggacgccagtgtggctacagtgaaatgaatgaaaagagagtggtaggagaggaagttagatcagaaggaacccagatcactggggccttataggtgattgggaggatttcatctttcacttgagtgagatggatgttattagaggttttgagcagaggaatgacatgatctgacttccttttaagagaattattctggctgctatgtagaaacttagatggtcagaaagcaagagtagaagcagtgagttgatagataatccagatgatggtggcttggactagaatgacagtggcaaaaatgatgagaaaggagttgaagtgtgtatatattttgaagatataagagcaggtgaggatggcatcaaaatttttggactgtgtaactggaagatttgagttaagagaaggaatgcaggagaagtaagtgtgggagtagggagcagtcaggagtttagtttgagttgctgtctacacagatggaaagatagctgggagagtctaggtttgggagggggcggggcatagaaattgagttgcctatcagatattcaagtagaccatagagtagacagtggatatatagtttggagttcaagggagaggcccaggtaagatatataaatttgggagtcatctacatatagatggtatttatgttcatgagatcacctgcagagtaaatatagggaagagactgagccccagagtgctcaacacttagaggttatggagatgaggatgaactaacaaagaagacaggaaaggaacagccaaggaagtttgtagaaaagtaagagaatgtaaaatgtggtagaaataccatgaatgtgttctaggtaagatggtctgtatccatcttgactgaccaagtaaataagacccaataattgaccactagatttggccacgtggaggttactggtaattttgtttgtttgtttttgtagagacagggtctcactatgttttccaggctggtcttgaactcctaggctcaagagatccacctgcctttagaaaattaagtactggctgggtgtggtggctcatgcctgtaatcccagcactttgggaggatgaggcaggtggatcacttgaggtcaggagtttgagaccagcctggctaatatggtgaaaccccgactctagttaaaaaaaaatacaaaacttagctgggtgtggtggcatgcgcctgtagtcccagctacttgggactacaagcgattcaaggagaattgcctgaacccaggagccagatgctccagtgagccgagatcacaccactgcactccagcctgagtgacaaagcaagactccatcctaaaaataagtaaataaataaaatagaaaattaagtactcaataaatgttcactgctatattctcttttttcagtttttgcttttatttttgtttttctgtcacactgggctgctgctatcctgtttcagaactatagtgaaaatgggtagactagctgctctaacaagggatatgtgcttttcctagagagcagtctttgagatgtttgaccagtggcttccttccagtgcccccttgacctgcgccatgggctcacactcctatgccatttaaaaactgttttatgtttaattttctatttccatctgatacttgaatccatgtcatttttttttaacccattatcttctgtttcccttctcacttgaatgaagttgagagagcagaagcttggttcatcttctggctctcagtcttcccccaccccaactcccaactttgcttttgaactacaaccttttttttttttttgagacggagtttccatcttgttgcccaggctggagtgcaatggcacaatcttggctgaccccaacctctgcctccgggttcaagcaattctcctgcctcagcctcccgagtagctgggattacaggcatgtgccaccacgcccggctaattttgtttttgtgtgtgcgtgttttgttttgttttgttttgagacagagtttcgctcttgttgcccaggctggagtgcagtggcgcgatcttggctcaccaaaacctccgcctcccacgctcaagcgattctcctgcctcagcctcccgagtagctgggattacaggcatgtgccaccacgcccagctaattttgtatttttagtagagatggggtttcttcatgttggtcaggctagtctcgacctcctgacctcaggtgatccacccaccttggcctcccaaagtgctgggatcacaggcgtgagccaccgcaaccaggcgaactacaacttcggatgtgattgttcttttgttctgtagctcaaggctagacacgtagggaaaatgacgccatttgctggaggattggattgtctttgttcaggctgcaaaacagcttttgcatcaaagttgaggtctaggagaaggccacctccttgagcccttcttgctagctagagtccatgttccagcatgccaggactctccagtgatttgtttttatcttccctcctcctgagccttcatctttgagagagaacaaagtggaaatagtgccaaactctgtgttataaagtatagtggttttgccgctttagccttggtcgactcactttacatttctgagttgcagtttttccatctgtaaaatgggaataataactcatgaagtttgactctacagactattattgtaagataaggatgcaaaaagcttgataaactaaagcactgtttaggtgtaaggcagtattattactctcctcacttctttatccaggctggaccaggcttgcagggaactggtgccagactctgtattttcatttttactttcccaggatattcacctatataaggggcagaacccagtgaggctcctgaccccataatatcttgtgatggacttccatggtcttgccatccaggaaggttcagcaacatagctaaactattgatttgccaactctcagctcctcccagccatggttgttatagctcggtaatgtgggtctgagaagctttgttgccttctctctactccattggagatgccaaggaagaattgttatttcatcttctcttaaaactttgacttgtctcctgtagatgcttggccaggctgtcagaacatcctgggagttaatgagagaaaaatacatatagctcccactaagtgcctataatgtgtcaggcactatagttagtgcttatcttgtttaaacctcatagcatcctttgaaataggtacttattatttccagtttactgaaaagaaaactgaggttcaaaaaagttaaatcccttgttctaagtcacatagtgagttaagttgcagagctagaatttgaacttaattctatcttattccaaaatttgttgttctaatgaccataccatgaggcctcctgttaccatacagaaagaggggccatgtgctacataggaaaactcaggagatttccattcatatgatctacatgaagatcccaactgcgcctatgcgatctgggacaagtggctttcaacttgtccaagccttagatactatctcattaacttgtcaccataggtgttttttttggggagagggggagattatttatttatttatttatttatttatttatttatttattttgagacagggtcttgctcagttgcccagcctggagtgcagtggcaggattatggctcactgcaacttccagctcttgggctcaagcgatcctcccacctcagcttcctgagtagctgggactacaggcccgcgtaaccacacccggccaatttttgtatttttagtagagacagggtttcaccatgttggccaggatggtctcgatctcctgacctcatgatccacctgccttggcctcccagagtgctgggattacaggcatgagccaccgcgcccagccagtagatgttattcttatctccagtttacatttgaagggaacaggcctcagtgagttcagatgacttgcccacggatgcagaatagtaaatggcagagccagaactcaggtccaggtctatctaacacctgcttcagtgttctttccaccatttttcacagccagcttctaagacctggtgtatcattcagctagatttatagctctgaggctgctggttggaagctggcatccttttctgctctctttctcctcccatactttctccctcttcttagaaaccttacagaggcaatataggtatttgaaattcaaagaagagatttatgccgtgcttaaaatctgctcatactgccccattagacacctgggaatctgcctctcgtcttttgtatgggtttgtactgttactttggtagcatgatgtggtgggtatagttttgggaatgttctttctcagctcttttctttatgagtataatcttgtgaggtggctgtaaagttagagatgatgaatattcaagggtagcaagtacaggcttattatttgatggcagttatttcccctggcaccaggatctaatagaaaccagaatagcagtcaggagttctaaatcttttactcctattctttgaccttggatatgtgagtcactgtttctagatagactggctagtctttaggggcgcctttcagctttaatgtcctgcactttaaaaaatgaaagtaataagatacttgtttaaaaaaaatcaaattagacagaagtatttgaaggaaaaagtgaaagacccatatcctttcccccattcagttcattcccaatgtgtaacacttattaccagtttgatgtatccttttcagtgttctctgtgtatactaaatatacacaagtatgtgtaacatacacagtttatatcatgtgcatatatatataaatacacatgtatatgttatacgcactggaacctacaatacatattatgtcttggttcttttacttaacatgttttagctatttttttcttgttggcacttaaagatttactttattgtttgcaatgtcttatactttttttttttttttttttgagacggagtctcgctctgtcgccaaggctggagtgcagtggcacaatcttagctcactgcaagctccgcctcctgggttcacaccattctcctgtctcagcctcccgagtagctgggactacaagcacctgccaccacgcctggctaatattttgtatttttagtagagacggggtttcaccatgttagccaggatggtctcgatctcctgacctcgtgatccacctgcctcggcctcccaaagtgctgggattacaggcgtgagccaccgcacctggccacaatgtcttatactttattaagtgttggctggacatggtgtctcacacctgtaatcacagcacttcgggaggccaaggtgggcagattgcttgagcttaggagtttgaggccagcctgggcaacatggagaaacccaactccataaaaattagcagggtgtggtggtgcatacctgtggtcccagctacttgggaggctgaggtgggaggattgcttgagcccaagaggttgaggttgcagtgagctgtgatcgtgccactgcactgcactctagcctgggcaacagagcgagactgtctaaaagaaaattaagtggtcccctattgattgtgtgctataatttttctttttttctctttttagagatgagatcttgctatgttagccaggttgatcttgaactcctggcctcaagcattcctcccacctcggcttcccaaagtactaggattacaggtgtgagccactgcacctggccaattatgtgctatgattgttaaaagcaaatatacacatacagtgttgatttttaaaattttcttttcaggagaagaagaaaaagaaacatagagataggaagtcatctgactctgacagctcagactctgagagtgatacaggcaagagggcaaggcacacatcaaaagacagcaaggcagcaaagaagaagaaaaagaagaagaagcacaagaagaagcacaaggagtgagagtataaagagtgtagggggtggttgagagtaagaaaccaggagccttgtgccttgagactcctggaaagactcaatagtgagaatatagcctcccaccccattaacttcgctcccatgggagatggcttcccctcatgcaacaggcaggtttgggagttagaggtcaaaagcagctgcctgaatgagttgttgtttccttatcactcctggtccctttgcaagtgaaccctgcagctcacccattcattcacccaacttccttcattcagcaggaggtcctattaccctctccagctgccactgccagagctggattcctgtaaaggagtccaggctagagccacagagactgttgtggaggtgagttcggctgtagttagagtgattggacccttcctattggtctgtcctgggccaactggtgggtgatctctgctgcatccaacatgggagcagagactggcagcaggaggggggaacatggtgagaagtggtgctcacttttcccattcctcctaacatagttctactatgctagaagtggcatccagcggccacagctagaaaacagtctgcagtgtgacttaacttgtgtattgcattccagcagaccactgaaccagacagcgaagccaagatcattgttctactttgtatttactactgtgtgaatcagttgattctacttcaggtccttgcttaaattcctgtcactaaatggaaatgtgtttggttttaaacttactgagttatttttcctataatccttcttcctgggtaacttacagacttaaagtcactgagcctgcattagctgacaaaaacatttaatatgttaccttagaccttggagagatgcccagcagaggtacagagccaaaggcactagcagatcactgccttcttgggagatcacttataagccctcccttttgtaatgatcagatgccctcttccctcagagttgattagagaagcagtaagaatttgtagtcataagtactagcctggtgcacaggtcagcagtcctcttggccagtggtcattttctcccaccaccatggtacaagcctgggttctgtgccctgaacctgaattctggaaagggagagactacagcatttcacagagaacagccagacccaagagctttcagtgtaggatgggcctgaagtgacagttcaatagccaaacctggggaagccccatcactgactgaactaggtcatttgaccatggagggggggcagtgtaaaggcaacgtgtaggtacagctcttttattattaaatgtgtaaggtgatcagctgattaacaggctccgagactgtccatttcagtctcccatccagtgcttcttcctcagtaaccttcaggccgttatttctgcccactctctgacacacaggataaaccaagactcccagagttatgttaccaaaggcaaaaaggcaactgggtggccttggctctgctttattgacctcagagcaccctatgagtgcagttaaaaaaaaaaaaaaaaaaccacatacaccatgggaactggaactggatcccggtcagtggcacctgaccccagaagaattcgtggatttgtacaaaatgcagaggaagaaatgaggcaatgtggtgctgagtcgaggggtagccgattggcagagtagtagtcagcaacagtgcagtcaggtcatgcctctttctcataagtgcgagtgcaaactgcagtgccgtgggtgagtgtctggaaggaaagacagagtgagatggggggtggagccaggaacaccattgcgagcattctaccctcccttcctcctgataattgtcacttgagtacctactatgtgccggctatatgtatgtatgtgtgtgtgtgtgtgtgtgtgtgtgtgtgtgtgtgtatacatacataattttttttttctgatatgcacagcaaatccttaagataggcattgtaattcttattttagagatttggaaaaaacgagcctttagagaggaagtaatttggtcaagatcctgagtgtttttccttcccttataccatttggcttccttcatccttagtgtctaagatggtgcctggcatatagttgacaaataggaaaaatatccagagactcaggaaaggactgtgtttggctactaactccaatccttccctaacttagagtagtgccagggccagagccctgtacctcccactatccggtctggcatcatagagccagacccatggcctcaccatagttcagctgccactgagaatttggtcctgcatatcacatccccaccaaagctaggcacctcattccaaacttcaaggggacccctgtcccacatgagtacaagaatgcagttaacaggttatgctgacccaagaaggtgtgcagtgaagatgcctaggtgaaaacctgaggccctgtggttaggcagaatccacagttggctgctctccctgggtctggggggaattcagtcaaggctagattctccaagtgaagtccccaagcttgaacagatctgccagcctggctgtggtacttcctacccaagcagtagtcaagtagtttcagtaggccagacatagaaagcatgaaaatggggtaggactagaatggggaagaaaggactgtactgtcattcagtgtccccaccagtcacgagcctgtccctgcaagtgacaatgcagtcctagggaggagaggaaagggaatgctgagataggcaatgggagcccctcctagagggcctgggatcagatttggccctgttttctacttcttcctgaggtgaggcaaggtagaaacacaggaagagcaaacaaaggacatggagcacctgctgtgttcctcaatcagtgatgctttgtgctgtgcatacactgtctcttacaggcttcccagcagccctacaaggttggtattattaatacccgttttacagttgcacttggaaaaggtgatttgcccacagtcatgtagcctataaggtaagatttgagttccggcctgtgtgagtccaaagccactacacagaaaattcccacctgataccaccctgacccacaaccactctcttgtcccagcttctacagctctcaggggaggacttggctttttagaacaggcttggctgaaagagcagtagtaataaccaatcagatatagctccaaagttgcccatcttaccaggatgagttttccatcaattagctcccgcacaagtgtggtctcttgcccgtcccatttctgcaggtgaacaagtttccctccatccagtgtcacaatggactgtggaaagagggtagaggcctgagctgtgatcttagtcaggaattgaggggcagggtggggtctggacactgggccacagagcacacagcctttgacccaaactagtgatggtgtgaggacaagagctcaggcaatccgcctcccagctatccctgcaagacatctagttcacctccagcctctgctccactactgcctttctggggaagaggccttcagatattaggcaaggagggagaggcaggcagtatggtggagccagagagcctggctctgagaagtaccacaagccttcaagacagacacttatctgtactctaggtgattcccgtagcctggtcccctcagatacaggtgggatttactagtctatccctgggaaagactgactgaggaggaggagtagtcctgagaatctttatccagccttgtggttagtccacataatgtctaaaagacccttagtgataggaagtattggataattagacttcctgccctgtattcctacaccttttcttggtccacatcatgtgacctctttagccaacaagagggcagcaaccacaaagtcctgtgactggatgcccttgaagtggttcctcagctctgggtgctgccagcatacatacatcagctggttctcatttggcagctcttccagctctctttcctaggagtttgggggccacaaggccaggctaagggatcctgatgagcaaggtggttcagtaggagaatctgagaaggttctgtgtattgtttaggtgataaggggtatgaggcctgtctcttagtgtgctcttttttatccttaccttactccttgttctcattcccctagttttttttgcctactcagagtagatatttttgccctaggcattccacagggctattgtgtttaattggggttcttgccccttgagaaagtaggcaagtccaaggaggtatgagcaggtggtggggcagccacctttatccaaggtagactgccatctttgggcaccatccccagctctgctgccagccacctgtgtgatcctgttctttctggggacagctatgaggaagaggaaacagctgatggggctgaatgatagtgtcatgatagaacactgctatagggacaccctatagaggtcaaagcccttaagttctctcgctcccatgcctggcctggaaggctgaggcaagctgccaagacagccactgcagggtgatagaaccctgggaggaggggctaaggcttggtgggaagacactgcaaacacattcatgacaaggtgaatgccctatcacggaacatagctcttcctgcctgtcagctggcaacactggaaatagtttgtcagggtcattggccatgtctgggagttagaagttgaagcggcatctgagtaggtgcttctagttcctggctgccttttttgctgctggaggtcacaatgacctcactcagtggagggccctgacttctgggcatcattcctaaagcacttcaggtcacagccatggccacataactctgccatctatggaaggggaaagaaacctagagctactgcataccttgcacagggtcacccagctggagctggagtagatactgaggtcagaagaacatcctggctctgtgctgcccattccgaggcagacaatagatgaatcccaagaagggagggaagaaaacaagaggacagaactgacatgtatttagcatcagtggcattccagcactacacaggctttatgaatcttgtttcatttaaattccccatgatagtctgcccctcagggtgcaataccagggagccaagactaccagcctattctcttttagagtctcagcactctccattccccacccctgtttccctgacttaccttgaccttcctgtcatctgctgttgtctcatcgaactccacccccaacttaaagctgatctctgtgttcttgaaggtgctgtgtgtttttagggtgagaatgtccccattcttttcgatgattgtggtaggcttggtcatgctggccacctgcctggtagcaaaacccacacctgagggtagggggaaggttatgagtatatgagctggggtagagaagcagtgtacaagaaactcaatgaataactctcaggcctgggtatggggaagtggaggactgtatctttcaaagcctttgcatgggaattttaaaattcagtcttgcgcttagttctgtttggtgaacacagataactgatcccattagatgagagatacttaaggaacagcagtgccatagcaagtcagtggcagagctgggattagaataagctactattgggccaagtgtggtggctcacgcctgtaatcacactttgggaggccaaggcaggcggatcacatgaggccaggagtttaagaccagcctggccaatatggtgaaacccgtctctactaaaaatacaaaaaattagccagatgtggtggtatgtgcctgtaatcccagctactcaggaggctgaggctgagaattgcttgaacctaggaggtggaggttgcagtgagtcgagattgtgccactgcactccagcctagccaacagagtgagattccacctcaaaaaaaaaaaaaaagctactattaagtactatgagctttttgtgtagtaagaactgtacatgttatctcatttagttcttcctgttcttctgaagactgtttccacgttacagatacaaaaacagaggtaaagcccagggtcacaaatctgagattgaagcccagaattgtctgagtccagagcttgcttaagtgctcagctatactacctcccaaggctggagcataaggctgccttccagggcacctgaaaagctctcaaagccttaggaataaggctgaggaaagaagagaaacatagactttcccttccaaagccttaggcataggagttttccaactttggaagtttttaccctgaaactaagaagtgttagtgctcttgtcccttatacatggcaacccatcattttcaaagcctgttatctatgatctaggagttaggtacaaaggaagtatttgtcctattgtgcagattcaggaggagcctaaagcggtagcaacaatgagttagactcaaacccgtctcctgactcccagtctaaggctttacagagactctcttcctgacccaagcatggcttccttgggtactgggcaaagtcctaagtgtcctgcaaccaagtaaagaacaaagaactaatcatgactgccccctctccccccagcagcttaacattgaactgtcttccaaggcaaaggtgaggcaggaggcagcccagtgtagtgaggtggtgtgtgtaaagtctccaaatgtacctggctacatagtgcttgctggaagctaggtactctgcacatgccctacatgggttgttttacttaatgcttgtaacagcctcgaagcgtagattatccccagtttacaatgaagagtgcgaagtgtcttgtcgaaattcaaagagaataaactactgacatagatttgaacctcggctccaaaactgttgactattttcactgggcgattctgtccagcacatactcaatccaggccagcagttgtgcctgtggtcactggtactagacgggacctctttgccccttgagagccctaggtctacagcaggaggggcaggggctgcctctgctgttatgctgtcagcccacccttgcttggccagtgaggaacttggcattgccccttggtatcaggatgagtcaggccaatcacactcccttgcacagagcaggaccttgtcacggcactgggagctctgttcacttaggatctacccagaggtatggagtgtttgaaaaggaaaccactgcgggatgagtgagggtctgaaccaagagaaactaagaatattgagctgacagaatttaggagactcagggagatctgggttctacttagaaatgaagccagcactacttactgagagctgaggagggtattttcccaggctttccattcctacgatgagaatgctggctgccttaacataagctgctgaaagataacaggacttcagggagaccagcccgctgacccaactcggggcagaataagggaacaagaatggtaaagttgttgcagctcaattcaagactcagctctggcccagctttggaaggaggaactaaatctgggcattccaacttcccaatagctgctgggctgtgttcgtgggggctgggggctgctcctctaagaatgactgcctgcctagaattactgggcatagcgcccaagatagggtagaggccgttgagagctttgacctctccatctaagcccaaagcagtagaagaagggctgaggtcaatcattagctaagcagtttctacttttcttcccactcgcagggcctgtagggtagtgggaagagctctgggttacagatctagaaaccttagattttcatattggctctgctgtggaattgttataatacatttctactctcctggtttcagtttccctgttgaactagatggtatgggaatctccaagttcctcacctgtgagattctttgaatcctgattcttctccatcccaacaccacagcagttctccacatcctcctaaaccagtgatcctccctcccaggtcttgaccttgccttgggaccctctactgcacatcagaagtccaatggctttctctgcctacccctcgcacagataggtgagccttgggttgcaggaaaggcccagctgatcatgggcctcttgccccaccctaccacgaggctcacagacagtgatgaaggcctggatacatagactgcaggacaaggtcagactggctggtgagaaagggcattctccagcaagaattctcttccctaaccaagcagagatggggattgctgcttactgcaggttcctgtcttacgtccttctcatatctgattcactgatccacagttttttccccactaatctttttcctcctaggtatttcctacttgtttacatcattgtacactccctggctgccccattccctttctgggttcagtctcctccaatttctaaactacccatgcccctgttctttttctcccctggctacactccctttcctgtgatcagtgttctttatccaaaccctcctcctacctccaaatcacatatccctcttcctggaaagagcctcccacacagctgcctccttccaccacctccctaccgtggtctctaaccagatttggaccaccaaagccccctctgaacaggccccacctgctctaggccaggctgccatctccgcgctcccctattccccagtcttaaccaggagggatgcggcaggagtgctgcgtggggctaggcacgccaccagccagtccccaagccaacatcctgagccccgcggcttgctcaccgagtgacttcatgtagtcatcgaaattcttgctgtccactagcttccaggtgcccaggaaagcgtccaccatagtgatgctgggctaggctgagagaagctacaagagagcaggcgtgcaagggctccgacggcggctccctgcccgggctgccgctttaaatagccctcgcatcacatgaggagacgtggcccacgcccccggctcccgaaataggaagccccaggctagggctcacccaggaggggctggtgcgcccatcccccaacccaccgaggtgggtggggaccagccagtggcgccctgctagcctgcgtcagcgccagtgcctggcccccgagtccctaccccaggctggtaggaccttctccctttcctggcctctaggcactctggaatctgagaaggaagcagccaacaccagcccgagagctagggcgcatgccatggtggatatcttcccgtcccccagtccctctttgagcttagcgtcagagcagagatgagactagaaaagcaaaacgcccttgggctggtgcccacgccggggaaagctctggttgacttctggcacgggcatctgtcctcgttttacaagtgaggagtccgaggctcacaggggaactgacaaggtctcaagaaataggagggggtgaatggagctcagattgcaagcttagtctagcgggcttcagagctcgcgctctcccttcactctcactgcctggtggcggagacagtcaccagcggctcggtctgcggctgagctgaccttgtcctctgcctgttttgagcaaaagcctgacccttcgcgccccgcccgcctcacacgtgcttgcccctccctgcggaatgtctcctgctggccctcctccgtccccaccccaccccaccatctagctccccacccgcccctgcaagtgctctgggcttttccggtttcttcgcacagctccgagctttagctcaggtcgttcccagctcccctcctgcagaaattctgccaattcggtcagctcttcaaggcccatggctgccttccccacctgccgccctttctttggcctgtgcacactagcaagccgcctgcacttttgggtaatttgctgcctcctttcgagagcctgttgtgcggtggtttgtcactgtatagtttactaagcactttcagtaaaaataagacctgccttgtcttgctatttattgcatgctgagggctttgggtgtattgtttcattgaactttttattttattattattttttagagacaaagtctctcgctgtgtctcccaggctggagtactgtgacgccatcatagctcactgcagcctcaaactccggggctcaggggatcctcctaccttagcctccccagcagctgggactataggcacacgccaccacacctggcctcattggacttttaaagcaaaatccatgaagtaggtgttactgtattattttctctttttaaaaaggtgaacaagttgaagctctgaggagctcactcattaattcagcagttaataaagcacctactttgtgccaggccctgctttggagagagacaacagggaacaagacacacattcacctctgggcagccagacataaaactagcgtggtgcctctaaagggagtcctgtcctgtcctgacctgagggcccaatgtagacttctcaaaggaagtgaggtataaatgaatttctgagggatggcaggaggccctgcacaccaaggagtagtgccgaactgaatttcagccagcagcagcctgtccagggtgggcctgcaggagccaacacaggagcccagaggcctgccacgtgcgtagagtatggcaggccctccttcctgggactctgtttctccatgtgcaaaccctgcctcccttccctggactgttctgagaacaaggccagggaggaagagccctctccccaccctaagatcttgattcctttggacggtccagttgccagaagact

SEQ ID NO: 379 - DNA, 43561 bp, Homo sapiens
gctcacatcctccctgcaacctcggactgtgaccttatttgcaaatagtgattgcagatgtaattagctaagatgaggtcacactggagtagagtgggcccttaatccaatatggctagtatcctgattagaagaggtgaagagaaatggaccccggaggggagaacgctacatgagggaagtgatgcagagccagccgcagcagcgagggaaatccctggaaggcaggaagaagcatggcaggctgccccctgcggctttcagcagcagcaggaccttgccgacaccttgcctttagacttccgttctccagaactgtgaaaaaataaatgcatggtgttttcagctgcccagtatgtggtcctttgtgatgacagctctaggaaattaatgccagatccttgctatgatgacgtaatggaagtggcactttacctctaggatcttcctccccaaaacccacaactccattctaatcatgagaaaaacatcggatacatttcaatagaaaagcatcctacaaaatacctatctagtaatccctcaaaactgtcagagctgggctgggcgcggcagctcacgcctgtaatcccagcactttgggaggctgaggtgggcggatcacgaggtcaggggatcgagaccatcctcgctaacacggcgaaaccccgtctctactaaaaatacaaaaaattagccaggtgtggtggcgggtgcctgtagtcccagctactcgggaggctgaggcaggagaatggcttgaacccaggagtcggagcttgcagtgagccgaggttgcgccactgcactccagcctgggcgatagagcgagactccatctcaaaaaaaaaaaaaaaaaaaaaaaaaaaacaccgtcagagccagtcgggcctgggggctcacgcctataatttcagcacttaaggaggttgaaccaggaggattgcttgagcccaggagtttgagaccagcctgggcaacagagagagaccccatctctaccaaaaataaacaaataagttgggcatggtggcgcacatgtgtggtccgagctactcaggagactgaggtgggaggattgcttgaggccaggaggtggaggctgggattacaggcatgagctaccacacctggccaggagatccctcttgataagagtggctttgtttacatggaggccttggacaagccaggtggtttatacttagagtcatcaaaattcatagaaccaggaagaagaatggtggttgccaagggctggggaaggaagaaatgggagttagtgtttcatgggtagagtttcagttttacaagatgaaaagagttccagcgatggatagtggggatagttgcgcgatattgtggatgtatttaatacctctgaactgtacacttgaaaatggttaagatagtaaattttattacatatgtattttaccacaataaaaaaagttgaggctggccaggcatagtggctcatgcctgtaatcctcccattttgggaagccaaggtgggaggatcacctgaagttgggagttcaagaccagcctgaccaacgtggagaaaccccgtctctactaaaaacacaaaactagccgggcgtggtggtgcactcctgtaatcccagctactcaggaggctgaggcaggagaatctcttgaacctgagaggtagacgttgcggtgagctgagatcacgccattgcactccagcctgggcaacaagagtgaaactccatctcaaaaaaaaaaaaagttgaggccaggtgtggtggctcatgcttctaatcccagcaccttgggagactgagacaggaggaccacttgagctcaggagttcgagaccagcctgggcaacagagcgagatcttgtctctacaaaaagaaaaaaaattgaaaaacaatgcactgtcccctcaactcctgctatgacctccttagcaatgaacaccatctgacatgctatatattttactcattgtttattcttattgtccccccaactacaatgtaagctccaccaggacagagagcttgtgtcttagtcacagctgtgctctggcatggcgcctgccaccagcagctgacaaacttacgcaagcattgcagcaatgctgaataaaggaatagaaaataaaaacacttgggggaggccgggcacggtggctcacgcctgtaatcccagcactttgggaggccaaggcgggcggatcacgaggtcaggagatcgagaccatcctggctaacgcggtgaaaccccgtctctactaaaaatacaaaaaattagccgggcgtggtgttgggcgcctgttgtcccagctactcggaaggctgaggcaggagaaagtcatgcatccgggaggcggagcttgcagtgagccgagatcgcaccactgcactctagcctgggcgacagagcaagactccatctcaaaaaaacacaacacttgggagaaaagtctaaacttgtcattcagaacctcacaaaaataatcattttgaaacctggcaaggagaagagaatcattgctaatatttggccaaaaattgttcttaaacattgactttctccaaaaattgttcttaaacattgactttctctggttcacagtccagaagaaggaacagaaaatcgagtgaaaaagttgattatacaaattgggtcattctttttttttttttttttttttttttgagacggagtctcgctctgtcgcccaggctggagtgcagtggtgcaatctcggctcactgcaagctccgcctcccgggttcatgccattctcctgcctcagcctcccgagtagctgggactacaggcgcccaccaccacacctggctaattttttgtatttttttaagcagagacgggatttcatcgtgttagccaggatggtctcgatctcctgaacttgtgatccgcccgcctcggcctcccaaagtgctgggattacaggcgtgagccaccgcgcccagcccaaattgggtcattcttgtcatatccaactaaatcagagttgagaggtcagaaaaaaatgcacttagggcacatagcacttactccaagaaataaattatctgtgtgtagtggctcacgcctataatcccagtgctttgagaggccaaggtttgggaggattgcttgagaccaggaatttgagaccagcctgggcaggatagggagaccctgtctctgcaaaataaacaaattaatttaaaaaaaaaaaaagagagaaaaagaggctgcaccatggtggctcaagtctgtaatcccagcactttgggagactgaggcgagtggatcatttgaggtcaggagttcaagaccagcctggccaaaatggtgaaatcccatctccattaaaaatgcaaaaatgagctgggcatgatgatggtgggcgcctgtaatcccagctacttgagagactgaggcaggagaattgcttgaacccaggaggcagacattgccgtgagccgagatcgcgccactgcactccagcctgaacaacagagcaagactccatctcaaagaaaaaaaaaaaaaaaagaggctgggcgcggtggctcatacctgtaatcccagcactttgggaggccaaggcaggcagaccacaaggtcaagagatcgacaccatcctggccaacatggtgaaaccccgtctccactaaaaatacaaaaaaaaaaaaaaaattagctgggcgtggtggtgcacacctgtagtcccagctactcgggaggctgaggcaggagaatcattttaacccggaaggtggaagttgcagtgagctgagatcacaccactgcactccagcctggtgacagagcaagacttcctaaaaaaaaaaaaaagaaaagaaaaataaattttctgtgaggccagctgctgaaacgtcctgctgtaaccctaagaccagttggacctagtagctgctgaagtgacctgccatcactctaagactagtttaatctactgttgtcactcaccaatctgagcttgctagctcccaaaagtgtctctagcaccagtgagcttctttcaaaacaattcataatatttctcttgctcataaaattcccaaacttcacttaattcttctgacatactgaagactacccagtctatgtggatgcctcatattgcaattcttgcttcccaaataaaacctgttattttatctatatttttattttttgagacagagtctcactttgtcacccaggttggagtgcagtggtgcgatctcagctcactgcaaccttggcctccagggtcaagtgattctcctgcctcagcctcccaagtatctgggagtacaggtgtccatcaccacacccagctaatttttatatttttagtagagatgaggtttcaccatattggccaggctgatcttgaactcttgacctcaagtgatctgcctaccttggcctcccaaagtgctgggattacaggcctgagccactgcacccagtccccaaataaaacattttacatttagagattcatttctatattttatttgactttgacaattgatatacaaaatttaacatggttaggaaaatccagaccatatagaatttccttagaataaataacccagtgttttcaacaactaaatggcaaataaaaaaaaagatatagaggggaaatgtatatatgagaagacatcacacaatctgagtacgtggattcactgggcctgaattttttgttttgtttttgtttttgagatggagtctcactcttgttgcccaggctggagtgcaatggtgtgatctgggctcactgccacctccgcccctcgagttcaagcaatcctcctgcctcagcctcccaagtagctgagactccaggtgcatgccaccaggcccagctaatttttttgtgtgtttttagtagagatggggtttcaatatgttggccaggctggtctcgaactcttgacctcagatgatctgcccgccttggccccccaaagtgctggaattacaggcgtgagccactgtgcccagccctgttaattttttatgtgtgataatattgttattacatttaaagtatgatctacagaccctggggtctccaagcccttttctggggatccaggaggtgaatcttttttttttttttttttttttgagacatagtctcactctattgcccaggctcgaatgcagtggcatgatcacagctcactgcagcgtcaacctcctgggctcaagtgaacctcccacctcagcttccagagtagctggaactacaggtgcatgccactgcgcccacctaatttttgtttatttttttggtagagatggttttgccatgttccccaggcttgtctcaaactcctgggctcaagggatctgcctgccttggcctcccaaagtgctgggattacaggcatgagccactgcaccggccaccagtggtgatattaatgtagttgtttgatactgtataataaaaggtgtcaacatttagaacctctgcatgagctggccaggtcagcaatgtgtttctcagaaacacccgctacactttctctttatttttcagggaaaattaatagaggacaatgtggttgtgaattttagaaggtcttgaaaagtacagcccacacacgtggtgcttactcagtgctgttacacataaggcggtaaggggaatttatcttgtgtgtatgtgtgtgtggggggagttctccattctcttcgtatagttcagtgtttagtctttttaaaatatgcatagttttttacaaaaataggattacgctgcacatattcttgtgtgatcagtattatttcatttctcaatgaaataacccccacgtgggtaatacacattatcctttttagtgtttccccaaattctccttacatatcaccacaatttattttacgtttacctactaaaagatttttagatccttcccaaggttttgcaaatataaatggcaatgtgaggaacattcttgtatatacatctttccataagattataggttatggtaatttataatttttaaatgttggtataataagatcttcagaaaaatttgatgtgtacactcacatcacaatgttgtatatccatcaccactttctccttccagaactttctcattatcccaaacagaaacgctataccgtttaagcactaactccccatccctttttattccagtccctggtaactctgttttactttctgtctttataaatttgcctatcctaggtacgtcatataaatggaatcatacagtatttgtccttttgtgtctgccttctttctttttttcttttcttttcttttaagaaacagagtctcattctactacccaggctggagtgcagtcgtgcaatcataggtcactgcagcctcgaactcctgggtcaagtgatcttcctgcctcggcctcctgagtagctggggccacaggcacatgccactacctccagcttggcttatttcacttagtgtattttcaagttttaatcacgttgtagcgtgtaccagaacgtcattctttgatatggctgaataatattccactgtatccattcatcagctaatggacacttggattgtctccacctttggatattgtgaataatgctgctatgaacattggtgtaaacacctttctatgaacctgtttgaggatattgttttaattaaaagcaagctgctaccactacatacctattagaatggccaaaattcaagacactgacaacaaatgctggtgagaaattggagcaacaggaattcttattcattgttggtgggtgcaaaatgatgcagccactttggaagacagtgttggcagtctcttacaaaactaatgatatggacaggaggcaggagggcgggattcctggtgagggttcttaccctcaagcttggacccatggccctaaatgagaacaggcattcctgttttcacgcctgtacgttgccttttccaagaccattgtggcccaccctgctctctatcctgtgcccataagaaccccaaatcccaggctccacaaacagaagagcagcagaggggcagaggggcagagctgcagagcaaggtggtggagaaggagaaaagagaagaagcaattgagcattgaagaggtagctggatggtcagagaggaatttggccagggacagcagaactccaggggacgattatcttcccacgccatcccctttccagctccccatcctgctgagagccacctccctcactcaataaaacctctgcatttaccattcttcaagtccatgtgacctgatcctttctggatgctggacaaggacctgggtattaagagggcagggtgtaaaaggctgtcaccctcactctccactgagctggttaacgcttagctgtccatggatggcaactgctagaagagcattaattgtaacacacccctagatgctaccatggggccagagcccaaaggtgctcaccctggccctggcacccacttgcctctgtgctccccctcccataaggggttttagcacagtggctgagtaagctagccacgacaagtcccgcgaaggggtccagggaactctcctgtctcattaacatactgttaccacacaatccagcaaccatgctaatttttttttttttttttggagacggggtctcgctctgtcgcccaggctggagttcattggtgcaatctcggctcactgcaagctccgcctcccaggttcacgccattctcctggctcagcctcccaagtagccgaggctacaggtgcccgccaccacgcccggctaatttttatttttgtatttttattagagacagggtttcgctgtgttagccaggatggtctcgatctcctgacctcgtgatccgcccgcctcggcctcccaaagtgctgggattacaggcgtgagccactgcacccggccgcaaccatacgatttacccaaatgaactggaaacttatatcctcacaaaacctgaacacagatgtttagagcagctttattcatagttgccaaaacttagaagcaaccaatgtatcttcagtaggtgaatggatttaaaacactggtacatgcagacagtagaatattatgcagcactaaaacgaactgaggctgggcacagtggctcatccctataatccccgcactttgggaggccaaggcaggaggatttcttgatcccaggagtttgagacgagcctgggcaacatggcaaaatgccatctctacaaaaaatacaaaaaattacccaggcatggctgtgtatgcctgtagttttagctacttgggaggctgaactgggagggtcacttgagcccaggaagtggaggctgcagtgagccatgatcgcaccactgcactccaacctgggtgacagagtgagaccctgtgtcaaaaaaaaaaaaaaaaaaaaaaagccagggtaacttgagggaaacatgagggaaacttaaatgtatattactaaatgaaagaagccaatctgaaaaagcaacatatgtatgattccacctatatgacaacctgcaaaaggcaaaactatggagacagtaaaaatatcagagatttccaggggttgtgggatggatgaataaatggagcacagatgattttttggggggcagtgaaactattctgtacgatactgtaatggttacaggcatttgtcaagacccatagaatgtacaacatcaagtgaacactaatgtaagctatggactttgggtgccaatgattttgttttttaatttatactttttgagacagggtcacccaagctggagtgcagtggcacaatcttggctcactgaaacctcagcctcccaggctcaagtgatcctcccacctcagcctcccgagtagctgggactacaggtgcgtgccaccatgcccggctaatttttgtattttttttttttttttaagagatgaggtttcaccattttggccaggctggtttcaaattcctcggctcaagcaatctgcttgcctcaggctcccaaagtgctaggattacaggtgtgagccactgagcctggccaggtgctgatatttaactgtaggttcaccaattgtaacaaatacactgttctggtgtgggatatcaactttggggaggttgtgtgtgctggggggacatgggttatatgggaattcaatgtattttctgctcaaattttgctgtgaacctaaaactgttctaaaggatgaaaggaactgagggtgaagggaaatgggaagatggtggtcaaggggtacaaagtctcagttatgcaagatgagtagttctggggagatgcacagctatgtgacgatagttgacaatattgtgtacttgaaatttgctaagaagatagatcttaagtgttctcatcagacaaataactatgtgaggtgatgcacatgttaattagcttgattatggtgaatatttcacaaatgtagatatcaagttgtacatcttaaatatatagatctcaacaaatatatatacctcaacaaagtggcctgggaaaaaagggaaaaaagctagttgcagcacatgatacctttatggccagttttgtaacaacaacaaaaaaatcaaagtgcgaacttaatgttatacgcagttaatctttagaaagtgagattatggatactttattttgtacatatattctaattaaatacagttatagattatttgtgtaatgtttaaaagccaagttgttgtatttaagggggaggtggtgaattgtagttcacgacccactctgggaaaaaagaaaacagtgcaggctaaggagattattttggtcggctcatcagaccgcctaacaaggcgaagactttcctgagagtccctaaagccgcggccccggaggcttgtgggaaatgtagtcccgaacgtggatggtccacccctccgaggaccctgggaacggcccgcgcccctgtttctgcgcatgtgcagtgctgcgagcgcgccggtggccgcccttcccccaccaccagcggcgagtgggtgacagagcccccgtctccgcgcgtcttcgccgccctgcgccgtgacccgctgtggcactgggccacgagtggaggctgcgcccctccaggtacgagaggggcttccaggtagctccgcgcggcctggggccgaggggaaggagatgagggatgggctcgtgcccgcgcagggtgggagcccaaacttcggctactcgtaggcggcagtgaccctcagggcggcgtccggggttgcccggcgctcgcctctgaacggggccggcggggcacgcctggccgaacgtgcgggggcggggacggcggagggaagggcggctatgaggcttcgccttcttctctttgtcaggagatgcgcctcagacgggcggcgaagggctcgggccgcgcgggagcgagttctggagccccggcgggcgcgcgcgcgcgggacgaggccccgccggggcgtggtgggggcgtggcctgacacacctggccacgccccgatgcccggtgcctcgtgggtggaggaaggactggagcctggtcagttgccggtggtgaaggagaaccgtgatccctttgtcagagggtcttcagtgaggtgttcccctgatcctcgcatccaccccgtgacttccagcgttatcatctccgtcgctatcccaggaacacgggaggttcagaaggggaaagtgatttccctaaggtctcacaacccggtggtactttatgtgagcagcagatattttttcatttatcttttgattttactcgctggtagattttgccatgtatacgttttgacgttttaaatttctctcgggtggaatttactgttctttccgtttggggcacccaaaattcttcactactttgaaatacgaaagttttcccatgattctggtgcagtcacgctctgcgtaacagtgtttctgtcaacgagggacctcatgtaaaatggtggtcctatgtgattgtaatactatatttttgtattgtaccgtttcttttctttactttcttttttttttttttttttttgagacggagtctcgctctgtcgtccaggctggagtgcagtggcttgatctcggctcactgcaacctccgcctcctgggttaaagtagtgctctgcctcagcctcccgagtagctgggattacaggcgtgagccaccgcgtccggccagacacaatttattgatgtaactgttcctctaaatactactttaactacatcactcaaatttttatatcttgtattttcttttctgttgttgttgtttttgagactgagtctcactctgtcacccaggctggagtgcagtggcactcagctcactgaaacctctgcctcccgggttcaagcagtcctcctggctgggattacaggcacccgccactacacctggctgatttttgtatttttagtagagacggggtttcaccatgttggcccggctgctctagaactcttgacctcaagtgattctcccgccttggcttcccaaagtgctgggattacaggcatgaaccactgcacccagcctttttattgtgttttcattaccattcaattcaaatttttttaacttcccttgtgacttcattttttacccttatttatttagattgtattgcataatttccaagtttttggagattttccagatctttttttttttttttttgagacagagtctcgctctgttgcccagtctggagtgcagtagcgagatctcggctcactgcaagctccgcctaccaggttcacaccattctcctgcctcagcctccagagtagctgggactacaggcgcccgccactacacctggctaatttttttatttttttttgtatttttagtagagacggggtttcaccgtgttagccaggatggtctctatctcctgacctggtgatccacctgcctcggccttgcaaagtgctgggatcacaggcgtgagccatcgcacccggcccagatctttttatattattgatttatagtttaattctgatttggtcagaatactgtgttacgaatttcaattattttaaatttgttgtggtttgtttttgtattgtatttttgtttcattttgttttagtagactcctggtctcaagtgatccgctgaccttggcctcccaaagtgctttacaggcgtgagccactgcaccaggcctgttgtagtttgttttaaggtcgaggatatgatgatctctctgggtaactgtttcgtgtgtatttgaataaatattgtgctgttgatcgtagaatcttccttgattgattgattgattgagacagggtctgtctctgttgcccaagctggagtgcagtggttcagtcacagctgtctgcaacctcaaaccttttgcctcagcctcccgagtagctaggactgcaggtgtgcgccctaatccttttgcctcagcctccggagtagctaggactcaaggtgtgagccaccacactcagctaattttctgtattttttgtagagacgaggttttgccatgttgcccaggctggtctcaaacccctgggctcaagcagtccacccacctttgcctcccaaagtgctgggtttacaggcatgagctactgtgcctgaccctctttttccattcttttatcttttttttttttaatttcctgactcctacaactgatcatccttttactttgaatgtagctatgtttttatattttaaacaaactgcttatagacagcacatggtttggtcttactttttttatataatttgacctctgttatttaattggtgtgtttatgccaattattgatatagttgtgttaaagtctaccatcttgctggtttttttctgtttttcttatttggtctttgtttctgtttacctttttttctgtctacttttgtcttaagtgggtcttttttataattacattttatctccactgttgtcttattgtatatttgtaaaaatttaacagagtttttggttgttaccctaaagtttagtggaactttaaagatatcatactgttttatgtcaatatacttggaacattatactcccaatttcatcctcccgtcttttgcattattgttgtcatacatgttgcagaatattgacatatgctgtaaacccacaaaactttgctactatttttgctttagataatctttcacagtgattaaaagcaagaaaaagtatctattgtgttgatcctcattttaacgattctcgagattttcatttatttgtgtagattcaggtttttgtctgatatcatatttcttctatttaaataacttcattaaacatttcttctagtgcaggtctactgataatgaattcgctatgtttttgttgtttgaaaaaggttttttacttcattatcatttttgaaagatatttttgctgggtatagaattctgagttaatagttttttgctttagttgcttttttgttgttgtgaaagcactttcaggatgtcactactttgttttctggcttagtttctgatgagaaggtggctatgattcattatcttgatttttctacatataatatgtcttttttcctctggctactttgaagattttaactttggttttcatttgtttggatacgatgtgtccatgtgtgtttttgtttgagtttagtttttggtattttccctgtttggataaattgagtttcttggacctgtggtttcatattattatttttggaaaattcttgtccattatgtcttcaaatacttcttttctccttttggaatttcagttacatgtttattagaccatttgatattgtctcacagcccttggatgctctatccttttatgtttttcttccatttctctttgagtttcagtttgacctatcttcaagtttactgaaacttttcttagctcctttgtctactaatgaacctgctgaaagatcaactctgttactgtacttttcttagcatttccatttgattttttcttgcagtttccatctctgctgaaattccctatttgtttattcatgttgtccaccttttctagtaaagcctttagtatatgaatcatagttgtgttaaatgccctgtctgataatttcagcagttgagggttctgttgattgttttgcctcttttgatagtggattatcttagtcttgcctttatgggtgtctgataatgttagattgaagataggtgctgttagtatgatcttttctgccccttctgaagaggcaaagggactttcccaggaggtggtattttcccaggtggtctctaggggtttctaaacaagtcattctaggagttgtaaggcaggtcagacctttaataacaatgccttcctttttcctctattccagttctgccttcatagttctctgcctttgcccaaaactgcagaaaatgaacaaatcccaggtgagttgtttgtttattccccattttgcttttcagtgcatttaaggaagtttataaggatccagaaaatgaaatagaaaagtatgaataagacacaaaggaaacatagcaagaataactaatcaataccagcagccaaaaagcaaattgagttaattaaatgtcttgcattggttatgaataccaattatttggttctgtacattaggtctgaataaattttatggaccttcatatagatggtgttttggacagcacccccagaaacaaccaactttgaaagggttatcactttatctgtggttgtttcatataacattcctcagtgcaagtgcagaagattattgtatgtatttggtttttccagtcagattagcctaatgccagagaatgcagtaaatatgtgggtttgtatttaaatccctccaccccaagcaggtaccactgtcattactttcttgtgtagctttccagagcttatttgtacataattacacaagtacaaataaaagcacaaacgtaagatagcatgttaatcatactgttctgtttatatgcgttctgttttaatagatttcattttttttagagcagttttgggtttacagaaaaattgaatggggaatgcagtgtgttcccatataccccctcattcccaacccctacccccagtttcctttattattaatatatgcattaatgtatattgttacagttgatgagccaatattgatactttaaagaccatagtttacagtagggatcactctctgtgtacattctgtgtattttgaccaatatataatgacatgtatccatcactatggcatcatacagaataggttcactgccctgaaaatcccgtgctccgcctatgcacctctccctctgtctccctaagtccctaacacccactgatctttctactgtctcatctccctagtcgtgtcttttctagaatgtcatatagttggattcatgcagtaggtagcctttttagattggtttccttcacttagaaatatgcatttaaggtttctccaagttcaagacaatgctggccaacacggtgaaaccccgtctctagtaaaaaaaaaagtacaaaaaattagccaggcgtggtggcgggcgcctgtagtcccagctactcgggaggctgaggcaggagaatggcgtgaagccaggaggcggagcttgcagtgagctgagatcgcgccactgaactccagcctgggcaacagagcgagactttgtctcaaaaaaaaaaaaagagaaggttcctccaagtcttttcttggcttgataactcatttcttcttagtactgaatatgtcatgatgtgatgtaccacggtttatttatccattcacatattgaaggaacagataaacttagtggcttctaagttttggcaattataaataaagctgttataaacatctgtgtgcaggttttttgggggcatgttttcaactcatttggataaataccaaggcccctggatcatacactaagaatataattaattttgtaagaaactgccaaactcccttcaatgtggctgtaccattttacattcccacattctcaccagcaatgaatgagagtttttttttttttttttttttggttttaaggagcggaaagtttaataggcaagaaagaaaagagaaggcagaaggaagaggctcccctgacagagacagagggaggggggctccaaagccgagagagggaacctcctgaatgagagtttctacggccctgcatcctcaccagcattttgtgttgtcagtgttctggattttagccattttatttatttatgtttttaatttttattttttttgagatggagtcttgctctgtcacacaggctggaatgtagtggcgtgatcttggctcagtgcaacctccccttcccaggttcaagtgattctcctgcctcagcctcccgagtagctgggattacaggtgcgcaccaccatagcccagctaatttttgtatttttagtagagatggggtttcaccatgttggtcaggctggtctcgaactcctgggctcaagtgatccacccaccttggcctcccaaaatgctgattacaagcgtaagtcactgtgcctggttatggtttgtgtttcaatctcttaattatgtgatttgattttgttttgtttttgagacagggtctcgctctgtcacctaagtgggagtgcagtgatgtgaacacggtttactgcagcctcgacttgctggactcaagcagtcctcctgcctaaatccccgcaagtagctgggactacaggcacatgccgccatgcttacctaattttttgtatttttttgtagagatggagttttgccctgtcgctcaggctcatcttgaactcctgagctcaagcaatccatgtccacctcagtctcctaaagtgctggcattacaggtgtgagccaccgtgctcagcccaattatgtgttttttaaatcattcagtaacatatctttgaagtatttccatatcagagcatagaggttgctcattcttttttttcctaatctttaattgtgtgacacatgtacagaatagtgtattaagacataacactctttaaatgtgttataacaacatatataacaaatatatatgcattaaagaataataataaaatgggtgcccatgtaggcacccaagttaagaaatagaacattatctgttctttatgacaaattttctgattgaatccacctagtagatagccactatcttgacatttttcttaatagttcccttgctttccttaaagactttaccacttagatatattcttaatgtaatattcagttgataaactataactgggattaatatcacttatagtcttaatataaaatttagttaacaaactataactggaattaatattgccttggtttgcataatcttttgtctaattggtggaggtttttttttcctttcagacatgtgagatctaaaagatgcatccgtgggccctttgccaagacttaggttatcatttattttttaaattacactagctagtgttagctaagaagaaatgaaaccactcatgtattgctggagatagtatagaatgatacagccttactgggagcaatgtggcaacaccaagcaaatttagcagtgtaaagcagctgtgtctagaaatttggctactgttggggccaggtgtggtgggtcacgccggtaatcctagcactttgggaggccgaggttggtggatcacttgaggtcaggagatcgagaccagcctggccaacatggcgaaaccctgtctttactaaaaatacaaaaaaaattagccgggcgtggtagcatgcgcctgtaatcccagctacttcggaggctaaggcaggagaatcgcttgaacccaggaggtggaggctgcagtgagccgagatcatgctactgcactccagcctgggcaacagagtaagactctgtctcagaaaaagaaaagaaaagaaaagaaattttgctactgttggacaaagcctcccaggaaaagatgagctgaattgaatttccaggtatagcctggctttgactttcctgagagtttacagaagtcccgtttggggaggttattggcaaggtcatgagaagcatggggctcaacatagttgggccgtgtgacagggtcagagtgtagactaggtattgaatttttggtacgaatataattagagggagtgggatgctatgcattttctgcatcttggttcactggtgaatagccaccactcaggagtagattaaagcagaacacttctgtgacatgaaatgactgttctcatctgatccaaggcagtctggtatggaggggaaagacagatgtcatcagaacatgttcaagataagccaaaccaagtacagttaagaatctgggccaggctcacccaggcattctgccctcaggttaataaaaagttggtacagtggccgcaggtatcttgttgatgacaaccctcagaatgccagcttttgaatcactgtgttccagtccgtaactacaagtaatgtggtgttagtagagaatcagtgctatttcaccatctcccaccgctgtctccttcccactcctagggatttccttcctctctctcatgttgatcttttgtttgcagcgtctcttttttggattactgttgttttattgaagtacatgcttcagcagcttcttgagaaagggtttgtgagaggtatgttttttaggctgaatttctgaaaatgtcttttttttttttttttttttgagacagtctcactctgtctcccaggctggggtgcagtggtgtgatcttggctcactgcaatctctaccacagggttcaagcaattctcccgcctcagcctcctaagtagctgtgattacaggtgtgtgccactacacacggtgaatttttgtatttttagtagagacgggatttcaccctgttggccaggctggtcttgaactcctggcctcaagtgatacgccctcctcagcctcccaaaatgctaggattacaggtgagagccactgcacctggccttcattctgttctggtatttgattgatagctaggtatgaatgtggatttgtccattcctcagtttagttctgtcaggcttgatataatttgaagctgtgttagtcattgcatatatggttatggatgtgtgcacacatatgattctgtcttcctgatggacttatccttttatcattttgaaatgcccctctttatccctgataatactgcttttctgataaaaataaagccatacctacctcttctgggttggttggttggtttgttttgagaccggatctggctctgttacccaggctggagtgcagtggcttgatcttcactcactgcagtctttgcctcctgagttcaagtgatcctcccagtatttggaactacaggcgtgtaccaccatgctcaggcaatttttgtagttttgtttttggtagagatgggatctcgccaggttgcccaggctggtctcaaacccctaggcttacgagatctgtctacctcagcctcccaaagttctgggattacaaatgtgaaccaccatgcctggcccatacctccttttttttatgattagtgttatggtatatattttatttttgcttcaacctatttatgttcatatgtttatagtatatttcccctaaatagcttgtagtttggtcgtggttttgatccagcctgtttcttttttctttttttgagacagggtcttcctctgttgcccagggtggaatttagtggcatgaacacagctcactgcagcctcaagttccttgatccagcctatttctgtctatttttttttttttttaattttttttattttttgagacaggatctctctttctcacccaggctgcagtgctggagtgaagtggtgtgatcttggctcattgcagcctcaagcagttctcccacgtcagcctcctgagtagctgggactacaggcctgtgacagttaattttaattttaattttttttattttttttgtcgtgatgagatcttgcctcccaaagggctgggattataggcgtgagccaccatgcctggcctatttctgtcttttaattggtttattattttatttgtgattttttttttttttttacaggcataggtgaatttcagtgtgtcattttgctatttatttttagttgtcctgtgtgttcctattttcccttttatcttttttttaagtggttgctgtagagattacagcttataatcttaactgaccacctctttaatattttgcatattactttacagttcgtctgaagtgtttatgggttaaaactaatatataggtactgtctacatctgctccttttgggttgtttatctcttgattgtttttgtcttgtctttttttttttttttttgagacagagtcttgcccagactagagtgcagtggcttgatctccattcactgcaacctctgcctcccaggctcaagtgatcctcccacttcagcctccttaatagctgggactacaggcacatgtcattatgcccagctaatttttgtattttttgtagacatggaatttcgttgtgttgtccaggctggtctcgaactcctgggctcaagcaatccacccaccttagccgcccaatgtgctgggatttcaggtatgcgccacatgcctggcctcgttgttttggcttgcttgatttctccttcattccttccttccttcccttcccttcccttcctttcccttccttccctcacttcccttccttccctcccttccctcccttccctcctttccctcctttccctccctccctccctccctccctcccttctttcctttccctccctccctcccttccttcctttctctctctctctcacttttcatttttttttttttttttttgacagagtcttggttacccccagactggggtacagtgacaacgctcacagttcactgtagctgtgacctcctgggctcaggcaaccctcccaccccagcctcttgtgaagctgggtccacagacatgtgccactatgcccggctaatttttgtactttttttagacagggttttggtatattgcccaagctggtctcaaactcttgggctcaatttgtccacctgcctcagcctcccaaagtgctgggattacagtcatgagccactatacctggccctggttttgctttttcacatgtctagcagttttgtttgtatgctggatatgttgtatgatacatagctccttctaaaaaatgttaagttttgtctgccagatagctaaattattggcagatgattctgatcccattggggcatgttttaagatttgcaggtgtgggtgtatcggtttggtcatactcctttctcctagggtgtgctccatccttctagggcatggcttttgtggcatctcaactgtttgccagtatctctatctttctggattcagactgtcccagctcctcagcactatgcaacctctgaaatctctagtcagctctcagtctcacagtcgatgccactagttgtcttggaggcttgccctccacctacacatattaggaactagccaaagatttgaggtgaatctttatgcagaatgttaaggcttctctatggcttctgtagcgccatcatcctatgtcttactccattttgtgctgccatggcagaatacttgagactaggtaatttataaagaacagaagtttattttcttggctgggcaaggtagccatgcctgtaatctcagcactttgaagggccaaggtgggtggatcccttgagggcaggagtttgagaccagtcttgccaacatgtactaaacccatctgtactaaaccccatctgtactaatcccatctgtactaaaccccatctgtactaaaccccatctatactaaaaatacaaaatttagccaagtgtggtggctaaccccatctgtactaaaccccatctgtactaaaaatacaaaaattagccaagtgtggtggcacttgtctgtaaccccagctacttaggtggctgaggcacaagaatcacttgaacctggaaggtggaggctgtagtgagctgagatcatgccactgcactccaatctgggtgacaaagcgagactgcctcaaaaaaaaaaaaaaaaaaaggaagaaatttattttctcacagttctagaagctgagagtccaagatcaaggtgctggtgaaggcctggtctcttcttccaggatggcacttgaaatgctgcatccttcagaggggaggagtgctgtgtcctggcatggcagaaagcaaaagggcaaaaaaggagatgaactcctttcatcaagccccgttagaagggctcctaaccccgctcacaaggggaggagcctctatgatccaatcacctctcaaaggccacacctcccaatacttaattggggattaagtttcaacatgaaattttagagaggacaaaaatactcaaaccatagcattgcccctagatcctagttgctttacagacccaaacaccagtttgtatttttttttaatttatttaattaattttcaagatggagtcttgctcttgttgcccaggctgtagtgcagtggcaccatcttggctcactgccacctccgccttccgggttcaagcgattctcctgcctcagcctcccgagtagctgggattacaaggtgtgcgccaccacgcctggctaatttttgtatttttagtagaaacggggtttctccacgttgtccaggctggtctcgaactcctggctacaagtgatctccccgcctcggcctctcaaagtgctgggattacaggcgtgagccactgcgcccggccaacaacactcacttctgcttgggctttgttgttctgtgccatggttcagcatgatcgtaaatgtgtggctctcctcatagatgccttttggtaattgtagccctacagtgattgctctcctgtgcttgcaagtaattatttattttgtccagtttttatggtttgcctgtctgataattttgaagatactgctttctggtgtagtcaagaggtctgaaggctttcagtcttcttacttgtaacctattctctcctgaaactcacaggcttttctctttgcagctggtgttctgaaatttccttcgaatttttttcttccattatgcatggtagattataagatttctttatttcacagaaatacaaataaagcatagtagttttatgaaatatatatatatatatattttttttttttttttttttttttttcctgagatggagtctcacttgtcatccaggctggaatgcagtagcacgatctaggctcactgcaccctccacctcccaggttcaagcgattcccctgcctcagcctcccaggtagctgggactacaggcgcccgctactgtgcccggctaatttttgtatttttggtagagaaagggtttccccatgttggccaggctggtctcgaactcctgacctcatgtgatccgcctacctcggcctcccaaagtgctgggatcacaggcgtgaaccaccgtgcccagccgaaatatttttatgtattaaaacagttgaaagtaacttcagtatggtgcagcttttgagacagggtctcactttgtcacccaggctggagtgtggtggtgcaatctcagctcactgcagcctggacctccttggctcaagcaatcctcccacctcagccccctatgtagctgggactacaggcaggcaccatcaagctgggctttttgtatttttttttttagagatgggggtctcgccctgttgcccagactggtcttgaactcctgaccttaagtgatccacctgccttggctccaaagtgctaggattacaggcatgagccactgcgtccagcccaagtataggtcaacttaattatccgcctattttgctgtctagtcagtgcctaacattttgacgtttccatgtattgtgtatgttgaagattttttttaaatataatttcaacttatttgagatttgggggtacatgtgcagatttgttacatagatatttttatgatggtgacgtttggggtatgattgatcatgtcaccaagtagtgagaatagtacccaatagtttttgcctttgcccctcccttccctaccagtagatcccagtgtctgttgttaccatctttatgttcgtgagtacccagagtttagctcccacttataagtgaggatatgcgctatttggatttctgtttgtgttaattcagttaggttaataccctccacctgcatccatgttgctgcaaaggatatgatttcattcttttatatggctgtggttttaaaatttatattacttgtattatattttaaatgtattaaaatgtaatttttctttttttttttggaaacagtcttgctctgttgcccaggctggagtgcagtggcacagtcttggctcactgcaagctccgcctcctgggttcaagcgattcttctgcctcagcctcccgagtagctgggattacatgcgcccaccaccacgtccggctaatttttgtatttttagtagagacggggttcgccatgttggccaggttggtctcgaactcctgacctcgtgatccacctgcctcggcctcccaaagtgttgggattacaggcatgagccattgcgcccggccaatgttttttatattacaaaaatcatacattaatgttgtctcttactgtctctatcatatgaggatctgccctccccagcgtgcattgttgttttttttgttttgttttgtttttttgagtacattcttgctctgttgcccaggctagagtgtagtagtgtagtggcatgatctcgctcactgcaacttttgcctcccgggttcaagcaattctcctgcctcagcctcctgagtagctgagactacaggtgcccaccaccatgcccggctaatttttgtatttttagtagagacggggtttcaccatgttgtccaggctggtatcaaactcctgacctcaggtgatccacctgcgtcggcctcccagagtgctgggattacaggtgtggccactgcacccagccttttttttttgttgttgttgagacagggtcttgctgtgtctccagggctgaagtgcagtggcatgatcacggttcactgtagccttgacctcccaggcccaagctgtcctcctacctgaacctcccacatagctgggactacaggtgtgcaccaccacgtccagctaggtgttctgttgttgtagagacagggtcttgccatgttgcccagggtggtctcaaactcctgagctcaagcagtcctcctgcgtcatcctcccaaatgctgggattacacacatgagccacagcaccggcactgtttatgtcacctcactcaatcctaaaattttcttgaccattaaagccagtctttccatcatagagataaccagtatgttttgtgtggggtatccatgctctttgtttaatcacttttatatcatgaacaggattatatagaattttgggtcatgttatgtgcattttttggaattctgtttattgatgttcctgtggacagcttcctgtgccttttgttttcaggctttgttactttgtttatattttagctggatcattgaagtttgtgttgtttttaaaatttgcctcttgtaaaaattatatgtaggtttttaaaccctgaaggtcttagtcttttaacagacatttatcccatttttattttgattactgattttatctgcttttccttctctgcttatttccaccctttaaaggtttatattttttcagtactttcctattttaaacaaaagttaatcagaatttttcttccaaacatggtactttcttcctgccacaacttctaagttgatgacatccagaaattagtttaaaacaacttcctttcccattccatatttgcatacttttaatatgttttgctggtttgctgttgctttttttgcacatccaactgattcttgctgggcttaattttggttttggtacatctttgaatagtggtaataatgcctgatacttgacatctattatgtactagtcatcattctagatcgggggtgtcaaactctggctcgttgtccagatgggctgctgccttgtttttatgtgacccacaagctaagaatggtttttaattttaatggttgagggggggaatatcaaaagaatattttgtgctgtgaaaatgatttgaaataaaaatatgaaactcagattttagtttccataagtttttttttttttttgaggcggagtttcactcgttgcacaggatggagtgcaatggcacgatctcgacttaccgcaacgtccacttcctgggttcaagcgattctcctgcctcagcctcctgagtagctgggattacaggcatgcactactatgcccggctaattttgtatttttagtagagacggggtttctccattttggtcaggctggttttgaactcatgacctcaggtgatccacccacttcagcctcccaaagtgctgggattacaggcatgaaccatcgcgcccggcctccataaatcgagttttattggaacacagccatgcctatttgttgacgtgttgcctatgcctgtttttgtggtatgatggccaagtcggtttgttttagcagagactacatgtagcctgaaaaggaaaaatctagttagttacttacttgaccctttatagaaaaagtttgtcaaccaactcattctaaatactttcagccctttgaagatttgtcttctgacttccattgtttttgttgagaaattagctgtcaggttttttgtacctctgaaggcaatacctgttttttcctctgggtttttttctgagacagagtcttgctctgtcacccaggctcaagtgcagtggggcagtctgggctcactgcagcctccacctcccaggttcaagcaattctcctgtcccagcctcccgagtagctgggattacaggcgccctctaccacacccggataatttttgtatttttagtagagatggggtttcaccatctttgccaggttggtcccgaacacctgtgatccgcccacctcggcttcctaaagtgctgggattacaggcctgagcctggccacctctggggttttaaatcagttttgttatatgctgagtattttttttttttaatgtacttattgtacttggggttgctggttttaaaactatagcctggtgtggggtgtgttggaaaattctcagctgttatctcttcaaatattgtttccactgcctctgctgggactcctgctgcaagtatattagacctttttagcttgtcccacatatcttttaggctccttaatgtaccttttgcatttcagtttagatatttactgacattttttgactaatcatttcttcagccattctggcctgttaaattcaaccatgtattttttaaaaaaattttctaccatttttatggcttgaatgaggggatggaaggacagagatccttacttgtacctggtattttacagttggaagttcatcttctgccttaaagagttaaaactttgactatttaaacatcgatgtcacagaaataatgcctatgtgagctttattagcacactggtaacaatgaatatctaatgtgcttgtctcacagtacacatcttgagagcagaaacagtgtttattttttgagacagtcttactctgttgcccaggctggagtatagtggtgcagtcttggctcactgcagcctctgcctcccgggtttaagcagttctcctgtctcagctcccccacgtagctgggagtacaggcatgtgccaccatgcccgactaaattttagtagagatgggatttcaccatgttgtccaggctggtctcgaactcccgacctcaagtgattcccccgcccacctagcctcccaaagtgctgggattacaggtgtgagccactatgcctggccaatagtgttttattaatctgagacacctatcaaatatgacagtgccagagatataggggaatctgaataaatctcaactatttataaaaatatattttggaagacatgaacaaaaacagtgaacaagatgtatcgttggtgtaatatatagattttcatgatgaatgacataaagttttcatctatcctttctatatcaccaaatgatcatcttaggatgaataacaatatgccatttcagggatcagtttcattcacggatgtgactgtggactttacccaggaggaatgggaacaactggacccctctcagaggatcctatacatggatgtgatgctggagaattatagcaacttactttcagtgggtaaggacggttttcaggtacagctcaccatgtgcctagaggtatttatgtcctgtctcagtgaccagaaatgagcttctgaattactaaatgtttttggcctaagtcctcaggtattaaacctgagagatcttgcagcctttaaagctctatcatctcctttcctttaaggcttctgaagtccaggcaattaggagctatgtcccattagtaaatggctgtcaagccatatgcaattttcaagttggagcaaccagaagagttttgggtagcatagagttgtcaattcagaacattctaagggagataggacgggagagagggagaagcagaagccagtggaattagtatccagacgattatgagcagctcagtacctttgaaatacttttcagcaatctgtttttcaaatccctaacacttaagtatagctgaggacagatgacctgtacctcaatctctgaagcatacctccaaatatccgtctctccctgcttacctttttttttttcctgtttaatcttatagatatttgcctctcacacttgaaccctgaaactttcctaacatatcttaaactttgttgtgtcttgtacatgtaccattcttttccagtccaccattaatgggcacctaggttgattccatgtctttgctattatgcatagtgctgtgatgaacctatgagtgggcatgtgtctttttggtagaatctttttttgagacagggtctcattctgtcacccaggctagaatccagtggtgacatcacggtgcactgtagcgtccacctcctgagctcaagtagtcttcccacctcagcctggagtagctgggatcacagacacacaccaccatgtcctgctaattattttttacttttgtagagacaagttctctgtagaactcctgaccccaggccaggcgccatggctcatgcttataatcctagcattttgggaggctgaggcgggcagatcacctgaggtcagttcaataccagcaccaacaacatggtgaaaacccctctctactaaaaatacaaaataagccgggcatggtggcatgtgcctgtaatcccagctactcgggagacggaggttgcagtgagctgagatcacaccattatactccagcctgggcaacagagaccgaccccatctcaaaaaaacaaaaataagacctcctgacttcaagtgatcctcctgccttggcctcccaaagtgctgggattacaggcatgagccagtgtgcctggccagatgatttttaatgggattgctatgtgaaagggtagttctgaattatttgagaaatcttcagactgttctccacagtggctgaactaatttaaattcccaccaacagtgtatcttagccttgccagtatctgttgtttgacttaatgaacctgggtaactttatccttaagatgctgaacacattgaaagaagtaggctgggcatggtggctcatgcctggaatattgagagtatcccttgagcccaggaggtcaaggctgcagtgagctatgattgtgccactgcactccagcctgggcaaatgagggagaccctatctctaaataggaatggaagaaaagtaggatatgatagtgaaaacatgttcactctcccagcaacttcagtagaaaaaaaaaagcaataaaaccagcagcagttagtgatcctgtggtaagggttgtgtatctcttagcgaatgagtttctggattttaccatttgcaagattctcacttaagagatttggagctctgctatctggttgtcactgcaaacctatgagaagtgctgttctctggaaatcattttggtaaagatgaacagtagaaaaaaaggagaaaaagcttagaactatgcagactggtgctggttctaccatagtagtccgagtttagcaaataatactattagtcgagatctgcttaggtgtttccccttaattccctcatctgcttactttctcggtctctgtgctaactgcagtgtccttaagaacactgtgaatctccctccctggcattgccagccttctcatattgtgttctgttttctgtctcctttcaccctctctgcccactttaaggtcattttgtgatctggcaatgctacttgtattgattttggttttgttttgtttttttaaccacaagctattacctttctctttcaaagtttgaaaggaaacatttgcactgggaattttttaatattgggagactgggtcccaaactaaagagtcagccctgtgatagaacacgtgtgaagacttcccattcggtaacattatagcggaggcattgacaaggttcttttcattgtgctctctattcctagaagtgtggaaggctgatgaccagatggagagagaccacagaaacccagacgagcaggcgaggcaatttttaattcttaagaaccaaaccccaattgaggaaagaggcgatctctttggaaaagcacttaatctgaacacagactttgtttctttaagacaagtaccttataaatatgacttatatgaaaaaactttgaaatataattcagacttgcttaatagtaatagaagctatgcaggaaagcagactgatgagtgtaatgaatttggaaaagcacttctctacctgaagcaagagaaaacccacagtggagtagaatattctgaatacaataaaagtggaaaagccctcagccataaagcagccatttttaaacatcagaaaataaaaaacttggttcaacctttcatttgtacttactgtgacaaggctttctcctttaagtcactcctcattagtcataagagaatacatactggagaaaagccatatgaatgcaatgtatgtaagaaaaccttctcccataaggccaacctcatcaaacatcagagaattcacactggggagaaacctttcgagtgtccggaatgtggaaaagctttcacccaccagtcaaacctcattgtacaccagagagcacatatggagaagaagccctatgagtgcagtgaatgtggaaagacatttgcccaaaagtttgaactcaccacacaccagagaattcatacaggagagcgaccctatgagtgtaacgaatgtgcaaaaaccttctttaagaagtcaaaccttatcatacatcagaagattcacacgggggagaaacgctatgagtgcagtgaatgtggaaaatcctttatccagaactcacagctcatcatacacatgagaactcatacaggagagaaaccctatgaatgtactgagtgcggcaaaactttcagccagaggtcaactcttagattacacttgcgaatccacacaggagagaaaccatatgagtgttccgaatgtgggaaggcctttagcaggaagtcccgactcagtgtccatcagagagttcacatcggggagaaaccctgaaactccagccaggtcttactgtggaaaactcctgccagaactcttcaagcgggtgaaaaacctcatgacagtattgagggaacatgggaattcatactgagatgcaatctctcaactcaaaaatgtattaaaaataggatcccatgagaacattatactggaagttacatgtgatacccagctaaagaatacatatcagaatatatccagttgtaaatagccatacccagttgtactacaatgagctttttaaaatcttgaatgaattgagtattctagacagcagcataagaaatatacaaacagtatcctatgaatttagtggttttatgtggatatgccacaaaacacaagtggtatgctttagatctgcacatgtgaatttagcataatcactgggaatttgaaattcttgtcctctgtgataattaggacataacaagattttccatactaaacatcacatgtgtttttcagtatctctgcaatccagtatgcattccaaatgaaatgtgtaacatttaaagtagcatggaacctacgtctttccctactgcttgctggcatatatcagttggtatgaacattgttcttgagctgcctcttaggaaacagaagacagtgttgaagttttccctgcttctggtttgctgaagattttctagaagcactatttacacaaatatgcaaatgtgaaataaccgatctataacgtgaaggaggcagacatgagctgtactactcagtatgcaccacagaataagagtttgccgtgtaaagacaatatccccattcgtcatgctcttattttcccgtgggatatttgcatacaaatgcatgtctgttaccaaaatattgtgtaacacagacagaaaccacctgtttttgtctttccttgtttcccttaatatttcatgaattgtctagcaaaaatggtaggatgcttctgtagttcacaaatgttacatttcagagactttagaggaaaaattattttaaataactgtcaactgtttcattgctttttaaatttttcacgtgcataaccccctttagaagtaaatttttacactattttgttgtttaaaggaggcatttctacttccttgagttttgctgttgccaacctaaaacatttccctttggaacatgagttataagttattacttttcctttacatgtttacacttttataaaaatcagatttttcagtggtctctccagatattaacaagaattgttgtgtaactcaaagatttgcttttatagacttgatttcaaattcttaagttcagcctttccctatcaatcacaaatcatgtattggaaattataaatggcaaccaaaaactggcttttaaaaaatatttttggatatcattgatgtgctgtcacactatatattgagtgactttctgaacaaatttatccagaacatccatagcccaataagcttttgtctaagttgtcatcttacttactcacaaaggaggggaaaacgttattttcatagctgcttttagaaatgtaaattgtaacagcctccttggacaacattgtgagtctgttttaacattaatatactcttacaacctaggaatctcctgggaatctatccctaaggaataaaaagcgccagcacttaagattatatgtttactaatgtatattgtattttttggtaaggaccaaaaaaacaaacaaaaaaaagaccatcagtaagggaatggatgaataaattgtggtaaaaacataccatggctgaatggtatttccttgaaaagaatgtgtgggaacaaactccaaacttctctaggtcaaatgaggaaagcaagaggggagagagagagtgtatgtgtgtgtgtagcagtttttataaaataaagataaacccttatatatgtgtgtctttgtatatgattttatgggcctggtgaatagaattccttccatttttaacctgtggacctcaccagctttatcagtgagggctttagcagtaaactgaattagcgccttatgaaaggatgacttggagaatgagagaaggattaagggaacaaacaacggatggtaaggaatccagagaccagcagtgccaagaagctgttgtctccctagggaccaaaggaagaaatggtgtttcagagcccagtgagagccaaaatgttggaaggtctctttcctgtaggagatagaaaaataaaaaggaagagtgtctcttaagtggatgttgaagctctacaaagatgcagctactgtgagaaacacagaactgtcaggaaagggagcagagggggaaaagcctcagctctttattgctgtctcctgaagatgcctccatcaactgaacctaatcagaagcccgggtgatgccgtcctcctgggataaagcagggtagaaagatggaggatggaccaggaggggaaacagcacaatcagcaaatctcccatctcagtttcagccttgctggtccgactgtaatgaggctttcccagaaggacccttcttcccctatggtcattccaagtggcaactgtttgtctcatgcctcttatgcgtttagaggtaagatgactgactctgaagcccaatttcagaggaaataaaaatttgggagttgtcacagggataatattttaagccataaagctaggtgagattacctaggaaaaaaaagtataaagaatgtcaaggactgagccccgagcactcaccccagtgtttgctgggcaggaactggcaaatgaaactgagaaggaaccaccagggttagggtgaaaaccagtagagggtggtatctgaagccagctgaaaacacttattttgaagtagaagagtggccactatatcaaatactaataatttgtatgaagttggatatatgctgagattaaccatcagtgaggtcattttgaaaaaaacagttataaaggagtggtcagggtaaatctaggaggattcaagataaacttggaaacaggagctgtgaataaggggccaagtgttaaggactgaaaagtctgagattttgtcctacttgcaaggtaacaagttaagctaccagtttcatggatactggcagaagacatactgtactgacctcgaatacacatttgctgggtggagttacaggaggggaggtccaagtttagggagcctgaatcttaaacagtggtctagaagtaaatctatcaaacctttgtctagaaggaagacatattatactggatgctaaacaaactgttgctctggagaacggattacctatctaaggctattcatcctgaaaacagcctgtaacaaaagccatcaccatatgtacttgtaagatagtgagaaacgtgagaaacccatggagaattgtctcccaacacagagaaacggatgggtaactgaagagatgggggcttttgaggattttggtgttttaaaatattagaaattctaggataaatttatatactcatgggaacgataagtagaaaaattgacgctgtacgagaagaggaggaggagaatggactagagcagagcctgagcaggtgaagacactgggatccagggtactagtgaagaggtcagacgctggagcaccaaccaggaggaaggcagagcgtgggcagagaagatgctagagcttgtgagtgttcttgtctgattgcttttatttccactgttaaactgaaaacatagttattagctgagagtgaggatggtagaggtggtgtgagacgtttgggggatagggaagagtgaaaaaattaaggaaatgtacgatacactaaaggcccacttgaggttagtggtcatgagtttaacataacatcaattgtcagggttgtatgttttgttccagccacattcagcagagttggatttagcctggattgactggtgtgaaatacatgaaccatgggacttaagctgattaggtgaagagtcacaacttcagagagggaaatcagcgggagtggtttcagcaagatggcagaatagaactttctagcacttgactccctgcagaaacatcagtttgaatagctttccatgcacaaaattaccttcacaagagctaaagaaaccaagtaagagatcacagcacctgggtatagtgtagaaataaaggatgcggccgggcgcagtggctcacgcctataatcccagcactttggcaggccaaggtgggtgggtcacctgaggtcaggaatttgagaccagcctggccaacatggcaaaaccccgtctctactaaaaatacaaaaattagccgggcatggtggtgcgtgcctgtaatcccgcctactaggggggctgaggtaggaggatcgcttgaacctgggaggctgaggttgcagtgagcttagattgtgccactgcacttcagcctgggcaacagagcgagactccatctcaaaaaaaaaaaaaaaaaaaggatgcattgaagagggcacgaaggacagtgttacattatttttattacctcttccccaaccccaggcaccatagtgtcaacagagacaccctccatacaggggaaagagaagaaagtgaacactggactttgcctccatcccaaacaccttctcacctgggtaaaactcagagctaggcaggccccactgccctagaccccaggccactacccacagagaacttccaggccgaccccaccatgaggttgaatcccatagccccaggccagcacagcagacttggtctgctcacctcacctccagaccaacctcagtggtccaggctcaccaagcttcaggtctggtcccacagtcgggttccaggcctgcagatgcaaggcttcaggtctgtcctgggttctagaccagccccgagccaggtcagcacccctggcctgaggctccaggctggcccttgcctcacctcagtctacaggcactgacatggtgccaaggcctgcccaggtctaccctagcacactgtacacagcccggggcctaccccagcaccatgtaagcccccatggaacaagggttcaggccaacccaagaggatacagtttccaggcttaccttcaaggacccaagttccagggttacccctatgcacccaatcaacaggtccactccagtagatccaagcttcaggcccagttctgtagactcaagcaccaggtctgcccatctgctgatgcaggtaccaggccatcctggctgaggactccagcagcaaactcacttgcagatcacaccagatggcctccccagaatctctggacaggttgactggtgaagagctttcccagacaatggcagtctgcagactggaatacttattcactatttcttcaaatgcccagatactaacacactagaaggatcaagaacaatcagggaaatatgaccctccgaaaaaggaacaacaaaaaaagcaccagtaatggaccctaaagaaatttagaagatttggataatgtatgagctgcctgacatttcaaaataattattttaaggaagctcagcatattaaattttcttaagaaaatagagaatttgattaaatcaagaaaatgaccgccgggcgcagtggctcacacctgtaatcccagcactttgggaggccgaggcgggtggatcacaaggtcaggagatggagaccatcctggctaacacagtgaaaccctgtccctactaaaaatacaaataattagccaggcatggtgtgggcgcctgtagtcccagctactcgggaggctgaggcaggagaatggtgtgaaccctagaggcggagcttgcagtgagccaagatcgtgccactgcattccagcctgggcaacagagcaagactcttgtctcaaaaaaaaaaaaaaaaaaaaagaaaatgaccaacattagaaacttaaattataaaaataaaaaattctgaagaatataattaatgacatgaaaaatgcaatagagagcagcaacaacagaagtgatcaagcagaagaaagaatgtgagctcaaagacattttatttcaaaatatccagtcagaggagaaaaaagaatgaatgaaaagactgtggcatttatggaatgccatcaaaagaacaaatgtttgacactcagaagttcaagaaggaaagagagacaaaagggcagaaaggttaaataatagggccagggtgggggtggttcatgcttgtaatcccaacactttgggaggccaaggcaggatcatttgatcctaagagttcaagaccagtctgagaaatatagtgaaacccccatctgtagaaaactacaaaaaattagcctgatgtggtgttatgagcctgtagtctcagctacttgggagcctgaagtgggagaatcccttgaaccaggaggttgaggatgcagtgagccatgatcatgccactgtatgccagcctgggtgacagagtgagaccctgtctcaaaaacacaacgcaggagggaggaagtggggagggaagggaaaagaggaataggaaggggaatagggggtggaagcaggggaggaaggcagggagaaaggaagatataaactgtacaaatctgggaaaatatgtgaatatccaggtataggaaggtgaaaggattgaatctgactggagacctaacaagactacaggagtacatgttaaactgtcaaagagaagatcctgaaaacagcaagagaaataaagcaaatgacttatgggagcttcaataaggctagcagtggatttccaaacaaatcttacaggctatgaagagagtgggatgacatattcaaactgctgaaggaaaaaaaaatgctgaccaagaatactgtatccagcaaatctgtcctgaaataaaggagcaataagaactttgctagacaaaccaaagctgaggaagttcattaccaccagacctatctttcaagaaatactaaagggaactgggcacggtggctcatgcctgttatcccagcacttgtgggaggccaaggcgggcagataacttgaggtcaggagttcaagaccagcttggcaacatggtgaaacgctgtctctactaaaaatacaaaaattagctgtgcatggtggtgcatgcctgtaatcccagttacttgggaggctgagacaggagaattgcttgaacccaggaggtggaggttgcagtgagccaagattgtgctactgcacttcagcctgggtgacagaaagaaactttgtctcaaaaaaactaatcaacaaataatagctataaaatgttgagggatacacactataaaaagatgtaaattgtgacattaaaaacataaaatgtggaaaggggtagagaacatgtagtttggtttacaatcaaagttgttatctacttaaaatatcctatgataactatattttctgtaagccttatgctaaccacaaagcaaaaaatctatagtagatacacaaaagattttaaaaaagaaatcaaagcataccaccaaagaaaatcacgtcattacaagtaagaaagcaaaagggaaagaaaggaacaaaggatctaggaaagaagcaattaacaaaatggcaatagtgggcccttggctatcagtaattaccttaaatacaaatggattaaattccttggttaaaagagtggctgagtaaaatttttgaagacccatttatatgctgcctataagaaactcacttcacctttaaggtcatatatatactgaaagtgaaaggatggaaaaagtattccatggaaatggaaaccgaaagagtagggatagctatacttaaatcagataaactagattttaagtcaaaaattgtgacacaaaggtcattatatgacaaacgtgtcaatttatcaagaagatatacctctaaatttatatacattcaacatctgagcacctaaatatataaagcaaatattaatagacctgaagggagagagagagactgtaacataatatcagtagaagacttcaataccctactttcagcaacagacagatcatccagacagaatcagtaaggagatgtaaactacagcttagaccaaatggacctaagagacatacacagaatttccatccaatagcagcagcatacacattcttctcaagcacacaaggaacttctctaggataggatgtatattaggccacaaaacaaatcttaaatttaagattatatcaagtatttttttcctaccacagtggtataaaaatagaaatcagtaataggaagaattttgaaaaatgcacgaatatgtggaaattaaacaacatgctcctaatcagtgggtcagataagaaatttaaaaacatcttgagacaggctgggcgcggtggctcacgcttgttatcccagcactttgggaggctgaggcgggtggatcacgaggtcaggagatagagaccatcctggctaacacggtgaaacttcatctctactaaaaaataaaaaagtacaaaaaattgcccggcgtgcctgacacatgcctgtaatcccagctagttgggaggctgagacaggagaattgcttgaacatgggaggcagaggttgtagtgagccaacatcgcgccactgcactccagcctgggtgacagagtgagacttggtctccaaaaaaaaaaaaaaaaaaaaaaaaaaaagtcttgagactaatgaaaacagaaacacaacataccaaaatttatgggattcatgcagtgagctgagatcgcaccactgcactccggcctgggtaacagagggagactgcatctcaaaaaaaaaaaaaaaaaaatttataggattcactaaaagcagttctaagagatgtttatagcaataaatgcctatatcaaaagagaacaaataatgctatacctcaaagaactagaaaaagcagcccaaagttagaagaaaatatcagaacagaaataaattattcatggatttattcattcatttcttagaaaaagacaacaggaaaaaaaccttaagaattttttaagataaaattggaaaacttttaggtagagtaagaaaaaagacaactcaaaatcagaaatgaaagctgaagtgttacaactgataccacagaaatacgaaggattagaataccatgaacaattatacatcaacaaattagagaacctagaagaaacggataaattcctaaacacatacaaactaccaacactgaatcatgaagaaacagaaaaaccaataggctgggcgtggtgactcacgcctgcaatcccagcactttgggaggccgaggcgggtggattacttgaggtcaggagtttgagaccagcctgggcaagatggtgaaaccccatcactactaaaaatacaaaaattagccaggcgtggtggcgggcaactgtaatcccccctactttggaggctgaggcaggagaattgcttgaacccaggaggcagaggttgcagtgaaccgagatcgcacactgcactccagtctgggcaatagagtgagactcgggtagggggggtgggtggggaaaaggccaggcacagtggctcatgcctgtaatcccagcactttgggaggctgaggtaggcggattacctgaggtcaggagttcaagaccagcctggccaacatgacgaaaccctgtctctaccaaaaatacaaaaattagccgggcatggtggcgggcatctgtaatcccagctacttgggagactgaggcagggagaatcatttgaacccgggaggcagaggttgcagtgagccaagattgtgccattgcactctagcctgggtgacagaatgagactccatttcaaaaacaacatcaacaacaaactcagtaagaggctgaattacaaatccatcaaagaaaagcgcaggacttaatggtgtcagtactgagttctacttaacatttaaagaactaataccaattcttttcaaactcatccaaaaaaattgaacaagggggaacaccttcaaacttattttatgaagccagcattaccctgataccaaagccagacaagggcactggaagaaaaaaaaaaattacaggccagtatccctgatgaacatagatgcaaaaaccctcaacaaaataccagcaaaccaaattcaacagcacattgaaagacaattcactatgatcaagtgggatctatcccagggatgtaaggatgtttcaacatacacaagtctataaatgtgatctaccacattaacagtatgaaggacaaaatctattctgatcaccttaatagatgcagaaaaagcatttgacaaaactcaacatcttttcataataaaaactctcaaaatagatatagaaagaatgtacctcagcacaaggcaggccatatatgacaagcccacagctaacatacttaatagtgaacagttggaagctttttatctggctgggcacagtggctaacacctgtaatcccagtcccttgggagtccaaggcaggcggatcacttgaggttaggagttcaataccagcctggccaacatggcggaaccctgtctctactaaaaatacaaaaattagccaggtgtggtggtgcagccctgtaattccagctacttgggagactgaggcaggagaattgcttgaacctgggaggcagaggttgcagtgagccaagatggagccactgcactccagcctgggcaacagagtgagtctgtgtcaaaaaaaaaaaaaaaaaaaaaaaaaaaagagaaagcttttcatctactatcaggaacaagacaagaatgtccactctcactacttctattcaacacagtattggaagtcctagccagaacagttaggcaagagaaaaaaatgaggcttccagacgggaaagaaagaaggtaaattgtccatgtttgcagatgctatgatctcatatagaaaaccttaaagagtccaccagaaaactttcaggactaatgaatgaatgaagttgcaggatacaaaaatcaacgtacaaaaatcagtagtgttttatataaacaatgacctatctatacaagaagtcagtaagacaatcccatttacaatggctacacaaagttaaatacttaggaataaatttaaccaaggagatgaaagactggtacaccaaaaactgtaagacgcagataaaagaaactgaagatacaattaaatggaaaactatcctgtgttcctggattggaggaatattgttaaaatgttcacactgtccaaagcaatctacaggttcaatgcaatgcctatcaaaattccaattatattttccacagagatagaaaaaacaatcctaaaacttgtatgtaaccacaaaagaccccaaatacccaaagcagtcttgaacaaaaagaacaaagcttgaggcttcatactaactgtatcagtgcattctcacactgctataaagaactacctgacactgggcaatttatgaaaaaaagtttaattgactcacagttccacaagcttaacaagaagcatgactgggaggcctcaggaaacttatactcatggtggaaggcaaaggggaagcaagcagcttcttcacatggtaaccggagagcatgctagcaaagggggaagtgccacacacttgtaaaccgttagatctcatgagaactcactatcaggaaagcagcaagggagaaatccacccccatgatccaatcacctcccaccaggcccctcctccaattcgacatgacatttgggtggggacacaaatccaaaccatatcactagttgaattcaaaatacactacaaaggtatagtaaccaaacagcatattagcatcaaaacaga

SEQ ID NO: 380 - DNA, 88284 bp, Homo sapiens
ataagggcagctgtgctgatggctgctgatccagctatgctaaggctggccagaaggggcacaaggagtggggcagctcagcaaaacctggaatgtaattcagggggagcaatgagaagttgtccctctggcccactgtacacatagacctgggggagcacatgaaccaacactcacaggagaggccccggttaagtcccactgatgcagcaagtgaggtcagaagtgcaggccagccaggtattgttgggtgcctggtaggagactgaggtgtttaaggtagtaagtagagaatgattacaggtagcctgaaaggcagaagcagacaagttatacccagagctaattagacaggaggtgttctttgacacttctcctagtgtaagggcatggggctgtgtatgacaagaaagagagttaactttgaacatggctttattcctaacccaacataccatgggggtttggccttcaggcacaaccagcaatcttgggctagtttaggctggatgatatttaggaggtgatgtaccccatccagaatggatatcaggctggattggagatgttgttgttgtaactgagatctgggaacaaggagtggtggtgggatagttaaattgaccctgtctgggtgtctttggaacatagggtcacctaaatcagttaaaggcctggttgacttaggagggctctatgggaccaggacctttttttggatggtgaacatagttccaacatcaaatcctgagatacaaagccttaatccccatgacatgccataataccattgagctgaattagggttacagacagttatagtgagagggctacaattttttatagtacacggtctaggacgggaattgtgagttatggaaagggttgaggaccaggttgatcctccagggtaagtggctagggttacacacgaccagtgagggcagaaaaactgaaaagaatctcaacaactagagtcagggtgattttcaagacagaggtaaaagtcaacgccttggagtcctttttttgcacctttagagctcccacctccggtctagcttcctgtgtgtctgaatcctgcagcaaggttgatgttccccactcctgcgactggcagattgcactgttcttcatgggtacaggcaggctctgggaacaaagcacataaatcgactgcaaaagagacttccttggaggttcctgccttccaagtagtgtttgaaaactcacatcctgttgtgaaagacgtgaggagaaaagagtaggatggagcagacggcataataggcagaaacaaacaaaagaggtaaataaaaaggattaatttgatggctttactcaacttaggtgcagttttaaggggactggcccaggcttggggacccatgtttcctgctgggctttgttggctttcttgatgtcagagtgatgaatccaagcatggataccatccacctttagagccgttggcgtggtgagaatgacagtatgaggtcccttccaggcaggagtgagtccttctttctggaactttttaacatacaccaagtaacccggttggaaagagtggcagggtccagtctggcaggaaccggattggaatgtgctcaccagaaaagtggctggatgatgtctcatacctgttggagagactgcaagtactgtaacaaattagcttgtgagatttctgctaaatggttatctcttagcttaggcaagctagtgcaccccttttatacatgatttcaaaaggtgaaaacccagcccggtaaggggtgcatcttactctaagaagggctaaaagaaggagccttacccaattttcacctgtctctaggattaatttagtaagagtgttttttagggtgtggtttatgcattctacctgtccagagctctggggtcgataggcgaaatggagtttccattgaatgtttaatggcttgctgaccgataagctatggacgaggtgaaggctggtccattatcagaccccatggcaacaggcagcccatgtcgagggatgattctattgagtaaaagcctaactaccatggtggcagtttcatttctgtggcaaatgcctcagtccatccagaaaaaatgtctactagcaccaggaggtatttataccctgtccggtgtggttttatttctgtaaagtcaattttctacttttctcctggtgagcttccctggaggccgtggcctgggctaggcttgggacctcatctggcatttacctgagcacaagccatacaccagagagctgcttggttagttaagtcctgaaggtgggggatcttgaaatggctctttagaagctgggccagttttattcttcccaaacaggtggtagaatgcagatgattgattaaagtttccccaaaggcttgggggcataaagattctggaatcaggaagaatccaccaaccttcctgatttttactggcctgaagatctgaagctagtttttcttccactggggagtattctggttggtctggcaagtcagtttgtggaaaggacactgtggacagcagggttaaaggggtgactgggagcagagctgcctcttgagctgcagagtctgctctttggttaccacaggcaacggctgtgctctgtctttgatgtcctttgcagtgaattacagccatctgctgaggaagccaaacagcttcaagcagggccaaaatttcttctttgtttttaatagtctttcctgctgtggtgagtagccctcactcttgatagatgactccatgtacatgtacagtagcaaaagtatacctgctgtcagtgtaaatgttaatacatttgtccttaccccatcagagagcctgagtgagggcgaccaattcagccttctgtgctgaggtacctgccggccgtgcctaggcccacagtatatctgtctctgttggaatggctgcaccagcctttcatactccctgttcaaggaagctactgccatctgtaaccacggtggcatccaactcctttgggggcacatctcagagatcaggtcggccagtttccatagtctctaacagttcttggcagtcatggacaggtgtggtaaggtctggatcagggagcaaggtagctggatttaaacaccttgtgggagagaaagctaaacaaggctgatctaacagtaaactctgatactgcaggatgcgagcatttgacatccatttgccagaagcacttcatagcaaagtttctatggcatgaggagctgtaagggttaaattctggcctagagtcagtttatcagcctcctggaccaggcttgtttttgctgctgtggctcgcagacaacgtggccacctggagaccacagggtctagctttttagacaaataggccactgggggtcaccatggtcccaaagtctgagtaagtacacctttagcaactccctggctctcatgaacaaaaaggtgaaatggttttgagatatttgggagggcaagagcaggggcctcagttaatgtcttttttagattttgaaaagcctgttcttctttgtcagtccaaactagtgggccattccctccggtagcagtgtacaggggcttagcgatttctgtgaaccccagtatgcataaatgacattatcccatggtccccaggaattcacatacctgtctcttggtggtgggagtggggattcgcaggatggcttccttttgagcactggtgagtgccgtttttcctttgtttatcttttaccctaggtaggaaactctgggaagacaaagctgggccttcttggtgagacctggtacccgagttcctgcagaaggccaagcaggtccctagtatgttgcaggcagctgtcagtaatttcagtagctaataaaagatcatccatgtactggagaagagtacagttagggtgactggctcagaacggtatgagatcttgttggagagcttctccaaaaagtgtgggggaatttttaaaaccctggggtaactgggtccaggttaattgggtggtgtttcctgagccaggatctgtccattcaaaagcaaagataggttggctttttgggggccagaggaatagccaagaaggcatcctttaagtcagtgacagtgtatactgtatgttctggtgggagcagtctgagtaaagtataagagttacggacagttggatggatggtaactgtccacttgttaacctctctcaagtcctgtacaggctggtaatcatttgttctgggtttctggactggcaaagatggagtattccaggcagactcacatggtgtgaatataccagcttgtaacagttgctgaatatggggatagatttcccctctagcctgctgactcataggatattgttttacctggactagcaaggcagtggccaggagttgtacaactactggcagatagtgctttgccagtcctgggggtttgactcagcccagactcaaggaaagagagtctgtaaatccagtaggagaggattaattttattatccagtgcttgtgagggtgaaactaagagattttttttgatggaggggtggttagcaggagctgaacagcagtgggcattgtgtcccctaaagcaaggtgagcttgttgggccaagaaggagatagacgccttcagcttatgaagtaggtctcatccaaggaggggaaaggggcactctcggactatgagaaatgagtgggttgctcttttctgtcccaaactcacctctcatgagtgggtgacaggatattcctgaatagctccagtatccccttgcacagccacctttttattagagacactgcccaagggcatttgcagtactgagtgttctgccctggtgtcaattaggaaacgtacaggccggccccccactgtggcggacaccatgggttcccgggggccaagggagagggagacccagccccatcaatcagcatattcctccacagcagggaggatgaggacctttttattctctggtttttcttctggttttaatgggcgttccttcttccagtgtcaaatctgcttgcaataagcacattggttttttagtacaggagcctgctcacctttttggcctttttggcagggacccgagatctcctggccagcgctctgtgctgggggcccttccctcctggcttcttggatggcagccactaagatttttgcctgtctttttgatgctttgtcagcagccttttcagctgcctgagatgcctctttttgtttttcaaactcttgattgtcaaaaactttctgtgctatttctaaaagctgaatgatattcattccagcaaatccctttaatttttgtaatttctttttaatatcaggggcctcctgagccacaaatgccaaattaatagcacggctattcttaggagccgctggctcaaaaggggtgtaagtccaataggcctcctggaggtgttccaaaaatgctcccagtgactcatcaggcccctagaaaacttcagttgtcttagataaatttatgggtttttgagttgctcctttgatacccacaaggagataccagtgaaaatcatccaaagctgtctttccccatgaggagtttggatcccaactgggccgggtagagggaaaaacctccactaggaggtcttgggcttccccctctggtctaccggctgatgtaaggaaatacttcctagcctcccttcagatacagtccctctcttcagaggtgaaaagtgttaaaaggagttcctgacaggcatcccaggtgggccagtgagtccggagcatggattccatcagtgaggtcaagacctggggcttttcagagtaggggggattatgaacctttcaattgtacaggtcagaagtagagaaggggacataaactaaaaatggagcagagcgctcactgcctggagggatttgggcctctctcagcaggaggagaggggccacctcctctggctgaggccgtaattgggtggctataggtggagaagccacagagcatgtagtcaaggagacatgggaagattctgggagagcaggagggttgtagggtggcaaacatgggtgaggaaaactttcctcttctttagaaggaggcagtacaggaggagccgagggagctgagggttggggcaaaagtgcagtcgggctcaaaaggacctgggaggtgggatcatgaatggtgcatgagcagagccatggaggagggctctggaccaaatctagccattgatcaatgtaaggaaactgattggggtgtccgggagttccagcaatgacctgccacacagtctgcacagttgtgagattcagtgacccttctaggggccacctggttccaaactgtggccattccacttcataaagtgtccagagtttgctttcttaaggcagactccataatcctctgagaagcccagagaggaattttgtaacgtatattggaagggctccaatctttatggggccaggaagaagagttccccattctggaggcaattaacaaggtctaggcgaaatattaaactcagcatggacagagaaattcacaatctggggggctgtagtataggaagaacagaagtattataaccagaagaagtaggaaaacaactatagccaacacttcttgtcacataagttctgtttctttaagctttgagatctagggggaggacaagaggtgggtctgaggccagtgggacctatgtgatcctcccctcctttctgacttatagcccaaatatctttggtatctccacgactcaaaggcaaaaagtttaaagttggccctttcttttaaggattttaggagggagagtagagtcattggacgttggacttgctgtgacacaggaaaacaagatgggtggggtaagggatggggatgaggaggaaaggggccactctgatcttttctaaggtaggagagtagccagagggatagaataagaatccaggtggagtaaagcagtatgggcacaggtttctctgcacagtgccttatctaagggcatgggaaaagttatgggatgacagaaaaggtgagcaaggaggactgcagggtggctattttgaatccaccactggtctaaggcagaggtggtccagtcactggggcatggggtgtggcaatccaaatgctagcaatctttatggtgccagaaatcccaaacgggcaaatgttccccacacgcctccccgtaacaacacctgatttgtttctgacagaaaaggcaggactgggaagaccagcccaaatgactgatgagaaatttgacctcctgtgttagaaaatctgcattcaggactttaaagaagttcttgcccagtcatcttcggaaatatcgatgacctgacatgtgaaacttagacagacaccagacaggacaagagacaccggggtatacaaacaattatgacaatttttatagacagacaaggggagggggtcccgtgatgggatcagccagatgcccacctggctgctccgccggaggggacttaggctcctcttggcattggcagaccggtataaacccaccggctcagatcaagctatgcccgatgctgccttaagccttatgaggtcgccacggaaccacaggtgagggcccactccaactccgtagctttcaccgtggagctgcaaactggaaattcaaggacaagcccttgaaccccacattcacacacacacttacacagagtttatcacaattctttattcccattctaaaacagaggtctcctagaaacctgaatgagagaaggagaagagataaaaagagagagagagaaagacagagagaaagacagagagagagagagagagagagagagagagagagagagagagaggctagtcttaacagagaaggctgacagaaaccaggactccgtcctccagcatcctggaatatgggcagagtcagaaggacgccctcgtcagggccgcttccctcccagagaaacagagtcagatctgacttaccttcccaggaccagaaatgcaggactcaggagttgattttggagggcacacaccggcagtcgatccgttcccctccggaagacagtggcctacgggtctctggaacagcttcaggaggtgcctcccctataagcccgctgtccagccaggagagcctggagcgagtccggcactcaccaggtggcaattatcttgctggggcttccaaatgttgtaaccgagcgagttgtagagaaacgccacactctgagactaatttcaggagtccttttattgccggtgaccgagagacagctagtgctcaaaattctctcggccccgaagaaggggctagattttttttatatcgtggtctaaataggggaggcggagtttagctaaagcaatttttacagaagtagaacaggcagaaagttaaaaaaattaattggttacagaagcagttacagaaaaataaacagttccaggtgcaggggtttaaactatcacaaagaggtaaatgcaggggttttaggtgcgtccccaggagctgctggttcagcttgcctcaatatcttatcagtaagtgcattcctggacgtgcttggagtcagcttgcactagttatgcccttaagggagggaggtaaaggggctgtaagtgaaggaaataaaatggagtctgtccggctctctcagctaagagagataatcaggttaaaacaaggtagggtatcaagagatcatgccattgtacttcagcctgggggacaagagcaagactttgtctcaaaaaaaaaaaaaattggtaatatggtgcactgtaagctacagaaagacagttataaagaaagattttatataaggaagaatcttgtatgttaaattcttgttctaaaaggagatgactggttgtttaaagaatggatgtttaggacaagtcagaaagtttgttataagatggtctgtggaaataaagagttgaataattaaaggaaaggcattgccaagattaacactaaagttactttagccaccggatgatgtatttctcccaatcatattgaaagttataaaaatggcctaaacctaaaagtattccctaatggcaagtcaaggggaaaatgtatgtttttctcaaagaaaatgttacttttatattaacgtttctggtaatgtacagcaacatctagtggaggcaaaccagtattacaatccattgggacaactaacaggtgtagaactctgctattataccataaggttgtattaccccactagcagcggtcatcttaatatgaatattctaatcctgtcttcaaaaccttctggtaaaaattatctcttttttgcctaggtgctgcaaacagagccacacgaggacacaccattctttttttttattgtttgtttgtttgatttaagacgaagtctcgctctgtcacccaagctggagtgcagtggtgagatatcggctcactgcaacctccgcctcccaggttgaagcaattctcctgcctcagcctccctagtagatgggattacaggcacgcaacaccaagtctggataatttttgtgtttttattagagatgcggtttcaccatgttggccaggctggtcttgaattcctgacctcaggtgattcacctgcctcggcctcccaaagtgctgggattacaggcataagccactgcacctggcctggacacaccattttttttcaagaactcttagatcaacctcaggaggagccctaactgctgttccccaacatgatggcccttttcagcaggaagtatcttgaaagattcgtcatctgacaccccctaacagcagttaggaatacgtctcctgaggggagaataatataggagttattaagaaattattttaggcatttagagagggtaaaagagttctctcactagaatttttctttaataaaaagcagccccaaagccaattcttttctaacagaaaacagcctgaaaagtcaagctgcaagctgataagcaggctggagactttcatttgtaaatgcaggcggctgtattaaaaggcaagtacatttcaacagaggtgaattcctcctcttttttctttgacaccacttgtgtgggtgtcatggcaccagccaggtaaagccacgtgagcaggtatcatggtgacaggtagaagctacatttgcataataaaagactagggtgggagggccagcctttgcatgggttatgtaaatggcacacctggtcaaccaatctcctgtgccctatgtaaatcaatcactgactcctcaagcttctctacaaaatcaattgtgttctacccgcaaccaggaaattttttaggtgaccctgtttctcagcatgaggagctttctctctctctgttatttttgcctattaaactttctttttttttttttttttttttttttgagacggagtctcactctgtcgcccaggctggagtgcagtggcgccatctcggcccactgccagctctgcctcccgggttcacgccattctcctgcctcagcctcccgagtagctgggactacagacgcccgtcaccacgcccggctaattttttgtatttttagtagagacggggtttcaccgtgttagccaggatagtctcgatctcctgacctcgtgatccacctgcctcggcctcccaaagtgctgggattacaggcgtgttgtctattaaactttccaccccaaaatcaatcctcgtgtgtgttcgtgttctaaattttcctcgtgtgagacaacaaaccccaggtatttaccccagacaatgcagccatttcagagtctgggaaatgaatcttagtcacagaaaaaaagaacagcaatgaacatggcaaggtgcttatgattctggtccactggatcttcctatccctaggaaagtaaataccatcacagtcagcacccagcaagttaccaccatataatttcttgtttgttccaaaataaatacaggtgattcttatcacaaaggcaaataaaaagtagtttactttttaaactgaactgtatcagtttagtttactcttaagttcttataattttgaaaatgcagttgacacttgtatggcttatgaaatttttgatagtctaacattacttgaattgttcaaagaacagtatattttaaattaagaagagtaaactgtatgtgtttgtttcctatatttaaggtttagaatcacaaattacactcctgtttatgatttgaaaacttcaaagtttggtttttccatctgtacatacacagaacagtgttatcgtgctgaaacatttgtatcttaagatggcagtcacagtttccatctgtctggatatattttggacttttgcatgttaaacataagaaagagactttttgttttaggtaatctaagactgttgtacacaaactacagattactgtagggttcagcaaactatgtttataatgtgacattaatatctattttgatgtctaaatcaaaactttttttagaaataattttttttttacaaatatctccacaaattcaggtttattttataaaatggcaggatagtaaagaaataggtggtttgccatagtatatgaatacatgcacttaattaaaataccaaatattataatcaaaatttagatagcagatttaaataatttcttgatttttcactacaggatagaaattcacaaatattttataaatcaaagctattagtattaggttttacttagtagtaatatatatatatattctgggtatttaaaaaatatatatatattctgggtatttgaaaacaccaaattattgatgaaaatgtccattttgaacaaattattgatcatatatatcatacatcatacatacatatcatatatgcaatcatacattatcatatatgtatgatgtataatatatgatcaagaatttgttcaaaatgggtatttttcatcaataatttggtgttttcaaatacccagaagtcttgttttaatcagattaactctaagaatagtttactaattttattttttatggtgtgttcaaaatttgatagtttaatatggattgatgatgggtaaactaatcaatttcttttcaaatctcataggcctattacattgtcaaggatgttattaataaaaattctttcttttaatattgtttacagggatttaggtctagtctaatctgctcaacctgttaatcagtgtcagctgccagattccaactcatttttagtgtgcctatgtgactttttctccatagtctctgaattacattttgattagttattggaatatcatatagcacagctcatacatttaaaacaaaaccaccaggtaaaatgagttctggtttagtataaagaagctgtcaccaagttagtgttacatacatagatggatgtggctcaacaagattttagacaaaaaaatttgaattgaactatggcaacgtgtgttgctatgacttagcctctagtgggcttatgaacaaagacaaatttcagcaaatttatccagttgctttcagtatctctaaagatagtatgtcaagaattctcatgctactgtctgaaaaaacagattcttctcttatctaagaaatcaactggatatatttttataagcttgtgcaagaaaaaactgcaatgcagtactaataattacagacgatataatgtggaaaagaataatctagaatgtcaatttcaatatgtaagtatttaggttgggcatggggactcatgcctgtaatcccagcacttgggaggctgagtcatgtggatcactttaggtctggagttcaaggccagcctggccaacatggtaaaacccatcactactaaaaatacaaaaatcaagcatggtgggaagcacctgtaatcccagctactcaggaggctgaggcaagagaatagcttgaactcaggagacagagattgcagtgaactgagattgaagcaccgcattctagcctgagttacagagtgagattctgcctcaaaaaaaaaaaaaaaaaaaaagtatttaacctttcacttgaaaaatgtgataaaattaagtttttggtaagctttgtgtagcttaacatcagcatagagtagaaaaaaaatctttaaaaatgcaaacaaaaagctacaccaaaaaaactaacatctaccagtgcatacatattgatctttgttttgggagagtctaaagcaaaacatttggtgaacttgatacagttattttgatcacattggcatactgataaaatcattttatttaatttcactgaaacatgttcacatcttaaaaatactgttttgtaacatgaatgataaatgtaaagtctttatcctcaagaggatcctgattctcaagatatatggcaacccgtgtctctggtttctccaaactgaagtttcatgaaggctcaaacatgaagtgagagggagtcaacaacagagcatgagaagcaagaaggatgaggtaggatggtcagctctaaggctcagaggttcctgggggaccccaatataatgatgtcaactatgaagctcactagtaaacataaacataaaaagctgaggctgggcatggtggctcatgcctgtaatcccagcactttgggaggcctaggcaagcggatcacaaggtcaagagatcaagaccatcctggccaacgtggtgaaaccccgtctctactaaaaatacaaaaattagctgggcatggtggcgcacacctctaatcccagctactcaggaggctgaggcacgagaatggcttgaacccgggaggtgaaggttgcagtgagccgagatcacaccactgcattccagcctggtgacagagtgagactccatctcaaaaaaaaaaaaaaaaaaaaaagttgaaaactccatggcttctctttggtgagaaaaagtctctggaattacaaacagtcctgccaaaaggattgagccagaatgacatgtatctaaggattattaaggaggaatgttcataagcacataagtatttgttccaaaacttattacagtagcaatatccttttctgtaattttagcttccccaaggtagggttgctgtagacaaactaagacaaggcactaatatgttgaaggcaattagtttctaaatttaaaaaacttgcaatttttttttttgagatagagtctcgctctgtcacccaggctggagtgtggtggcacaatctcggctcactgcaacctctgtatcccaggttcaagcaagtctcctgcctcagccctccaaatacctgggattacaggtgcctgccaccatgcccagctattttttgcatttttagtagcgacagagtttcaccacgttggccaggccggtctcgaactcctgacctcaggtgatccacccacctcgggctcccaaagggctgggattaccggggtgagccaccacacctggcccaaaaacttgcaataattttataaattttattgaactctgtttcatgtataaatctcacaaaaagacactatccagtagctatttccctgagacttttctgggaatttctgttgcttgatttcaaatcaaccttattagaatcctagtcatttttgaagccctagatgtaataaaagaaagagggcaggaatgaaaccaagtttccccaaacagtcaatgtctaatatattttgttccccaaaatgaccccaaaaaccacacaagctaaaaaacagtgggtttgaaatttaacctacattcaacagtagcagaaaaccatatgtaaaaatcagcaaagtcataacttagaaacattctgttattccagaaaaaataataaaattcttattttggcatttttaaaaaagaaaaaatacactaaatatgacaaaatataccaactcacttatatctttgaaatatgattttctttctcctaagtatttaatataatatttagacaagactttcatgtattatagctaccatgcatgaactaaaatagccttgggggaaataatttttattaataatgaatattgaggctccagaaatgtaaaatgatttatcttggatacacagctagtgacccaaatgaagctcaaatatgtttgatttaaaaattttaattttgccactgttgacaatgttgacataacagctaaatctgagccttagagttgatagttggggaataaatcaagtactattgaggcgggctaggtaatcaagaaagtggctatgtcctggggatgcggcaaccatggtgattgcatgacaactgcagactgccaacacaataagcaccaacatttacattggatttcagctcattcaagaaaagctctctccagcagggaaattcccctgtagagagcacagtttgattttacctgtcctctaactgaccttttactcattgtaatagtaaaaaacactcacgtgtgtggagatttaagatgctaatgagatatgtgacatataaagaaacatgtacaggtactgagtgtgtgtacgaagagaaccacccagaacatggttactagtaacatctctttccacctccttataaataattatgtaagactctcataaatggaatctccttagttccagcctttgctgtatcattctttttttttttttttttttaatttgagatggagtttcgatcttgttgcccaggctggagtgcaatggtgcaatcttggctcaccacaacctccgccacctggattcaagcgattctcctgcctcagcctcccgagtagctgggattacaggtgcctgccacaacaccagctaattttttgtatttttagtagagacagtgttttactacgttggccaggctggtctcaaactcctgacctcaggtgatcttcccacctcagcctcccaaagtgctgggattacaggcgtgagccactgtgcccagcctgaagtattttaaaatggaggttgagagccttgagattaaaggtcagatttgatggtcactccatactcaccactccgatgattctgtattttgttctgatcctggacaagctcccagatgaaatggctgcactgtctggggtaaatacctggggtccattgtctaatgccaggaaaatgtatgacataaacacacaggaggagtgggtttaggagcagaaagtttaatagacaaaaaagaagagagaaagcttcctcatgctgagaaagcaggtcacccagaagagtttctgggtttggggtagaacacgattgattttgtagagaggcttgtggaggcagtgattgatttacatagggcccaggggtttggttgaccaggagtgccatttacatagccagtgaaaacactggctccccaccctagccttttattatgcaaatgcagcttctacctggctgtgaccatgacacctacacacagggtgaaaaggaaaagagggggaagtttccatgttgaaatataactggcttttggtacagctgcctctatttacatatgcaaccctctagcttgcttataagcttgcagtttgactttttaggctactttctgttaggaataaaatggtttgggggctgctttttattaaaggaaaattccagtgagaactcttttacccacttaaactgcctaaaacagtttcttaataaatcctgtattaactcctcttcaacttcatttctattgtggcatgaataattttggactgctttagcatcttcctttaacttctgctaattttctttgactttttattattcttgtccatctctggtggttgctttgctgtaccagtttgagaagttcaggtggtttcaccctcagctgctccagcagtccattcatttggctcaagctcttggacagtttctccccgttcttctgtttgtggcatctgagatttgtcagcagggcgtggttttcaggaaccatggctaccacctcgttccacctgcagggtggctcttgcacttctggtgggtgctgattctacagaaacaacagcagcagccagagcatccacatctggtgtcacccagctcagggacaccctggctgtaaccctgggatgaggtccagctaactgcatagaaatctaaggtcatccagagcatttcccatagctgggtgaaccctcctcagtttgtggagccaggccctcccaccagcttcctgctgcctcctcctctaccatcagagggatgcacaggatgaggaaggagcacggagtcaccatggaagagtccaggggagtgaggatgagctgggacaggcagcctcaggccaagtgcatggtggtgcccctcatacctgagcacaaatcagatcagccactgccactgcagggaggacagagaagcccaggcttcccagccagcctccctctgcaccagtagagatgaaaactattttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccggaaaactatttcttaaacaaaagtatggagtagaacttgcatatctgacccaatcacattttcattctctttttctttttgttttgctttttcctcttagattgtgctctcctgaagtcagattgggataggaggtttataggaaacttcagaagtatccacttatcaggagtgtgtaaggcgtttatgtagttagacttcaagtttcatgagagtagagaccaaaactttcctttctctattttattttctaaggctaccaaaaggatggcatatcatgtgtgctccacatacatttattggttaaaagaatgaatacatattctttgtaaactgtgaaactatgcaaatcaagcctttattatttttattttctatagtttagttaataaaatcaaatagaaaataatgaagtgtagaatgcagaaagcactatcgaaagtttaatgttgctctccctattcctattcctatccctatccctatccctatccctatccctatccctatccctatccctctccacggtctccctctgatgccgagccgaagctggactgtactgctgccatttctgctcactgcaacctccctgcctgattctcctgcctcaacctgccgagtgcctgcgattgcaggcgtgcgctgccacgcctgactggttttcatatttttttggtggagacggggtttcgctgtgttgtccgggctggtctccagctcctaactgggagtgatctgccagcctcggcctcccgaggtgccgggattgcagtcggagtctcattcactcagtgctcaatggtgcccaggctggagtgcagtggcgtgatctcggctcgctacaacctccacctcccagccgcctgccttggcctcccaaagtgccgagattgcagcctctgcccagccgccaccccatctgggaagtgaggagcgtctctgcctggccgcccatcgtctgggatgtgaggagcccctctgcccagctgcccagtctgggaagtgaggagcgcctcttcccggccgccatcccgtctaggaagtgaggagcgtctctgcccggccgccccgtctgagaagtgaggagcccctccgcccggcagccgccccgtctgggaagtgaggagcgtctccgcctggcagccgccccgtccgggaggtggggggtcagcccctgccctgccagccgccccgtccgggagggaggttgggggggccagcccctggccggccagccgccccgtccgggaggtgggggggcgcctctgcctggccgccccttctgggaagtgaggtgcccctctgcccggccgccaccccatctgggaggtgtacccaacagctcattgagaacgggccatgatgacgatggcggttttgtcgaatagaaaagggggaaatgtggggaaaagattgagaaatcagattgttgctgtgtctgtgtggaaagaagtagacataggagactccattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccccagggccctctgcctaggaaaaccagagacctttgttcacatgtttatctgctgaccttccctccactattgtcctatgaccctgccaaatcctcctctctgagaaacacccaagaatgatcaataaaaaaactaaataaataaaaatttaaaaaaaaagaaagtttaatgttaacccagcacacatgggtaaaatacattttttttttttttcagacggagtttcactcttgttgccttggctggagtgcaatggtgcgatgtgggctcaccgcaacctcacctcccgggttcaagcgatttttcctgcctcagcctcctgagtagctgggattacaggcatgcgccaccatgcccagctaattttgtagttttagtagaaacggtgttgccccatgttggtcaggctggtctcgaactcctgacctcaggtgatccacctgcctcggcctcccaaagtgctgggattataggcgtgagccacctggcccggccattaaaatttttagtttctaaatttgggaccattataattacatttaaattgccacatgaggatggaacatgaaacctgacttcaggagagcacaatttaaggggaaatggcaaaaaaaaaaaaaaaaaaagaaagaaaaagaaaaatgaaaatttgattcggtcagatccgcaagttctcctccatactttttgtttttttagaaaataattctttcctctgctggtgcagagtgaggctagctgggggagcctgggccccactgtcctcccggaggtggcagtggccgatttctgctcaggcatgaggggcgccgccatgtcctgggcctgaggctgcccagcccagcccctcctcactcctttggactcttccacggtgtctccaggcccctgcaccatcctgtgtaactctctgatgaaaggcgaggtggcagcatgaagatgatgggggaactgccccgcatgccaaggaaagctcgcccagctgcacaaaatgctctggttgacatcgggtttctgcgcaccaagctgcgccatgaccaagggttagagccgaggcgtccaccggctgggccaccccggacgtgggcgctccatctgctcctgcggttcctgctgtgcttggctaagccgtggctggaaccggcgcccgccagaagtgcaggagccgccctgccggcagaaagagggcatggtcgctgaaaaccaggccctgctgacaaatctcagacgccaggaacagaagaaccacaaaaatggacggaccgttggaacacctgagggtgaagttgtgcgaactcctcaaagtggaacagcaaagcagccaccagagatggactagaaagatgaaaaattagcagaaatcaaaggcagatgctaaagcagtgcaaaaccgttcacacaacgatagagacggaattgatgaagaagtttgagaaatgaatgacagaaagaaaggacagcagtgaccatggtaaggtgctgacgattctggtccactggatcccatcatccctagggcagtaaatctcatcacagtcaccactcagcaagttaccaccgcagcatttcctgtttgttccaaaatgaataaaagtgattctcatcacaagggcaaatacagagtagtttattattattatttttaactaaactgtagcggtttagtttacttgttctatgttcttataattttgaaaatacagttgacacttgcatgacttatgaagtttttgatagtctaatgtcacttgatgttccaagaacagtatattttaaattaagaagaataaactgtatttgttttatatatttaaggcttacagtcacaaatttgaaaacttcaaagtctggttttccatctattcatacataaaacagtgtagcgtgctgaaacatttgtttttttaaagtggcagccacagttcctgtctgtctggatatattttaaacttttgtgtgttaagcttaacataagagacttcattttgttttaggtaacctaagattgttgtacccccccccccaaaaaacttcacagattactgtagggttcagcaaactgtttatataatctaacattagtatctctattttctaatgtctagattttttttagaaaagattgttttgtttttatttttgttttacaaatgtctccacaaattctggcttattttataaaataacagaatactaaagaaatgggtgctttgccatactatgtggacactggcactcaatgtccaatgcccacattggatatttggataaaataccaaatatccaaatattttaatcaaaatttagtaagtttaaataatttgattttttcactacagtgatagacattcacaaatatttcatatattaaagctatcagtgttaggttttacttagtagtaatatatatataagatcaagaatctatttaaaatggatatctttcatcaataatttggtgctttcaaatacccagaagtcttgttttaatcatattaagtctgagaataatttactaatttcatttttggaataatgtgttcaaaatgttctagtttaacctagtgttgattgatgatgggtaaacaaatcaatttttttcaaatctcataggtatattatgttattgaagatgttttcaattaaaattctccctttcaatattgtttacaggaatgtaggtctagtccaatctgctcaacctgttaatcagtgtcagctgccagattccaattcgtttttagtgtgcctgtacttttctttccataacctctgaattcatttctattacttatttaaatgttatataataaagctcatatatttaaaacaaaaccagcaggtaaaatgagttctggcttagaataaagaagctgttaccgagttacatatacagatgcatgcagctcaacaaaattttagacaaaaagtattggactgaactataacatgtgttgctatgactaaggctctaatgaccttaagaataaagacaaatttcagcaaatttatccagttgctttcagtacatgtaaaggtagtacatcaagaattctcatgctactgcctgagaaaacagattctactgttacctaataaatcaaaatcaactggatggcgtttctataaccttgcaccaggtaaagaaaaactgcaatggaggactaattaacgcagactccatcataaggaaaagggtaatccagaatgtcactttcaatatttaagtatttaaatttttagttgaaaatgtggtgaaatagtgcttttggtaagctttgtgtagttgaacatcagcattaagtagaaaaaaatctttaaaaatgtaaacaaacaaaaccatacaccaaaaaaactaacttgaccagtgtgtacatattgatctttgtgttggtagagtctaaagcagaacatttggtgaacttgatacaattattttgatcacattggcataccaataaaatcacttatattgggtcaggtgcggtggctcacacctgtgatcccagcactttgggaggccaaggttgggcggatcatgaggtcaggagtttgagaccagcctgaccaacatagtgaaacaccgtctctactaaaaatacaaagattagttgggtgtggtggtgcacacctgtaatcccagctactcaggagtgagggtgaggcaggagaatcccttgaacccaggaggtggaggttgcagtgagccaagatcctgccactgcactccagcctgggtggcagagcgagactccatcttaaaaaaaaattatttatattcagtttgaataaaacattttcacatcttaaaaatactgctttgtacttagtatgaacaataaatgtaaagtctttatcctcaaacggattctgattgtcaactcaatacatatggcaacccatttctctggtttatccaaactgaagtcttgtgaaggctcaaatatagaatgagagggactcaacaacagagcatgagaagcaagaaggatggggtaggatgatcagccctaaggctcagggattcctggggaccccaatataatgacatcaactatgaagcttactaactgaaaataagcataagcagctgaaaactccatggcttgctttggtgggaaggagtctctggaattagagtcatgccaaaaggattgagccagaatgacacgtctctaaggattattaggggggactgttcataagcacataaacatttgttccaaatcttattacagtagcaatatccttttctgtaatatcagcttccccaacgtacggttgccatagacaaactaagacaagtgcctaatatgttgtaggcaattagtttctaaatttaaaaaacttgcaataattttatgaatttcattaaactctgtttcatgtataaatctcactgaaaggcagtatccagtagctattttccttagtcctttctgggattttctgttgcttgattccaaaccaaccttaatttaatcctagtcatttctaaatccccagatggaataacagaaagacagcagaaatgaacccaagttaccccaaacagtcaacatctaacatattttgttccccaaatgaacaaaaaatcacacaagctaaaaaacagtgggtttaaaatttaacccaaatttaacagtagcagttttaccatatgtaaaaattagcaaagtcataacttagatacccatagtccgttattctagaaaaaattaatacaattatgacttttttagaaaagaataaatatgacaaaatatacccgctcatatctttgaaatatgaatgattttttcttttaatatttaatacttagacaagtattatagctatcattcatgaattaaagtagccttaggggaaatagtgttttatattaataatgaagattgaagctccagggatgtcaaataatttctcttggatacacagctagtgacccaacaagctcaaatatgtttgatttaaaaattttgacttttccactgttgacattgttgacataacagctaaatctgagtctcagggttgataatttagaataaatcaagacaagtactattgaggcaggctaggtagtcaagaaagtgacgatgtcctcgggatgcagcaaccacagcaattgcatgctgactgcatattgtcaacacgataagccccagcatttacactgtatttcagccattcaagcaaagctctcttcagtagggaaattcccctgtagagaacatgcacattttgattttacttgtcctctaactgaccttttactcattataatagtaaaaaataaacacgtgtgtgaagatttaagatgttaatgagatatgtgacatataagcatgtacagccactgtgtctgtgcaccaaaaggaccacccagaacatgcttactaacacctcttcccgtctccttgtaaataattacgtaagactcccataactgagtctccctagttccagtctttgctgtctcattcttacagcagcctgccctgaattcctcctctctcagcgagtactggctattctttacctaacttttaaaatagtatttctactttgcaataaatcactctatgctgcatcttcattgttttgtgtctcttgtttaaattttttgaaagtgagaagaatcgaggtctcacacagccatcaacactatcatgctttgttttgtattctttattatttctttctctgatatgtcaccattcatattttaaacccagacaacgctgctaaattaaaaatttaaataatcacaaaatgatttgtcataaaagcatgtatatggctgggtgcggtggctcacgcctgtaatcccagcactttgggaggccaaggcgggcagatcacctgaggtcaggagtttgagaccagcctgaccaacatggagaaaccccatctctactaaaaatacaaaattagccaggtgtagtggcgtatgcctgtaatcccagctactcaggaggctgaggcaggagaattgtttgaacccaagaggcggagcttgtggcgagcctagattgtgccattgcactccagcctgggcaataagagcgaaagtccatctaaaaaaaaaaaaacagttaaaatgcctttgaagagtgaaaataaaggatagattaagcagagaatttgacatggaaaaaggctggtcaattgtttgaaaattacattgcggctgggtgcagtggcttatgcttgtaatcccagcactttgagaggtcgaggcaggcacatcacctaaggtcaggagttgaagaccagcctggccaacatggcaaaaccctgtctctactaaaaatataaaatttagctgggtgtggtggtgggcacctgtaatcccagctattcgggaggctgggtgcgtggcaggtgtgtgacaccatgactagctaattttttttaattttattttttgtattttcagtagagatgagtttccaccatgttggccaggctggtcttgaactcctgacctcaagtgatccgcccatctcagcctcccaaagtgttgggattataggcgtgagccaccatgcccagcatattttttccaaattttctagtttgcatgcatagaggtgttcatagtagtctctgacaattttttgcatttatgtaggattagttgtgatttcacatctctaatatttaaatagatgcagagaacaacagaaaaaaaaaacagatgcagaataaaagtttgacaaaagttgacattcccttatgataaatctctgaaaaatttaggtatagaacaaatgcacctcagccaataaatgccacatataaccaaaaaaatgcacagctaacaacatactaaacggggatatattgtaaacttttactctaaaagctaaaacaagacaaggatgcccactctaatcagtcttactaaacatagtactaaatgcccatgacaaagaaattagagaataaaatcaaagacatccaggttaagaagaaattacattatccctatataattatcttttatctctgtacataatctgaagtatagaacagccgaagattttactgaaaaatattaaaataaacacatttattaaactttcagaatacaaaagcaacatccaaaagtcagtagcatttatgtacactaacaaatatctcaaaatgaaattaaaaaataattccatctacaaaaactgtagtaactatattttgaaaaaaacttaaccaaaaagttgaaacaccttatattatactgtaaacagcattacataaattgagtaatgcgcaaatgaaatactactcatttatgaattgcattaataaatttctatatcacacaaattgatctacagatataatgcaacccctatcaaaataccagtggcatactgcatagaaaatttaatttatatggtaccacaaaagaccctgaatagccaaagcaatcaagaaaaaaaagtaaaggtattaccataccttcaaaatattctacaaggcaatagtaactaaaacagtatggtacttgaataaaaacagacacataggccaatgcagtagaaaaaaagagaccagaaatatatccatgtatttacagctaagtgatttggaataaagctgacaatttctttttttatttttgagatggactcttgttctgttgctaggctggagtgcagtggcacgatctcggctcactgcaacctctgccatctgggttcaggtgattcccctgcctcagcctcctgagtagctgggactacaggcgcgtgccaccacacctggctacttttttgtattttattagagatggggcttcaccatgttggccaagatggtctcgatctcctgacctcatgatccaccctccttagccttccaaagggctgggattacaggcatgagccaaaagaacagtaacttcaataaatgatgttgagaaaactttatgtccacaggcagagaaataaaatgagaccctcatctcacaccgtatataaaaaccatttcaaaataaattagacgcttaaatgtaaggcttgagatgagcctggtggctcacacctgtaatcctaccactttgggaggtggaggcaggcagattacctgaggtcagttgttccagaccagcctggccaaggtagtggaaccccatttctactaaatatacaaaattagctcggtgtggttgcaggcgcctgtaatcccagctattcgggaggctgaggcagaagaatcacttgaacccgggaggtgaaggttgcagtgagctgagatcgtgcaccattgcactccagcctgggcagcaagagtgacactccatctcaaaagtaataataacaaataaatgtaaggcctgaaactctgaaactgctacagaaaaatagaatgaaagccccttagactgttctgggcagtaagttggttttttgtttatttttttttttgagacggagtctcactcggtcacccagcctggagtgcagtggcatgatctcggctcattgcaacctctgcctcccgagttcaagtgattcttctgcctcagcatcccaagtagctgggattacaggcacccaccaccacacccggctaatttttgtatttttagtagagatggggtttcaccatgttggccaggctggtcttgaactcctgacctcaggtgatccacccacctcagcctctcaaagtgctgggattacagacgtgaaccaccgtgtctggtcagtttttttttttttttttatttaacctcaaaatcttaggaaataaaaggaaaaatagatgagtcagatgacttcatattaaaaagctgctgcacagaatctgatacaatcaacaggatgagacaactaaaaaaatgaaagaaaatattcgcaaattacatgtgacaaggagttaataccaaaagtatgtaagaaactttgctgggtgcggtggctcacacttgtaatcccagcatttggggaggctgaggtgggcagatcacctgaggtcaggagttccagaccagcctggccaacatggtgaaaccccgtctctactaaaaatacaaaaattagccaggcgtggtggcacgtgactgtaatcccagatactagggagcctgaggcaagagaattgcttgaacccaggaggtggaggttgtagtgagctgtgatcataccactgcactccagctggggcgacagagcaagagtcagtctcaaagaaaaaaaactacatatatatgtatatatatatatataaataaatatatgtataatatatatgaaactcaattaactatacaacaaaaacaagtaactcttaaaatgagcaaaaggcttaaataattttcaagaaaagacatacttatggccaacagatatatttaaatatgcccagtgttaagtacgatcagggaaaggcaagccaaaaacaactatgagatatcaattcactcctgttagaatgactcttattaaaatgaaaaagaaaaaaatgttatgaaagatgagaaggcattgcgtggacactgttggtttgaatgtaaatgaagacggccgttaggaaaacaaaatagagatttctcaaaaaacttaaaatcaaactaccatgtaatacagctgttgcactattgggtatatttccaaaacaaatgaaatcagaatgaagaaacacttacacttctatgttgtttgcagcactcttcacaatagccaaaatatagaatcaacagttcaggctgggtgtggtggctcacacctgtaattccagcactttgggaggacaaggcaggcggatcacttggggtcataagttcgagaccagactggccaacatggcgaaaccctgtctctactaaaaatataaaaattagccaggcatggtgacgggcacctgtaatcccagccactctggaggctgagttgggagaatcacttaaacccaggaggtggaggttgcagtgagccaggattgctccactgcactccagccagggtgacaagagtgagacttcataaaaaaaaaaaaaaaaaaaatcaacagttcagcatctaatgagtaaagaaagacaatgtggtagatatatacagtggaatactatttaaaaaagaatttttttgagaccaagtctctgtctatacaatctcggctcactgcaacctccacatccctggttcaagggattctcatgcctcagcatccagagtagctgagattacaggtgtgcaccaccatgcccagttaattttttgttgtatttttagtaaagatggggtttcttcatgttgcccaggctggtttcaaactcctgggctcatgcaatgcaccttggccttccagaatgctgggattacaggtgtgagccaccacacctggcctttaaaaaaaaattcattatttttaatcacatggattaagctggagaacattaattgagataaggttaatagttcatgatttcacttacacatggattccaaaaaacataacctcattgatgtaaaatggtgaccatcagaggccaatgtatttagaatgggctgggcacggtggctcacgcctgtaatcccccagcactttgggaggctcatcacgaggtcaggaggagaccatcctggccaatatagtgaaatcccgtctttactaaaaacacaaaaattagctgagtgtggtggcacatgcctgtaatcccagctacttgggaggctgaggcaggagaatcacttgaactggggaggcagagattgcagtgagccaagattgtgtcactacactccagctggtgacagagtgagactgtctcaaaaaagaaaaagaaaaaagagggttggaatgatatctgtcaaataatacatagagttgaatagaagaaataagttcaagagatttttttgtacagcatggtgactatagctcatgtttttgtatttttgaaaagtggtaagacaatgtcatgtggtctcaccacaaaaacgttaactatgtgaagtattagttacctagaactaatcacctgacaatgtatatacacttcaaaatattatgttctacagaaaaagtacacattttatctgtcaagttaagtttttaaagctttatagaaggataacaatgtgtcaaatactgtccatgtttttgtcataatcttggttgaatagtatcaaaatatatagtttttgtttttggttgaatagtatcaagatatatagtttttgtgtttttatcatttaatttgtcagtcataaccgtaggaactccgatatttaacagtatgttctggacccagcacattgcatggaagaagcttatgtcctttaggatttttactttaagctccgggcacctggagtttctggtgctgatggtaatggtatgaaagacactcaaagagcaggtgttgcttatggtcccatgactggccactctgtgaacacagtaaactagtttgcatgcaaagtaacagaaaatgttttaatccaaatgctgtcatgatgcccaaaatttatccagaaaaaatgactaaggagttgcctgcatttcagggacagaaaataaaaactgtagactaaacttcacccacttaaaaaattatatgagaaattcctccaaattgtaatatcaatatggaaaagcaatattcttttaagtttcaaattcacagagctcattattttgtagcctttagcattcacttaaaaattatatgtgttatcctcccgtctccctctccctctcccgtctccctctccctctcccgtctccctctccctctcccgtctccctctccctctcccgtctccctctccctctcccgtctccctctccctctcccgtctccctctccctctcatgccgagccaaagctggacggtactgctgccatctcggctcactgcaacctccctgcctgattctcctgcctcagcctgccgagtgcctgcgattgcaggcgcgcgccgccacgcctgactggttttcgtttttttttggtggagatggggtttcgctgtgttggccgggctggtctccagctcctaaccgcgagtgatccgccagcctcggcctcccgaggtgccgggattgcagatggagtctcgttcactcagtgctcaatggtgcccaggctggagtgcagtggcgtgatctcggctcgctacaaccacctcccagccgcctgccttggcctcccaaagagccgagattgcagcctctgcccggccgccaccccgtctgggaagtgaggagcgtctctgcttggccacccatcgtctgggatatgaggagcccctctgcctggctgcccagtgtggaaagtgaggagcgtctctgcccggccgccatcccatctaggaagcgagaagcgcctcttccccgccgccatcccatctaggaagtgaggagcgtctctgcccggccgcccatcgtctgagatgtggggagcacctctgccccaccgccctgtctgggatgtgaggagcgcctctgctgggccgcaaccctgtctgggaggtgaggagtgtctctgcccggccgctccgtctgagaagtgaggaaaccctctgcctggcaaccgccccgtctgagaagtgaggagcccctccgtctggcaaccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccagtcgccccgtccgggagggaggcgggggggggggggtcggccagccgccccggccgggaggtgaggggctcctctgcccggccgcccctactgggaagtgaggagcccctctgcccggccagtcgccccgtccaggagggaggtgggggggtcaaccccccgcccggccagccgcccagtccgggagggaggtggagggtcagccccccgcctggccagccgccccgtccgggaggtgaggggcgcctctgcccggccgcccctactgggaagtgaggagcccctctgcccggccagccgccccgcccaggagggaggtgggggggtcagccccccgcctggccagccgccccatccgggagggaggtgggggggtcagccccccacccggccagccgccccgtccaggaggggggagggggggtcagccccccgcccggccagccgccccgtccgggagggaggtggggggggtcagccccccgcccggccagccgccccgtccgggagggaggtggggggatcagccccctgcctggccagccgccccgtccgggaggtgaggggcgcctctgcccggccgcccctactgggaagtgaggacccctctgcccggccagccgccccgtccgggagggaggtggggggaacagccccccccccggccagccgccctatccaggaggtgaggggcgcctctgcctggccgcccctactgggaagtgaggagcccctctgcctggccagccgccccgtccgggagggcggtgggggggtcagccccccgcccggccagccgccccatctgggaggtgaggggcacttctgccgggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaataaaaaaaaaaaaaaaaaaaaaaaattattattaaatgtgagaaaaaaaaaaattatgttatacttttattatataagtatatattttaataaaagtatgttacataataaaaaataaatttaaaattgttcacttaccattaactcttaaaaatttaatttctacattttcttgcaaattttatgtttgccacactttaagaatctaattttttttttaacaaagaacaactattctgatttaatcttctcacctgtggacaatgtatgcttttatcttaactaatccgaaagttatattgataaccaaactctccagttaaaaacaattattcagtgcattaaaaaataccaactttcagctgggtgcagtggcttatgcctgtaatccaagcactttgggaggctgaggcaggtggatcatatgaggtcaggagtttgaaaccagcctggccaacatggtgaaacttcgtctctacaaaaaattaaaaaaaaaaaaattcagccagatgtggtggcaggtgcctgtaatcccagctacttgggaggctgaggcaggataattgcttgaacctggaaggcagaggttgcagtgagcccacattgcaccactgcactccagcttgggcaacaagagtgagactctgtctcaaaaaaaaaaaaaaaaaaaaaaacaaccaactttctcgtcaaaatttacaaagtaccatgtgaaatgaaatggcattaagacaacagtgagaaaactgaagccataacacagaaaaaggagatgggctgtgctgcatacatagctggggatacacataataaatacagagaaatctgaagataattaagaaataaaagatgcagaacttctctttaaattcagcaagattcagcattgcagcctggaaactatgtcctctccacatgaagaatcaattttatttcttcaccactgatgttttccatctctgaactgaagttacaagctaactttagcaggaatacttatggcttactatggagcatctgttacacagcaagaactgtcatgtatgtttgctacatttaaatataaaaacatcctcacgacttataaagcttccctagtacttacctgaacaaattgactcaataaataaatttacttatgtcaactataaaaagtgaaaagaaaaataactaaagggctatagagttctccaactaaaaacaaaatgaagtgttctaactaaataaaatgtaacttaatacactaattgtggaattacatttaaaaattttgtatgcactaaattttgtaaaaattattcttataatcacagaccagctcacataatgaatacttcataatctgtaaaatatttatatgaaaaaagatacaaaataattaggggtctatcatgagtaccaggcaagtataaacagaattttcatggggagattcagaactataagccacagaatgtacagtaataaattcaatacaaagcagagaatacattttcttttagcatttttgaggcttttagttttctagtagtcatcttgttaaaatgatttgttttgttcagtattgcttttttcttcggaaaacaggtacaaattcatacacacaaactcactctataattttcttacacttaaggtttatctttagactaacatatatttaactatatgtaaatcaaaactaaatgtctgcatgtgtttgcaggcagacaggaaacatgctcaaaaaataaatattagaaaactttaaaaatacttattcaggcctcagaaatgtagggattttattatacttctacataacttttattatgaccataaaaataacactgtaatcaataacaatttaattttacattttaaaataactaaaagtataaaactgggttgcttgtaatacaaaggataaatactagaggtgatggatacctcatttaccctgatgtgattattatatactgtattcttgtatcaaaatatgccatatattgcatgaatatatactcatattatgtaccccaaataattaagaaaaataaatttaaataaaataaacatttggctgggcacggtggctcatgcctgtaatcccagaactttgggaagccgaggcaggcaaatcatttaaggtcaggagttcgagaccagcttgacttacattatgaaaccctgtctctactaaaatacaaaaattagctgggcatggtggtgggtgcctgtaatcccagctacttaggaggctgaggcaggagaattgcgtgaacccaggaggtggaggttacagtgagccgagatcgtgccactgcactccagcctgggtgacagagcaagactacctctcaaaaataaaataaaataaaaacaaaaatttaacctacagaaataatattctttaacttatttgcagtcaaagccactagcaaaagagattactagagatgttaatccattatgttaccaaatagtatactgttaccatgttttacgtacacccttgagtaaggtggaataggttaatgtctgtggcataataacacttcactgaatgcacaatagtatttaacatgttaaaaaggttgaatatattaacatcacatataatctgaaatttaaaaaatatactgcattttatataaaagtattagtaaaatatactaattttaatttacttataaatgaaattaagttttctcataatgcagaatattactctgaatgcctaacgcacacattgcttaatattataagttaaccataaaagtctcttcacttagattttcatcatacatctcatattttaatgtctttttcatagcaaagtttataaataatgctcacctaataaaaaagaatctctcatatctgatgcagcaacaattgatcacatgctttcacatgtaaataggagtgaagaaaaggcaggaaataatttaagagttgaattacattattactcacttttcaaaaaatctaattttttcaaaaagttaagcatactttgaatgcaataactgcaaaaaatttctacttttaaagttatatacaaatattttaccaattttagttttagattattttctatactcagcactctgatttagtaaaatacctgaagcatcagtgccttacatatttctactgtaaattctctgatatttacagacttaatgattaaaatttttaaaaaatttttcctgtatctgcaaaaatatgttttagtatgaactctctggtgttttctaagctgtagtttttgaaaaagtatttttccaactttattacattcgcacagtttttttcaatataaattccctgatattgaacaaagtttgagcaactgcttcagaggtttcctctaatacaaaacgtgtacagtaagatctgtgatacaagtaaacatattacaattctactacaatgttcttcttcaaaatactcttcactttaaaagcttatattttcttaaagatattttgacagtagttgcacttatgtttttattgagtatgaactctctgatgttgagtaagatgtgagcatgtattaatggctttttcacagtctttatatttgtacaatatttctcaagtataaatgctttcctgtgaaggtgtgagcattagttaaaagttttgtcacactgttcacacatgtagaagttttctccagtataacttaccttacctacaatcaagtgtgacaaccatttaaaactttatcacattcttcacatttctaggatttctcaacactatgatttatgttttgaaaagtttgaggtgttttcaaagcactgtcacatctttctggtttgtagaatttctctctagtatgaattatcttatgtctgttaggaattgagaatttattaaaggctttgccatattcttcacagtcacaggagttccctccagtatgaatttttttatgtttagtaagagttgaggactggtaaaaggctttgccacatttttcacatttgtagggtttctctccagtatgagttattttgtttaataaggcttagggactggttaaagtctttaccacattcttcccatttgtaagatttctctccagtatgagttatcttatgtttagtaagggttgaggatcggttaaaagctttgccacattcctcacatttgtagggtttctctccagtatgaatcatcttatgtgcagttagttgtgaggaccggttaaaggctttgccacattcgtcacatttgtagggtttctctccagtatgaatcatcttatgggtagtaaggtttgaggactcattaaaagctttgccacattcttcacatttgtagggtttctctccagtatgaattctcttatgtttagtgagggctgaggaccagttaaagcctttgccgcattcttcacatttgtagaatttctctccagtatgacttgtcttatgtttagtaaggtatgagaatcggtaaaaagctttgccacattcttcacatttgtaaggtttctctccagcatgagttatcttatgtgtagtaagggttgaggactggttaaaggctttgccacattcttcacatttgtagggtttctctccagtatgaattatcctgtgtgtagtaaggtgtgaggaccggttaaaagctttgccacattctgtacatttgtagggtttcactccagtatgaattcttttatgtgtagtaaggtgtgaagaccggttaaaagctttcccacattcttcacatctgtatggtttctctccagtatgaattatcttatgtgtagtaaggtgtgaggaccggttaaatgctttcccacattcttcacatttgtagggtttctctccagtatgaattctcctgtgtgtagtaagggttgagaaccagttgaaggctttgccacaatctttacattggtaggaattctctgtaatatgaaatcttttatgttgagttaggtgtaaaagcatgcaaaatgatttttcacattttttacatttgaaaggtttctttctagtatgtcttatcttatgtctgtttgaatttgaaaatgtatgaaagacttttgcagatggatcacattgaaatatgttgctctgggtagttatcaaacactggtttaatttgttatcatgttctttgtgcactttacactcatccacacttttacagcctttttgtaactgtaaattgtcatgtccatattttccatattttttcagaatcgcttcttgaaaagaatctttaatgtcctgctctgcccaaaggtcttggggaaaatgagaacatataactgaaagaaataaaaataacaaattactttacttactagacacagatagtttacaaatctaacctctaatatacaaactacataaataagatggcataggaaaataccaaaggccctcattcctttatagacatataaatgtaaaaaaaaaaaaaccaaccaaattacatctgaaaaaaattataaatgagttaagtgtgtgaagtgcccctggtgagaacaatgcaaagagccacttagaagtaaaagtctgtacatttacccaacagagctctttctgctccccaatataacatactgtctttagaagtaaattgccaacttgtttttaatgacaagtaaaatactggcacatttatctttattacttgcttctaggagcctttccagacactggtttgtgtctctcttgaaatataatgctgaaagaaacggtggtatactttggagtgacagtcttaactttgctgagaccaaaggtaaatgtttcagcaacagagagactgctgtaccacagacagaaaacaggtgtagcacgtgattattattaagaagaaacatgaataaactcctttaactaaaagagaaagacaaaatctcagacaagacacattctaagaacatgtttgagagactcccagaatctctaaccaagacgattgttcagactatgccaggacaaagctacattataaagattgtgacaggtagccttttttaatgtccaaatttcaatcaaggattacaatgtatacaaaataaggcaatatggttccataaaaatataaaattttaaaaaagaaactataaaaaagatgtatacacaccgattttaaaaattgaaaataaattgaataatactcagtgagtgaaacaggaagacagagaactatagaaaatcagaaaaatgaagataagaacataaatatttagaatatcaaaaaaacaaattgtggaggtaataaatataaaaaagaatagctgaaaaatattgaaagaaacgatgtaaagatgaagaagctcaacaaacaaactaggaaacacacaaagatatttataacaaacacatatataagcacaatttcaaaagtcacagacaagagaaccttgggagctgcaagataaaagtgatgcgtcatttgccagcatagtcttatgagacagccagtgaattgtcaataaaaattttgcaggccagaagggaagtgtgtaataaagtcaaactcctgtaaaatacagcaatcaagtaagcataatactatcagcaaatctgtcctgccaaataaaaagaaaataactttcaaaagtaacaaaattctgaaaagtatattggaactccataaaccctacatacaaaatgtactgaaagcagttgcttctattgaaaataacatgattcaacaaaaacaacacagtcaaataaaaatacattactttcgggaggggggagggatagcattaggagaaatacctaatgtaaacgacgagttaatgggtgcagcacaccaacatggcacatgtatacatatgtaacaaacctgtacattgtgcacatgtaccctagaacttaaagtataataatgaaagaaaaaataaaaacaaaacaaaacaaaaacaaaaaacaacaaaaaaatacattactttctgggaaagattatatgcacatatatacttttacttctaagtatatgcacatacaccaaaatggaattccttagcattatcataatggtgcagaaaacatttttaattattctctaaaatttgaaagtgaaaatcagagaaatcattataaacatctgttaataaatatacaacataaaaagatataattagcaaaatcaatgacaaatttgaggggagaagtaatgagaaaaaaaatgtgcatgcaactgaagttcttttttaccagattgaaatatactgttatatcttttagaggtttacgtaatccccaaggtccaaaaaagaacatgtgtgtatagatacacaaaacaagaaagaagtaaaagcatatcaatataaaaataaaaagatacaaagacagagagaaaatgagtgaccaagatataagaatcaaataaaacaattaataaaataacattagtatgtctttctgtttcagaaaattatttaaatatatatgtttaactttccaatcaagagacatactttcaatagagacttatttaaatattttaaaaactgagatccaacttgcctttctacgacagtaagctgagatctattgattaaaaaaaaactgaaagtggcaagatggatgtagatattgcatgtaaatattaaccaaatgagagaagaggtcaaaataatattacataagctacatcttacgtgaaaaactttcatattttataaaatgtactgcaagtcaaaactgcaaagagacaaagaagggcattaaacaataatagattcatttactgataacctaagtgtgtgtgtgtgtgtgtgtgtgtgtgtgtgtgtatctcacattaaggttccaaatacataaagcaaatattgatagaactgaagaaacatctagacagcaatactatagtaggacatttcaataacttactttctgtaataaaaataaatcaaaacagaatatttgtaagtgaagagaggacgtgaaggcagtataaaacaattatttctaacagaggtatagagaagattcctcaacaatatcgggatacacatgcttctcaattgctcatacaacattctccttaatagaccacatgttaggccaaaaaagaagtcttaacacatttgttaagactgagattgtatggattatattacatgaacaaaatgggagtataaaacaataatagaaaaacaattaaacatttacaaatatatggaaattaacacactcttgagcatgctcctgttcaaagatagaaataatagatattttgaaaatgtccatacttttcaaagtaatctacagatttagtgcaatgttgttaaaaatttctcattgcatttttgagaaactagaaacaacaaccccaaaagtatataaaatgtcaagagacaataaagtacccaagagtcttcaaaaaaaagaaaatgttgaaggcattatagttcctgatttaaaagcacattgcaaagctacataattaaaacaagttggtatgagtataatggttaaaaagtagactaataaaatagaatgccacatctatagaaactttcacatatatgtttatatgaagagttattttcatatccataattattgcagcattttttaccaatagcaatgcaagtttctttcctttttctttccttttttttttattttttattttttgagatggagtcttgcactgttgcccaggctggagtgcagtggcatgatcttggctcactgcaacctccgcctcctgggttcaagtgattctcctgcctcagcctcctgagtagctgggactacaggtgtgtgccaccatgcctggctaatttttgtatttttagcagagacagcatttcaccatgttggccaggatggtctcgatctcttgaccttgatatccgcctgcctcagcctctcaaagtgctgggattacaggcatgagccaccgtgcccggcaatgcaactttctgtcaccaaattatccaatagatataatttgcaatataaaaatactggaatatcatccaggatttaaaaagcaggaaatattctaataactctaaaaataaagcttgatgacattatgcaaaataaaatgagctagccacaatgagacagagattgtatgagacacatgaagcagtcacattcttagaaatagaaaacaaagtggtgtttgcaaagtgccagaacatcagacaaattggttgttgtacattgagatttagctttgcaagataaaacattctaggggtatgctgcataacattatcaatataattaagaggaataaacagaatattaaaaaatatttgataatgggcctggtgccgggactcacatctgtaatcccagcactttgggaggccaaggtgggcggatcacaaggtcaggagttcgagaccagcctggccaacacagtgaggcaaaagaatcacttgaacccaggaggcggaggttgcagcgagccaagatcccgccactacaccccagtcttggcgacagagcgagactccgtctcaaaaaaaaaaaattgctaatattttatgtgttcaagtaaaaatgaacaattaataccaagaaagatacagttacaatagtttcaatattatcttcaaatcccaaagtgtttctcccacatagaagtaatgtagattcacaacagatattgaaattaggagaatttttataactggtcacctagccaagattgaacgaccatttacaacaaacctacacaacaaatatacaagtcataaaataaacagagatgatatttgtagaggcaaacaaacacagaggtaattatattggcagtagacatatggctgatttatatttgatttggctagacacagtcttaaattgtacagagttaaacactgtcatacacaatggcaatataaaataaaacaccaaaacacaagcaactggtgttaggtgtcataccttaaaatacataacacaatataaaatatatatatatataatatatgtaaaatatataacacaaaattaaaatatggaatgtaaaacgtattggatgccatcaagtagatcaatatattcatcaaatgaatcttagaagaatatagggaaaaagtaatacagaggtaacttgaagacaaaaaaggctgagaacttcccaaatttttatgtaacaaaaaaatttctaaccaatatttaattcaaaattattttacttcaaaaacaagataaaaataaggactttccaaaataaaaattcagggcatttattacaactaccacagtcctacataaaatgttacatggtggccaggcacagtggctcaggcctgtaattctacagctttaggaagccaaggcagatagatcacttgagaccagtagttcaagatcagccagagaaacatagtgaaactctgcatataaacaaaaagaaatgctaaaatgagtccattatgttgaagaacaaaatgatgccagaagtatcaaaaaaatgtataaatataaaactctctattaaatgtaaatacagacacatatagaatttttttactatcataatgatgcacataaaacccttacagttctttagatataaaaaacaagatataaatctgcataaatctgttaatagatacacaatgtaagataatatggtttttaatattaataacaaattggaaaatataacaacagaggttttgtacttaattgaaggtgtgatgagattaaaatacattgttttaactttaagatgttttatgtaatctgtttttcaatatggttacattatatttcaagatgattacattatacttctggaaagtatgcaaaacaaaataaaaaataatcaaagcaagtcacaacaaaattaaaacaaacaaaaattaaggtagtaacacaggaaatgagaaaagacatatctacaagaaacacataaaatagtaacaatgaggtgatttctgcagatcagcagacttagtctttccccctgctggctgaggaatctgggcagtccagatgtatggaatttctcccagtgaagcacacccccttcaccaagaagcagccagagtgccttgttaaatggttcctgaatcctgtgcatcctgactgagtgaggaccaccccaccaacaggcattgtaagacaacttataaagaagtattcccactgtcatcagctcagtgcccatctgggataaagcttacagatgaaggagcaggcagttctctctgctgttctacacactccactggtgacacctccaggtgtgggagaaacccaggcaaataggatctgaagtggatcccaagcaaatcacagcggccctacagaagacgggcctgactgttaaaggaaaaacagaaagcaaccacagcagcatcaacaaaaatgtccccacaaaaaccccatccaaaggtcagcagcctcaaagaccaaagctagataaactcatgacgatcagaagaatcaaccaaaaaatgctgaaaactcaaaaacccagagtgtctctactcctccaaataatcaaaacatatttccagcaagagcacagaaccgggagaagcctgagatggataaactgacagaagtaggcttcagaaggtgggtaataatgaacttcagtgagctaatgaagcatgttctaacccaatgcaaaaaagccaggaaccatgaaaaacattacaggagctgttaacccgaataaccagtttagagaggaacataaacgacctgatgcaactgaaaaacaacatgagaacctcacaatgcaaccacaagtatcagtaactgagtagaccaagcaggaaaaagaatttcagagcttgaagactatcttgctaaaataaggcagataagattgaaaaaataaaaataaaaaggaatgaaaaaaatcttcaagaactattggattatgtaaacagaccaaacttacaactgattgcagtacactaaagagagggaaagaatggaaccaagttggaaaacatacttcaggatatcatcgagaaaaacttttccaacctaacaagacaggccatcattcaaattcagaaaatccagaggaccccagtaagatactccatgagaagatcaacctcaagacacataattatcagattattcaagtttaaacttcaggaaaaaatgataaggacagccaaccggaaggccaggtcacccagaaagggaagcccatcagagtaaaagtggacctctaaaaagataccctacaagccagaagacattgggggccaatattcagcattcttaaaaaaaatgaatttctaacccagaatatcctgcaactaagcttcatagtgaaggagaaatgaaatcattttcagacaaacaaatgctgagggaattcatcaccactaggcctgctttgcaagagctcctgaaagaagcactaaatatgaaaagaagaaaccactaccagcaaatgcaaaacacattgaagtacaaagaccaatgacactacaaaacaactacgtcaacaggtctgcaaaataaccagctagcaccatgagaacaggatcaaattcacacataacaatattaaccttaaatttaaatggactgaatgctccaattaataccagaacttttggaggccgaggtgggtggatcatgaggtcaggagatcgagaccatcttagctaacacggtgaaaccccgtctctactaaaaatacaaaaaattagcagggcgtggtggtgggtgcctgtagtcccagctactcgggaggctgaggcaggagaatggcatgaaccccggaggcggagctggaagtgagccaagattgtgccactgcactccagactccagcctgggcgaccgtgtaagactctgtctcaaaaaaaaaaaaaaaaaaaaaggcacagaatggcaagctggttaaagagtcaactcactggtgtgctgtattcaagagacccatctcacatgcaacgacacacatagcctcaaaataaagggagaagaatttaccaagcaaataaaatcagaaaaaaagcagaggttgcaatcatagtttctgataaaacagactttaaaccaacaaagatcaaaaaagacaaggaaggacactacataatgctaaagggatcaattcaaggaacacccagatttgtttttattgctcgcttgattgattttttttgagacggagtcttactctgtcacccaggctggagtacagtggcatgatcttggctcactgcaagctctgcctcccgggttcacaccattctcctgcctcagcctcctgagcagctgggactacaggtgcccgccaccacattcggctagtattttgtatttttagtagagacggggtttcaccttgttagccaggatggtctcgatctcccgacctcatgatctgtcagcctcagcctccaaaagtgctggcattacaggcgtgagccaccatgcccggccttattgatttatttttttgagatggaatctcactctgttgcccatgctagagtgcaatggcgcgatcttggctcactgcaaccttcacttcgcaggttcaagtgattctcctgcctcagcttcctgagtaggtgggattacaggcaccaaccactatgcccagctaatttttgtatttttaatagagacagagtttcaccatgtctaggctggtctcaaactcctgacctcaggggatctgcctgccttggcctcccaaaatgctggcattacaggcatgagccacacatccagccagcactcagatttataaaacatacttagatacctacaaagagacttagactcccaaacaatgacagtgggagactttaacaccccactgccaatactagacagatctctgagagagaaaaataacaaggatattcaggacttggactcagctctaggtcaagtggacctgatagatatttacagaactcaccagccaaaaacacaatacacattcttctaattgccacatggcacttactctaaaattgattacataattggaagtaaaacattccttagcaaattcaaaagaaccaaaatcataacagtttctcagaccacagtgcaatcaaattagaactcaagagtaagaatctcactcaaaaccacacaactgcatggaaatttaacaacatactcctgaatgacttctgagtaaataataaaattaagtcagaaataaaaaaattctttgaaaccaatgagaacaaagagacaatataccagaatctctggaatgcagctaaagtagtgttaagggggaaaatatagcactaaatacccacatcaaaaagctagaaagatctcaaattgacttcctaacatcacaactaaaaggaaaagagaaccaagagcaaacaaaccccaaagccagcagaagacaaaaaataaccaggatcagagtggaaccataggagatagagacacaaaaaaaacccttcaaaaaaatcaatatatccaggagctgtttaaaaaaaataaaataaaagagatagaccactagctagattaataaagaaaagagagaagaatgaaatagacacaataaaaaatgataaagcagatatcagcactgaccctacattaatacaatcatcagggcttggcgtggtagatcatgcctgtaatcccagcactttgggagggtgaagtgggtggatcacctgaggtcaggacttctagagcagcctggccaacaaagtgaaaccctgtctctactaaaaataaaaaaataaaaaaaattagttgggcatggtggctggtgcttataatcccatctactcaggcggccgaggcaggagaattacttgaacccaggaggcggatgttgcagtgaaccgagattgcaccatcacactccagcctgggggacaagagtgagacttcattccaaaaataaaaaaaaagaagaaaaaaaaaaaaggaaatacaatcatcagaaaatactataaacaccactatgcacataaactggaaaatctagaagaaatggataaattactggacatctacaccctcccaagactgaaccaggaagaagttgaatccctgaatagaccaacaacaagttctgaaattgagacagtaataagtaggctgccaaccaaaagaagcccaggaccagatggatttacagctgaattctaccagaggtacaaagaagagctggcaccatttcttctgaaaccattttaaatgaaagaaaagtaggaactcctccctcattttataagatcagcatcattctgatatccaacctggcagagatataaaaacaacaacaacaaaaacttaaaaccaatatccctgataaatatcgatgcaggccgggcacagtggttcttgcctgtaatcccagcactttgagaggctgaggcgggcagatcagctgaggttaggagttcaagaccagcctggccaacatggtgaaaccccatctctattaaaaatacaaaaattatctgggtgtggtagcgcacgcctgtgatcccagctactcaggaaactgagtcaggggaactgcttgaacccaggaggtggaggttgcaatgagccgagatggtgccactgcagtccagcctgggcgatagagtgacactatgtcaaaaaaaaaaaaaaaaaaaaaaaaaaaaaaaaaaaaaaaaaactgatggagaatgagaaaactattttaaaattaatgtggaacccaaaaaggccccatatagccaagacaatcttaggcaaaaagaacaaagctggaggcatcatgctatccaacttcaaactatactacaaggctgtagtaaccaaaacagcctggcactggtataaaaacagacacatagacccatgaaacagaatagagaactcagaaataagactgcaaatctacaactgcctgatctttgaaaaacctgacaaaaacaagcaataaggaaagaactccctatttaataaatggttctgggagaactgactagtcatatacagagaatggaaactggatgtggtaagaaaaagagcaagtgtaaggtgaaaaagccaggttcaggccaggcgcagagactcacgcctgtaatccaagcactttgggaggtcgatgaggtcaggagttcgaaaccagcctgaccaacatggtgaaatcccatctctactaaaaaactacaaaaattagctgggcatggtggcgggtgcctatatcccagctacttgggaggctgaggcaagaaaattgcatgaatcagggaggtggaagttgcagtgagccgtgatggtaccattgcactccagcctagactacagagtgaaactccatctcaaaaaaataaaaaaggccaggttcttttaatgaaccagctctcatttgaattaatgaagtgtaaactttctgattatcaaaaggctggtgccaaggcatttatgagaaattcgtccccatgacctaaacacctccctaccaggttccacatccaacattggggattacatcgcagcatgaggtttgcagaacatgttcatccaaaccatatcacagacaaactaggcttaacagacatgtacaaaatttttcagttaaaagcaaaataatacacaatattcttatttgcacctgatgtattctgttagaacacataacaagtcttattgaagaatacgtagtggctgatacgcataatttcaacaatttggaagacaaaagtgagaggatcacttgggaccacaagtataagaccagtgtcagtaacatagtgagagcctgtccctagaaataatcaaaaaattagccaggcatggtagtgcatgtccatagtctcagctactcaggaggctgaggtgtaaagatcacttgagtcaagcaggctgaggttgcagtgagccaaaattatgacactatactccagcctgggtgacggagtatgatcatgtctgaaaatgacaacaacaaataaatttaagaagaccaaaatcatgcactgcatggtatctgaccaaaactgaataaaactaggaattaaaagcaaaagtaaaactggcaactccaacaatatctaaaaataaaacacatgggctgagtgcaatggctcacacctgtaatactaccattttgggaggctgaggcaagagacctgcttgagcacaggtgttggaaactagcctaggcaacataggctagtctctaataaataaactgtctctaataaataaaataaaataaaattaaattaaaacacattcttcaacatattcctgctcgagggtcaaaaattttaattttgttaagatgccaatacaacctacagaggtgaacaaattcagtacaatctctataaaaatctcaatagcacagttattacagaaatattctttaaaatttttaaatgtgattgtgaactataactaaccaaacacccatgaaaagaacaaacaggcattatacttcccgattttaaaacattaaaagctacaataacaaaaacagtatggtactgatacaaagacagataaacagatgaaagagcagaatagagagttcagaaatgaacccttgtgtatatgattaaatgatcttccacaaagctgccatgaacacaccatagagaaaagataatcatttcaaaaaatgttaagaactaaatgtcaacactgataaagttggatcatttccttgaaccgtatataaaaaatgttttcaataaaatacttacataaaaaaactaacgaatctcttagaacaaaatagaaaaaagtcatgacatgggtcttggcaccattttcttagatacaacattaaatgcatgagcaacaacagaaaaacagaaaaatttaactacacgctacttcaaaatttatccacattagaaaaaaaaaacattcaactgtgtaaaaatgcctcataagaaatgggtgaaaatatttgcaagtcacatgtgataagagttaatattcgggccaggtgcagtggttcacacctgtaatcccagcactttggaggctgaggtgggcggatcacctgaggtcaggagttgaagaccagcctgaccaaattacaaattaataatttgtagagaaacacgtaaaaataaaaatgaaaaatgaaatcacctcacatccattacaatggccactataaattttttaaagacgccaactctgttgatgatgcaatgaaaatgaaacctctgttgattgttggtagaaaacaaagttgcagtcattattttaaaatgttacatttctcaaataattaaaagtggaattattatcaaatacagcaactccattaatgaatctatattcaaaatatgcaacaaaagacctagaagacatatttgaacatctatgattattgtaccagtactcacaaaagtcaaaaggctgaggcaacccgggtgtctcttgatttatgaacacatcaaaaatgtaacatatacataaaatggaatattatacagacttaaagaagaaaatcttgtcaattttaagacaaactttgagaatattatgtcatctgaaataatccagaaacaaaatgatggacactgtatgattccacttatatgagatatcttaaatagtcacactcataaaaacagaaagtggaagggtgtttgtcaagggctggggagagggtaaaatgggttgttgttacttaatgggtatttagttttaatttcacaagatgtaaaatttctgtaagtcttttgcataacaatgtgaatatacttaacatggctaaaatgcaattattattattattattttttttgagacggtgttttgctcttgttgcccaggctgaagtgcaaggggcaatcttggctcactgcaacctctggctcccaggttcaaggaattcttctgcctcagcctcccgagtagctgggattacaggcacctgtcacaaggccccgctaatttttgtatttttagtagagatggggtttcaccatgttggtcaggctgctcttgaactcctgacctcaggtggtctgcccacctcagcatctcaaagtgctaggattacaggcatgagccaccacgcctggcatgtaaaactttttttttttttgagacagtctcactctgtcacccaagctggagtgcagtggcacaattatggctcacttcagcctcaaacttccaggctcaagtaattctcttctctcaaatttcccaagtagctgaaaccacttgtgcataccaccatgcctggcaattttttaaataattttgtggaaagggaatctccctgtgttgccctggctggtctcaaacttttgggctcaagtgatcctcctttcttgacctcccaaaatcctgggattacagctgtgaggcaccaccatgtctggccttgaaatgtacacttaaagaaatttaagatggtaggctgggcgcggtggcccatgctgtaatcccagcactctgggaggctgaggcagagcgatcacttgaggtcaggaattcaagactaacctggagaacatggtgaaactctgtctcttctaacaatagaaaaaattacccaggcgtggtggcgggcacctacattcccagctactcgggacgctgaggcaggagaattgcttgaacccaggaggtgggggttgcagtgagccgagattgcgctattgcactccagcctcggcgacagagcaagactctgtcccccacccaaaaaaaaaaaaaaaagatttaagatggtaaattttatgttacgtgtttttacaaccattaatttttctttttctttttttttttttttttttgagacagagaattgcttgaacccgggaggcagaggttgcagtgagctgagatcgcgctattgcactccagcctgggcaacaacagtgaaacgccgtctcaaaaaacaaaaaacaaaaaacaaaaaacaaaagttgaagaggtatttcctccatcaaattcacagacaccaatgcaaaactatattgtgcccattgtcaatgcttctattttaacgtaggactggaagtaagtggcagaatgatgagtcaaaaacatttttaaaaagccactgaaattgaagaaaaataagttactttttgtggatcatatgatcttatatataaaaaaaccataaacactacattgaaatttgtctaaagtaataaatacactcagtaaattagcaaaatataaaattaacatacaagtataaactactgttccatacattttaaccatctgatacaataaagaaaacaatcttatttacaatagcattaaaataataaatttctgagaggaaatttaaccaagaaggtaaaaaaaatctttacaataaaagatataagatagaccaggcacagtggctcacgactgtaatcccaacactttgggaggccggggcaggcagatcaagaggtcaacagatcacgatcatctggccaacatggtgaaaccccatctctactaaaaattaaaaaaattagcttggcgtggtggcatgtgcctgtagtcgcagctactcaggaggctgaggcaggaagattgcttgaacccaggaggtggaggttgcagtgaaccaagatcgcgccactgcactccaacttgatgacagagcgagactccgtctcaaaaaacaaaacaaaacaaaaaagatatatcaatgaaataaattattgaagacacaaattttaaaatatttcatgtccatggattgaaagaataaatattgttaaagtgtcatattatctaaagtaatctatagctccaataaacttcctattaaaattccagtggcatttttttccacagtaataaaaaatacaattctaaaatttataagaaactgcaataaacttcaaatagccaaagcaatcttgaggcaaaagaacaaagcagaggggtattatactttataagttctaactatatttcaagaatatagtaataaaaacaggatggaatgtgcaaaaagattaacaaacaaaacaacggaacagaaaacactactttcacacatttcagacatgatgaaaaaagagaactaaaaaatagtttaacatagagtttcccaaaattatgcagatatctgtgtgtccccccaaataatggaaaagtagggagattgtgcagtcttttatatgccttgaaaaggactctggctctcactgtaaacctgaaggaagatcaccaaaaggaaagtagaatctttaaagaatttaaaagcataagacagaagatgcccctacgtgacagccaaaaaaaaaaaaaaaaaaaaagcccaaaaaacaaaaacactcaggcatcccagaaactatttcctttggaacatagcttcccaaaccacattttaatgaccagctttctttttgacctttggacctcacatctgtgtcatctgttgtgttcactctcacctacctgggggtttggctaccatctcatgtctctttatattccagggctcttttccttgctccagacaggtgatcaggtctggcttagtgagagcaatacctgctttattagaaataaataacatgaatctttctcatattctccaattaccaacctagtactatgcttagtaaagaggaggtgatagaatattctagaaaattaatcctaacgtactaattaatgagagaaatttctaaatatttagaaaatattttaaatttgtaggttcttaatttcactacccggtactcatgaatcaaaaaattggtggtgatgaatggattttaaaatatgggcaaatatatatgtacatatatatacatttatttatttttgagacggagtctcgctctattgtccaggctggagtgaagtggcatgatctcggctcactacaacctccacctcctgggttcaagcaattctcctgcctcagcctcctgagtagctgggactacaggcgcctgccaccatgcccggctatttctgtatttttagtagaaatggggtttcactttgttggcaaggctggtctcaaactcctgacctcgtgacccgcctgcctcagcctcccaaagtgctggtattacaggagtgagccaccatgcccggcctaaaaacatgggcaacaatattttatgacactaaatttctggaattaccactaatctagagtgaaggatacagatcagctcaggaatatggaaagttcaggtcaagatgaaacatcttgaatacattcttttccacacacagcctcaagattttcttgaaaaaacggatcagaaactcatttatgcaaagcatgaattaccaaaaatcattccacaaaaaaagagaaacctttacggtatattagaaattgtgtattaaagttattctcacccaagaagaccaggtttctgtagttctctaacatcactttcctatacaaaccctgctgagcactgtccaggcattgccactcctccagagagaattctatggccacatccctaaacgtcaatggcccctgaaaagcacaagcacagagacacacatatatttaccaagtggccatgggcagaatttattatttgaattaaaatgaaatgacagagcaaagagaattggttctgattaatagaaatgacaaattttccaataatttttaacacagaaatattctctaaaatattctctaattctgagagaagagaatggcataagatccacaacaccagtgtatatatgacacttttctagataaagtataaaattaagagcataaacacaaacatatacatttttgagtgttattatttatatcataaagaatgagttgtgtatatttttcagacaaaaaagagatgttgagttagaaggcacctcctgaattttaatgtttacaataaactggaaatcttgtgcagattttttttcagaagatctggaatgaagtctgagtttctgaatttctttcttttttttttttttctgagacggagtctcgctctgtcgcccaggccggactgcggactgcagtggcgcaatctcggctcactgcaagctccgcttcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccacgcccggccgagtttctgaatttctaacgagctcactagtaatgccaaagtttttggccccaaaagaaaattctgtgaaacatccagtaagtggaagagcctgtgttttaccagatttttctggcctgtaaaacaaagagccttcattttccaaagacagctacatgcaaagaaaacataagaaaaaagggcagctgccagattaaatgtgatggcttatgcacattaactgcataaagatgcctaataatgacaagaaaaatagttaactctgtagtgaaagaaatatcagagagctttttaaccaagtaaattattaatatcaaccatagtaggacgaatttttatgttgtgcttatgcacatagaagaacatagcatcattgcctagatattgcccctccaaaagtaaattatattctgaattcaatcatacagaaacatcagttttatgcaaagttcaagatacaggtatctccaatgttctgtaattttcaataatgattttaagtagtctttcttcagcaccctatatagcaggtatctctcaatcttttttcagaactttctgggtaataaatgccatcctatttaagtaagtattttcttaatcctgttctgcatagagctaatggagaacacagatggaacctcaacattacatattctccacgtaaaccccagctttccccaataggaatcttgagtatccacatccttccatgttcaacagccacaatgggaacatttttaatagtgcagatcataaattcatggtaggaattctgcatggcatataagaagccatgatattgagaatgtagagaaggctctagtacataggaaagaaatattttgcatagacccttgactatcattagaattttaaaaagtagttaaactcattagtaaggaaaaacacaagtagagaagtaaaggtttgcaaatactaaatgcatgagactctagaaaagagtggacaaagctcttgatgtgagacttacttagctgaagaaaaaaaaacatcatttttcctctttctccttcttctcttggaatccttttcagatgaaattctctaaagaagtaacatctacatcttgagaaaactgccttaaatgtgtcagcaccaccttcttacctgctagcaccacgcccacagacagaaggaccaagaccaaaaagtccacccatacctctcccttataacagaggagattcaggaaaaatgtgctgctccatggatgtaaaaatgtaagtttctcctttcctgtctcaggtgccctcccctgccacaaacaccagcaatttctgctacagtaatgaacatatgggccacactgccctgtccctaccaaacccaaacagaacaggtatcgtaaccaccctttagtgcaaaggtggcacttaactctcatgaatgtatcttgaagccctcatacttcattctggcctcaccttagagtcacatgaggcacttcattaaaataacatggatgcttccacccacaacaataaacagaagctgtggggaaggcacaagagatttttgccaactggtcatgtgatcttaatgagaagcctgggctgataaccacttagctaagcattgcctctcaagctttaatgagctcaaaaatcacttggtaatgttggtcccactttatgtaatgtgattctgcatgtttggaaagggttcatgaatgggtgtttcaaacaagtcccctgccaatgctgatgttgctcccccaggctcatcattagcattagtgagagaaagcaggcaccgcacagagtccctgacattcagcactcttgtcacaacacaaatacttctggtacaaatgaagacaaccacactccatcctgaagttttatattatttgctggctctttaaagtttacagaggaaacaaaaggcagcaatgttggaataagtctgcatttggaaaacaacatgtacacatgtactaatgcaataattattaagcaggtactatgtgctcaagagtacaatatagagcactgtgctgggcataacatattatgtgatttaatccccataacacattggaagttgatactaagtgttcagtaattctcaggatttagataaagggcccagcattattacttcttcctctgtttctctgttattgattttttaaaaaaatgtacagaataaggctaaatatagacagaggagggggcatagaaagagtttaagaaatttttttctatttatatttacttgtctgtgacttgtggagcaactactggatctgcaagaatagaaaacaagctgctaaatggaatgtttctgtaagcactggttttaatacaaaatttaaaaaaataagatgttaaaatgtatagtttatttttcttatttatctgcttttgggttgcaggaaattgtaagcaccagctctagaaaggcagaaggatttaccggccaaaactctgacctttataaatcagttctgtaaggcaagactccaaagtgggccagacctaaagaaggccttcaaaaagggtgaatctgaacagaactggggcagggaaaggaccctatggagaattctgttctctgccactggagtatttccagttctgtttttcctaagcttacctaagaaaaacttaaatcctagagtttatgtaactttaatctatttttgccactgctctgtcaattttataactatactaacaggcaatttaaatgactcttttaaagttttctggaataatttcattagaagataagtatgtattctaacaaagtaaaagatacacaaataatactaacaactcttcagtccataaatatcccttcaggtgataacctcagaagacacaacaatataaaaagaagtgggcaaagtttttttgttttgttttgtttttgagatggagtttcattcttgtcacccaggctggagtgcaatggcacaatcttggctcaacgcaaactctacctcctgggttcaagtgattctcctgcctcagcctcccaagtagctggaattacaggcatgcaccacctcgcctagttaattttttgtatttttagcagagacagggtttctccatgttgttcaggctgatctcgaactcccaacctcaggtgatccgcctgcctcggcctcccaaagtgctgggattacaggcgtgagccactgctcccgactgaagaggccaaagttttgttttgctttgcacacatctattcaccgtaccaaccatatgatgtttaattcaaccgtgtatccagttgctagtctagagcaaaagtttctggatggtagggaccgtgactgcttcatctattttttgaatgaccttatgaaatggaagcaattagtttatcttttgagtcaccggacctcctctttgtgtttcaccaaagtaacagcaaactagagaaactctcatctgggtaccaaccaaagttatctcttgtatgagtatgaagggagaaaaaaaaaaaacagaatgactcatttctcttacaccgagacagaagcagaattaaccactcgtcagcctgaaacaattctgcactggacatcctcaaatgtctcaaagacatctaggtgattgtgagaaggttcttactgaccctgggctgatggcccagtgataagccaggctgagagagattcatgctgattctaaatagaaaatggaactgccttggtggagctccagaacctgcatcacctatcctgacttgctagcttttgggtaagaagaaggacaagaatactctactccagtatcatattttacaggtaggtatagttgtggtcatggctctggatactttgtggccttgatctctcactcttaagatgctcgtttacacttacagattctgtcatcaaattctatttatacctggagtctctcacataactgtagcaggtcactcactaaacaagatctgaaaagcttgaagagccacactctcaaatgggggcttcaagatttctacactgacatctcacaatacagaaaatgccttctgttggttttcagtacattctcaatccaaagtcttctggccctgtcttgtaaatcctaggcagaggccagaccttatgtgcagattctaggtgggatcaatctgactctgcatccttgggtgttacagcaaacagactacaatcaaaggagagctcccctcatagaggctgctctggcacattctaaataatatgtctaactaaaagaaaaaactgaggcaacatgaatataagtagagagttcatctgggccaagcttgaggactgtaaccttggagcaaaaatacatcttccaaagactgaacaaataagaaattgaatccctgaatagaccaataacaagtgccaaaactgaattggtcttaaatggccaccaatcacaaatagcaaagaaccagacaaatttacagattaattctaccagatgtacaaagaagagctggtaccacttctaatattatttcaaaatattgagaaaaagggacttctttttcagctcattatataaaaacagcatcattctgataccaaaactgggaagagacacaataaaaaaagaaaacttcagaccaatatccctgaggagcactgatgtgaaaaacctcaataaaacactggagaaccgaatccaggagcacatcaaaaaacttatccacctctatcaagtcggcttcatacctgggatgcaaggctggttcaacatatgtaaatcaataaatgtaatccatcacataaagagaacgaaagagaaaaacacataattatctccagatgagtcagcttggggaggcggaggcagcggcagcgcggcgagcgtgcagggaggccggagccctgcccggggcgggtcgcggggtgggcgggtgaactgccagcgaggaggcacctgcttgcgcgggtgcagcctgggctgcgccattgttgggggaggggcggctgctgagggcggcgagtagggggctagagaaggcgccagccccggcccagaggagcagagacgccccatggggaacacgctgacctattgcgtgtccccccagtaccagcctcaagctgggccggtgcgtggtgccagagctgtactgcgcaaccgacatctacgaggcggcacccggggatgcggtggcggtagcgcccgcttctgtggagcctaccagttggatttcgcagcgggcgagggccaccacctgcagcacatcagcgaccacgagatgccctaagatttagctttggagtcaaacccttctgaccatccaagggcaagcacaagtttcctgagcaaatctcaaaccgatgtgcgagacaagaggaagagcaaccacttaaatcatctatctccagggcagcttactaaaaagtatagctcatgctcaacaatatttctaggtgacagaacagtcagccagcctaaccttagaaccacagtaaaatgtgaccttagaaatatattaccacataaagaacagagatgcaaacagatccctggatatttttgatgagagatcacatcccctcacacgagaaaaagttccacaggaatagtttaagcatgatcctgagcacaaatttatttacagatttgttcatactctttttagtgctgcacagctaacagctgaatgtgcaacagtaactctggtttacttagaaaggcttttaacttatgctgaaatcgacatttgccccactaactagaaaaggattgttctgggagccactcttcttgcctccaaggtttgggatgatcaggctgtatggaatgtggactactgccagatcctcaaggacattacagttgaggacatgaatgaaatggaaaggcatttttcggagcttcttcagtttaatattaatgttcctgctagtgtttatgccaaacactaccttgaccatcgctccttagcagatgaccacctgaattttctatttgctcctcttagcaaagaaagagcacagaacctagaggctatttctagattatgtgaagacaaagacttgtgtggagcagctgtaagaaggtctttcagcgctgatcaacttcattggtattcagcactctaaagccatcctctcttaaagggagaaatgaggggttataatgtcacgggaccttcatctacaaagactggagaaataccacctttcctgctcaaaaaccagcaaaattagtgttttcatcaaaaggaaagatctcaaattcaagagacgcacggacaacaaggatcatactccatagaaaagaatgggaccttgtcaatgcaacaaaacactcttctgtcctttttaatgtaaacagagtcaccaaaaccactccaaagtgaaggctcccatcccacacacagatatttgcttacaatgtgggccagtaactgaactatgttaggttttttaaacaatagtttaaatttttagactttaaagacattaaccatataacttttatgtttcttccagtttttctccccctgctcattttgctgcatatgcctttagaatcaatgcagtattgcccttaaaacaagggactctaactaaagccacttaggagcagactgcagcattgttaggtattgaagggttcttcctccctactgttaccattaaagctgctagtcattggcaatcattttaaaccaaaaagctgatggataacatttgtcattcatattctttgcaagcattactttagcattttagcatgtctgcggtcataaacaaaggaagtatcagttatgatatctacttctattggggtccatgttgcatttcttgtgaactataaatggtacttctcattttctgataatttttatcttattaaataaatgtattaaaagatattttcataatgccaatgaacatggtggttcagtgacagtgaaaaaaaagtaaagcagttttaagctttaatatagtttgggccctccaaggtactgcagcaggagtataaatgctataaacctttgaaaaacatcatttgagagttttgttttttttctttaagagatgggggtcttgctgtgttgtccaggctggagtatggtggctgttcaccagtgcagtcatggtgcactgcagcctagaacttcctggcttcgcgccatcctctagcctcggccacacgagtggctgggactgcaggcgcaccctgcatttgtctcctgaatgttaggcttttgattttttgtttcagtcactcttgaagtcactcttgactgaagcaaaaaattaaaagctttatattcaaaattctcaaaatgaagctgggtgtggtggtgcacacctgaggttccagctacttgggtggctggaggattgcttggggtcaggtattggaggctgcagtgtatcgtgatggtgcctatagaaatagctactgcacttcaacctggacaacatatcgggaccccatctcttagaaaaatgcaaaattaaatgcaaaagaaatgcaccgggcatagtgattcatgcctataatctcagtactttgggaggctgaggtgggaggattacttgagcgcagcagttcaagaccagtctagtcaacacagtgagcccctgtctgtaaaaaataataataaataaaaataattagctggatatggtggcgtatgtctgtagtcccagctactctggaggctgaggtgggaggatcacttgagcctgcggggtcaaggctgcagtgggccatgatcatgctactgcactccagtctgggcgacatccagaccctatctcaaaagaaggaaaagaaaaacattcaggcaaggttttatgaaggtttgtagcacttctacaagtatcaaagcttaaaattacattaaacctttggaatatcttgtatctccataaaatgcccttctctttttaaaatgaattacttgcagagctgtgctctatatgcattgatcaccgaagtttctttaatttaaaggaagattttgaagagcactgttaattaacatgtaataaaaggaactgggccctaatgatagaaggtgatatgaacagctgttttatcatcctacatgctaccaacctgtaggtgtcccattaagtcctgctatttaagaaataacttacataacccttaggaacacttacttcaggctttaaaaggcaaggaacaaataattttaggagactgataatgccatctaaatttgaaaaactaaaaggagattagtgttctcaattatgtgaaatctatttctcctacttactcaaatctaatcctaggaatcttgcttataaacaaagcattcctgggccaggaatacttcctctactatagcaatatttcacatcatattgtgctgcaatttccatcatttttaaagggcagagaaataaatgataaataatggtataaaaatattacaatctaccacctcaaaaaaaaaacaacaaaacattgtttatggagttcagagcttggagagtcaagtattgatagctgttttattttaaaaagaatgttacaatttatgtggtttttatttctcatgtttatattaaaagttaataaactcttttaattaaaaacatatcattatttcaatagaaaaaagcctttgataaaattcagcatcccttcatgttaaaaaccaatggaacagaacagagacctcagaaataccaccacacatttacaaccatctgacctttgacaaacctgacaaaagcaatggggaaatgatcttctgttaagtaaatggtgctggggaaactggctagccatatgcagaaaactgaaactggaccccttccttacaaaattatacaaaaattaacttatacaaaaagtaactcaagatgggttaaacacttaaatgtttaaccataaaaaccctaaatgaaaacctaggcaataccattcaggacaaaggcatgggaaagacttcatgacaaaaacaccaaaaggaatcgcaacaaaagccaaaatttgacaaatgggatctaattaaagagcttctgcacagcaaaagaaaaccatcatcagaatgaacagacaacctacagaacaggagaaaatttttgcaacctacccatctgacaaaggtctaatatccagaatttataaggaacttatacaaatttaaaagaaagacaaccccatcaaaaagtgggcaaaacatgaacagatacttctcaaaagaagacatttatgtggccaacaaacatgaaaatacactcagccgagctcacgcctgtaatcccagcactttgggaggccgaggcggctggatcacctgaggtcgggagttcaagaccagcctggccaacatggagaaacccgtctctactaaaaatacaaacttagccaggcatggtggggcatgtaatcccagctactcgggaggctaaggcaggagattcgcttgaacccaggaggcagaggttgcagtgagccaagatcgcaccattgcactccagcctggccaatgagagtgaaagtccgtctcaagaaaaaagaaaaaaagaaaaaaaaaaaagctcaacatcactgatcatcagggaaatgcaaatcaaaaccacagtgagatacatctcacaccagtcagaatggtaatgattaaaaagtcaagaaacagatgccggtgaggctgtggagaaatagtaacacttttacactcttggtgggaaggcaaattagtctaaccattgtggaagacagtatggtcattcctcaaggatctagaccagaattaccatttgatccagcaatcccattactgggtatatacccaaaggaatataaaccattctactataaagacacatgcacatgtatgtttactgcagcactatttacaataacaaagacatggagccaacccaaatgcccatcaatgacagactggataaagaaaatgtggtacatataagccatggaatactatgcagccatcaaaaggaatgagatcatgtcctctgcaggaacatgaatgaagctggaagccagcatcctcagcaaactaacacaggaacagaaaacaaaacattgcatgttctcactcataagtgggagctgaacaatgagaacacatggacacagagagggaaactacacccacagggcctgttgaggggtgaatggtgaggagacagaacatagaggacgggtgaataggcgcaccaaaccaccatggcacacatacctatgtaacaaacctgcatgttctgcaagtgtatctccctgcttttttagaagaaattttttaaaagaggaaaaaaatgttacttatcacataaaccaaaactaaagacaaaaaccacatgattatttcaatagatgctaaaaaagccttcaatataatttactatccttcatgtttaaaaccctcaacaaactaggcattgaaggtacatacttcaaaataatgagtcatctttcacaaacttacagccaacatactaaatggacacaagtgagaagcattcctccttgaaaactggcacaagacaaggatgccttccctcaaaactcctgttcgacatagaattggtacagtctcagcagaaaagctctttaaactgaaaagcaagttctgcaaagtttcaggatactaaatcagtagcatctctgtacatcaacaacatccaagccaaaagccaaatcaaaaacataatgccattcacaattgccacacacacacacacacaaatatcgaggaatacagctacccaggaatgtgaaagatctctatgacaagatgatcaaacactgcttaaagaagtgagagatgacataaacaaatggaaaaccattttatgccatggatagaaaagattagcatcactaaaatgtcaaaactacccaaagaaatttactgacttaatgctattcctatcaaactaccaaaaacattgttaacagaactaaaacttaactattttaaaatttatatggaactaaaataagcctgaatagccaaggcaattttaagcaaaaagaacaaagctggaggtattacattaaccctcttcaaactacactacagggctacgataaccaaagcagcataatactgatgcaaaaagagatgcatagaaaaatgcaacacaatagagaggccagaaataatgccacacacctccaactatctgatctttgacaaagctgacaagaggaatgaggaaataattccctatttaataaatggtgctggaacaagctgggagaggtggctcacacctgtaattccagcactttgggaggccaaggtgggtgtggatcagttgaggtaaggagtgcgataccagcctggccaacgtggtgaaaccctgtctccactaaaaatacaaaaattagctgggcaaggtggcacatgcctataattctagcactttgggagcccaaggcaggtagatcacttgagatcaggagtttcaggccagcctggccaatactgcaaaacttcatctctactaaaaatacaagaattatcagggcatggtggtgcatgtctgtagttccagctactcaagaggctgaggcatgagaaatgcttcaacccatgaagcagaggttgcactgagccaagatatgccactgaactccagccttggtcacagagtgagaccctgtctcaaaggaaaaaaatagtcactaacagatactggcaaggttgcagagaaaagggaatgcttttatacactgttggtgcgagtgtaaattagttcaaccattgtgaaaagcagtgtggcgattcttcacagaactaaaaacagaattaccatcggacccagcaacctcttaactgggtatatattcaaagaaatataaattattctaccataaagtcacatgcacatgcatgttcatttcagcactgtttacaataacaaagacatggaataaacctaaatgcctatcagtggtagcctagattgaaaaaaatatggtatggtcagatgacagagctcattcttgtaatcccagcactttgggaggccaaggcaggtggattgccttagctcaagagttcaagacgagtctgggcagcatggcaaaaccccatctctacaaaaaataaaaataattaggcagacatggtagtgtgtgcctgtagtcccagttacttaatgggctgaggtaggaggaccccttgagccttggaggttgaggctgaagtgagccacaactgtactgcacttcagcctgtgtgacagagtgagacactgtcttaaaaaaaaataaagaaaagatttaatagaaacaaaatatggtacataagcaacatggaagactatgtggccataaaacaaacaccaccaagataaagatctctgcagcaacacggatggcgctggagaccattagccttagaaaactcatgcagaacacaaaaccaaatgcatgttatcatttgtaagagctaaataataagaacacatggacacgaggaacagtcacggggcctagctgagaatggaggatgaaaggacaaagaggatcagaaaaaaatacctctttggtgctatgcttagtacctcagtgacaaaataatctacaccaaacccccatgacacaattttacccatataacaaccctgcacatgtacacgtgtagaaaaagaaaatccatgggtggggaagaatgcagtgtaagtggattgtttgttctacagacagtggcccaggtggcgctgtactctgatttatttctgggtccatgcaggcagagaagattatgaacaggtagtccaggaccctaggctggtggagaaaacaggttgctgctgcagattcattgtctgggggttgggatatgccaggagacttgtggacacttttgtggctttttggcaagaaatactaggatccacaacgctgtagtgaaattcccaagtgtggtgactagtcctgggaggggtgtggacacgtcaatgtctagtgggtatgtttgtgagtggatcagaatcctgtggtgatagctgtggaacaagggggtctgtcatcagagttcctttcctctaagttttcatcctctcttaccctagaagatctggaatcacacgacaatgaaaggctttgttctcctttagacgagaacagagcctcccactccaagacaccaagagttccattccaggccaggtctccatgatatctttcttctaccaccaaaactgcagagtttgctgaataccaagcaattctctagcaccaactcaatgtctaacattcgaattctgacaccatgcagagtcagcaaagaccctgattcaaggtttagtctcataacattgccctctttgcagttgccagtcacaaaccccataggcccatctatgtttctgggctactgtttaaaaactgaggactcctgcgaccttcctcaagttcaataatttgatggagctactcacagaactcagcaaaacactgcagctatgtttacagattataaaagatacaacccaggaaaaatcaaatagaagaaatgtatagaacaaaaagaagaggtggggaaagatgaaacatatagataaccctggtaaatagctgtgattaataaaatttttcatcctctgtgttctccaggaacagtttatggaaagaaacactcttccattatgaattacacagtgctctcttttcttttttatcacatagccacagactattgaactagagcaactcgattttgaatatggctgagtaaaataaggctgcaaccactgggctacattcccagatggttaggcattctaagtcacaagatgagactggaggtcagcacaagatacaggtcataaagagctggctgataaaacagtttgcagtaaagaagtgggataaaacccaccaaaaccaagatggtgatgagagtgtcctgtggtcatcctcactgctacacccccaccggtgccatgacggtttacaaatgccatggaaacatcaggaagttacaccataatggtctaaacaggagaggcataaatattccacttcttgtttaccataaaattaagaaataaccataaaaatgggcaaccagcctatggagaaagccattctcttatatctccactttcttaataaatgtacaggccaggtgcagtggctcacgcctgtaatctcagcactttcggaggccgagatgggtggatcacctgaggttgggagttcgagaccagcctgaccaacatggagaaaccccatctctactaaaaatataaaattagctgggcgtggtggcacatacctgtaatcccagcaactcgggaggctgaggcaggagaattgcttgaacctgggaggcagaggttgcactgagccaagatcgagccattgtactctagcctgagcaaaatagtgagactccgtctcaaaaaaaaaaaaaaggaaattgctattattctaatatgactaagtgtatgttattaataattacactttgggaggctgaggctagcgagtcacctgaggtcaggagttcaagaccagcctgtccaacatggtgaaaccccgtctctattaaaaatacaaaacttagccctgcatgtgatggcaggtgcctgtaatcctagctagttgggaggctgaggcgggagaatcgcttgaacctgagaggcggaggttgcagtgagccaagattgcaccactacactccagcctaggggacaaagcaagactccatctaaaaaaaaataaaataaaataataataataattacattgttacctaaaatcattgtatgccacagagctaaccaaatttccttgtcaattttttttttactgtaactgccctaagactttgccatccagacaatcatcttgtgttgatcctcttcaaaagatgatttgtagtccactataagacaatgataggtgttcttaaatgcaagtttctgataacattagaaattgtgacattagaatagaggaagaactttcttgttttttttttttttttttttgagatggagtctcactctgtcgcccaggctggagtgcagtggtgcgatctcggctcactggaagttccactttgcagtttcatgccactctccttcctcagcctcccgagtagctgggactacaggtgcccgcaaccatgtcccactatttttttttgtatttttagtacagacagggtttcaccatgttagccaggatagtcttgatctcctgacttcgtgatctgcccgcttcagcctcccaaagtgctggcattacaggggtgagcaaccgtgcccggcctgaggaagaactttcaatactaatggagaactaaaatggtcatgactatcaaacagaacaggaattaactgagtggactgaactaatagaagactgaagtaatattttttgacttcgcctaaaacatcactgatcctttgttttgtttttcagagtcaaaaaaactattcttttgaactattcacaccttttaacaattgagtaaagtatacacctgtgaaaaaaatttggaaaatatttgtgagtattctgaacttaaaacaatttagttatttatataagtgcaataagaaactgttttcttttacaacaggacacaattagagaaacttgttattttaccaaggcttctgactagaatgacatactttgctttaatgaactaaacttgacttgtagaaccaataaagctccatgggaaaactggtattataccttgtctacacagcccctgtacagggttcctggctagcggtaaataaaaaaatttcttatctgagattccttttatgaaacaaggttccatcaaacccaatttaaaaggcctatgtgaaaaataattattcttgctacactttatagaaataatcgggccaagtataagactaaaactttttttttttatgttcacacttcacattgtcttatgtttatttgcagttatttttgaacttgaagatggcatatcttccagccatagcagttcacttcttcatgttaatttggtggctaacacaacaggtaatatccaccacccactcccaacctacatcctgctgatcttgctttgctcacatcttggagacaatagagttcacagagttgagtctgtggctagagccggtcagaaagcatgaatctgaaagatatttttaaaatagcactagtaggccaagcacagtggctcaccagcacttgggagaccaaggcaggcagatcacttgaggttaagagttagtgaaaatacaaaatcagctgggcatggtggtgtgcacttgtaatctcagctactcaggaggctgaggcaggagaatcacttgaacttgggaggcagaggttgcagtaagccaagatcatgccactgcactccagcctggggaacaaagcaagactatgcctcaaaaaaagaaaaaaaaatagcactcctaaacaaaacagtcacaaagcttagctttctctttctactactaacagtgtcataagatggattatgtaaaaatctggattactgtttgaattatgaagacatgacaatcagccacgacttcctatcagcttggttccaacaaatgcccagttcatgaaaagctttcttaagtttccttggaagaattttgcttattttgctttactgttgtagaatatattgccattctactccttgtgtagaaatgcagaataaacttactgggtgttttcttaaagtgaacacttattaatcttccagatatcacctattgttggaactgggagttaggaatggccgtcatcaaactgatgctttctgattgagctcctctctacctcaaatacaaaagacgctaataggcaagaatatcatcacctctattcagcatgaagtagtaacagaagattgatcttcgtcccactacaacccttaggattaagggtttccttgtttaaaaaaataacaataataatagagggggaaaatgtcagaggcatattgaaccaaagcaaatccattttgaatagggcctgggtaaaacagggctgagatctactggcctgcattcccagatagttaaccattctaagtcacaggatgagacaggagatcagcacaaaatacaggccataaagacctggctgataaaacaacttgcagtaaagaagtgagataaaaccctccaaaaccaagatggtgatgagtgtgacctctggtcatcctcactgctacactcccatcagtgctatgagagtttacatatgccatggaaacatcaggcagttaccctttagggtccaaaatggggaggcataaatactccaccccttgtttagcaaataatcaaaaaataaccataaaaatgggcaaccagcagtccttggggctgctctgcctgtagagtaaaccattcttttatttcttattaataaacttactttcactttatggactcaccttgattcttgagtgaaatccaaggaccctctcttggggtttggattgggacccttttcggtaaaatctctgcacatattttttctttttctcatgaaaaaaaattggctaaggctggcgtggtggctcatgcctgtaatcccagcactttgggagaccgaggtgggcagatcacaaggagattgagaccatcctggctaacatggtgaaaccccgtctctactaaaaacacaaaaattagctgggcatggtggcacgcacctgtattcccagctacttgggaggctgaggcaaaggaatcgcttgaacctgggaggcagaggttgcagtgagccgagattgcaccactgcacttcagcctggcgacagagtaagactccatcccggggggaaaaaaatcagctaaatttgtcttcagtggtctaagtaaaattttacgtgggctcctgaactttgagctaccctcaatctgagctaacttaaaacttcattctgtgcccctcctaagaacatgctgacttcagggtaaaacattctctaatctaaaatctaaccttttcaatctccaactgccattcccttcccaccttctctctaatcttttttgctccactgtatgaaagaaagccctcgtctgcctaaacttggcaattcttaaagtttttatagttggtattcctcctgttctaatacttttttggaattcaaattttttaaataaattgaacttggttatacattacaaagtctagaaactgccttaaaacaataacaacttcatcatcagcaagaccctcccaatccccttttatgttaaccttaactgcatctgcctgtgagcccccagctttccaggactctgtagcttctctcagcagataggcttcttccatggctgcagtgagaaggctgggacatctgcaggagagactccccagaaaaaactaacaaggccgttattaaatttcttctgcaggctcaatattagccttagctctgagtcactgggaccaagctctaatttccatgttaagagttattcacttggttgttgaaattaagtgtctgaaaaatccagcaaaatgcagtgttcatataagggaagggaattttaaggtgcttacattttatacctcaataagaaaagcaaaagtatcaggccgggcatggtggctcatgcttgtaattccagcacttcgggaggccaaggcgggcagatcgcgaggttaggagtttgagaccagcctgaccaacatagtgaaaccccgcctctactaaaagtacaaaaattagccgggcatagtggtgcgcctctaatcgcagctactcaggaggctgaggcaggagaatcacttgaacccgggaggcggaggttgcagtgagccaagatggtgccattgccctccagcctgggtgacagaaccagactccgtgtggggaaaaaaaaaaaaaagcaaaagtatctatttctttcagacaataaacgtattactttattaattccatttaaaattattttgtaaacaatgagtcatatgggagcacttctaaacagtaccgagtttcatctcataaaatttagcataaaactcaaaaatcaatgtaacaggatctgaacacagatattcactgtcacaaatttaccctgaaaaaaaagaaactgatgttttaatgaatctatgtaactcaccaattatccaccacattttcttgtggaaatgtattcattttccaaaactaaaattgagagattttgcctgggagcattctaaaagctaagccttgaaattctgtttgaaatcactcagccataaaaaaaacacacctgagaaaattcctaactcactctgggaaaaacagtaaatgagaatttttaacaaatttttgacaaatgaaatacatgatcagacatttttttctgaaacccacctctttcatgacctttgtaaatatttttctacctttcaagccctactaatataatgcaatttacagctaaaaaactgaggtcaaaataagtgacaaatatcttcaaggtgacaaacccaggtagtggcagtgctgattaaataacagatgtgtctgactcatgtttcaagtcaggtcattcaatcactggagagattcttccacccactcctgctcacttatgtgctcaagaaccacccactcagaagacactgcattatgccccagtgactgccccaggtgcattttactttgcaagctcttacaccatctcactggggtcagttctgttgttgtttgtcttttggaatactttttggtaacaaaattttcacttttttttccaatatttttctttatatttatttcactatttttctgccccccttagatgatccagggagcagaaattatttttgtgtttcccctcaataccagcatctgattggctgaccagcaacgtgtctccaagaaatgaaagctgggttgggtgaagacaattttaatgtctcaaggggttaccttttcaaaataagactgcaccagaagactcctctcagccccagggcatccacttgctcccttgagaggacacattccatacctcgggtcatcctacgggagaaaataaaccagaagctgacattcactaggcactttagctgacagaaccatggcggatatctcggtttatccacagatagtactgaaacccaggaccaggaaaaaactaaagggtggctgaggacacatcaccccatagatttttccaaatcaaaaccttgacccaaaaacattctgataaatctctgtgcctagagaaggtaaaaggaaaagagacacagagattttctacaatacagtgtcagaggattagtctttgtttccttttcgtgggaaatatttacaagcggataacacatcttcttaaaagcgccatttaatgctttgtcaaaaacaattaattaaaatatggtataaacaagtacactaaaggacaaataggtgataatgtgaattaggaaggaaaagttgacatttgggaacgccagaagaaattggaaatttagtatcttactgcaagccagagtgaggctggagaaatgggggacgggggttagacttaacaacctgcttgggacacaggtgaaaaatgcagcagaaaatcagttccccgtggagtgtgaaaataattaagagacaggcaattccactgaggtgtctctagtccctgggttcctacttaaaaaaaaaaaaaatctaactcaggtgcattttttttttaattactacattcagagaaaatgtaggcttaaacaactataaactgttaattaacctctgattacacaaccaggaaatcttcacctgtattgtacaaatcaagaaactacgttactgtaaccaattactaaatttagttttcttcatcatacattttataaatgactttccttcaagcctctcccatagacaacaaactacaaaccatagctggatactctatgattcttgaatcactgtttgattaaattctttaggccaggcgcggtggctcacgcctgtaatcccagcactttaggaggccaaggcgggcggatcacgaggtcaggagttcaagaccagcctggccaacgaggtgaaaccccgtcccaactaaaaatacaaaaaaataaggccggcccagtgacaggcgcctgtaatcccagttactcgggaggctgagccaggagaatctccagaacccgggaggcggaggttgcagtgaggggagatcgcgccactaaaccctagcctgggcgacagagcgactccgtctcaaacaaacaaaaaaatcgttaatatttgtgcagtgactcccatacatttttaataggagaaaagaggaactgggaaagccacggaccaaagatcttcccattcatgaacccgcaccccgagtcaggattttcccctgacgaccctcccgtggtccctgcacaatctgagagagacgcggcgctgcgggtgcagagctgccaagagagggctccaggccaaggcacagtcactacgcagggaagagaaaggacgcctggggtcctggctgtcagcgcagccgccatcttatggccgaaggggacggaggccgagctgggcaaggcgcagattgtgaagctgactgcggagaggcctgagtcccgccacagctacttcccaccagttccaaccagccctttcgccgtctctcgggatgtcggaccgggcactctcaccatttctaggcttctagggggtcctggcgtcttagctgtggatctcccaatatctgcaggtcagagggccacacaggctaggcccctaggagcagaagacacagagaagtgagagcaaaacctggagctccggctacagcgagagacaaagaccccgccaaacccggaagccgtccagtccgctccagctgcatgcctgattggacggtttccagcccagcgtccctggttggataatgcttaaatccccgccctgtcaggctttgagtgacagaagatgtgatcagatgcgggttcaatgaagaaagagtgacagcctagactgccccctcttctgacagggcttcctccctcagctgagctaggcccatcccagagagtatttgcctttaaatttgtgtataaggtcatatgtataaataaataatacattatatagctatacacaagtgaaaagaatataacaattattttaaaatttcagcttttatgaccttcctggcttctggccctttgagcaggcagcctgagattttagaaaagagaaaatcatctaaaatgaatgtcagccacatgtggatttgaaattttctagtagccaaactttaaaaagaaacaagttgaactgattgttaacaatgtaattcacccattatattcaaaatattatcattttaatgtgtgagaaatatgtaattattgataaaatatataaatatttggaactaaatctttgaagctgactttgtattttacctttctagcatatcgcatttcagaccaggcacattgtgggaacccagtagccacacatggacaatagctgtcacattgaagtgcagctctgatgtcagcggtgtgaagggcctgaacatctctttcctgcgagagtgaaagaagagactctccctacaaacatctctctttggttcctagggtggaccagatagttcccatagaaagagctgagggcagtaggaataaaatagccacaggtaataaacaactgctggccacctgttgcccacctttcttttagagaccagatagtgaacaaaggatgatggggccacaggagaaaaaacaactatgtcttcagttctgtccacacacttgaactccagtatttagagatggagaaaatagattaaaaacaaacatagtttgctatatggtcttggccctaacaatcaggctgtgtttatctgttttctcctgtggtgtgggggactatgtgagtctaagcaccaatcacacgcatacatgtctacaggtatttctgcattacccaaaattctcttacaaaacatcgaactttaaatcaggggaagaaatcagtacctagagggtgtccactgttagaagccaactcttagtcaacctgtcactgaatcctggcaacttatctgtactgggtgcatgtattagttagctattgaggcataacaaatcatccaaaacttattagtttataattgaaatggttggccatttaggccgagctgagtggggccattcttctggtctcagctgagctccttcagacatgtatcatcacctgctttttgactagacagctgtgcatctgggggtgagcttctgctcctgggtctgtcaacaggggcaccttgcttctcctcttcatggtatcttattttccagctggctaacatgggcattattcatggagatggcagcattctaaaagaaaaagagaagcagtcaataccatttgagcctgggccccaaactggcccactgtcatgttcacaggtttctgttgacctgagcaaataaggtcagccagatatagggctttgaaaacagattccagatcttgatggaaacagctgtaaaagcacctggttatgggcaaagatacaagagggatgaaaaaatgtcattttgcaatcagtatcattctaccttttttgcatatgtggtatatagaactcttccacatcaggaaacttgtgcaaagtcctacggctactaagtggctgggctgagactcaggatcaactttatctgactccaaagcccatgcacctccatagatgacactactaaagtagctgccctgccctagactattgaaatcctggagagtgacacttccatagtagaagtcagattccttttagatttgtgctcatttgggaataatcctcacaaaaattgcagaagcacacggtggctctcacctgtatttttagtactttgggaggctgatatgggagatttatgtgagcttaggagttccaatgcagcctgatcaacataataagattctgtttccatgacaaaaatgaagaaattagccacccatggtggtgcatgcctatagtcccagatacttaggtggccgaggcaggaggattgcttaagcctggaaagtcaaggctgcagtgagctatgagtagttacaccactgcaatcaagactgggtgacagagtgagtccctgtctcaaaaaaaaaaaaagaaagaaaaaaattggagaagcattttgaaaagatataaaataatttggggaaataactgaaggatgagtttagaaaatcaaagaccaacaacacattatttatttttcatcatagaaaatagttgaaatccattaaaaggaaaaatctttagagaaattaataaattttttaaatttattttttatttttgagatggagtctcgctctgtcacccaggctggagcacagcagtgcgatcttggctcactgcaacctcggcctccccagttcaagcgattctcctgcctcagccttctgagtacctggattataggcatccgccaccacgaccagctaatttttgtatttttagtagagacggggttttaccatgttggtcaggctgctctcgaattcctgacctcgtgatctgcccaccttgtcctcccaaagtgctgggattacaggcgtgagcagcagagtccaattgagcatggaatgatttgcagattgggtagcctgtggatccagagtaggcgcagagagactctagcacagccacatgatgaaaacagattgatagacagcaaaagcaaagtgacatacagaaaatgaaagtgaggtacagaaacagccagattgattacaggttgggatttgccttatttaatcatgatttgaacacttgatgttcttttattggcagaagcacagtggttggtacaataatgggttacagtctatttatatatccagttaggtttcagtttactatgtacaaaaaaacctagtgaccaaagttaaacaggaaagggtgcagctttagagataattaatttaacaatttctcccttttggtcacgttctcaattttgagagatagaccaaaactttagacattgatattactctgtcaccatcaaaagtgtacttatttagtctcaaatcccactatgaaatagcagaactgtgggttttaaaagtggaaacaaggacttcacgttatttgttttttagggttgcagtagaggggaccatcttgtatcgaaatctgctgtttccaaaataaaaataaaacctaccctgttttaagatctacctatttacttaaatttttaatttgattatttcacatttagcatgagtgactccatttactttgatttggtctgtttgggcctagtgcacaaggtcagtccagaataatggcctccaataattttgtttaaaaattttccaccttttggttaagttctcaaataggtcagagtgtgactaaaactcagggtcttagtgtcactctcagtttctattatttttggtttttgtttttatcagttcattcataggttatggtgtcctcatggtcacgtatgtatttgactttttgtggttccagttaaagagagactatttcacattctagagataactgcatgcaaacttcaataacttttgagagaatacagtgcagtagggagactactattttgactatctgggggtaataaccaaaagtttcaagtatgctttttagtcagggtcccatgaacccaccaactaaaattaaatagatcaaataattagctacataaatgttctcctcatttcaaacaagcagcctattcactaatctcctacaactgaatctctgtaatacctggtgaatttctctatgtgcaactataagtattagcaacttcacagatacttctctgtttatccagtaaataatctagagaaattctattatttaccacaattttactaagaaaaattaaagtctattgtgtaaccatagcctttacaatagaatttgctatagagccctattatggggaataaatttctttttttctttttttcttttttttttccgagacagagtctcactctgttgcccaggctggagtgcagtggcatgatctcagctcactgcaacctctgcctccaggttcaagcgattcttctgcctcagcctccccagtagctggcattacaggcacacgccaccacgccctactaatttttgtatttttagtagagatggggtttcaccatgtcggccaggctggtctcaaactcctgacctggtgatctgcctgcctcggcctcccaaagtgctgagattacaggcatgagacactgcgccagcatagggaataaatttttaaccattgcctcatttactctaaaccatgggggaaaaaaagacctaacaagtgatacccattaagaagagtactggcctcctggcaacactctgtaatctattctgaataagttctctttaacttataaggtaggttaagagcagtggacaaatattccatttttgatattatgaggcaacagatgtcctattaaaaattctcaccaggccgggtgcagtggctcacgcctgtaatctcagcactttgggaggctgaggcgggcagatcacgaggtcaggagatcgagaccatcacggccaacatggtgaaaccctgtctctactaaaaatacaaaacttagctgggtgtgatggcatgtgcctgtaatcccagctattcagcaggctgaggcaggagaatcatttgaaccatggagtcggaggttgcagtgagctgagatcacaccactgcactccagcctgggcaacagagtgagactccatctcaaaaaaaaaaaaaaatctctcccatattggcccttcgtcttttacctatcaaggcataagtttgcccatatagaaggttggctgcaaaatcattttcatgtaaaagtgtagctcatgaaggcacacaagtgaccccttttttatttctgtcatttggagagccataagaaaaaaacagtggactaagagtgtcgtaatagcagagatgtctttcttgatttttttatcttgttaaaaaaaaagctatctatgttaatgttaccatctgcttttgaggagaagcttccctgcttagctttactttaagatctccaatgggtatacaattgcaagtttggaggggcccttctgagtcatgagattatcaaaccaaggtttaaagtcctgaagtcttgctgcagtgtagatggcaggcagactcaatctctctggtttctaaattataaagggttttatagtattccatcagtaaaccattaaaagcattctttacctagtgaaaatatgctttgccgtaatgcattaaagctttgctgcatttagtcatattagacttcagtagcagaagatacatgaggttcttttatcaggtgcataagccttccaatgactattttacaatcgtcaacacattttttcactctcagttaacctgattgtcatcaatctgcaactacaaaagcaattctgtcaatttagttaactttgctcaatattactgtttctgtaataccttatttaacagttttataacatgtctagtaaaataagtatccctattattggagactttttaagaaatgtttcacgagcaaaacatatttcctaatattattttggctactgttataacatcaaactttttgcatgagaaaacttttttttttttttgagatggagttttgctcatgttgcccaggctagagtgcaatggcacgatctcggctcaccacaacctctgcctcctgggttcaagcgattctcctgcctcagtctcccaagtaactgggattgcaggtatgtgccaccatgccctgctaattttgtatttttagtagagacagggtttctccatgttggtcaggctggtcttgaactcccgacctcaggtgatccacccacctcggcctcccaaagtactgggattacaggcgtgagccaccatgcccggcctgagaaaacttttattctacagacatgaattaaaaatgacaattaaataaaatttctttcctttttttttttttttaaagcagaacctcgctctgtcacccaggctgcagtgcagtggcataatctcagctcactgcaacctctgcctcctgggttcaagcgattctcctgcctcagcctcctgagtagctgggattacaggtgggtgccaccatgtccagctattttgtatttttagtagagacagagtttcaccatgttggccaggctggtctcgaactcctgacctcaagagatctactcacctctgcctcccaaagtgctgggattacaggagtgagccactgcacccggcctaaaatttctttacaaatgtttaaatagcccattgggtagcagaaatgtacatgaagttttgattgtcttctcgggattctgtttgacaaaaaaaaaaaattggtcctaacctattttagtaattagaataatcaccaaacacacacacacacatacacacacacacactcaatttatatttagcttaatttattttttatctcttctgtgatgagtaattaaatgcagtgattttgatagaggaaactttaagaactcagaaataaacaagtggctgttggctgtctaggttctccatgagtccacacacaacattaaatttatgtcctcttcaatatctggtttgtttcttcaattcaggtgcatagcactgataactgagaagttatcatacataatttgacttgtaccacagagtttattcaaacggcatatctaaaacaattttagtactggctaatttagtataaaaatgtggtagagtattttcatgatgttcaattaatttttgttttgcctggattagtagtttcataagagtcattctcttcattagaattctcacaattcttacccagtctaaacagtttgattgtaaaattatcagaaacttgtactcaacttgtctgggtcctttccatcttttcataaaactatgctaaaattaattcattaactgtggaaataacttaaaatagttataaagaaacaaatgaaaaaattgattttatctgtgtcctacaataacctatcataataaccataattatgactaatagcatatactcagaaatttcatacaattttcaaataaatgctaatagcacttattaaaatataagttgaaggtcagacatcatttttaatgttatgatgccttccatgtaacttaacatatcaaataattctgatgattactcttctggatgttgcattagccctctgcagcatctaaaagttaagggtcaaagaaaagacaattattaagcggaaatttcattctggaaaacctgtcaaatatgtcaaagggttaaaacacttgaccagatatataaaaattggctctccctctccctctccctctccctctccctctccatcaccctgtccctctccccacggtctccctctccctctctttccacggtctccctctgatgccgagccaaagctggactgtactgctgccatctcggctcactgcaacctccctgcctgattctcctgcctcagcctgccgagtgcctgcgattgcaggcgcgcgccgccacacctgactgtttttcatatttttttggtggagacggggtttcgctgtgttggccgggctggtctccagctcctaaccgtgagtgatccgccagcctcggcctcccgaggtgccgggattgcagacggagtctcgttcactcagtgctcaatggtgcccaggctggggtgcagtggcatgatctcggctcgctacaacctccacctcccagccgcctgccttggcctcccaaagtgccgagattgcagcctctacccggccaccaccccgtctgggaagtgaggagcgtctctgcctggccgcccatcgtctgggatgtgaggagcccctctgcctggctgcccagtctggaaagtgaggagcatctctgcccggccgccatcctgtctaggaagtgaggaacgtctctgcccggccgcccatcgtctgggatgaagtgagaagcgtctctgcccggctgcccatcgtctgagatgtggggagcgcctctgccccgccgccccgtctgggatgtgaggagtgcctctgcccggccgcgaccccgtctgggaggtgaggagcgtctctgcccggccgccccgtctgagaagtgaagagaccctccgcccggcagccgccccatctgggaagtgaggagcgtctccgcccagcagccaccccgtccgggagggaggtggggggggtcagctccctgcccggccagccgtgccatccaggaggtgaggggcacctctgcccggccgcccctactgggaagtgaggagcccctctgcccggccaccaccccgtctgggaggtgtacccaacagctcattgagaacgggccatgatgacaatggcggttttgtggaatagaaaagggggaaaggtggggaaaagattgagaaatcggatggttgccgtgtctgtgtagaaagaggtagacatgggagacttttcattttgttctgtactaagaaaaattcttctgccttgggatcctgttgatctatgaccttacccccaaccctgtgctctctgaaacatgtgctgtgtccactcagggttaaatggattaagggcggtgcaagatgtgctttgttaaacagatgcttgaaggcagcaggctcgttaagagtcatcaccactccctagtctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaagaaaaaaaaaaaagaaaaaaaaaaaaaacacttgaccaaaatagaaccacaagttctcataaaataatagtcacttatttagccaaagtgataattaaaagattaaaaaaaaaaaccaccaaaatcttgggctgggtgcagtggttcatgcctgtaatcccagcactttgggaggccaaggcaggtggaccacaaggtcaggagtttgagaccagcctggccaatatggtgaaaccccatctctactaaaaataccacaattagccaggagtggtggtgggtgcctgtaatcccagcactttgggaggccaaggcaggtggaccacaaggtcaggagtttgagaccagcctggccaatatggtgaaaccccatctctactaaaaataccacaattagccaggagtggtggtgggtgcctgtaatcccagctacttgggaggctgaggcaggaaaatcgcttgaacctgggaggtggagattgcaccactgcactccagcgtgggtgacagagtgagactcccgcctcagaaaaaaataaaataaataatcttttattgtttgatacaggagattcagtttttcaatcaaaagacctgaaaaagccagcatgagaaaagtcctattttttctgtttttccttttcaatttattcagaagatgaacaaaaatattttcctgtgtcatattaataatacatacactttttgttcaggattaaatcagcttttacatttttggagcctctgatgttaaatccttgatggcaaaaggagattgatctgactcaaacatggacctctgtggttcctctttctacaataaacatgagtctcaaaaagaggccacaaataggtcaaagtctcctaaaaca

SEQ ID NO: 381 - DNA, 41430 bp, Homo sapiens
ccttgggccaggtaaatacggattcccaggttggccttaaccctccaacgcgcttggcgttgtccctcggaaactctctagagatgagcactctagagatgactcagtggactgggaaaggcagacccacctcaatttgggtgggcacaatctaatcagctgccagcacagtcagaataaaagcaggcagaagaacgtgaaaacactagacgggcttaacctcccagcctacatctttctcccgtgctggagatcagagatgatgatggaaagggagaagatttctattatgttctgtgggccgtcagcatgaaattgcacatgctacccaggcagggctttgcatttcacattttaacttgcatcgccttcacacagaattccaggccttttaaattaaattgttaaaattagtttttatttacttatttattttaggacagagtctacactgagtatagcactgggtctacactacgcccaggctggagtgcagtggccatgatagctcagtgtagactcgaactcctgggctgaagcgatcctccagcctcagcctctctagtcgctgggactacaggtgcctgccaccacggccggcttaaaattgattttaatagcaggaaatttcctggatctaatcctcaactgacgttgctttgctccggcaggatcccagtttgcagagggctgagctgctccagcctcactgccagcaaaacccggaaaacagaggcactggaggcgtggcctagggaagccccgccccgtcccgtcccggtccgctctctatgctgcgcgcgcgcagttttttgcagacccggaagcggatcgcgtgggtagaaggtcacaccgcagcgcgtcagtttccctttgtttagattcaatctgggcttcccagctcccccgcgcttctgtacccgggatctgagagtcaacacagaccttgaaatccccgcaccgctccctccaccccgtgtaaattcaggcgtctccgtgagagtccggcgctcgcttccctgtgtgttaaaatcgctcggcgacgggtcctgtccccgctcgttctgccttgggccaggtaaacacggattttcgagactcctttccgcttaaaactctttactgacccaacgtcctgccccgcgcttttaaaagtccttaccgcaaggtggattcccgcccggggagcctcccaacctcgcccccggcccctgaagcgcagcgccgcagccccagtcccggcgggggaggccgcgtcctgtactgggtcctgggacccttgagaccccacacttctaataattcagccccacccttttcctccttgatccgggccttcctactccccaggcctccccttcgcagccatcgctactcccgacccccgggtgtggggacgtgacttcttctgtcttaggacattcaggattcttcgtcccaaattccatcccactaaaaatgtgctcttggcggaggtgggcaccttattgtactcccctgcctatggatgtgtggggaaagatggtgaaagagtggcaggaaatagaaaaattttgaaaaagaagcatgagggagatccataagcagacggcagagagtagctgagagatttacagagacagtgaatgaagccgagaatgtagcagggggagaaaagtaactggagaaatgtagagaaaagctgggtctccagagagatgaagatgaagcaagattgggagaggggcagaaagggggaggctcctcagacagagtaggggagaggaggagggatttggagccagggcagacagagcagcatggtgctgggacagcaagagggggcagctgatgacaaggagagcagagggagaaccacagcatggggaggcctgggatccgggggggccagagagtggggacaagagagtgtagcagggaagaggaaatttaacagggagaacagagaggaagcagagatagggagggcaagaaacaggcagaatggaaattggggacaatcaaaaattggacacaaagaggaacaaggggtaaaacaaattgccagaatggagcagaacaaatggaagagaaggaatagagggaagagggggagaaacagcaggagaggagaggggcagaaaaataagccaattcttatgggaaaaatgaagtgaaaaaaagcaggagaaagaaggtaagaatgagagagctgtacagaatgagggagggaaacatactaatgacaaaagagggggaacctgagtgcagatgagcgatgagttgatggactattatgatcaaattgtgatatactgatttctctaattgtaatctaataagcacaaaatttatttcaaaagtacagatgaagatgagacttgcaaagttcctgcctataagggaagtgcattttataattcttgacatcacaagttagcttccattcacaatccctgttcagccagagggcagtgacttgcctcattcgggtgtgggtgagtgggtaagacaggaggaaaaaccaaagcgtttttcctacgcttacaatcaacacaatagtgaacacccaacacagaatgccacatctctggtcaccaaaatgtgttggggattacttcccacccacaagcagttcatcagacaccacctgggtgttgtgtaatttaactcaatttcacactaacactatctatgtggagttagcctcagattctacaggttgagagctcagttccacaggcatgctcccacttcaggtgccacttgcaagtcctgggttgggacttgaaccttgtgaccaaccaactatgaaccgggggttcccatgaccctttcctcacattttgtgaatttgctagagtggttcacagaactcagggaaactttttgcttagtttcacccatttgttacaaaccatattacaaaggatacagatgaacagccagatggaagagccttcctagcaaactaatcaaaatgaggggcttttggaccaggcgcagtggctcttgcttctaatcccagcactttgggaagccaaggtgggcagatccacttaaggtcaggagttcaagaccagcgtggccaacaaggtgaaaccccatctctactgaaaatacaaaaattagctgcgcatggtggcgtgtgcctgtaatcccagctgcttggctgagacacaagaatctcttgatcccaagaggtggaggttgcagtgggccaagatcgcaccactgcagcctgggcaacagtgagactctgtctcaaaaaaaaaggaggggctcttagtaaacatgtttttttttctttgagacggagtttcggtcttgttgccctggctggtgtgcactggcgcgatattggctcaccactgaaggggtggcctgcccctccacacctgtgggtgtttctcgtcaggtggaatgaaacactcagaaaaagaaagagacacagagcaaagtacagagaaagaaaagtgggcccaggggaccggcgctcagcatacggaggacccgcgccggcccggtctctgagttccctcagtatttattgatcactatctctaccatctcggagagggggatgtggcaggacaaaggtaatagtggggagagggtcagcaggaaaacatacgaaccaagatctctgtcataaataaggaaacgtgctgtgccttgatgtgcatgtatacaaacatcttggtgcagtaaagagcagtattgctgccagcatgtctcacctccagccctaaggcggttttctcctatctcagtaaatagaacatacaatcaggttttacacctagacattctattgcccaaggacaagcaggagacagatgccttcctcttatcttaactgcaaagaggccttcctctttcactaatcctcagcacagaccctttatgggttccaggctgggggatggtcaggtctttcccttcccatgaggccatatctcaggctatcacatggggagaaaccttggacaatacctggttttcctaggcagagttccctgcggccttccacagtgtattgtgtccctgggtactcgagactggagaatggcgatgacttttaccaagcatactgcctgcaagcgctttttaacaaagcacatcctgcacagccctaaatccattaaaccttgagtcaacacagcacgtgtttctgcgggcacagggttggggctagggttacagattcacagcatctcaaggcagaagaatttctcttagtacagaacaaaatggagtctcttatgtctacttctttctacatagacacagtaacagtctgatttctctttcttatccccacacaccacaaccattgcctcctgggttcaagtgattctcttgcctcagcctctccagtagctgggattacaggtgcccgtcaccatgcctggctactcttgtatttttaatagagatggggtttctccatgttggtcaggctggtcttgaactcccgacctcaggtgatccacccgccttggcctcccaaagtgctgggattacaggcgtgagccaccgatcctggctggaaaccatgctttttatctgcatctaaactgaggggcagccttgtgggactgcacctttaacccgtggaatctgtgcctatctccaagtagacagtagcaaagttgagttaacctgtgggacacacagctgcgagcgtgccacagaactggtcagcacgggccagacgcgttggcttaagcctgtaatcctaacactttgggaggctgactcaggcagatcacttgaggtcaggagttcgagactagcctggccaacgtggtgaaaaataaaaaattagctgggcgtagtggcttgtgcctgtaatcccagctactcaggaggctgaggcagggaattgcttgaaccctggaggcagaggttgtggtgagctaagaccgcgccactgcactccagcctgggcgacagtgaaactccgtctcaaacatgggggaaaacacacattttggtgatgggcggcatagtattctgtgctgaatttgagtgtagtaaaaacagttatcttttttccttacctcaaacagtaaagggaagagacttggcccaccagtctcagggcctgtgatgtctactcaatagtgatggaatgatctgtccctgctcctggctgctgctgatcctgagactgtacaccatgtgccagccccacttacagtctcagagtggaatgacatccctcctctatggtgtcgttaatttttttgtctaggaaattattattattattattattattatttgagacggagtctcactgtgtcacccaggctggaatgtaatggcgcaatctccactcactacaacccctgcctcccgggttcaagcgattctcctgcctcagcctctcaagtagctgggactacaggcacacgccaccacgcctggctaatttgtgtatttttagtagagacggggtttcaccatgttggccaggctggtctcggactcctgacctcaggtgatctgcccgccttggcctcccaaaatgctgggattacaggcgggagccactgctcctggcctagggaattattttggtcagcatactgaaatggaggtgttgtccactgaaacacacacactcacatactcactcactaaagccttttcgttccatttttcaatctttaaaacaaaaaatactgtatttactacatttctccctgcagtaagtacccctcttgcatgctctatttaagatcacagtacactaaaatcttgtttatattctctcttcaattcttgcccctagttcttggttgactccatccaatcaagttatcgcatccacccattccattgctcctgcgacctgtttctaaatttatttttatttttaaaaagttttattttttatttttattttttttgagacagagtctcgctttgtcatcaggctggagtgcagtggcacgatctcggctcactgcaacctctgcctcccggattcaagcgattcttctgcctcagcctcctgagtagctgggattacaagcacacgccaccatgcgtggctaatttttgtatttttagtagagacggggtttcaccatgttggccaagattgtctcgatctcttgaccttgtaatctgcccgcctcggcctcccaaagtgctgggtttataggcatgagccaccgtgcgtggcccctaaatttatttttaattaattatttatttttttaagggacggggcctcactctattgcacaggctggagtgcagtgaggcaatcatagctcactgtaacctcgaactcctaggctcaaatgatcctcctgcctcagtctcccaagtaggtaggactacaggcatgcaccactatgcctggctaatatttttatttatttacttatttatttatttttgagacagggtcttgctcccagtctcccaggctggagtgcagtggcataatcacagctcactgcaacctcgacgtcctgggctcaaacaattctcccacctcagcctcctgaatagctgggactacaggcccatgccagtatgccactaatattttggttttttatagagttggggtcttgctatgttgcctaggctggtctcaatttcctggcctcaagcgattctcccatctcagccacccgagtagccaggactacaggtttgtgccactgtgccatgctaatattttgatttttgtagagttggggtcttgctgtgttgtccagactggtcttaaactcctgagctgaagtgattttcccacgtcagcctcccaaaatgtatccagatggaggcatcattcattaaaacacattcctacataaaataaaggttttattttccttctactcttctatctttaaaacaaaaaatattatattaactacatttcttcctctaggaagtacccctcttctgtgctcccaaatctctggaattacaaggatgagcccctgcaccaggcttaatagtttttaaatttttgtcctcatctttctttccctgtcagcagcaatttgcacagccgatcactccctcttcttttttcttggctttgaagagattcttcataatttaaaaaatctgtttaactttttttttttttttttgagacggagtcttactctgtcacccgggctggagtgtagtggcgcaatctcggctcattggaacctctgcctcccgggttcaagtgattctcccacctcagcctcctgagtagtcccgagctgggactacaggtccgtaccaccacacctggctaatttttgtatttttagtagagatggggtttcactgtgttggtcaggctggtcttgaactcctgacctcgtgatccatccaccttggcctcccaaagtgctgagattacaggcgtgagccaccgcgcctggccctgtttaacatttttgtcatcaccttcatgtctcctgaactgtcttctgtgaatatgggagtgtcccacaatttagtccttaaacctgttctctctgcccacaccctctacctttccttatgatctcgtcttacagcttcaaacaccacctgcctgtctccattttccctctccacccacccctctctcctgaattccagaatcctgtgtccactcgtgttctggacatctctgctggggcatccacaggcatctccaccttcatatgtccaaaagagaccctgaactccccaaacacgtatccccagcagtcctgcacatatcagatgagggacaccctgtactttctgggaattaagtaaacctgtcaaatgtatttaaaatgtaggagatattttcttatttgtgttttcatttataatacaaacaataaatcacatgtttacttacatgcctgtaatcccagctacttgggctaaggcaggagaatcgcttgaacccagggggcagaggttgcagttagccaaagatcacgccctgcactccagcctgtgcaacagaatgagaccctgtctcacaaacccacacacaaaattatccggctttggtggcaggcgcctgtaatcccagctactccaggaggctgaggcaggagaattgcttggacctgaggcagaggttgcagcgagccgatatcatgctattgcacttcagcttgggtgacagagtgagactgtctcaaaaaaaaaaatgtatttgctcagttaggatggaaataggcctgtatggaaagtacagttaatgtttgagttgtaccttgatacaagcagtttcttgggagaaatggcatccagcccagtggagacccgcaagaacaggtcatgtccatacattcccgctagagggcagtgctggtgttggtcgaggcttcggaggtcaccttgaaggctaacggtgtgatcattggagaacagctggcatacagccacgtctcagtgtaggctgcaggtcttcagagaggcccctgacagcagagtgtgtcgcagcctctggtctcacagtgcctgtcaacctcttgaatttctgtgtattttgaattccagtagtcgaggtcagaatctcatatatggggtctgagaaggtgccatataacattctccaggggagctgggaatccaaccacattctctggggtgggagggaagtttactccatttcctatttatgggggctgctaaggggtgatgcatcactcgtgaaggaaggaggaacacactccaagttcttatcacagcacacaagtcattcatgtagcaaactatgtaagtggaatcatttgaaacctacataacagggggcccaggtttctcctgcctcagagacttcatctgggctgttcctctgcctggaactctctggcccctcagctgcaggtgacaaacacccttccttccccaggcctttgttctggtagtaccttcttaggattctgtgacccccccatagcccccgatttaacactccagcctgaccccaccccaactctcctccattttgaagctgtgtgtgtttctttctttcccttttcctgccactgtctggatcctggtgacagcaaggacccaaggggagagacgagccagaaggtggggactgtgctggctcaacccctctgagtggagctcagccctagtctcacatttgagagctgaggcattttgcagaaacatctcttgtgcctccttacagagattctgatttcaatactcaggtggaggccaggcctaatatttaaagctgatgctacagtagttgctccctatctgctggtttgatttctgtggttccagatcctcgagtttaaccgtggtctgaaaatattacacagaaagttccaaaaatgaagaatgtacaacttttaaatttcttgccattccgagtagtgtgctgaaatctagcactgtcccactctcttttgtttttgaggagtctccattgcccaggctggaacgcagtggtgcaatatcggctcactgcaacctctgcctcccaggttcaagtgattctcatgcctcagcctcccaagtagctgggattacaggcatataccaccacaccccactaattttttgtatttttagtagagacagtttcaccatgtagcccaggctggtcttgaactcctgagctcaggcaatccacctaccttggcctcccaaagtgctaggattacaggtgtgagccactgtacccggccagtcccatgctattttgcccaggactcgaatcatctccttttctggtatatctaggcagtacagtcatccctcagtattggagggattacttccacgacccctgaggataccaaaatcaggtgatcttcaagtcccttatgtaaagttgcatagtacagccatacactgcataatgacattttggtcaacaatcagatctatgatggtggttccgtaagattacactgttacactggagatgagaagttcctgttgcctagctacatcagagtagtcatgacgtcatagtgcagtgcattccttgtgtctgtggtgatgctgggggaaacgaacctagatcgttgccaggcagctttaacctgggtgtgggtgaggatgacactgtgatgctcctagaggtggttcatgaggaatggacgaataagtggttggaactgatatgagaacacatagctgaagaagaggtgagaagataggaaagtgaaggaaaagaaaaaaaaaatccaggaactttcacagtgaagggtttagcagaaacttgtacagacctcaacaagcttcttaaaaagtttgaaaacatgaactccaacaccaataggtgtttatttatttattttatttttatttttatttttttttggagatggagtctcgctctgtcgcccaggctggagtgcagtggggtgatctcgactcactgcaagctccgtctcccgggttcacaccattctcccacctcagcctcccgagtagctgggactacaggcgctcaccaccacgcccagctaattttttgtatttttagtagagacggggtttcaccatgttagccaggatggtctcgatctcctgacctcgtgatccacccgccttgacctcccaaagtgctgggattacaggcgtgagccactgcggccagcttattttattttttgagacagagtctcactctgtcacccaggctggaatgtagtagtgtgatcttggctcactgcaacctccgctttctgggttcaagcgattctcctgcctcagcctcctgagtagctgggattacaggtgcctgccactacacccggctaaagtttgtattttgttttttttgtttttggttttttttgagatagagtctctctctgttgcccaggctcagctcactgcaacgtctgccttccgggttccagcgattctcctgcttcagcctcctgagtagctgggattacaggcatgcgccaccatgcccagctaatttttgtatttttagtagagacggggtttcaccatgttggtcagtctggtgtcgaactcctgacctcgtgatctgcccgcctcggcctcccaatgtgttaggattacaggcgtgagcatggggcccagactaacgtttgtatttttactagaggcagggttttaccattttggccaggttagtctcgaactcttggcctggtgtgatcagcctgcctcagcctcccaaagttctggggttacaggcgtgagccaccacacccaaccccaaaaggtgtttattaatagaaaggaaagtttatggtgcattacctgctcacaagaacatttaggaagaaaaaataagcaagtaaaccaccatagatatttttcttcctctctcgttttcctaatcagctgatttatttttttattttttgagaccgagtctcgctctgtcaccaggctggagtacagtggtgcggtctcggctcactggaacctccacctccagggttcaagcaattctcctgcctcggcctcctgagtagctgggactacaagcctgtgccaccactccgagctaatttttgtatttttagtggagatggggtttcaccatgttggccaggatggtcttgatctcttgacctcaagatctgcctgccgcggcctcccaaagtgctgggattactggtgtgagctactgcaccaggccctcagctaactttcagattcacaccacagacatatttctgaaaggagtgccttctctcctagaagagcctcgggcaagttcttcaagaggtatccagaagaagtcattgttatcccagatgacagctccatacatgttattgctcctgaggaccttccagtgggacaagatgtggcactggaagacagtgacattgatggtccccaccctgtgtaggcctaggctaatgtatgtgtttgtgtcctggttgttgacaaaaaagttttaatggggaaaaagattttaaatgggaaaaagcttatagaataaagacatgaagacaaaatatttttgtacagctatataacgtgtgttttaagctaaatgttattgtagaagtcaaaaagtttaatttagaagtttataaagtcaaaaagttatagtaagctaaggttaatttgttattgagaaaaaaatattttttatgttagtgtagcctaaatacacagtaagtatgtatttatttttgagacagcctctcacactgtcgcccaggccggaatgcagtggtgcgattatggctcactgcagcctcaacctcttaagttcaggtgatcgtcccaccacagcctcctgggtagctgggactacagatgtgttccaccatgccttgacttatttcttgtatttttttttgtagacacaggagtgttgccatgttgtccaaactggtctcgaaattctggagtcaagcagtctgcctgcctcgttctccaaacgtgctgggattacaggcatgagccactacgcctggccaagtattcggtatttataaaatctacagtagtacacagttatgtcgtaggccatcacattcggtcaccacacactcactgactcatccagagcaatttctagtcctgcaagcgccattcatggtgagtgccctagacagctgtaccattttttaaacatgtatatcatattattattgtaccttttctatgtcgagacatgtttttatttacaagtacataccattgtgtcacagttgcctgtagtattcagtacataacatgatgtacaggtttttagcaataggctataccatataccctaggtgtgtagtagactataccatcttggtttatgtaagtgcagtctgtaatgaaatggtctgaaaacacatttctcagaaccggtcccattactaagcagtgcatgactgtatttgcatataaattacacatgtcctcccgtagactttaaatcatctcttgattacttataatggattatttttaatggattaatgaaatttataaatgctatgtagttgttatactctgttgttttcttgtattattttcattgtttgttactttttggtttctttccttttttttgtaattatttcagtctgtcgttggttgaatccctggatttggatcctagaaatactgagactgagggccgagtgtagactctatctgctcattagtcagtgaatagtcttctttttgatctgctccacttttggggtacctcagtccttttgtttaacccttattttacttaacagtattccccaagcacgtgaatattgatgctggcaatttggatgtgccagtaagaagctgtcacatgcataatttaagtggagtaaatagaggtcagtactgtttgaggttccaggcatccactgggcatcttggaacatatcctcatggatacggggattccagtgtgttctgtctctggcgctgagcaccaacgctctgtgtcctccatttctgagggcttacatgagcctgggatccatagagaggggaggaggggctgtgctcttcatggagtttggtcacagctgtgtctcttccctgaatggggcagctcagtccagcctagctccctactgctgtagcgtgtgtgcgggcttctccaggaggggagcgagtcctgaataaaagagtaaaaatttcactcattcttcctgtaggaatttcttgtccctgcatcaactctggtgcagtgggcaacagaggacatctttccgcaggattaggtctaacctgtgtgtgtggttgtggcatagggaggggaatgtgttgattccgagcagtaatcagtgtatttttgacatttaggattgacttataaacagtcatgctatgtgatgaagaagcccagaagaggaaagcaaaggagtcagggatggctcttcctcaggtaaagtgatattctcggtggttggttctctctgtttctttctgaaatgcctgaagcatcctgcctgacacgtttgctcacactcacccatgccttccctcagtccctttcatctcgcttagattctatctctcgtgacccagtgacatgaatgtgggaagagactgcactgggcgtggtcctgggaagggctcacacccagacatggatggagacggggtgagggtcccgtggtgtcagtggtgttgggcagcagggattgttcaggggccacatctggatgcactgtcagctctctgtggaccaggattagagaggctgccaatggaagtcacgtatttttttttttttttttgagacagagtcttgctgtgtcacccaggctggagtgcagtggcacgatctcgactcgctgcaacctccgcctcccgggttcaagcaattctgcctcagcctcctgagtagctgagattacaggtgcctgccaccacgcccagctaattttttgtatttttagtagagacggggcttcaccatgttggtcaggctggtctcgaacccctgacctcgtgatccacctgcctcggcctcccaaagtgctgggattataggcgtgagccaccgcgcctggcctgaagtcacatattaatgcacacaagtacctggtacattctggaaaaggagttcaggaaggagaaatcttttctgtctgatttttactacatttgaagctaaacacctttcctactttctaatgtctggcttggttcagagaggacattctctcttctttctcagcatgcccctcccatggagactggtgttcctgcagggagtcttgtacagcatctgtgttaggtgaaaaaagctgtaattttgcacagagattggagcataaattttttgtcattaaagaggtggaaattatattcattcttgttccagcaattagttatttttttatgttaaacatcaaattatgtatatatttgttttataggaagacaccacacatgcagcttaggccatcaaatacgaagcctcccctgccctgccctgtgcagtttcccaccctccctgcgtctcactggtgacccactgctgtcagctctgtgtcaagagtgagagcatgtcctgtagaaatatatttatacagcattggccgggcgtggtggctcacgcctgtaatcccagcactttgggaggccgaggcggacagatcacctgaggtcaggagtttgagaccatcctggccaacatagtgaaaccctgtctctactgaaaatacaaaaatcagcaaggcttggtggtgggcacctgtaatcccagctaccacagaggctgagacaggagaattgcttgaacctgggaggcggaggttgcagtgagccaaggtcacgccactgcactccagcctgggcgacagagcaagactgtgtctcaaaaacaaaacaaaacaaaaaaaacctatacagcattataaggctggacgctgtggctcatgcctgtaataccagcgctttgggaggccaaggtgggtggatcacctgaggttgggagtttgagaccagtctgaccaacatggagaaactccatctctactaaaaacagaaaatgagtcgggcatggtggcacatgcctgtaatcccagctccttgggagactgaggcaggagaatcgcttgaacccgggaggtggaggctgcagtgagccaagatcgcaccattgcacttcagccttggaaacaagagcaaaactccaaaagaaatatatttatacagcattatggtattttaaataaaatcctcagtgattgtttcgttgtaatattttataccaaaagttgtgaaaatttgcatgttttcatgttaggaagatggattccttgctcctttacatcctcatgtgaacgttctctgaattagaaattagtcaccttggcaaggtgcagtggctcacgcctgtaatcccagcactttgggaggctgaggcaggcagatcacctgggctcaggagttcgagaccagcctgaccaacatggtgaaactctgtctctactaaaaatacaaaattagcctggtgtggtggtgcacacctgtaatcccagctacttgggaggcttaggcgggagaatcacttgaacccgggagatggagtttgcagtgagccaagattgcgccattgcactccagcctgggcgacacagcgagactgtctcaaagaaaaaaaaaaaagaaagaaatcagtcacctctctttttttttgtgcctggcgtggttcagggaccatgtgtgccattcagcccaggaggagtctctggaggtcctgagctttgtctaggatgcatcctctctggactttgcttgtcacctcctcactgaagagggtggccaggttctgctcaggagcttccctttctgcacctgctctgcagcctgtgtgaggccataggaagctggggtccgcaccgccacctagtatctgcccgtgtaactgcgggctctgatttatgctgatgcctttgttctcagtggcttcctgatctggggccctgttacttcagtgcttctgttcaaccaagacagaacgttgtccctcaggagaaatctggagtttgtggtttcctctggatgatggcgcgtcgtgcctgagcaggggctcaggctaacgtgttcatgcattttcccactgggctcccagcaggttgacttggtgcttctttggggtgcaggaacttgctaaggaccttctggatttctcacaaagccaattggtctgtgtactgtttaatttttgtctccagggggacagaaaggtctgtggcttcgcattcctgtgtcttgctgacattactcttttagtagagttgcgaatttcttacacaggtctggagtgtcttttagttaggggccatgtgtatatttgctgagggagaggtaggatgtttcttgtgtgtgtgtgtcatttataattagtgctgctgaagaaggaaacttgttttctttttttattttttttgagatggagtgtttcactcttgttgcccaggctggagtgcaatggcgtgatctcggctcactgcaacctctgtctcgcaggttcaagcaattctgctgcctcagcctcctgagtagctgggattacaggcatgtgccaccacgcctggctaattttgtatttttagtagagacgggatttctctgtgttgatcaggctggtctcgaactccccacctcaggtgatccgcccatcttggcctcccaaagtgctgtgattacatgtgtgagtcaccgcaccgggccaaaacttgctttcaatatattcgtattagttaatacgcctaaatggcattctttgttatggttacaatcctgtcattcgttagttctaacagatcctgctttttcctgcctcctacccccactttttttttcctgttttttttcctctgcttctggtccctgctcaggcatcctgtgcagtggtaattggctgcagcacagaccagtgccctgtttctggccttaaattagaggaaatgcatcccacgtttactgttgattatgatgttttatgagatgttcttgtttaatatcatgttttttttgtttgtttgttttccaatttcattcttggcctgagtattaattatctagtaatttcttaaggtatgtcctgctgagatattttctttgacctttatttgtttgtttattttttgagacggagtcttgctcttgtcgcccaggctggagtgcagtggtgcgatctcggctcactgcaacctctgcctcccaggttcaagcaattctcctgcctcagcctcccaagtagctgggattacaggcgcccgccaccatgcctggctaattttttgtatttttagtagagacagggtttcaccatgttggccaggctcgtctcaaactcctgacctcaggtgatccatccacctcggcctcccgaagtgctggagttacagacgtgagccactgcgcccagcctatttgttaaattagtgtataatattcttaaattttgtatcatgtatcactgttttattaatgaaataaatcaataaactccattgggcttttgctaatacctacatatgtaaattttaatggacaaaagtgtatttataggccagggttagtggtgcatgcctataatcccatcttcttgggaggctggggcaggattaaactcttcccatgaacccaggagtttgagatctttctgggcaacctagtaaaaccccatctgaatttttaaaaatactacatatttttgaatgtgaacatttactagagattggaattgaagtttctatgttttttaatgatctgccatttttaatagcttaatattcaaaaatgtttatcaactaaattgagtacaatttctacatttttagtgttgtaaacaatgtggtcctcattttagggacgcttgacattcatggacgtggccatcgaattctctcaggaggagtggaaatccctggaccctggacagagggctttatacagggacgtgatgttggagaactacaggaacctggtctttctgggtgaggatgacttccctccagaagccgggatctgctctaatctgtctttgcattttctcttgcgtgcctcttgggagcccctaaattgcttaactgaggtagaaaccttgttgactcagaaatgaaaagctctattatgctctctggatttgaaatgcgtcctttcttcagatgtaccgcccccttcataatacatcattgggtggcaccggataaccagttctctgttttctcccctgtgcttacaagtcagtagttcttggaagagatctcagtgtctacatattgcatattccctaagcattcagaaggagccagtctgtgggtgaacttgtgagatattattcttgatccatttgcgatatcccctctcttacctaaacacagggtttgggttttggaaatgccccagcacatcttgtttctttctttttattaacaggaatctgtcttcctgacctaagtattatttccatgttgaagcaaaggagagagcccttgattctgcaaagtcaagttaaaatagtaaaaaatacagatggaagggaatgtgtcagaagcgtgaacacaggtaagagctctgatgggcagtgtggaggccatagtttttatttttttatttttgagccagggtgttccgctatcacccaggctgtagtgcagtggcaatcatagctcactgcagcctcaaactcctggactcaagcaatcctcctgccttggcctcccaaagttgtagattatagccactgcaccttgcaaagccatactattttttttttttttttttttttttgtctcactccgttgcccaggctggagtgcagtggtgtgatctcggctcactgcaacttctgcctcccaggttcaagtgattctcgtgcctcagcctccccagtagctgagattacaggcatgtgtcaccacacccagctaatttttgtgtttttagtagagacggaatttcaccatgttggacaggtgggtctcaaactcctgacctcaagtgatctgcctgcctcagcctcccaaagtcctgggattacagacgtgagccaccacacccagcccatactaactattcaagagtgtgtgggaaactctccaaaggtgggagagttctgtgagaaaagaaaagtttaaatcctaggcattctgaatggaaatatttctttgctctctcttgtcactcagttctataaatgtgtgatagtttcatcttttcaccctcgagtggtgttgccacccagagacaaaagcaaagtctttatcctgatggacagcaccctgtcatgtggcttctgtgaacttttgttccatgattctgaagaacacagggagcattgttgccaggggtctctttcccctgtggtctttcttcctgtacttgattccatctgatgcttagtttctgtccctgtaggtcaaagctgaggtcttcatagacctgcccccttgacctattcatggtccaccccatttcctgtaatgggaagatgtaatcaggaaatgagagaacatgagctactcttttttgcatctgggccctggaaactacaggtgcctccagccccctctgcctgttcaggtctatttggatgggaagaagccagtgattttcctattctcacatgccactcagcacagagcatttcacttctggtcaccaaaatgtgtggggatttctccccatcggcaatttttcactggatctttactgggttttctataattcatttctaacactgtctacctggagttagaatcagatcccacaggctaagggttgggttcccaagcctgtcgcccacctcagccaccacttgttagtagtagattgtcacctttctgtctgaccaacacagctgtaagctgggttccctcgactcccttcttgggttgattactttgctcgggtggctcacagaactcagtgagacacttcattaggttcactggttcatgatgcaggatgtttctaaggatacagatggacagccagatgaggagattcacagggcgaggcacgtgggaagattgactgggtgtgccgccctccaggcgcctgtgtgtcttcagcatttggaacctcttgtgaccccatagttcacgagcggcttcatcacgtaggcgtgattgatattaactcaatctccagcccctctcctagaagctagtgggtggggctgacagtttcatgcttctaagtatggcctggtctttctggtaatcagccccatccaaggaacccacaaaggttgcctcattagagcagatcacactcgtaccacccaggacatctcaaggtcttcagagctctgtgtcaggaaccggggaagagaccaatgtatgtatgtattcttattccacaaggcccctcagccattcttcagttgtgcttcatccacactttactggtgtgtgtcacaggggagtaggtggctcttctgagatgcttactcagctgagtggggcagatagtcaacagaaagaccctgtattcgatccctaggtccccatggggaacatggcacaaaatagcaaccagatgcttctggttttaacactaccatcatttgttcaaaccactgttactttcatcttgtacctttccatgtattataaattaacttggtttttgtatatttagtcagcagttccatatttcatataatactctttgtgtttattattttgtatctgtagggctgtagtatcagggaatggccattgatttatatatttttgagtgtggtttttttaaatgcacagggtatgcctcagcaggagagtctctaaaactgacactccagaaatttttgaataggagtttaaatatttgttttcctttgttgtacgtgacttagtagctactattgaacaacacttttgccaattaaatgtattacagtgtataatatggaaattttttatatcttaagaatatgctgttttaaaattgttgccatcttaatctcagaaataccattacactgacttgccgtaatttgttatttaagactgaggggcaaaactcaaaccgtatcttcctctgtctggtcttgcaccacgcaacaataaacacagacaacttatgtcaccaaatgtgagttttacttccaccaataagcaatcagttctgcagtggctacttgctgggggcccttgaattctattctgatgctgtgtacctggagagcgtgtcacatgccacaggttgagggctcagtctccaatactgccccctttcagacacgggtcataagtccaggcctctggaactttcgaccaactggcttcaaaagttggggttcccatggctccctctttgggtttgattaatttgctagagtggttcacagatctcatggtaatacatacttaacatttacagggtttattccacagcgtattttaaaggctccaggcccggcatggtacctcatatctgtaacccaagaatttttggaggctgaggtgggcgcattacttgatcccaggagtttgagaccagcaacataatgagacgttatctctacaaaaaattaaaaaattggccgggcgcagtggctcacgcctgtaatcccagcactttgggaggcccaggcgggcggatcacgaggtcaggagatcgagatcatcctggctaacatggtgaaaccccgtctttactaaaaatacaaaaaattagccgggtgtggttgcagacgcctgtagtcccagctacttgggaggctgagcccggagaatggcctgaacccgggaggcggagcttgcagtgagcggagatggtgccactgcactccagcctgggagatagagcgagcctccatctcaaaaaaaaaaaaaaaaaaaaaaaaaaatttaaaaaattagccaggcatggtagtacacaccttgtagtcccagctactcaagaggactgctcgagcccaggagtttaaggctgcagtgagctatgatcgcgccactgcactgcagcctggctgacacagagcaagaccttattccaaatagatagagaaggataaattaacagatggaaagaacatagggtcaggtctggaagggtccccagcacaggagcttctgtgtcctggagttggcttgtgccaccctcctggcatgtgtgtgagttcctgctcaccttcctgtcagcctcggggtgttcagctgtccagaagctctctgaacccagtccttttgggtttttatagaagctttattatataatgaagttacatgatataacttcattatttgtctttttgtctttgtatgactggcttatttcacttaccagagtgtctttcaggttcatccattttgtagcatataaagaaatttccatatttttttaggaacaaagaatgcttcttttgctttctttttttgagacggagtcccactctgtcgccgggctggagtgcggtggcgcgatcttggctcactgcaacctctgcctcccgggttcaagcgattctcctgcctcagcctcctgagtagctacaactacaggcatgcgccaccatgcccagctaatttttgtgtttttagtagagatgaggttttaccatgttcaccaggatggtctcgatctcctgacctcgtgatccacccacctcagcctccaaaagtgctgggattataggcgtaagccactgcgcctggcctcctttttctatttgttaatcaggttactggttttctgatttgtaggagttttatgtattttagatatataaaatcttatcagaggtatgatttgaaaatattttctcacatatggtaggtttccttttcactctggtaattgttttcttccatccacagtagttgtaggtcttgtggtagtacattttatgtatttttaccttctttcttgtgttatcagtgttctatccagggaagcattattgaatccaacgttatgaagctttccacctgattttttctaggagttttatggttttaggtcttagttttaggtcatgaattggctttcagataatttttgcatacggtgtaataagagttcaacttcattcctttcttgtggatatccagtttcctcagcactatttgataaagagactgtcctctctcgttacatggtcttggcagccttattgaacatcatttgaccaaatatttgagggtttgtttctggcctgtctgttctagtccattggcttatatgtctgccttcatggcagtacagttctattttgatgaaggtagcttagtaataagttttgtaatcatgcagtgtaacacctccagctttctttctttcaagtttgttttgctattgaggcacatgtgtgatttcatattaattttaggatgagtttatttatgaagaaaacttccttgggattttgctaaagagttcactgaatctgtagatctctttggctattgacatcttaaccttaagacttacaatccataaacatgggctgtttttgcatttgtgtgtgtcttctctactttgtttcagcaattttttgtagatttctgtgtacaaatttttcccgtccttgttaagcttattccctccatatttggaggttttgcatctacagattccacaaaattgcagatcagaaatccacaggtcattgaatctgcacatatggatcccatggatacgtagggcagactgtattttcaatccatggttagttgaatctgcagatatagaaaccacaggtatggaaggcctgcagtaaggaactcaggcatccacagattttgatatctgagagtgttttaagaaaaactctcaaaccatgtttttcctctgctctcacgccaccacaacaatctgtcaagacagaataagacttccgtgaccgacggtataggagttttttcccacacatcaagcaacggacaagagctgggtttcctacagttcagttctgacactatacctggagatagtgtcagatcccacgggttgagggctcagtgtcaaaggcttcccccatttcccaccagttacgagtctgggcctctagaacttctgaccaactagcttccatttgtggtttctgtggcccctctttgggctcgataaagtttctggattgtctcacagaactcacagaaacacttacttacatttgccagtttattataaaggctattgaaaaggatacagatgaagagacctgtagggcaaggtatgggggaaggggtgtggagcttctctgccctccctgcgaccagcatccaggaagctccatgtgttcagccatctggaagctctctaaatgcagtcctcttagatttttatagaaaccttattatgtcagcattctttcccccagacataaagcaggaccctctctcgggaggtcttaagacctataatcagaaagatgggagattagagttctgccttgaggcaggtgaatggagggcaggaaaaggttggagaggttctgtttcctgagttctgccctggggcctaccgtacccaacactataacagaagactgtagcaaaggctatgggagttatgagccaggaactgcagatgaaaacaaatatatatgtaataccataacaccacacaggggttcctggaaccagtcttccctggacaccaagggacagctatattctcaatagaaataatgcaacatgggctttctttttattttttcctaattatgaaggaaaagccttcattatttcaacactgagtatgatgttaccttttggctttttatataaggcttctgtatgtaaagtagattcctcgtattcctaatgtgtagagtgtttctatcatcagtagttgttgatgtttttcaaatgttttttctgcatctgatgagcctatcaagtgggtttttgtttttattctgtttttgtggagtattgcagggatcaatgttcctaagttgcaacatcgttgcattccaggagtgactttcacatgatcatagtgtgtggtccattttaatatactgctgaacttgcttgctagcattttgttgtggatatttgcattagattgatgaggaatattgctctgtagttttcttagagcctttgtgtgccttttctgtcaaggtgacactagccttattgaatgagagagggagtgttttgtccatcacatggaacatttttaagagtgttggtgttaaatcctttttcagtatttgatagcgttttacagtgaagtcatctggttcattacttgtttttgttagtagttatttgataactaattcaatctccttatttgttactcgtcttagtgtttctacttcttcatgagtaagtcttggtgagcagtgtgtatctagaaattcatccattgttgggacacagttgtacaatctcattttcttttttttttttttccgagacagagtctcgctcttgttgcccaggctggagtgcactggcgcgatctcggctcactgcaacctccgcctcccaggttccagtgattctcctgcctcagcctcctgagtagctgggattacaggcgtgcaccaccaggcctggctaattttttgtatttttagtagagatggggtttcaccatggccaagctggtcttgaactcctgacctcaggagatccacccgcctcggcctcccaaattgctgggattacaggcgtgagccactgcgcccggccacaatctcattttctacaattcagttttatttgtaatgtcctctattccatttctaagtttacttatttgaggcttacgcttcatttttgttttgttgtttatctagctaagggtttgtcaatctttttaaaatttattttaatttaaaaattttttttttcaaaagagacagaggtctcattatgttgctcaggctgatctcgaactcctgagctcaagtgatcctcccgccttgccctcccaaagtgctaggattacaggcgtgaaacactatgcccaactgtcaattttcttaccattcgaagtatgagcttgcagtttcatgactttagtgcttctctcttctgttttctaatcttaattttttctttctgctacctttctatttagtttggttttttttatacttcattgaagtataaagttagattgtttacatgtaactttatttatttattttagtgatgaggtctcactctgtctcccacattggagtgcagtagtgcaatcatagctcaattcaaccacaaactccgaggctaaggtgattctcttatctcagcctcctgagtagctaggactacaggtgcatggcactgtgccttgctaactaaaaaataaataagccagcactatggctcacgcctgtgggaatcacactatgggattacgcctgtaatcccagcacttcgggaggccgaggcgggtggatcacctgaggtcaggagttcaagaccagtctgaccaacatggtaaaaccccgtctctactaaaaatacgaaagttagctgggcatggtggcacacgcctgtagtcccagccactggggcggctgaggcaggagaatcagttgaacctgggaggcggaggttgcagtgagccgagatcgcaccactgcactccagcctggtgacagagcgagactccatctcaaaaataaataaatacataaattttgtagagatggtgtcttgtattgttgcctgtgctggtctgcaactcctggcttgaagtactcctcatgcctcaaactcccaagtgccgggattatagatgtgaggcatcatgcctggccatttgtttatttttaatgtaagcacacatttttgttgcattttataagttctggtgtgttctgttttcctttccttttctatcaagatattttaaaaatcagtttgtggtttcttttttgacctattggttttttagatgtgttgtttcatttggacatatctgtgggttttacatttctttctgttaattttgttttattacattataatgggaatcaatactttgtagacttctaaatgtttaaaagattgttttgtgtcataacatgaagtccatcctggaaactgttccatgggcacttccgaaaaatttgtattctgctgtttttaggtgatgtgttgtgtatacgtctgtcatatctaatgaggctatagtgatgtttgagtcctgttttcttcttcttctctttgatttttatttatttatttttattttttagttttaaggagcagggagtttaataggcaagaaagaagggggaagaaagaaagaagaagctcccctgtacagagacagagtgaggggggctccaaagccgagagacagaacccccttctctttggttctatccccttttttttttttttttgagacatagtctcaccctgttgcctacccaggctggagggcaatggtgtgatctcagctcactgcaacctccacctcccaggttcaagcgattcttatgcctcagccacctgagtagctaggattactagaatgcaccactgcatccagctaatttttgtagttttagtagagatgggggtttcgccatgttggccaggctggtatcaaactcctggcctcaagtgatcctcctgcctcagcctcccaaagtgctgggattacaggtgtgagccaccctgcctggtcaccttgttctatccatttttgaaaatgaagtattgaagtctactactatatcgtggagctatctgtttctcctttgaattttgtgaatgtttccatcctatacttaggggctgtgatatttggtgcctatatatttatagttgttatatcttcttggtgaattgaacccttcatcattgtataataacttttctttcttatactggttattgagtaaacgtctgttctctttgattttaatatagacacctctgtgctctgctggttactatttgcatggaatatccttttccatcctttcagtttcagccaatttatgtctttagagttaaagggagtctgtcgtggataggatttagttggatcctgttttgttctgattccaatgggaaatcatttgtatttcacatactcatagagaaggccttaatagtgccatcttgtcacatattagctgtagattttgtaacatcttgtagatttttttgtccttcatttttcccttactgcctgcttttgtattttgttggttttttaattgtgacatgctttgatccccttctcatctcctctggtgtatgtttgtagattttcctcttgtggttaagattgaagttacataaaacattgtaacaataaaacattattttaaaatgtcaacagcttaaccttgattaggtaccgaaagcattacattatagctgtgctatttgttattgtgctagaagttccttctatatatgtaatattcccattaacacattttagtgctttttaaataattttgcctttgaaatgctaggaaagaaaagccaaattacaaatgaaaagtacaataatgcatgatttttttgttttcttttttaatttttttctcatacagtgtcactctcaggatactatgtttccatatttgatcatttattgacctttaatggagaactttatattttcatttgggttagaagtactgtctggggtccttttatttccttttgaaggattccctttaacatttcttgtcagacagttccaaggtactaattaccttcctcagctcttctttattcaggaacgtgtaaatttctcctttatttttgcaagcaagttttgctgaatatagtattcttggttttttgtttgtttgtttgagaaggagtctcgctctgtcgcccaggctagagtgctgtggcgcgatcttggctcactgcaacctccatgccccgccttcccccatgtgaggttcaagtgattctcctgcctcagccttccaagtagctgggattacaggcatgtgccagcacagccagctaatttttgtgtttttagcagagatgaggtttcaccatgttggccaggctggtcttgaacttctgacctcaggtcatcaatccacctcagcctcccaaagtggtaggattacaggtatgagccactgcacccagccgtatttttttttctttaagcactttcaacatatcatcatcttactgccttctagcctgcaagtttgctttaagatgtttaatgataggctgggcacggtggctcacgcctgtaatctcaacactttgggagaccaaggcaggcagattgcctgaggttgggagtttgagaccagtctggccaacgtggtgaaaccccgtctctactaaaaatacaaaaaaattagacgaacgtggtggcgtgcgcctgtagttccagctacttgggaggctgatgcaggggaattgcttgcggaggttgcagtgagctgaggtggtgccactgcactccagcctggggcaacagagagagactccgtctcaaaaaaaaaaaaaaaagaattgtgacaggtgtgacagggagacctttcccaattagcctgttgtaaagggtgtgggaacacctcactcctgggattgtgtctctcctagctttatgcgtatattatactattactaatgtctatacaactgctcttaaatgtcttattttctctaagaggctcatccctgctttttctgagaagctttcagtttctgttctatttttctgcccttaatctttctcaaagtcactcataatcctcccgagtcctgcagattccccactgctccaatgcatcacgtcacccccttgtgttttcagctctcacaatgtgacatgcaaagtatgccgatacttcttccagtgtctgagttgggtgaggctgattctggtccctccaccagacggtaaacatgccagaatcatgggttcatgttctactctttcttcttttctagggaggagctgtgtattgggaagcaatgcagaaaacaagcctattaaaaatcaacttggattaacccttgaggcacatctgtctgaattgcagctgtttcaagccggaaggaaaatttacagaagtaatcaagttgaaaagtttacaaaccatcgttcctcagtttcaccacttcaaaaaatttcttctagtttcacaacacacatttttaataaatatagaaatgatcttattgatttcccattactcccacaagaagagaaagcatacattagaggaaaatcttatgaatatgaatgtagtgaagatggtgaagtttttagagtccgtgcaagccttactaaccatcaagtaatccatactgcagagaaaccttacaaatgtactgaatgtggcaaggtcttcagtcgcaattcacaccttgtagaacattggagaattcatactggacagaagccttacaaatgtagtgaatgtgacaaggtgtttaatcgcaattcaaaccttgcacgacatcaaagaattcatactggagagaagcctcacaaatgtaacgaatgtggcaaagcttttagagagtgttcgggacttactacccatcttgtaatccatactggagagaaaccttacaaatgtaatgagtgtggcaagaacttcaggcacaaattttctctaaccaatcatcagagaagtcacacggcggaaaaaccttacaaatgtaatgaatgtggcaaggtctttagtctgctttcataccttgcacggcatcaaataattcatagtacagagaagccctacaaatgtaacgaatgtggaagagcatttcacaagcgtccgggccttatggcccatcttctaatccatactggagagaaaccttacaaatgtaatgaatgtgacaaagtctttgggcgcaaattatacctaaccaaccatcagagaattcatactggagagagaccttacaagtgtaatgcatgtggcaaggtcttcaatcaaaatccacacctttcacgacatcggaaaattcatgctggagagaattcactgcgtaccttacagatggaatgaatgtggcaaaatctttagttagaattcacacctagcacaacattggaggactcaggagaaaaaccttacaaatatcataaatgtggcaaagaatttagtttgcattgaagcctcatcactcatctcttgatccacactgaaaggaaaccctacaaatgtaaagttaataacatatataaataatctataaagagagaacagttatatcagaatagagcatttaatgaaaactaccagtatagcatattcttgagtaggattcacatttaactgctggcaccgtaatttgtaactctttgatttagaatgtacatacttctcatgttttaagtaataaagtttaaagtttttttttagttttttcttttttttttgagacgaagtctcgctgtattacccaggctggagtgcagtggcatgatcttggctcactgcaacctccgtctcccggattcaagcaattctcctgcctcagcctcctgagtagctgggattacaggcatgtgccactactgcccggctaatttttgtatttttagtcgagacggggtttccctccgttggccaggccggtttcaaactcctgacctcaagtgatccactggccttggcctcccaaagtgctgggattataggtgtgagccacagcgcccggcctagtttaaatttttcttagtgtgaatgaattacatcctttctaccagcgttgtttaatcttacctcaggaggatactttatagtagagaataataacccattatgattttaaggttgaagcagccagaaaagtgtgtgtgtgtgtatgtgtgtgagacataaaacaacatacgcttctgggtgcaatatacttaagtaagtatgatgttgagtaattacacttagtacttgagttagtttctctgtactctggtgtaggatgtttatgtgggtaaagtcaaaatcactttaatagtacaatttcagccttgtacaccctcaaatgtgtgtgagtgttaaagagtatgccctgtattgtgtttctacatgcctctttcttgtgtgccaaataagaactatggtgtgcaccttcattttcatgcagcaaaaatatatagtaatatgacaaatattaggaaataaagtatgggttgagggcaaaaatactgtaacatggccgggcctggtggctcacgcctgtaatctcagcactttgggaggctgcattgggtggatcacgaggtcaggagattgaggccatcctggtcaacatggtgaaaccttgtctctactaaaaatacaaaaaaaaaaaattagctgggcctggtggtgtgcacctgtaatcccagctacttgggaggctgaggcaggagaatcgcttgaacccaagaggcagaggttgcagtgagctgagatcaccccactgcactccagcctggtgacagagcaaggctccgtctcaaaaaaaaaaaaataataataatactgtaacacaatttctttttgtacttctagtgttcagtgacatcatttgaaaatattaatgttcacccatcttctttttaagtcacacacagaaagggaattttgttttggtacattaactagaaacttcatatagtcaccctcacaactcttttggtaatttgaatttttgaccactcttctggaacttgtttgaagtccccctaaggtttggcttggatcttgagaatgatgatcccatacactgatatggtttgagagtgtttattatataatgaggctctgtgggggaaagcagggtatacttttccagctggtccaaaagtggcttcagagaactgggataggtgactggcttggggtgtcatgattgctaaagggtagggctggggcggggatacccactacccatactggaaacttagttacaattcacacctagcatgtatatttttatattttttgtatgtatatatatttttacatttttttcctacattgcctccaaattctatgtttaatacatttcttccctgttttgctctggtgaaaactttaggggacaaataaatgagtgctgtttggagacaaaattttgtgacatgggactgggcattgtggcgtgtgcctgtagtcccagctacttgggaggctgagatgggaggatcacttgatgccaggaggtcgaggctgcagtcagtgagctgtctgcacttcagcctgaaagacagagggagaccatctcaaaaaaaaaaaaaaaaaaaaaaaaaaagttgtgacctgagtatgtccataagacaatggcaggtatacactaggattaatataaatatgaaaaaaaaaaaaaaacttggccgggtgcggtggctcacgcctgtaatcccaacattttgggaggccaaggcaggcggatcacgaggtcaggagttcaagaccagcctggccaacatggagaaaccctgtctctattaaaagtacaaaaaagtagcccggtgtggtggtgggcgcctgtaatcccagctactcgggagactgaggcaggagaatcgcttgaacccaggcggcggaggttgcagtgagccgagatcgcgccacttcactccagcctgggcaaaagaacgaaactctgtctccaaaaaaaaaaaaaaaaaaaaaaggaaattgcacattccgccctggcagggttttgcatttcatattttaatttgcatccccttcataaacaattcaaggactttaaaattccggaaactagtgtttattattcatttatatttatttattttaattatttatttccaatttgttatttatgattatgtatttattaggcgcaaggtttctctctcatgcccaggcgggagtgcagcgcacgacctcggctcactgcagcctccacctcatgggctcaagcgatcctcccacctcagcatccgggtagctaggaccacatgcgagcgcccctacagccgatttaaaattaattttaatagcaggaattttcctggatctaatcatcaacaaactttccctctgccgggacacaatctatttccagatagctgagttcttccagtctccacggcaggtctagcctccaaaacgagacgagctgggagcgaggcggagggaagcgcaggctccgcccaatcccacccgggcctggcctcgcctcgcctctcagctgcgcgcgcagtttcctggagacccggaagcagattacgtggagtgacggtcatgctgcggcgtgtgagtttccctttgtttagattaaatctgggatgctgagtcccctcgcgcttctgtacccggcatctcaggggtcacacagaccttgaaatccccgcatcgctccctccaccccgactaaactcagacgttctaatgagagtctggcggtcgcttccctgagtgttaaaatcgctcggaggctggtcctgtccccggtctttcaccacagggccatgtagacagctcctgtcgcggagtttgcctgcttcaaatccttcagtgacccctagacacggcccgcgctgcgtaaagttctcacccgcgagatggatccacgtctttccggtcccccaagcctcgccctcttttcacaggcctgcccccttttctgtgccttaaatgagaggaaatcgatctgatgtttactgctgattgtgatgtttcagcctccattgggcttttgctaacacctaaataaatatttagtggacaaaattaggttagtgcaaaagtaatggcaaaccgcgatcacttttgcaccaacctaatatttatgggccggggctggaattccatcttctccggaggcccaggctggagaattccttgagcacaggagtttgagaccactctggacaacatagtgagacccccatctcaatttttgaaacatatgtttcagtacgggtatttaatagagattggaattctcgtttctatgtttttacatggtctgactttttgaaatagtttgaaataatgtttataaactgaattgagcacagtttatacatttttattgttgcaaacatgctgaaatgcacatttgcaaaaacaacgacagccaggcacagtggtgcacgcttgtcattcgagttactcggagagggtgtcatttgaggccaggaattcaaggctgtagtgtgccatgaataagccactgcactgcaacctggacacattaaaaaacgaacaaagacaaatatctaaaaaagaggttattgacagacaactctttcagttgtcacatatatgtttactagagtatatgtgtgtgaatgtatatatgtatatgaataagtgtgtacatgtgatgtgtgtggatgagtgcacagatgagcaagtctattgtttttatcaaaggcgcatcatcagtttatatacgtcttatatcttttaacagttgaaattacatcttatatattttcatgaccttaaaattgttctacactgttatgatagtgagtctatggctgtaaggatagtaacctgttatggggatacatgtgcgacagtttcttgattttaatcccggaacttattttaactatactcagttaggtcattgtctgtcaatttacttttgatgctgatctgttattgtttgatgtttttttttttctttttctgagatggagtctctctttgtcacccaggctggagtctcgctttgtcacccaggctggagtgcagtggcaccatctcaggtcactgcaaactctgcctcccgggttcaagtgattgtcctgcctcggcctcccaagtagctgggattacaggtgcccaccagtacgcctggctaatttttttattttcggtagagatggggtttcaccatgtttgctaggctggtcttcaactcctgacctcaaatgatccacctgccttggcctcccaaagtgctgggattgcaggcatgagccaccacgcctggcctaattcttaaagtttgattctaatgcccagactcctgggatctggcgcttactctgccatttttagccttcacacctggggcaagtttcttagaatgtctgagaaagagttgtctcttcaataggatgggaacagattgttcttttatgggcttttgttgttatagccgttagtacatgtacaacatttagaaagtgcctgtcacatgggaggtgttcaaaagcttcatcctggctgggtgaggtagcttacgcctgtaatcccagcactttgggaggccgaggcgggaggattgctgaggtcaggagttcaagaccagcctgaccaacatagtgaaaacctgtctctactaaaaatagaaaaattagctgggcacagtggtgggtgcctgtagtcccagctactcgggaggctgaggcagaagaatcacttgaacctgggaggcggatgttgcagtgagccaagattgtgccactgcactccagcctgggcaataaagtgagactccatctaaaaaaaaattatatatattgtatctgacgcttctatagaaataactgtgggttaattttttgtatttcttatgttgtccacaaaattagaaatctctactaattttttttttttttggagacagagtctcgctcagttgcccaggctggagtgcagtggcaccatctcggctcactgcaagctccgcctcccaggttcacgccattctcctgcctcagcctcacgagtaactgggactacaggcgcccgccactacgcctggctaatttttttgtatttttagtagagacagggcttcaccatgttagccaggatggtctcgatctcgtgacctcatgatccacccgccttggcctcccaaagtgctgggattacaggtgtgagccaccgcgcccggcctagaaatctatactaatttaaagaatatcaggttgggcatgcagtggctcatgcctgtaatcccagcactttgggaggccgaggtgggcggatcacgaagtcaggagatcgagaccatcctgtgtaacatggtgaaaccgcatctctactaacaatacaaaaaaaaaaaaaaattagctgggcgtggtggcgggcgcctgtagtcccagctactcgggaggctgaggcaggagaatggcgtgaacctgggaggcggaggttgcagtgagccaggatcgcgccactgcactccagcttgggcgacagagcgagactccgtctcaaaaaaaaaaaaaaaaaaaaaaaaagaatgtcataacttctaatggagaagtatattaaaacacaattagaaacatataactagctaaaaaaataccttaacgtggatttgtcagaacatccacttcaatcaagtcagtccttacaactgtctcctcattttgtgtgatatcctgttggtgaaatgtgtttttcattttagggacacttggcattcagggacgtggccatagaattccctcaggaggagtggaaatgtctggaccctgctcagaggactttatacagggaagtgatggtggagaactacaggaacctggtctttctgggtgaggataatgtcccttcagaagtcaagatctgccctggtgtatttttgcattttgtcgtgtgcctcttagcatcttaggagtcactgtattgcttgactgagattgaaaccctgttgactcagaaatgaaaacctccataatgctttataatgctgtatttttcagaaacaataagctccataatactttctggacttaaaataattgctttcttcagaattctggcccctttgagattcatcattgagtggtaccagggcttaagtatgcgtcaaaccttatgacagacttaagatatacagttctgtgttatccacccctgtgcttattatttattagttcttgtaagagagcttgatgtctgcatgttacaatgttccctcagcattcagaaggaggcagtggatgaattcatgtgaaatactgtaatttttttttttttttttttttttgagacagagtctccctgtgttgccaggctggagtgcagtggcaggatctcagctcaatgcaacctccgcctcccgttttcaagcaattctgcctcagcctcccgagtagctgggactacaggcacgtgccaccacgcctggctaatttttgtatttttagtggagatggggtttcaccatattggtcaggctagtcttgaactcctgacctcgtgatccgcccacctcggcctcccaaagtgctgagattataggcgtgagccaccgtgcctggcgaaatactattcttgattcatttataatatcctctctcctacctagacatggggcttgcattttggagatgccacagtacacatttattctttctttttattattattatttttttgagacagagtctcgctctgtcgcccaggctggagtgcagtggcgcgatcttggctcactgcaagcttcgcctcccaggttcacgctgagtatctgggactacaggcacccgccaccacgccccgctaattttttttttttttgtattttttagtagagatggggtttcaccgtgttagccaggatagtcttgatattctttctttttttaaataggaatctgtcttcctgacctgagtgttatctccatgttggagcaaaggagagatccccggaatctgcagagtgaagtgaaaatagcaaacaatccaggtggcagggagtgcatcaaaggtgtgaacgcaggtaagagcttggatggccagagtggaggccccataattttttttttttttaaacagggtcttgctctgtcacccaggctgtcgtagagtggcaatcatcagtggcaatcgtggcttaactcatagcctcaaactcctggtctcaagtgatcctccttcctctgcttccgaaagtggtgggattacaagcatgagccactgtaccctgcaaaaccacactttgagtttctgtttgggagctctctgcaagtgagagaattctttgggaaaataaaagtttaaatcctgtgagttctgattgaagtttgttttgtcttgttttgttgagacaagttcttgctctgttgcccaggctggagtgtagtggtggtgtgatcgtagcccgtgtaccctcagtctttgggctcatatgatcatctcacctctgcctgccaagtcactgggactgtaggcatgtgccattgcatcttgctaatttttaaaaaatcttttgtggagatgaggtctcactaggttgcacaggcttgtcttgaactcctggcctcaactattcttcccacctggcctgccaacgtgcttggattgcaggcatgacccaccatgcctggcctagaagggaaatttttctttgccccctcttactgctgctgtgttctttgtttttggcgttttgtttgtttgcttgtttgtttttgagatggagtctcactgtgttacccaaactagtattggttttttttttttaatttttaatttatttttattaatttatttttttgagacagagtcttgctctgtcgcccaggctggagggcagtggcacgatcctggcttactgcaacctctgcctctcaatttcaagccattctcatgcttcaggctcccaagtagctgggattacaggcgtgcaccaccaagcctggctaattttttttttgtatttttagtggaaacggggtttcaccatgttgaccaagctggtctcgaactcctggcctcaagtgatccacccaccttggcctcccaaagtgctgggattacaaacatgagccactgctcccgggcataatgttattattataattatttcaatagggttttggggaacaagtggcatttggttacgtagataagttctttagtggtggtttctgagattttggtgcacccatcacccgagcattgtacgctacattcaatatatagtcttttatccctcacccccctcccaccttttcccccaagaccccaaagtccattgtatcgcctttgcatcctcccagtttaactcccacttatgagtgagaacatacaatgtttggttttccctcaggctttgggctcatatgatcatcttgctctgcctgccaagtcactgggactgtaggcatgtgccattgcatcttgctaatttttaaaaaatgttctgtggagatgaggtctcactaggttgcccaggcttgtcttgaactcctggcctcaactattcttcccacctggcctgcctaagtgagttagttcatttagaataatggccttcaattctatccaggttgctgcaaatgccattatttcgttccattttatggctgaatagcattccatattagtatgccacattttctttatccatttgttgattgatgggcatttgagctggttctctatttttgcatttgtgaattgtgctgctataaacgtgtgtggaagtgtctcttttgtataatgacttcttttcctctgggtagatacccaggagtggttttgctggatcaaatggtagatctacttttagtcctttaaggaatctccccgctgttctccatagtggttgtactagtttccattcccaccagcagtgtaaagtggtccctttcaccacatccacaccaacatgtagtatgttttgattttttgattatggccattcttgcaggagtaagagggtattatattatagttttaatttgcatttctctgataattagtgatgtggagtctttcttcatatgtttgttggccatttctgtattttcttttgacaattgtctattcatgtccttagcaccgcccccccccccccttttttttttttttttttgagacagcgtcttgctctgtcgcccaggctggagtgcaatggcatgatctcggccccctgcaacctccacctcccgagttcaagcaattctcctgcctcagcctcctgagtagctgggattacaggtacccactgccaagcccagctaatttttgtatttttagtagagacggggtttcattatgttggccaggatggtctcaaactattcacctcaggtgatccacccgccttgggctcccaaaatgctgggattataggggtgagagactgtgcccggcccttagcccactttttgataggattgtttgtttttttcttgctgatttgt

SEQ ID NO: 382 - DNA, 56251 bp, Homo sapiens
agctggcttgtgggcttcaccaaagaggaccccactctgaagccagcctggagccacctacctctggcctcaggctgtgggcagcaaaaggaatgtgtgtgcacttggcgagcctcctgcccaccctgtccacacctaataagtgcaatcattttgagtctttctatgttgtctagacggaggggtttttgttttctgggtttgttttttgtttttgtttcttcttcctctattagcaaaaccctatttatagctgcccaagagaaaagagtgtatgtttggagtggaagaaaatcggttttgaatctcatgaaccttgagtgctggagcatctgatctgtctctatgccaccactggccacctagagcccttggctgtggtaatccagggtaattgcgcagaggcatctgatgtgtaggaaagtaattctggggatttgatggagcagaaaggagagagacctatgtttgctaaaccaatcttgctatccctatgcctctccatggagtcagtgtggacctcatgattatagaggccaatggaactggtcagtgattctctaccccaagtagggaaaacctccatcttttccctgtcttcatcctgttatcccctggtgtacacatggaagaggaccaggacataccacctggggatgggctgactcagggtcccgaggccagagacaaagctgtgggagccaagaataagacagaaggcatcagatatttgcctggctctggtcacttccctttgaagttgacttcaagcttagcttcctcaactactgtttttcagaaggaagaaagaatcaaatggaagaagaatcaagtccatgcccaagcccaaagcctgcacacattctgcccttaatccaagtgttgcctataaaattattttctgttttctcactctagttcccccaaagctgtagtcccaatcaatcaaaggctaccaactgagtcctcaggttcatttcttttttttttttttttctttttaactctcctggtaactcacagaacagctcaggttcatttctaggtgactgtcctaggctactgctcccccaggagactcaacactaaataaaggagtctgactccctgccctcccatcagtagcattcatcagccaaaacggccatagcagtaggtagccaatgacacagctagattccctgacaaccattagccaacatcatggtccttgtgggtagagtgtctggctacctttgtctttctgggtcaaggagggccactgtaaagatgcaaaatggctgcttccaaacaagggaaatggtcatttagtatgagtgtctctgtacttcccaggaagcaccatgaaaactgctttaatcaactctgactatcctaattctccaccagaagctaggataactttctttctttctttctttttttttttttttttttttgagatggagtctcgctctgtcacccaggctggagtgtaatggtgctatctcggcctactgcaacctccgcctcccaggctcaagcaattctgcctcggcctcccaagtagctgggattacaggcatgcgccaccgcgcccagctaatttttgtatttttagtagagatggggtttcaccatgttgcccgggctggtcttgaactcttgacctcaggtgatccacccgcctcagtctcccaaagtgctgggattacaggcatgagccaccgcgcccagcctaggataactttctgattcctctctgccagccgttttgcgtctcttggaaagccaaacggtgaccatgcttcttaatttatgccttcagggtctggcttctcctttctcccttcctttcctgtcacaccatgcatacatacatacaaatacacatccttcaaccatttattccatggcttatgagacctgcaaatgagttccacagtacggaaggcatagaccactaggcttcttaattgatgtcaaggcagatcttggtgagcaggtaaaaacctgctattgtccaccaagtttaatttaggtcctccaagttggagggttaagaacccaggcaaagctgctgctgaatctatggaggaggctggccctgggacatcaaactaggggttaactggattgaatgaggagtcaacgctcagggacattctaggtctttacaggtcagacagaagagaggtttttaccattggagggaaatggaaagatggtataaataggatcccttcatgaagcaacccagaggcctctctgcagcgtgtagggtgtggggcgacagtattgtggggcttccattcatcttagtacaaaacctcacctgctctgagcctggaaatgggagggcttcacgcaccaagtaatgcacaccagaaaggcacttatatcctcagcaacatggcagttcctctttacttctctgcctccctctttctatattatcaggccatgcctattcctacaacctgagacaactcttggagtcagaagaaaactgaccagatcctggatctgagctgcctgctccaggcctagaaatccccaaaggctggcactgagctgtgactgctttaacagcccccaagatttggtcagtttgaggtggtggagactcagatttgttgctgaaagttcagtaacacagtcctggtctttggccctagagaaactttttatatgagaagtgttctctatatacatgtttgaggtgactctggaatggattatgaggtcatatctcaaaatgtcagaaaacgttatagagcactcgaacttttgtatttgctgcttaacctcaatattacagccacaaacaaggggtaccaagacaaagtataactgagcataagcagaaaatgttaaccctccaggtttctttcttaagcacaataaaagtgggagcgaacaacacaaggatatttttacatttgacccgtctcaaaagtagcacaccctatccttgtgccattatttgtacaaggaaatatatgattagaaggaatagaacccccagttgtcatcagcttttttagacaccacaggttgtagcagtttgaacaaactgaaaactttatacttctgtgtgagctgaactcaagtttcagaataatcatcgccatgtgggaggctttttgttaaatgcagaagaaatttcaaaatattgtatttatatctgccttccactgctgccaatttagtaagcatctcctatacaatcgacaataaacagcaaatgatgcagttcatagagtattttgcacttggggaaaaatatgtatctgaattgtaaaaagaaatgtttggattttgtatgtcttttttattattattaaaatactaaatgaaactcctcagcccggcatcttttcctctatctcaatagcttatcccagagccagaaaaagccttgaggagacaatgtcttctggcttccagataaaacttaacccaaattttttggcaactcatccctaatgattttaaaatttgaaaaggcttgtcttttctctgtccttaaaagcagcatcaagtattatctcctgagggggatctaaggagtgggggaaatttattgttcctcctctccacagtacagtccacaacagctggccagcccacaggtggttcagcacctccctactcaggatgtcccacctctaggaaagcgccagcactgagggtcacccagtgtcattctttgtatgcagtacactcttagccaccaaatagtattgtgaaatacagatcatttagtcactaccaccatcactactcctacagggcaggagaaagcaatctccaatctctattataaatgaacagtcccaatttctaggctcagagatatagataaaactttgctgttgcaattatataattccctttcatgaaattttattggatttaatatctacatgatatagccatttaagagtataacttgagcaacaaggaaaaatctacctgatcaaaaaacatgtggggtggcctatcagaatcttaaacttaccctttagcatctataatgaagatacagatgaagtacattcattccataattactgagatcctattatatgccaggtagtgagcacctgctcatcagcttattgacaatagccatgctcaagatccacactcctcatgtaactttctgattataattgatcttcccagataagatttacccaacaggagcgataatccagttcacttggtggctgtaagtataaaagaatgcactggcattctattatgtacattaacttcctatgagtttgatttaatgtgacaaaacatgaacacctttgtgtggactgacccaaaatcacacttctagaactgcaaagccaaggaccatatccatgaccttcacactataccaacttggagccatcctctttgacttctctcataactcacttctattctaagaacaacacgtcttcctccttacttcgtaggacatttgctttggtgtctcaaaataatggatagtcagggacattggagtttggatatgcctatattaagaagtcttccaagtggggtaaatgaagatttttcctagggtacgtaagactgcaaggaatacccaggaaatagcctcaaatcagtctgaggagagttttaaaggaataaatttccagatcctcaacttccctataaaatattttctaaaaccaggccgggtgcactggctcacacctgtaatcccagcactttgggaggctgtagcgggcggatcgcctgaggtaagagtttgagaccagcctggccaacatagtgaaaccccatttctactaaaaatacaaaaattaaccgggtgtggcagtgcacacctgtaattatagctacctgggaggctgaggcaggagaatctcttgaacccaggaaggggaggttgcagggagctgaattgggccactgcactccagcctgggtaacagagcaagactccatctcagaaaaaaaaaaaaacaaacagccgggcgtggtggcaggcacctgtaatcccagctacttggcaggctgaggcatgagaatcgcttgaacccaggaggcggaggtggcagtgagccgaggtcgtgccactgcactccagcctgggcaacaggagcaaaacttcatctcaaaaaacaaaaacaaaaacaaaaaaaacggccaggcacagtggctcatgcttgtaatccccgcactttgggaggccaagacaggcagatcacaaggtcaggagtttgagaccagcatgaccaacaaggtgaaaccccatctctactaaaaatacaaaaattagccgggcgtggtggcacgcgcctataatcccagctactcaggaggctgaggcaggagaatcgcttgaacccgggaggcagaggttacagtgagctgagatcatgccattgcactccagcctgggtgacagagcgaggctccgtctcaaaaaaaaaaaaaaaaaaaaattctaaaaaccaatccatttgggagccagctgacatattcatgcacattctccactctaccactgcccccactttcaccatagtccttgtcctactttacaaaagaaaggaatgtctctcccctacactgaatcttgatgcatggtccagggtgtaaaaacctgaggagcttggagggagcaattattttccacttcatatcaaaatattcccattgcaatcagtcttcctattttatcttatataaaatgtttattattttctacctcctagtaaaaagtgaaattgctagctgctcaattcattatttcttagcaaatacagctttcctttctaaaaaatacagaagaaaaaaatttgtgtaacaagattattagttatttctgatttttagacatgattctcatttaattgttcccaaaagctgaacaacaagagtttgatgaaagcaggcacacacatttaccaagggaatatatgccttctatatgacttctcaaaactgatggatttaactatacattatacagcattattcctaattatataatgaaaaacagtactatcttatttttaccatttattatgttaatagtaggtctaaataattttaatcttgactggtttatcagtggtccattttataagctatagttaatcatttatttcctaataatttttataatattcctcaaaatgaatgttaacatatttatttgaatggaagaataaagtcagacatgtttctaacagaaagtaggtctgatttggctgattggtttgaaatgaaaactggctttgccaattccacaaatggcagttgttttctatacagtgaatgagctgaatctgcatttcagtttaacaaaaagttcttgaagacatgtaataattaaagaattttaccaaaaaatattgtgtaggcaaagaagtatggaaatcaatatctgattaacaaagtgtctctgagtgtaaaggtcacagataattaataatcatgtttaataaaaccaaaactgagactctaataactaaatccttttggaagttcagtggtttctaatcctttgcttttaacaaaattaaaagaagactctatttgatagtattaatagatcactctgtgattgttggcatataatttagaagttcaaagactcaaagaatatcattgtaacaaatctcttcctttcccaattgtggaaacaaggtttctcaatactcatgtctataaaaataaaaaacaggtaaaggattgatgttgcaccttatctccttctaccattaggtaatattaatccatgaatacctgaactaattggggagaaacaccatatttctcattaacagatgcattttcaataaaaattgtactttttaggtttcacaagtcataaaaatgttaaaaatatttaggaaaatttagtatttagtaatatttagtaaaaaaaaaaagtttagtaagttatatactaatgattacaggaagtgaatggaattcaaagtataaggagaaagagaaccatataaaatttctgttgaagagcttgttcatatatttttaagtggatgatggtaggcattagatttttagggtacttggaatccaccggatacttttttttaatgtgagacagtctcactctgtagcccaggctagagtgcagtggcacgatctcagctcactgcaacctccgcctcccgagttcaagtgattctcctgcctcagcctcccgagtagctaggactacaggtacgcaccaccatgcccggctaatttttgtatttttagtagagacagggtttcaccatcttggccaggctggtctcgaactcctggcctcgggatccgcctgtctcagcctcccaaagtgctgggattacaagcatgagccactgtgcctgccctgccagatacattaagaatgatgtagaccaagtgtggtggctcatgcctgtaatctcagcactttgggaggccaaggcgggcggatcacgaggtcaggagatcgagaccatcctggctaacaccatgaaaccccgtttctactaaaaattagccaggcatggtggcgcatacctgtagtcccagctactcgggaggctgaggcaggagaattgcttgaacctggaaggggaagttgcagtgagctgagatttcgccactgcagcactccagcctggttgacagagcgagactccgtctcagaaaaaaagaatgatgtaagtcttagtttaagatgtcaaaatttgaaattgtatcctctataagtatttaaattaatgaaggaaaatttaggtatcaacttaaaaatgaacaagaggtacatagctcttcaaaattcttttatgggttcattctaaaaaatgtctgaagatcaccagcctatatgttgagtggaagggataggagagaaactgctagcaatggtcttcaatactgccctccaaaatatcctcaccaattctcctgagaacctgaaattaccttccattaggatcattacttcagattcagacactgtttcccagagctcttgttaaatgtataattgcagaggtgactggccatcagattacgatccgtaaggaatgtgagaaaagacagatatatatatacagagagagctatggaaaaagggtggttggagagggacaaactcaggtacagcctgagttctattccctgcggtatttctaaccctcaattcatattataagaggagctacttaatcttctctctgtatctataaggtactttttctttttctttttttttttctttttttgagacggagtcacactgttgcccgcgctggactgcaatggtgcgatcttggctcactgcaacctccgcctcccgggttcaagcaattctcctgcctcaacctccggagtagctgggattacaggcgcccgccaccacgcccagctaatttttttgtatttttagtagagagggggggtttcactatgttgaccaggctggtctcgaactcctgacctcgtgatccgcccgcctcagcctcccaaagtgctgggattacaggcgtttaagccacggcgcccggcctataagttattttctatgggaaataacttgtcaaacttccaccaaaaaggaatggaaagagggcagcatagtggccaggcagtttatttccatactaggagatacagaagggattaattctaaccgtaggaattctaaccatcaaatgtcactcactggcctacctaaactgaactctggtcccagccagaacaagtcaggaagaggggatgtctaagaccgaaaggggggctttctagttaagctcttcaggcaggagaggaaaaggatgcccgcatccccaaagacacctttagctaccacaagccccaaaccccgtactttgtaactgtgtctagtttacgtcctttaaaaattattcttattaagttaaattgttttcggggcggggaagatacaaaagaaaccagttaaagtctgaaaggatagagaggggaaagtttctcacctcattcttccagccacccagttcctctcctaaaaggcaatctttaccagttccttctctaacgcccctcctttttaatttgattttttaccgaaagctcgctcccttttaattttccctcaggtttctgaaaatttcccaatcgcagcccctcccagcagggaaatagtaaaggggcttggtttttatgttcaacccaaagcaagcctacaaaagggagtagtcggtttcgagcctgacggtggagctgacgcgggaatgagagagaacctgagaagaccgccagggcgccctccctgcggaggcgagtccctcaccgcccctctacatcgtccttttcaataaggagctcttaatacctgcaactgcttccttcaaggggtggctggaagatcagtaggcaaggcctgcggactgcgcaccttaaagcgcttcgggaccgtaagacagtgagtgctgagcgcgcggccgggaagaagcctggaggctctgagctcggaggacagagaccgaagccccagggcctgcgtccctcacaacctgcgcctcctgtcctcccgcgctactcccgaagcgcaccttctcgcccgcaggccgcagaagtgatgacgcaaagccctcggggcctccgccacctcctcacgcttctgctggaccgaatccttggaatggacaggtagcggttcccgattgctatagcgacgacccggctccgagccgcgcccaggccctgacccgggcgtcgtgacgtcagcacgccttccctgggcgctcagcctcgctggccatgcgtcaccccggccttggtgggggcggggctccgaagagctcggttcagatcccggccgcctgggctccaggagccccggaaccaggataagttggatggctgccgcggcgaagcggggggcggggtggaccgtgcccggtattttctatacgggttccggggcccggtagaggcgcgccaagaggaaaggaaagtgcggcggccctggaacctggatatcgcgcgaggcaagctgcgcgcgggcgggcgggctatggcgcaggcgggttgtggggccggcgctggtggcggggcccggtgcatggcggtctgtcggcggagtcgccctcgggggctgtcaggttggtggctgcgggaggagtgggccaaccatgcccagggcgggaggccgggcgggcgcaggaccccgggaaggtcccgagcccggcgtgcccacctccctccggccctagcagggcggcctggccgctggaccgcggccgggccccctcccccacccagggtccctgcccctcttttccgccttgcggctcctcccccgtgactcccaaacctcaccccgtgacggcgcccgcctccacccttgtgaccccacaccccacccactgaccccaagacctcaccaggtaaccgttggttattattcattggctgctaacccaggaatttccccagcacttctcagagacccaccaaccagtgactccctcagttttaatccggtgactcacatgaccctgagatccccacactcctccttagtgacccccaaacctgggtaaccctcctggcccagtaacccccccgattctaccttgtgttccccacaaactcggtgactcccctcaaaactctgctggcgactcctaagccctactccaatagttttccacgcactcaccttgtacacaaccctcagtatctttatcctgtagccgtatgaccctcgttccacgtctgcctttatcctaaaatcacccccactggcatctctctctgcgatcccagcccttcagtgtcaatcagcacatgacttacaagcgtccagcacctttctggtgctaaggaggatatagagattaatatgaagtagtaataattggaggcatcagagaattctggatcaatccagaatccagtcaatccagtgtgtggtcccagctctgtcactgctgtgctttagggacctgtgagaagtcccctcctcagtctggacctcagtttctcatcatgactgtgatgaggttgggttagatgatctttgagtttccttccgtctgtgaaattgtgaaattatgcagttctcagtcaagataataattttttgcaatcatttttgtaccccaccctggaaatttcctcttgtaacctcatcccaggatctgcttgcatcatgaaccttactccctcattcccggatcaccctcttcactcttcatagtgcatacccatttcccttgatcaggccccatcagttaacatgtttgcaaagcagtatagcagagtgcttcatttgggggcattgagttcataacaaacctaggttccagactgattctggcccttcagctatgggacttttggtatattatttagcctgtcttaacttcagtctccacctctgcgaagggagaaaatagtagtgcctgacataacatatgtaaagcaccgggcaccatgcctggctcatgggaacccttagcataagctgttgttagaaatgagaagctgctatggatcttactctgtcctgagtgctagggatttaacagactgaacatgtggcccataccttgcattatgttgctactactgacatcttggaatccctatcttctcatctctgctgtagcctcacttctctggttcttaccctgattttgcctcaataacgattggcttgctgaatacctactgtgtgccaagctctggatatataagttaaatttacgtctcaacagccccaagagttaattattattatatccaccattttcccttcccatatttttgtttggttggttggttggtttcagagaaatgaaccagaaactctcacagctaagtagcagagctaagatttgaacccacagtttaaaaaaacaaaacaaaaccctactccattgcctgtctttcccccagacttactcaacctcagctccttattccttattttctagtaattcctaaatacaacatcagctcgttccttgatccctaaggtttctgttcttgagctcctagcctcaagagatcctcccaccttagcctctcaagtagttgagattataggcgtgagccaccaagactggccctgacccccaaggtttctattaccgtttgccatgtaacttggtgactttctcatcctgctgttcatgacttttgatctcatatcccctgaagcccctgcaccttgtaggggagggaaaatatcttcttaggttcatggcttaggcccctataacaacagatttaataagagaagattatatacatttatttaatgtaagttttatgtgacaggagccttcataaggaaatgaagacctaaagaaatgattaaacttgtatatttttatactagatctgatgaagagtggatagttgtggaaaaatacaaaaagggtaatatcaaatagtaataaactgggagaaacttagcaaggcctgtttgttcagactcttctctgtgtccctgtgtcttcacagataagggtgcttctttcctctgagtatagggagggcacctctttatgaggagggtattatgacctgcttcaggggaaagtcagaaaaatccttcctaggttttgtgatctgcttcaggggagaagagcctcagagaaagtgagagtgaccttcctactgccattttctcaagttgccatattttggagtagtgtcttgaacccagtcaacttctctcttcatcctttgcccaaatatctcttgttctatgaatctttgacgcttccagccctttccctgtgaactcactcaccatacagtgtctcccacctcactggcactttaccccaaatcctttcatcttgttaagtcccttagccccaggaatccacaagtctgtatgctctaaaaccatctagcccagttgcctttcatcctattttttagtctcagtgttctactcccaccaccccaccttctgccatcctcagccacattctgtgacctgaaaccttcatataatttgtccttcatttagtgacctcttgatgtgactagcttcaatggaatcggctccttccatcccagcatgaagcaatcctgtataacttgcacaccctcccattctaaggcctctcctctcatacccttgcccagtatcctgtgagatcctgcctctcagattcctccctcaccttttcaaacccggattgtctttcacccttccacagggcctcctcttcctgccttcctcttatttgtcccctcagccatcctcacctcaccaatcttgataattgattacaatataaatctcccttccatctcaggtctgctcctttcttcctccactctcttgtgcatctatctccagggccatgcgtatgcccctgctgctttcagctctgcttccttcatatgctgcactgttccaccaaacttcatcagtctcttcggtttatccagagaactacactcttctctgggaacttctgatgacttctgataatagatcaccaaaggatcttggttttttagagggcagggagagagccctttgaagtccttcagaatcaatctagctgtgtctcctggacaccctcccactatcctatcctgttatgaagctgcttgctgtatatgccctcagagtagaatgctttgggtgtcagcttctgcaggcactgaattagccccattgttttccaagccctgggaaaacttgataatccccaaccactgaagtctgaagagtcagtagcaaaatgtgacatcaaagatccacatccaaaagtctattctgtgggtcaccaaattcccaggtctcttataatgtacttattggctgtgcagcaataaatacagcagaaactaaaactagagttgaggaaagggtataccctgggttctacaactgctgtgggtggattttaaaaaggagttcttgccttagatttgtttacttagggcacagaacttattctgccttgtatttgagttatttgtgtacttttctcaaccccactctgtgagctctgtgagaacagagactaggttttcttttttcttttcttttcgagatggagtcttactctgtcacccaggctggagtgcagtggtgcagtcttggctcactgcaacctcctcctcctgagttcaagtgattctcacacctcagcctcccaagtagctggtgttacaggcgcctgcaaccatgcccagctaatttttgtatttttagtagagacagggtttcaccatgttggccagactgatctctaactcctgacctcaggtgatccactcgcctcagcctcccaaagtgctaggattacaggcatgagccactgcacctggctggttttctttatcttctgtcttcatctcttccctcacatttagcaggtagtcagtacttacctgttggattaaattaactcactcagaaattctgcatcaggtgtacaaaagtaaaagcagttcatgtctacattcattttgtggacacaacacccctccccaaagttctccaaacatgataatgggcatgtcccttgatttaaacgtcggtaatttagacacttccttttttagtcattgctcgggtgggggaatgggtgtaagtgcttttctttttctactgtatttctggtaagataggttgtttgacgcagttgctcaaatacagtggtaacagcatcaggggctgtcttatataaatctgttctcaagaaaacagctagtttgaaatatttagtgtgggttgcagagacgattaaggaacagaggaaaccaaggaggcaaaatgttggtaatttttgaagttggataatgggttcaagaggttcattataccattctttccatttttgtgtatgttggaaatccattataaaaagattaaaggcaggggcagctaggtgaacaagtgcaaatttagcactgttccttggaaaacacctcagagcaaatgagctactgtttctgaatcagtactgttatctaggttaagtagtatatttagtcctaacctttctctgacctcttctgtttgtgagatatcaggatgctaaatttaaaaattagcaccctgcagaattctgtacctagtggcctgggaattgtaacatcctggcatcaagcacctgttgcactgcttctcagcttaggtatggtttctggtggaatagggctggactggacctgagaagagggtgaggcagtaaggaggaaagagggactgagggctggagagagaccagagctctactagggtcttccccttcttgcctaaaggtttcaagttactgggagatcctaaaggtatatatattcattcattcactgattcattcatcccacaaatatttggtgaatatctgctgtgtgccaggtacttttctaggtactgggaatagagcagtgagctcactgtttgaggaatggacagggtagagacagacaataaacaaataagtaaaatatatattgagaaaattaagcagagaagggagatagaaagtgccaggagtaggccaggtgcagtggcacacacctgtaatcccagcactttgggaggctgggttgggtagataacatgaggccaggagtttgagaccagcctggccaacatggcgaaaccccagctctactaaaaatacaaaaattagccaggcgtggtggcaggcacctgtaatcccagctactcgggaggctgaggcacgagaatcacttcaacccaggaggcagaggttgcagtgagctgagatcacgctgctgcactccagcctgggcgacagagcgagactctgtctcaaaaaaaaaaaaaaaagaagaagaagaagaagaaaatgccaggattctgggtgttaaaattttaaatagggtagttgaagaggttcccactaaaaaggtaacatttgagcaaagacctgaaggaagttagggggtaagtcaagcatacatctaggggaaatttattccagtcaggaagaacagcaaacacaaaggccctgaggcaggaatgtgccctatatattcaagaaacatgaggaagccagccaatacggctgcagtatattagtgagagaagaaatggcagatgttgcggtgggggtgaattgggggcagatcacacaggccactggcttgtagtgtgagttgtgagtgagatggtagccattagagaattctaggcagataaataacatggcctgacatattgaaaaggtcattgtggctgctgtgttgagaataagctataacggggcaaaaatggaaggagagaaactggttaggaggctactacaatagtctaaacaagagaagttggtggcttgaacccaaggtgaagcaatggaaaggtgagaagtggttggcttctggatgtatttggaaaggagccaacaggatttgctgatggactggatgtgatatataaaagaaatagcagttgagggtggctacaatttttttttttttcaagacatctcgctctgtcgcccacggtggagtgcagtggcgtgatctcagctcactgcaacctccgcctcctgggttcaagtgattcttctgcctcagcctcctgagtagctgggactacaggtgcatgccagcgcacccggctaatttttgtatttttagtagagatggggtttcaccatatttgccaggctggtctcaaactcctgaactcgtgatctgcctggctcccacatttttggcctaagtaacaaaatggtaaaattcccatctactgaaattggggagcctggaaggagggcaggttgttagaaggaggagataaggaattcactcttgaacatgtcaagttcgaagtgttttttggatatcaaagtcgagatgttgagtaagcagctggatattcaagtcttttggagcctaggaaatgtctactctcaggaaataaaagaacaccatcacctggcaagagacagcggagtatgggaagaacactggtggtcaggtgttaggccctgctctgccaccaggtagctatgtgatcctttgggactcctctggcaacgcaggcctctgtctcttcatctgcaaaatgactgctttattttattttattgtctatttcttttttttttttttttttttttgagacggagtctcgctcgtcacccaggctgaagtgcagtggcgccatctcggctcactgcaagctctgcctcccgggttcacgccattctcctgcctcagcctcctgagtagctgggactacaggtgcccaccaccgcgcccggctaatttttgtatttttagtagagacggggtttcaccgtgttaaccaggatggtctctatctcctgactttgtgatccgcccgccttggcctcccaaagtgctgggattacaggcttgagccactgcatccggccccttatctgtttctttgacaaggtcttgttctgtcacccaggctggagtgcagtggcgcaatcatggaggctcactgcagcagtgacctctccagctcaatcagtcctcccatgtcagcctcctgagtagctgggactacagagatgggcaccaccacgcctagctaatttttgtatttttggtagagagggtttcaccatgctgcccaggctggtcctgaactcctgggctcaagcctccacctgcctcggtctcccaaggtgctgggattacaggcatgagtcaccacacccagccaaaatgaccactttagactaggaatgagttgtgttctcagcccctcctattgtgggagttgatgaattaagtgcttagaataaacatgataatatatgtgtatctgagagcattttggaaactgctgagttctacaccaggtagtggtattggcaataagatttcttccttcattcgctgaagtaatacccagtgagtgcctgccatgtggtgggcactatgtcacatgaggatacgatgatggagaagacgaatctgtgccctcagggagcaccgcagacaaccccctgttgtggcttcactgccaagtgcagacgaaacatggggctggagtgtgacattagccagggaaagcttgttcctgatctgggtctccgtggaaacagtgaacgtgcatgtcaaagatgaggcaagatggtaatcccgatgagggaaaagtcatccacttagctggactagggaagagttgggagtggttgggaagggttggagtggtgggggcttcagttccttccctcctccattctttcgttcaacatttacttccttgccaggagcttctcttagaagctcacagttctgtggtagatgaagagtttcatatctggtctcaggagttcaacttagatattacaataagcagaactgaatcaggattcaaatctgagctaaagagctcagttagctatgtaacctagtagtattaatcatttggtatctgtgggcacattctttgttaggtgctaattaggctgaaaggcatgctctccaggaacttaaattataatcactgtaacagaaagtaagaatgttattttcccctaaaagagtcaggtgttaaggaaaacacactccgtggcagtgtaaccctttaactgcatctggaaactgtccctgtggctgtgtttattcttgtgtcatttagatgtctacgtttatatcgtgaggagagtctctttgaccagataagagtataagatatagctcatcctaattgacaaaattagtcacccacaaaattagtttagaggagacatagtcaacatctaccacgtaatggaatggggaaattttgtcctggagagtgaaaaaagaaaaaacaaacaaacaaaaaaaacgaaacctggccgggtgtagtggctcacacctgtaatccgcactttgggaggctgagatgggcagatcacgaagtcaggaattcaagaccagcctggccaacatggtgaaaccccatctctactaaaaatacaaaaattagctgggcatggtggcgtgcaggagaattgcttgaaccaggacccaggaggcggaggttgcagtgagccaagatcgcaccattgctctccagcctgggctatagaacaagacttcatctcaaaaagagagaaaaaaaaaaaaaaaaccacctgcaatacaaatccaagtgcagctgaagccattgtctttaacagatggccctaacctgttttgagtgctgtttcctaaagctgccaacaaacttcaaatgccttttaccctggcagctatcagtcaagatatagaaatgtgatggtctcacaaatcctatgcaattgtctcttttgctggcaaaagtatgaggccagccgggtgtggtggctcatgtctgtaatcccagcactttgggaggctgaggcgggtggttcacctgaggtcaggagttcgagaccagcttggcaaacatggtaaaaccccatctctactaaaaatacaaaaatttgccgggcatggtggcaggcgcctgtagtcccagccactggggaggctgaggcaggaaaatagcttgaacctgggaggcggaggttgtggtgagctaagatcatgccattgcactccagcctgggcgacagagcgagactctgtctcaaaaaaaaaaaaaaaaaaaaaaatgtatgaggcgtactcaggctcctctcttccagttcagaatcagaaggatttgtgatgttggacaggtcattcggggtctcaggctcattatactgtcattacctggaagccagagtgcctcttttctagtgcctctatttgacattcccttagagctggccctctggtgaatagttcatccctaagaaggccagatacaacttgttaccctggtactatctcacttcatcacttcatttgttgggagttcctgctacttttggatggttgataaagcatgagacccatacagttaagataagaaccaaggaactgggagctctttgaggttgtagaactgacttgaggctttgatgttggggatttggcaggggtgcctaagaccagagttctttctctgagatcatcttctcaacccaggaaatactgtcctgtggccacatggagcaatgaaggggaaaggtagaccctgcttaggccaccacttcgtccagacccacccttgtgaccaggctggggacacacatgttgaagccaccatgtcctcaggtcctgtatagacttgctgttgcctcatgctcagctgatcagctttccatatgatgttatagaatggcctccatgaatcacgaagctcagttttcggatgtgcttttgctgtagatcagtaacatggaatccatcatatcaacactggactctccattcctcatgtatggagaatcatagatattcctgtaaccaacaaagggagtacaaagcatgcatttagactttctatttttaattttttatttatgttgcgtaggtaacacattctcaaggctttttttatttttatttttttattgagaccaagtcttgctctgtcgcccaagctggaatgcagtggtgcaatcttggctcacagcaacctctgcctcctgggttcaagtgattctccagcctcagcctcccaagtagctgggcctacaggcacgtgccaccatgcccagctaatttttgtatttttagtagagatggggtttcactatgttggccaggctggtctcaaactcctgaccttgtgatccgcccgccttggcctcccaaagtactgattataggcatgagccactgcacccagccatttgtttttcgtggagtataaaagatattccctgaaaagtcgcccttccatcgtcatcaccactcagtcatccttccacaggcaaccctggttagtaattttaataatttcttgactatccttccacagattttgtttgtttgtttgagatggagtctcgccctgtcaccaggctggagtgcagtggcgcaatctcggctcactgcagccacctcctggattcaagcgattctcttgcctctgcctcccgagtagctgggactacaggtgtgtgccaccatgcccagctaattttttgtatttttagtagagatggggtttcaccatgttggccaggatggtctagatctcttgacctggtgatccgactgcttcagcctcccaaagtgctgggattacaggtgtgagccactgcgcccagcccacagattttttaatgccaatgacattacataaaaagcactgttgaacccgggaggcagaggttgcagtgagccaagatcacaccactgcactcctgcctaggcgacagagcaagacttcgtctcataaataaataaatggcactgttttatacctagccatttttttcattatgttttggagatcttgccatgtcaatatgtaaggagcttcctcatttatgtctacgtagtatggaagtttgatattgatggacatttatgctgtttctaagtttttgcttttattacatgcagagatgccatagataaccttggacatgtgccattttcacgcatgtccatctacctgtagactagatgtgaaattgctgggtcagataatatgtacatttgtaattttggttgctattgtcaaactctcctccatagagattttgccaatatgttctcccaccaccagcaatgtatgactgtgcctgtttctccacagcctcatggacattgctttgagttaagaatatagcagattctgctgcacagtggctcacgcctgtaatcccaatactttgggaggccaaggcgggcagatcacctgaggtcaggagttagagatcagcctggccagtatggccaaaccccgtctctactaaaaatacaaaaaatttcccgggggtgatggctcgtgtctgtagtctcagctacttgggaggctgaggcaggagaatcacttgaaccctggaggtggaggttgcagtgagctgagattgcaccactgcactccagcctgggcgacagagcgagactccgtctcaaaaaaaaaaaaaaagaaaaaaaaatatatatagcagattccctgaagatcaacataggatactgaatcatggggtcccactgtgacactattccacaagacaaacaaaacacggcacatcccagtttgaagaatacagccaggcacagtggctgatgcctataattctagcactttgttgaggctaaggtgggaggatcacttgatcctgggagatcaagaccagcctgggcaacataataagacctcatctctacaaaaatttaaaaatttaaaaaaagaaaaattagctgggcatggtggcacgcacctgtagttccacctactcgggaggctgaggtgggaggatcgtttgagcccaggagatcaaggctgcagtgggctatgatcatgccactgcactccagcctggacagcagagcgagaccctttctcaaagcaacaacaacaacaaaaacagtttgaagactactgcattaaaaatatatccaccaggcaaggtggctcatacttgttaatctcagcactttgggaggctgaggtgagatgatcacttgaggccaggagttcaagaccagcctgggcaacatagcaagaccccatctctacaaaaataagtaaatagagatagatgtaagtaaataaataaattagccaggcttggtagtgcacacctgtagtcccagatatttgagagtctcaggcaagaagattactttagtctaggagttcaaggttgcagtgagctatgatcatgccgttgcacttgtagtgtgggtgacagagcaagaccctgtttctgtgtgtgtgtgtgtgtgtgtgtgtgtgtgtgtgtgtgtgtgtatgtatatgcacatatatatatccaagaggtagttggacttctggtagttaaaggaagaaaacttcttaaggcagttctccaccttggtgtttatgccagcatgaattagaaaagaagtagattgatgtttttcattttcttttgagacagggtcttgctttgtcacacaggttgaagtgcagtggcacaatcatggctctccaaagcctcaacttcctgggcttgaatgttcctcccacttcagcccccgagtagctgggaccacagccatgtgccaccatgcctggcaattatttttgtagagacggtgtctgcacctgacctcagcctcacattgatttttttaagacggtgtctcggctgggcatggtggctcatgcctgtaatcccagcactttgggaggctaaggtaggtggatcacttgaggtcaggcgttcgagaccagccaggccaacatggcgaaaccctgtctgtactaaaaatacaaaaacattagccgggcctggtggcgcgcacctgtaatcccagctactctggaggctggggcaggagaatcgcttgaacccaggaagtggaggttgcaatgagctgagctcgcaccactgcactctagcctgggcaacagagtgagactctgtctcagaaaaaaaacaaaaaacaaaaaacaaaaaaaaaacgagtctcactctgttgcccagtgaactctggagtgcagtggtgtgatctcagctcactgccacctccacctcccaggttcaagcgattatcttgcctcagcctcctgagtagctgggattgcaggcgtgcaccaccacacctggctaattttcgtatttttagtagagatggggtttcgccatgttggccagggtgatctcgaactcctgacctctaatgatctgcctgcctcagcctcccagtgtgctggggttataggcgtgagccactgcacctggccagacattgatttttaaagcccaagtcagggccaggcacaatggctcacacctataatcccagtacattgggaggccaacgcaggcagatcatgaggtcaggagttcaagaccagcctgactaacatggtgaaaccccatctctactaaaaatacaaaaatcagatgggcatggtggtgcatgcctgtaatcccagctactcaggaggctgaggcaggagaattgcttgaacccgggagactccatctcacaaaaaaaaaaaaaaaagaaatgggggtctcactatgttgcccaggctggtctcaaactcctgggctcaagggatcctcccacctcagcctcccaaagtgctgggatttcttttaaatggcgcttcttcttttaaaaagaagaaaaaaaaaattgaagaaaaaaagcaatatgctttatgcaaagatgtgttttagctgtttaaaacttatgttagtgcaagtttgtgttactaatttcctgttttctcttcagtgtttagaaacccacagaaccaggcctgttcactaggtttttctgcgtgtagtgaagtatttttctataataaacattgaatcattttactgcaacttttccaaatctggttctgatttgtttgccactcatcttcatcagccttcatccctcccaaactaatgtgtcttttttctcatgagaagttttctatgtttacaaatgaagaagtttctaagtgaagattaagtcataattatttttgctaatcaaaattgaacattcttttcaggcaaatgtttttgttgttgttttctttttttggcttctaaatacagttgccctctgggctggctgaggcagagtacagaaagccttgttccaactgtccagagttctggttggcagaagacaatagaatagcgaacaggtgcctgtagtcagcacagcccagcttgtgtgtggagcgcagtaggtctcaaccatgataaagtggaaaaacacaaaaaccatggctactctttagtttcctatctttcacatcccttatttttctcctttgaggaggcagtttaagcacatcttgattcatggagagacctaaagatccaaagtatctaaaaagttgggagtagtggcacacacctatagtcccagccactcaggaggctaaggcaagaggatcgcttgagcccaggaggttgagtttacaggagctatgatcactgcatgccaacctgggcaacaaaatgagatcctgtctctaaataaataaaaggtttttctaaatgttctctctcctcaataattacaatttatgttttaacattaagaaacacatcgatatattgcaaaggtgaagggttgttttcctgcatcaggaccagtaatgggttaagtttatttaaaagtgcagcaggccgggtgcagtggctcacgcctgtaatcccagcattttgggaggccaaggtgggcggatcaagaggtcaggagttcgagatcagcctaaccaacatggtgaaaccccgtctctactaaaaatacaaaaaaattagccgggcgtggtggtgcatgcctgtaatcccagctgctcacgaggctgaggcaggagaattacttgaacccaggaggcggaggttgcagtgagccgagattgtgtcattgcactccagcgtgggcgtgagagcaagactccatctcaaaaaaaaaaagaaaaaaaattgcagcaaacagaactggatttgctcctagttctgggagagtcaagagtgctcccttctgtcttcactcttttctcaccttccgctctcccagtctgtctctcccctatacacagctcaggtcattgcagagctagtaaaccttatatcctacaaggagaaaacagagcagccaccctcactgcccctctgccctgtctcggagggctgcaggagtaatgagtctgaaccggcaagtgcaggcagaactcacacatagccatcctgaagcagtaacaagcctttctttggctctgcccatgtcactgttgttagttcagtgccagcatgggaggattcagagtaaaccatcattgaaagaaagtacagggagaaaaatggcaatcagggcactggtagatgcctagcagccacaaagcttcctcctcaccctctgcagtcaggctcttttggaaggcagcttcagagattgggaaaggtcagggaacaacagtagcctcttttaaaggtttgtattacgagacttaggaaggaaacgtgaatgagttgaggttatttagcctgtacgcgagaacatgaaaaggagtggaaatttgttttctttgagtctaagaagggttattttgggaagtgtggctaccagctattccctttttccattgcgggtaggccaagaaggtctgggtttaagttacagtgggtgagatggaagttaacccgtattcaagtgttttgagtgctgacggtgtgccagtcacagtgaattagcagaaggaagaagtgcgccagatattgagaagtatgggctctggggccagccagcctggctttgaattctggcttcaacacatagtagtgttggaaccttggacaaggtactatacctctaagcctcagttgcctcatctgtaaaatgggtataatatacctacttcctcatcagttatttttaagattaagagttaatataggtaaggtgctttaaaaagtggctggtatatattaatcacatttatatgtgataaaaataaatattagcatgagcagtagaaaggatcttagggtaatttgggccagcatttcattttacagataaagaggcagacatagagatagaatcgagattagaagccaattctgtagacttctagtccagggtggttgccactagtcctagctgttttaggacttcgtattgcttcaaaagcatttccctttaggttcctcttccttcccctcctcctgatagctggtatttctagagtacaggcatatgtgccctcatttaatcccttacagcaggctatgaagcaagtgccactattatccccattttctcagaagtgacatctgaggctcagagagcctgcccaaggctacacagaagttcagcctggattaaaacccagacctgacttcagagcctgtgctcttaaccacaccactgattttccttagaaagtcccagtggagtgcagttgtgctcagttaaaccatgtgagtatttgacagaggtgagctgcaggagccacagggcccagggagtctgaggatattttgcaatcccttttcaacctatgtctgctttgtttttatttttatttatttatttatgggtttttttttttttttttttttgagacaagagttttgctgttgttgcccaggctagagtgcagtgatgcaattttggctcactgcaacctccgcctcctgggtccaagcaattctcctgcctcagcctcccaagtagctaggcatgtgctaccacacctggctaatttttgtatttttttttttttttagcagaggcggggtttcaccatgttggtcaggctggtctcgaactcctgatctcaagtgatccgcccacttcggcctcccaaagtgctgggattacaggcatgagccaccgtgcccagcctgctttgtttttagacctggtttctcttatgtgtcttctgacacagtgcagttacactaaagcgggttacccaaagaatctacctgatgaagagagtgaagcttgaaggtcagagcagaccaagagaggccaggagcagagctcttgtgagacagggaccacgtggaggttatcagggctctgggcaaggatgctaatagaccagagatgtcagatgtcagaatccccaccttgaccagtggttcttcaccattaatccctatcagaccctgatgacagccttggatttccctctctcctggaaaatgcaaaggctcacacaccaaaaaagtattttggagtagcttcaagtttcataaacccccagcttcacctctgtgcttcgcagcatagtaattaaggtcacactctggattaaatggcctagggtgaaatcctcctttactagttagctgtgtaaccttgagcaagttacttaacttggtcttgggcctccagttccctcacttttaaatgaggataatcatagcatttgattgtaggattgttagaactaaatgagttaatgtatgtgacattcctagcacgtggttaactctatagtagtgttcactatataatagtattgctgcccttgcaccttagcccatttagtaaatgtttatggacagaatgaatgaataattctagttgagatgccatgcctggggtagagcattccaatcagcgtgtcgcagttggtctataggtttttttgggtttttcgtttgtttgtttttgagacggagtctcactctgtcgcccaggctggagtgcagtggtgcagtcttggctcactgcaagctccgcctcccaggtttatgccattcttctgccttagcctcccgagtagctggaactacaggcgccctccacgcccggctaattttttgtatttttagtagagacagggtttcaccctgttagtcaggatggtctggatctcctgaccttgtgatctgcccgcctcaacttctcaaagtgctgggattacaggtgtgagccaccacgcccagccagtttttgttttgtttttttctttttttttgagacggagtttcgctgttgttgcccaggctggagtgcaatgacacgatctcggctcaccgcaacctctgcctcccaggttcaagcaattctcctgcctcagcctcccaagtagctgggattacaggcatgtgccaccatgcccagctaattttgtatttttagtagagacggggcttctccatgttagtcaggctggtctcgaactcctggatggtctataattttgccaagatattgatccgctcgcccctcagggctgtcaaagccccagttggtcgcttctggcttgaagcagtgacatctgcaatgtgaacttctgactttaagcagcagcatctgcaatgcaatgtacaaatatctgtctctctaggtcccctgacatgaaaacagtttgggtagcaccagtcaaagatatcggttggtaagtcgtgagaatccagtaggcagtccagattccaagtccaggagaattttgagaatggatgtcaaagagagtcttcacgactgcactgagtttagaggccgtgggcttcctgcaggcttcacaagtgttggggtccactgctagagcaggctgcacaccacagtgggtacagaagatatcctgccagcaggaagcttcagtgcttcccaccttgcacatgagggacccagggagtcactcacaggatgtgtggagagcccacagtgtgagttgctggagaaaccactgtgacgcagaaaccaggctagagcccaaagccttgtgtaggcaacggacattaaacagatagtgatgagtactgaagtaggttgagcccagaggtgtgagtgctaggaaaaggtggtacctaggctgtgggagtttataacaacccagccttgtatgcaaggtggactctaagagctgtaggaaactatggaagggttttagtcaaggaagtggtatgtttagatttgtactctttttttcttataaatctacttttatttatttacttttcattagcttaagtccttgaggggcacagcgtcacacagattctgtgttcaatagctttagcaagattgcttgggaatttagcacaaaccatgccactgtttccatgggcctgagtttacctttccccagattatgctggttttcttcagtttgctgccagcagtcagtgtgttgttctttgctttatacatgtaagtacatctcttgcctaaatagaattagtttcatttcgagcataaataccttcaatttttttttttttttttttttttttttgggacggagtctcgctctgtcgcccaggctggagtgcagtggcgcgatcttggctcattgcaagctccacctcccaggttcatgccattctcctgcctcagcctcccaagtagctgggactacaggtgcccaccaccacgcccggctaattttttgtatttttagtagagatgggttttcaccatgttagccaggatggtctcaatctcctgacctcgtgatccactgtcctcggcctcccaaagtgctgggattacagtcgtgagccaccgcacttggccaatacctcaattttaataagagctgtgtcctcgctttggttctggaggccccacttacagctagcaaaaaatggccttggactacagccttccaaatgtattgtatttatcttattattatttttgagacagagtctctttatcacccaggctggaattcagtggtatgatcaaagcttactgcagtttcaaattcctggggtcaggcagtgctcccacctcagcctcttgtgtagctaggattgcaggcatgtgccactacacctggctaatttttttttttttgtagagacaatgtcttgctgtgttgcccacattggtcttgaactcctagcctcaaataatcctcctgcctcagcctcccaaagcactgggattacaggcatgagccactacaccccgcccatatttgccttttggaagtcctgttctcagcaggcctctacaggctccaagatagtgggaagagagctttttttttaaattcaccctgacagcataaacatgaatgttagaacatgagttggaagaggctgaggcaggaagatcacttgagcccaggagttcgaggttacagtgaactgtgatggagccactgcactccagctgggcgacagagtgatactttgtctctaaaaaaggaaagaaaagaaaatgaattggaaacagacaaaagtttatctgaggacataagttataaggctccttatagttgtccagaggtgaaaggtgagacatgcctgaaataagtacctggacttttaagggaaaaggaggactcaagcatgatcccccccccccccgccctgaagttctgggtggaaggcgataccacccctgggataggggatactggaagtacaatagttctggaaggttgggacacattgtgagttctgttgaggacttattccacgtgtggtacatgtgggatgttccctgaggatggttaacaagctcagtagataaatgggtccgagcacaggagagatgttggagtaggcagagagaaccatcagcagtggggttaactgcctgccttcagcagggctccttcctaaggggagaaagtttagaaatgggttttgatcagtgatttcttactttatgaccagtttgattggcatgcttctcttctatgcttaacttttagaattcttagataatgtgtattttgagcccttttcataaaaaccaatatagttcactactttgaagaattcatcttttttcttcttggctggctggcctcattaactccttccctgagtgtctttgcgataggagaaagctggttaactcataatgtgatactgtttattttcttagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggtaagtatttctggggacctcaggatcctgccctgtccctcagcctctggaaaggagtgtccatttctaagagtcccaccatcaccttgccctcccgcctgcttacccttgcccaccaccacaatttgctctgcattagaatctcctgtggtgcttgatgaaaagggaactctaaaataaaatgctacaagtcagacaatcccagtcataggaaccaatacctctcaaagacagaattcctaatatgtaataagcagttgataaatatttctggaatgaacacagtgttagttatgactccctgcttttcagatatcccctgtcacagttttttagtgctttctagaagcagtttatcatcttaattcaagtatattcaaacattcaaactactaagcatctgccatgtacaagatgctcttttaagccaggcatagtggctcatgtctataatcccagcactcagaaggctgagatggaaagatcacttgaggccgggagttggagaccagcctgggcaacatagcaagactcttgtctctaaaaaaaataataaaaataataatctgggtgcagcagcatgcacctttagtcccagctattcaggaggctgaggcagaaggatcactgaaacccaggagtttgagggttcagtgaactatcactgcaccactgcacaccagcctgggtgacagagcaagatcccatctcttaaaaaaaaaaaaaaaaaaagatactcttcctgattcagagaggaacacccaagcagagatctcatgccctaatccccactaggggatgccagaattgaaaatataggacatgtagttaaatttgaattggacgtaacaatgaatactcttgtaggatacatacatcccaaatgttgtagggacgtatgtataccacatactagggacatacatataccccttataagggatagacatatataaatgtgggattaagctgggcttggtggcatgcacctgtagtctcagctacttgggaggttcagatgggaggatctcttgaggccataagtttgaggtcagcctagacaacagcaagaccccatctaaaaaaaaagtagggggtgttaaatactataaaatactaaaataataataccaagttctaaaaaaaaaaaaaaaagtattgtttatctgaaattcagatttacctgggcatcctgtattttatctggcaattctatccttacactgaaggtacttaaaatcaaggtaggtgtggagtcagaataaagtgtttagggcaaggcctgcaggccagggacacttttcctttcttgccagtgttctcaggcagccagatagcattcgtgtcttccttggacagcaccttgaacaaggcaaatactgccttgttcctactgttcatttggcgttttctggactccatgattgtcactgtcctcctgaagcactgtcattgcaacattgccctcctttatttcaacacactctcagaatatatttctgctcctaagtttacagataagttgtttattgatttcattttaagttgtctgtttcctgatgatgactaaggagtccccttaatctcatcagtaagcactttccatatgacagtgtgtgggggtcccttctggaaaggtttcttgtcaagagctgtctgtgacatgtgggttcttgttggcttcatcttcttgagaacgcaacttctctagaatgcttttgaagcctgaaactctctgtttgcagacttcccactccaggtcttgcccctccagtgcagtctccatgggatggaagaacttagaactctagctagggttgtgtttactccttggacccagttagttcccgtgcctcagtcttccactgagaattaatggtcaaacaaatgaataaaaagcaagtgaccacacctgacctgagagagccactctttccttatatctatccttcttacgtatttctttattctgtcagtcttcctggctgttctttgcccactctgtagtgttgcagtgtgcacttacacacacacatatgcaaacacacactcactcacaacagattttccctctgctcagggtagagctctccttcagagaccagaaccacactttcctgaaaggcttctctgacttctcctctgaagcttttgactgaggcatttttgtctctgtctgctggaagccctaaaattgtaagagacttatctttaattaggatgagtataaaatgtattattcaaacccagcattttaaaagtggaagaatgtgctattaataaatgcactaggactgttccaggcaaactggggcgtatggtcacctctctgtaatgggatatgaggcccttgtcagtcagctgttctccccactgcctctctccattgtagtctctggttgtttgaggaaatagtaggctaagttttttcttcagacaactcttctcaacattttgttttctaccttgaagcagtacccactctgctggccgtagcttgctgatgctttcagaaccccaagtactgatgcccttgccaggacagataaattgttaaaatgagggtagcctactgctctgtgggtgggagggaagaaaatgggttcatcttccccccatctcagctgcctttcctatttcttacctttatctccaccttacctgcctttggttagttgtaggactgttagttactgaccccaagaagactcagtttgggagcaagtttggggattcctctaaaggggagacgtcagcagagacttgggctggaagtaactgtctttcccacctgagcgctcagtttcctaaacctcaatcttctaaggaaaggacaaatcacttgtcattaactttttttttattttttcttcctttttttttttgagacggagtctcaccctgtagcccaggctggagtgcagtggcgtgatctcggctcactgcaaccttcgcctcccgggttcaagcgattctcctgcctcagcctcccgagtagctgggactataggcatgtgccatcacgcctggttaatttttttgtatttttagtagagacacggtttcatgatgttggctagactggtctcgaactcccgacctcaggttatccgcctgcctcagcctcccaaagtgctgggattataagtgtgagccaccacacccagccttacttttttgttttttctttttgagacaggacctcactctgtcacccaggctagagtgcagtggtacaatctcagctcactgcaacctccgcctcccgggttcaagtgattctcctgcctcagccttccgagtagctgggacgacaggtacctgcctccacacccagctaatttttttgtatttttagtagagacagggtttcaccatgttggttaggctggtctcaaactcctgacctcaggtgatctgctcgccttggcctcccaaagtgctgggattacagatgtaagccaccgtgcccagcctttttatttatttattttttatttttttcagacagggtcttactctgtcacccaggctggactgcagtggcataatcacggcttactgcaacttctgcctcctgggctcaagcaatcctcccacctcagcctcccgagtaactgggaccacaggcatgcactactacatccagttaatttttgtgttttttgtagagacagggttttgtcacatagctcaggctggtctcaaactcctgagctcaagcgatccacccgccttggcctcccaaagtgttgggattataggcatgagccaccgaatctgaccatcattaactcttcaatctccctttctttcctttctcatttctcttcttccttccccctctgtcagactcactggacacaaggaagggtcgtctagttctaatttcaagagccttattagaagtgctttccagtaaggtaaaggaagagtaatatcttaggaaatctggaggcttgttaatttttatgctgcttgttgtgttgccttaggtgatctaattttttactagaaaattgaaatgaaaaatgagaggtcaatgaaggaacattactcaacagtggcagtggaataagaccttcatggacacataatagcataatagttgtgctcacatagttctctattgctttactttccatttcttctaaaatgcatattgggcttataataaaagctaggatttattgagggctgaccatatatacctggcactcttcccagttttttatattcgttaactcatttaaccctaacagcaaccctataagagacacagttttcaatccccattttaagaaaaggaaactgaggcacagagaggttagttaaataagctgtccaaggtcacacagctgttaagaggtagagctggaattcaaactctggaggcctggcctggttccagagtctattgtttttaaccattaagctatatatcctgccttcacaggggctcctggtcttagcacactgtcatagtgagggatgaggggatatgttttgattttgttagtttgagctatatctgaattttgacccactggggctcatccaggtttaagggccattagttcaagtctcagcaacttactattaggttggaagtttccacttggctgggcatgggtagaataataagtgaagttattcctcctgttagtaactggaagggaatctgttgggaggtgatgggttcggcaaggcaagtgtcttcacccttagtgtctcaaggcccaggcccagggagacagagcaagggaacaaggaagatgttacccatgcttagacctgcaggctcgtgcctagagactcaaataagcctcagctaaaaacaggcaggcgtttcttagccctcttctggtcctggcccatttctctctatttccactcttaacaggagagaagcttcttgaagggcaggtgatccagctcgaggatgggaccaccgcatacattcaccaggtgacggtacagaaaggtgagggcaccccaacacaccatgccttgtcgagggaagcctgacagcccccaccaagggacccctccatggcactgagctccagggaaaggcaggcattgctctcgttacagaagctctctcctttgaggatggtcagcctgtgcagctggaagatggcagcatggcttacatacaccgcacacccagaggtagggtcaccatcatcacaactcggggaaggatgggaggcaggactggaggatggggtggcaggactggaggatgggatggcacacaactggggtgtagacatgggagctgtcatctccatggtacacacatgctcacctggattagcagccttgcccaccttccctggtgcagaccacaggagcagctatgtctgcaactgggaggtgagccttggagatcagtgacgtggactttgatggtggccttggctccagcacagccacaaagtcttagggctttaaataggacccgaggatatcatccaagaccaggaaaaaaaactaatattttagaatgaagctcctaaggtgctgaagaataacaatttattccttccgcaggtggtttcttgagtgactgttgcatgcctggcgttgtgttaggtgtgcagtatacaagacagaacaaagtcagacacagtccccgctctcctagagtctagagggggaaacagaagtgaaacaagccatcagtgatgaactgatcattacaaacagagatcaggctcagggagggcttctctgaggtagtgatgcttgagctgagaggtaaagaatgaggtagacttagctgggggaagagggatggcagggagggttcagtacttcaggcagaaggaatagcatgtgcaggcctagagctggggggaagaaagaacagcacattccaggaactgctaggagctagagccctgggagtgaaggcagaatgagcaggaggaaactggagagagaaagacagggctggtgcactctgggtttgagtgtcagggtgaggattttggtctttatcctgagaccagtgggaagcatttaaactgttgaggcagttaagtgacatggtcacatttgtgtcccgcaaagatccctctggatgttgtgctgcctggagggaactagagggggtgaggagcgactggtcaggaggctattgtggtcatctaagccaaaatgatgatgggcccctgtcaggtcctcaaggagcttgtgagttcccatttagtgtaccataggagacctcatccttaggtgagacagctgcagaaggagggccagcaagagtgaatcacaaagtgaagggccatgagaaattggatgttgaaaccctccttggtatatgtatctctcattaacttaaagctagggtcccagctgtatctcttccccttgtgtggcatcagggctaaccgcgtgttccctgcagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggtgagcacgcacagcgtgacacggtctgtcactctagacaaccgggcctggcctgcgcactgcctcttggccctgccagaacttcacctctcaagaggacaagggcagccctgtgcttgggcaccatgtgggatattccctttgcccctccaccccagctcccccaactcacctgtcacacatcattgtctagggcatgcaacacagcctggcctggccgctgacagctgtttacgctcacttttgtttacgctgtctttgcagagggaaagctgccataagaaacagtggcatccttatgctgaggagttaggcccagcttcactttggctgctgtagtaatcctctgcactagctgggaaagccctgccagtgacttgtattagctttctagtccactgaggtaattgtatttatttcttctctgtgactcagtcatttggaaaattaacctcagtgggctatgacaagggcatgtgcaacagaacagctgggattcctggattatgaggcccacacagtagctcagctggaaaggaaaagggtcctggctctgcaaataccagtcagtccaagttctttctgccgaaaccatggtcctgcatgtggggaaaagggtacagacatctctgagctttccaaaccagggtgttcccttcctggaatgactacagagcctcaggctggatgtgccagggcttcctgcacgttccttccttccagcagttttacccgaagatgggggaggttttttatttataatgaaaccagtgtgactgaatgatggaggaaaaaaggaagtcctcatgtcttttcaaaatgaagcacaggccgggagcagaggctcacgcctgtaatcccagcactttgggaggctgaggcaggtggatcgcttgagtccaggagtttgagaccagtctgggcaacatggcgaaacctcatctctacacaaaaatacaaaaacaaattagctgggcatggtggtgcgcacctgtggtcccagctactgggaagcggaggtgggaggatcaggaggcggtgactgcaatgagctgagattgtcccactgcactccagcctgggcaacagagggagatcctatctaaaaaaaaaaaaaaaaaaaaaagtcacaaaactttacagtaggctacattcactcccacccaggttccctgaggtatatcttagagaccaaatttgagactcgatgttgatgtaaagagaagtgggttttatttaaatcatgagccctgagatctatgcttgctctacctctacctagtccaaacttgggtgagtccctcctctcctcgacctcagcttattcctaatatgatgagatgggaccagatgatctcagaggtcacttccatccctgatgtcccttgattcccgtgattaccccaggagctagtgagacatggaatgaaatccaagtgcctgtgtgggttagcccgccaagcaggtcaggccacctctgaccctaccctctacccagaagctgtttaagtgtccgtgaagctctcagctgcttgagcctctgagctggagcctaactagacagaccttgccatgaatttggcctcacccctctgtcccctgctcactgtaacttgtagagttcagtttcaggagctcctggaaagaccagagtgtgattctgaagcattctagaaagaaagactaagggatagtcccaccaggaccctgcccaggaaagcagaagagcaataagggctccctgcatccagaggctggtgtgagatgggtggctttagcaatatcccagaagaggagacaaaaggggaggacttgtcagctgggtgctgtcattagagctgacatttctggtggaaactgcagcactcccctgggtgcttctggtcgtggccacctcactctgggccccaagtcctatcagatgaacctaggtgagctcatctccacagcaagcccccttgtttatgtacttttaagcactagtttcgtgccaggaggaaggggacccctcccatcagaagatggaggtcttgagagttgcaggctcctaggtgtgtgtgcttagaaggagggtttctggcacttggtccagttcaagcatggccattcagacaacctcccttttcaccttacctagctgtctatgtgatagcctttcttcaatagccgtcacagccactatgacctgtaggtctccctttatcccatcagagatgggtggtgactccccatgcccaccctgtttcttctgtagcatgccccagcatctgttccttgtccgtctagttatgttcttctgccccagaggcccctgacaggtttaaccctgcctgttgggtcttaagctgccagcagggccctgtgtcccaccttcttcactggggagaatacatatagggatctcaagacttttcccccaggttcttcatgacagccagattccccgtaatggaaaagggcagcaagttggagacagagcattccgctgtggctacaagggctgtgggcgtctctacaccaccgctcatcacttaaaggtaaggttgctggcagacagccgtcagctctgcagtcttccctcccaggctgtaattctacctttctgctttgattggaattggtccctgccctcacgttgctggagggaagaaatgagggtacacaggaatgccagcacagagcgcttgacacacatgaatggtacaggagggaagagaatcagggtcctaaagaaaaccaaagagccctggtcatacccttgctcctctgaattatgtgattgcttgtcctcacaggtgcatgaacgagctcatacaggtgaccgtccatacagatgtgacttccccagctgtggaaaggcctttgccacaggtaacctgcctggtgggctgcttccagttgagggtggagggttctcgttctgtttgggacctctctgaagggaacccaacaccaggctgctttcctggagaaactaccgtcagagtactctgacttgcagggtgctctctctggaggaaaccttgttacgggagtgcaaggcagcatggttcaggccagcagaaggagcctggagggttggtggagagacccagcctcttgtgtcagctctgatgccaaccagctgtggattattgggtgggccattgcatctctctgggcttattttcccctctgtgaaactagtacctttagccatgagttctctaagtttcttttcatgctcatgttctggtatggctccaactgctcctggagagggaagcagggcagagtgggcttttccagcccctgcccagggcaggggtgggatagaggcagacatgggcttcttgagccaaaggaggtggagagcctgtgcatgaggtggacggtggaggatgagaccccactgggtgctcatctcaccccctgcctgccacatatggacaggctatggactgaagagccacgttcgtacccacactggtgagaaaccatacaagtgcccagaggagctgtgcagcaaggccttcaagacctcaggagacctgcagaagcatgtccgtacccacactggtatgctgggccctgcccactccaaccccattccctgggcaaaaggaattcagcttgcctttcagacttagacctggagcccagtgccatccccagcttgctccagcatggccctctttcccacacccctcctcacatcccaccatttgcataggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggtgggctagctggcatgcgaggactaccctcactcaggccccaacccctctactgtaggcttcccatctaagacacattcccaactcccagcccagaacccttctgtgccagccattccaggctggtctgggggtagggtatccccagaacaactctgcttgcagtgagtaattcctcaatttccagttaggtccaatctgaaaggtattgccagtcctctctggggtccctcagctccctaccacccctctacacccaccctgagttctccaactctgactgaactcttgaaaagaggccagggtcaggaatgatggggaagaagcagagtgaactgtcaccttcaactcctcaccttatccgccgtccatgactcctgtgtatcctcaccctccccagtgttatgcccctcatccagctttctgtgttgtgtctcagcatgtgtgtcccctctttcccatcacaactgatacttcagtcatccttgcctcttgcctctgctgttcaccattctcaacctcccaccctcaaccttataagccccagtgccccctaccagccccttcactagccccagccttgccctgtcccccgtttcctttccgccttgtctctggattcagtggttcaacacctgtgtcctctctgtgttccactggccatcttccccaaccctgtccattcagagtctcaggtctcagtccctctccctccctctggctctcccttcaccaaccctgtccctcacccctgtccccttagtttcccccttgccagccccagttcccacccccctcacagcccagtgtccccaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgagggtaaggggagtgggcagagggtgagagtggggacaagccaggcctccccatggcatctggtagcagatgtcagccttggctctcctctcccagccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtacaggccctggagggcagaggtgccatactagctggcactctccactctctctggggactctgggagccctgaagttctgacagccccactgccacccagcttcttgtttaagttttatagacttcagaggctgaggctgaggagaccacatcttgcagcacagcctctcctcctcctgtgcttccagctcagtctctggggcttctagagcacagttagtagtttctctctttacttggaggctgacaggtcctgttcatctgaacaggatatgggatgtccttctcaagagaggcatgttcatatagcagccagaacatggtatggggtctgaaagcctggggtctggtcctactagtgtactagctagctatataacctgacccttgtccgtacccttgctagaaagtacatctgtgctttctagagttgttaggacacaatcaggtggcgaccctgagctggatacaacagggcccagaggcaaagtggtgataaatagaagtagtcagtggaattcttctagtgtggcctctctttgcaaccttggacccattttgtttgcctgtcacccatcccttccaccactatgacatgaaactaataagctgaccttgtctgggagagcaggtatatcttccttagggactttcagacaaccctccactgacactgccagctcatcttcccctcctgttggcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtatgaccaggcggtttgcttggggtttcttattttgtcattcctttccatggggcgggcattaaagtgcagcctaaactagtcaagtcttcttaccaggacaaagattccccacaaaagaaggggtcttccccacagttcctgggccatgagcagctcttacctttaaaagcagttgaatggaggtcaagagacactttctaaatctcaattcaaccctgatttgttgtgcaaccttaggcaaatcacttttccatggacttctgtccattttcaagtgaggggattaaaatatctctggaattttttacagctctgtccttctgtgattcaaaatccctaaattaaattgggctctaagttgggaggaaacccagccttacttagctctgagcctcaggctaattaatctgacccatacggttttatccattctcttctgggttgttcccagcaccttaattggagggatgtttatttggattgtggggagggagagtatactgcaggtggaatggaagacctccttttgtctttcaggtcacaatcattacctctggggctgtggtggctgaggactcaagtgtagcatctcttcgtcatcaacaggtggcactgttggccacagccaacggaacgcacattgcagtgcaggtgagtagagatctgggaggaaaggggatcccacggccagagaagtcaacaaggaataaaggggaattagatgaggatcttgaagagaagggcatctgactcaaaaagagcccatttcagaggacagatccctttcctcctgcatccatgcatctgtctcaggctcgctcttggctgaggcagaatgttgaagcctcttctggccttcaggataactccgatggcagtccacctgtggtccaagcccttcatcattttgtgtctctgtttcttcatctggaaatgaaggaggctgacgtagatgatcaccacggttctcttcagccagtccttcctccgtgagcaagtgggtctctctgaccctggctattccagggccccctggccatgcctagcctaataggactcttcatccgtgaacttcatgtttattggagccctactaagtgctcagcgtgtggcactgggtagatgggggagagtcaaaaaaaaaagtaggccacatattactaacactggaatctagcagggagggtctcactgtctccttccttctgcacccccttccccacagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctgaagaaaaggtgcccagcccccaccactcctcagctgccccccaacctctctatggcagagaggcagggagtggccctgtacatagactgctggggattgggtttgatttgttttgttttttttaattccattttgataatttttttcctgctctgggtggtggtggcacatggatgaatgagtatttaataaaagttccaaatttccacctgggtccctccatcctttcagctctaggcccgggtggcagggttggtcaaatcaggctatcagccctgtctccctggcacaaaccccactcagccttggtgccagagtggtggggctggcctgccagggacacaggtgggaaggaagcccagtataagataaagccctgaggagctgctggtggcttcttgcccacagctgagcaggtgggctccagggtagccaaacaggaccagggtgaccgctgcttccaggctctggctgaatctcaggcctcatgtgattgagctgggggaactcttttcctgccttttcttgtgaaacgtagtcagagcccctccaacccagccacccccaaatcacacagtcagcttctccaagagggcaaagccccaggttagagtgaggctgggggacacctttgccaaggttactgagattcaaggagcagagtctgatgcctctggagctgaagtcttggctctattacccagctctgggggtgcccacctaggtgcctaggactgtgctgtgggatttcaaagccacaatcagaccccactgaaaagtgagttggtgagaccagatcagctccagggggaagaagggatacaggggaaggcacttgatgggaagaagctctgggtttgactctgcctacacaggaacattgcagggattggtggtgcctcttttcctctctctgctgtgatggatatgccccaaccccttcctgcctcctaggattggaaccccctcctctgatccaggcatcctctcccaggatgcctagaaagctcccatttactcttgccaccagctccttgggaagagaggggcgggggcgtgcttccaggcaggaggtattcccagcaccttacttggagggatttttatttggcttagggggtagggggaggtgtcttagaattggcctgagcagatgtcttcaacatctgtgaccaccattcctggtgtgggcgtgtcccagtccttttggacactggatctgaagaaaggaagcactgacatggagggccctgaatcccaagcctgctgctgctgggacccttaaagttgaggtgcaccacaaggctcacccccatgtgtttcaggaagtttccagtgtcttcagggctactggggctagagtgggcagtgctctgagtaccgtttagagccagtgctgaggggatagggagccagcaagtcaagtgccacatcctgacctggagaggtgccctggcccatttccttctccagctttgtgatgttgcctttgtttccttccacttggatggagtcccaccaccatggtaatgttaagtagcaccaaaagctctacccagagcctactatgtgctttacgtccattctcagacattcttacaacacggaggcatttttcctgctttacaaatgaggaaactgctcaaggaggttaagtaacttacccaaggcctcctatgttgaactaggactggacctttactctgtctgaccccaatatcaggatgagcttgctttttccctcagcaagctgcgtctgggagccctggaaggctccagaagcctccgggtctgaggaggcttctaaaagggcctcacatgccccgggagccacgtggatacagaacgagggttcccgctctcggagagttggtccccagttcccatgcagggagtggagcctctgagcactgccagaacaacaggcagggttctcgacagcacagagcctcacgcaatgtgcaggcaggtggtgctctcgctccaccacggcacctctgcggtctctgcagccgtttgcatttcctgaaaccggatcttagtgtcagagccgcccccagccgggcgggcgcctcagccatggccctgcgcaaggaactgctcaagtccatctggtacgcctttaccgcgctggacgtggagaagagtggcaaagtctccaagtcccagctcaaggtgaggggcacccgggacccgggggaggacggcagatgcaccacaccagcccctgccgcctgggagccaggtgtggacactgtgccactccaggggcacccagccatccagcgtcccgggcctggggtcggggggctggtcctgggtaactgggccaacgtagcctggtagatgccgctgcccaccctccagagacctagtgaagtgtgtgcagaaaccttgcgcagaactgggccccacaactggaggccaggaggttctgagggccattatggggttctgagggccaggagccaggccacatcccagactctgtgtgatgagcacacacacctccacagagtcatgcttgggcacgcagtgtgctctttcttgctgcttcctcctgactttcaagagaaacagttagccagtgcttggcagtcatttcctctggagctgagagaggcataaaggggccgcccccagtcccaaacctgtctggcctgtctaaccctgcccgccaggtgggacagagctgcggagtgggtgaggactgaggaccctattatactgctacgcagctcacccccctatccaccacacatatcaggttgggaaacttaccttaggccttgagacctcaggtagggaagggggagaatctaagcccaggaaaatcccaatcaatgattgtcctgaagtcaatcatctggcctagacaatttctgggaggccaaggagtttttctctctcttcctctagtcctccagtagtgctgccttccctaccctagttagtggggaggaagcaaggccctcagccactagaatcagcgaacactgggggaaaggagcaaggtaggcctcagctctctaggacctgccataggggtgccttcgttcactctgcaagtacttgagtgcccctcgtgaggctctgtgcctggcatgtggctaggcactaaactggtgtctccctgccccatcctccaaaggagacgtgtggtctcaaggaaacctccattcttaatgaccgaggtagagggtgctggatacctgagagatgaatgggacagaacagttattgtgccccaccaccgttccaaccccctactttactgaacttggatgtgaggaacttgaatatcccaaactggtcctatgttaaattccttacctggatttgtgagcatctaatagatgatttcactcccccaggaaggagagcccactactatcttttgtcacctagggagaacctcctaacaggcagattcttccttacatcctatttaaatctcttgtattgcagatcatgtcatttggttgggtcctcagtataaatggaaaaaagtcgatcatccaaaatccatttctgcaaactctgtgtcccacccctacctcccaccctgtccctttaatatcttgccagacaataccagcccccgtggctttttgcttccagggtaacattttccacttctgtattacctgtggccactgagacctctccaggctctctctgcccttcacatggaaagtacagcctttaagtggctccccttttcctggtgccatcagccagtaaagcctcctagcttgagcctctgtcttgccctctaaaagggccactacccactccctcatccccacaggttgcgtatttctagggaaatactccatggagagcttgcatgcttgaactgtccactgtctgtacctcatcacagctcatattgaacctactgccagcaacatctctggtcacacaggatcaattatagagttccctcctacttgacagaaaacttgtcaactctggaaacctgggctaacagtgggagtctcaggggccaagtgggggtggggcggaaatggcggggctcctttcaagcccataatagtgaatattggaagaggaggaagtagtgatagtgttggggggcggggattccagcaaagcaaaggagtaatagagaagtggtcaaaaggcaaaggaggaagcagacgagagagttatacaagcagggcccacctctccccagaaaagacttggggatgagggaaaagaccttggagtcaatctggttttttgttgttgttttagagatgagatcttgttctatcactcatgctggagtgcagtggtgcagtcatagctcacgacagcctcaaactcctgggttcaagcgatcttcctacttcagcctcctgagtagctgggactacaggcacatgccaccacgcctggctaatttttttattttttattttttagagcctgagtctcattatgttgccccggctggtttcagacttctggcctcaagtgatcctctggcttctgcctcctgagtagctggaattatagtcttgagccacctcactgggctggttactaaaaccatccctagcgttagggtcctgggttggaacctggcaagagacctgcactagcccagggcaagatgtgtcggtgcgtgacatttgccacttctcccctaatgtgttggtagacgggctcccagtggctgtcctgggcaaacccacgatgaggccagagggtaggaggaagaacagcacgtcctctgagaaaagcccaaggagtagggttgtttctcctggaaaagagaaggcttgagggaaaaaccagatacttctttctctctttgaattcttgtagaaagtacaatggcttcatccagttgggttgagaacagagaaagtaaaccaataggaatggcactcctgcccaggatggatttaggttgaacacaaaacttcccaggagttgagggctgtgagttcttgcaaggttcccagaaccgcctctaaaaacctttggaaggtagccatcctgacagagggctatagagaggggagcccttgggaatgatgtgtgtcctactgaacacaccctcttacccaggggagcagttttgattttagaactagtggaggatcagctgataatttggcctccttccccactgactatcaggcagtggggtgaaggggtatgtagatggagcagtgtgtctctggtttgatgaggatctttgggtggcaccaggcctaccacttcctccttgactggcaggagctgggggaagggagggagggtagacaggggccttccagtctcctgcacctccagctgatattcagggcagtcctggagcccagagtgagactcttgcccactgagaatcaatgagcttcaggttttgcctcctctggagagggacaaccaccttctccttagtggaggaaaagttaagaacagctccagtccaaaaacctgctggctggctaggatcattagctttgtcctgacccctgtgtgctactggtctccccaggctaggatttgtgggtagggaggggaggatgatttaatgatgtgcagagcacttgactcagaaccacgcaggcttggatccgtactgctccccatctgggtgactttaagcaagtcactgtccatcttcagtttctcatctataaaccagggggttgatcaccaagctgtcctacaaaactaaagaataaattctgtacctcaagtaggtaaaattggtctatgatgcagcctctcctttcccttaactgggcctctgtctcctttgatgcccacacccaacccctacagccccttcttgctctcagcaggtgacacagctaatccaaagattcccaccttttaaaatttccagtgttcctccatgatagtagttatgcttttctagtaacccactagaatacatttggtaactcttaaaaggagctgtgtctttttttttttttttttaagacagagtcttgctctgtcacccaggttggagtatagtggtgcaatctcagctcactgcaacctccacctcccaggttcaagtgattctcctgcctcagcctcccaagtagctggaatcacaggtgcccaccaccacgcccagctaatttttgtatttttagtagagccggggttttgccatgttggccaggctggtcttgaactcctgacctcaggtgatccacctgccttggcctcccaaagtgctgggattacaggcgtgagctactgcacctggctggatctgtgtcttttaaaaggatcacttggaacctagattcatttaaagaccttgctgggcaaggtggctcacatctgtaatcccagcactttgggaggccatggcaagagaatcacttgagtccaggagtttgagaccagccctggcagcatagcaagaccccaactctacaaaaaatgaaaaaaattaggcatgatggctcctgcctatagttcctgctactctggaggctgaggtggaaggatcgcttgagcccgagaggtcaaggcttcagtgagccatggttataccactgcattccagcctgggcaatagagtgagattctttcttaaaaaaaaaaagtcaatttaggagagaattctttctgaaatcattgctgggtgcttttatggattcccaaaccctggggatcctgaaggctggaaactacagaatcagttcttgctgactgttgccaacatggacctgacacccacacttgagtttttaggatccccaatccccacacttgagttttagaggatcccccaagtcctgagaggagaactactcccctacatgcctccagaggaaagagtgaatagatgaagcatctcaaaggtcagtgactgccaactcagaggccagaggctccctgggtttgtggagactgtgggagtcctctctgaggaaacccaaatggcaacttgtgaaaaatacacctggaccccacccctggaaactctgagtcagtaggtctgggctgggcgggcatgtttcagtttcaccagttctctgggtgattgtggtgctcagccagggccagtgcactgtagagatcaagagcagggctttggagtcagaccttgggcaagacgcttcctctctctgagccttgatttcctcatctctaaaatgaggataatgagagtcccctgatccagggctgaggactgatggagatctgcaagtgagctcctgctcacaactcctctgtcactgccatttcctttgcagcatgacccctcccctagtcacaccctctctccacccccaacccctaccgcacccaggcacaggaagctgacagtctgaggtcggcccagctctctggagagaggccctgagtgtctgggcatttaattcttccttgtcctactatctgacagcacgcgggggtcagagtctctgccctgggttcttcaggatccaatggcaaaagtgcaggtgaggtgcaggtcttagggacagtacagggcgacagaactaagctcaaataactgtgctgttatgtggcaggttctgtcctgggtcggggagggcattcataggtcctctcctaagactccctttttagagagatgaaaactgaagcccagtaaggttaatatgctcactgggatttagtcaatctctgtctggcttttgtattttgtctgcttcttcccatgaagtgtttaagttcattcaagagatacttaatgagcatccattaggtgccaggccccgtgataccacagtgaaaaaaacgcaaatgtttctacccttgtggtgctgacattctagtcagaggaggcagataataaactaaatgaaatgtacaatatgatgaaagatgatacatgacatggaagaaaataaagcagaaatgggtagggatcatggaggtcaggcaggattgggttacaggtttaaataaggtgatcaggccgggcagggtagctcacacctgtaatctcagcactttgggaggctgaggcgggtggatcgcttcagcccaggaattcaagaccaacctgggcaacatagtgaaagcccgtccctacaaaagatagaaaaattaggcccagcacggtggctcttgcctgtaatcccagcactttgggaggccgaggcgggtggatcacctaagtcaggggttcgagaccagcctggccaacatgttgaaaccccatctctactaaaaatacaaaaattagctggatgttggtggcaggcacctgtaatcccagctactcaggaggctgaggcaggagaattgcttgaacccgggaggcagaggttacagggaactgagatcacaccattgcactccagcctgggcacaagagcaaaactacattgcaaaaaaaagaaaacacacacacacatatacacacaaaaattagccgggtgtgatggcgcacgcctacagttccagctactcaggaggctgatatgggaagatcacctgagccagggcggtcgaggctgcagtgagctgtgattgtgccactacacttcagcctgggcaacagagtgagacccagtctcaaaagataaggtgatcagaggatattccacctggtcagggaatatatattccctgagaaggtgtcatctaagtaaaaacagggaggaggaaagggtttgagccatgcagtgacctggagagaaatattccaggctgcaggaacagtaagtgcaaaggcccttgggcaagaatatgcctgacctgctggaggaacattaagaaggcagaatggctggaggcaagtaaacaagagggatgaggtcagagaaggtgcagcaggccaggtcacatggggcctggaggcctgtggaaggactcgaacttttactctgaaaattatgggaaaccattggagcatttgagttagactttaggagtcagtcagaaacattcagtgaatgggggacattatactatctttggagtcaaggttgagattagagtcattgctgccctcaaggaatgtagaacacccagaaatgctcacacaaacagtgaacagcaaaagaatattattatagagcaacttaatagggcaaattaataactgggttaatggcaccctttttcatccctattgttttaaattttatcctaaagacaatatattctcctggtttaaaaaaagaaaacacacagaagaatataatgttaatgaagaaattcggggctgcgctgtggtagctcatacttgtaatcccaacactttaggaggccgaggcaggaggatctcttgagcccaggagggctcttcctgcctcggcctcctaaagcattgggattacaggtatgagccaccatggcctgggcaatataatgggaactcatctctatgaaaaaaaagaattttttttttttttttccagacagggtctggatctgtcactcaggctggagttcagtggcacgatctcagctcactgcagccttgacttcctgggctcaagcaattctcccacctcagcctcctgagtagctgggactacaggagtgtgccgccacacccggctaattttggtattacaaaaaaattttttaacttagctgagcatggtgacacatgcctgtagtcccaattactcgggaggttgaagtgggaggatcgcttgagcctgggaggcggaagctgcagtgagcagaaatcgtgacactgcaccccagcttaggcaacagagtgagaccccgtctctaaataaataaacaaaaataaaaatgaatttattataaaattaaaacatgttagtggtaattttttttttgtgggggtgtgtgtgtgtatgtgtgtgtgtgacagagtctcactctgccacccaggctggagtgcagtggcactatccttcctggctcacctcaaccgccacctcccaggttcaagcaattctcctgcctcagcctccctgtaactgggattacagccgcctgccatcacacccagctaatttttgtatttttagtagagatgaggtttcgccatgctggccaggctggtgttgaactcctgacctcaagtgatccgcccacctgggcctcccaaagtgctgggattacaggtgtgaaccactgcgcctggccaaatttgtttttttgtttttgtttttgttttaatttttagatggagtttcactcttgttgcccaggctggggtgcaatggcacaatctcggctcactgcaacctctgcctc

SEQ ID NO: 383 - DNA, 64827 bp, Homo sapiens
tccattactttgatttctttttagtgaagaaagctaatttatttagaagttcaaatattacatacaggaggaaatgcaactattttatatttttcaaatacctaatctctgctcttcttcaagcctcatttatatttcatctttgttttatggcactgaccaaggaatagaccaaactaaacagctattgtcattcaattggcaactagttatgtatttctgggtgacatcttttgtataagtctttgggtagagacagttttgccatgatgaatcttggttttcatactattcttgatagaacttttaccaaaatactatgaaatgtattatatattataatatacagaaaaggtgggggtcttcatgcccgtaaatgtttatgttcaaatttgccaaaaatcctgatttattagttataatgcaacattatctgcaatctcaaccaaaataatacatccttctgctcacctcctccctgtccctggtcccagcctcactaaagcaacttttcttttgacagagatcattgctagaacagcttactttgcctactgtggctcacagctatttctagagcttgcctggtgtttcagatcccaaagaacattttggttattgagataggagctgaaagttgtgtttagcgttatgtcttacatccccaactttgactatggtagggatataattttcttagattatgttcatctcatccgggacacaaaagcgtgttaacttcttaagtaataattttccttcctttcaatgctttcattctccaatatcttgacaacatttactttgatcctttaaataagttagtcttatttttacttctatgccttaagcctactagatgaaatatcctttgcaaagttctataacttagttatagttatagttatttagtcacttagatgatgtaggtccttattttacagatagcaagggaggtaaagtgagttattcaagataccacagaataaattatctataggtcacctgtttttaaatttctactatgataaatttcaaatatacaaacattgaaatagtataattagtataatctttaacattttgacatatttcctacacacacacacacacacatgcacacacacacacacacacacacacatgcacacacacacacgaacattttttaaagagccatttcaaaacagaaatactgccactacttaaaagttagaattgggccgggtgcggtggctcacgcctgtaatcccagcactttgggaggctgaggcaggtagttcgcctgaggtcagtagtttgagaccagcctggccaacatggtgaaaccctgtctctactaaaaatacaaaaattagccaggtgtggtggtgcatgcctataatcccagctagtcaacaggctgaggcaggagaatcgcttgaacccaggaggcagaggttgcagtgagccaagattgtgccactgcactccagcctgggcaacaagagtgaaactccatctcaaaaaaaaaaaaaaaaattcagaattcttgcttaattctttccttttaattattaatttccaatgtaaagatttgtataatggttatcttcatttgtctatgagtaattttatgaaatccataaaatagaagcaattaatatggtgctaattgaagtgtttaaatgtaagggcttaaattttaggttctcctagatttcaatattgattgttaagtaatacttttgagtatatatgctacttgatccaactggctaaaacttttgtggatgtgatttcatcatgtccaaaagtatcatattttgtggatgtagttttattgttcacaagcagctaagctataaattttagaaattattatttcaggagatgtttttagttgtccttttatattacttatggcaataatgcaactatctaagaaaaacactcagccacttgacatcaatttccagatctaaagagcaaaggcagctctgtttgcttcaacaccttcctgagtaatgtcatgaagtttaatattacatcctcccaaacaggtcaataaataattttaaaaaatcatgaacgttaacgagaacaggggtgaaaatgtgttttggacagaataaagtactattataaattaccagcagcctattttatttcgtgattattgcttcctaaaggccattgagaaacaaaaatgtagactcaaaaagaaataaaataaaagtataccaccaatagcgacttatttttttcatgtaattttaattttaccatttttgtctggaaggaaggacaaaatcatccaaaagtggaagggctaatgtttttctttagcaacatggagattaggctgtaagatctcttgctgattttatctcttatacaatgaccagaggtagatatgagggttttggggatgcatcacttgccacctcttcaattgtcatggataaagcaagaagacaatggaagatctctaaatccttttggaatagtaaagcctacattctgataaaggaggtgatatttgaaggcaggtcccagggagtgtattactattttatcccccagttgttaaaacatcacagtttcataggtactttatctctagggcaatacttcatttcacatatgaagtagttggcagtaaggcccagcatatgacatccccaagagcacacacacaattcgtgacagaatgagaaccagagcccaaacctacagttatatttattcaagggtcagccctactatgtggcataaatgacatgttacatgaaatacacagacaacatgaagacacaaatatctccgtgaggctccagaagttgttggcaggctcagcccactacttatggtggtaaagcatttttttttcttaaaaaactttcactacccctagatcataaagatagtttcccatattaacttctgtaagttttactgtttttaatgcaattattataaagctgaagtgcttccttttgattaaaaagtttttgaggaagaaacagatattctatgcaattagtaaagtcacatcaaactggcatttttattaacaaactcaactatatagtctcagaaaaaaagagggaagtgcaattaataaaaatagtatgtgtagtctttctattgtttcggtcaatgactttatttattaccctgtataaacgtgagagacaatatcaaactgactttcttccattggttttagttcctatataactcagtgtgagcatctcaccttgtagtctatgattttacggtttaaagacgtgaatcttgcatctaacatggcttctgaagcaaagcaaccacttttctttgtgttcactatgatgtttttgattccctaaattgaattgtttaaaaatatattctagagttttaagaattaatattcaaataaaatagctaggctcaaatctagtcattcctcaagattttaagtttaaattctaacttaaattctgacttaaaaaattcaataataatttttaagtggcctttgaaaaatgtttcatcttatatgcaaaagcatttgattgatgtactgaaaagaaatcaaatatactacatttttagtaggggcagtttcatatgtttacaggagtttaattatctgctattaaaaaatctcaagcatttaatgcttaaaaattaaaaaaataaatttgttcaatcttaggtttattaaataacatatatgtatatatatgttatatatatgtgtgtgtgtatatatatatatatgtatataaaaccttggtagcatttcagttttacataagaagtttccattgtttacttgttacacattttaagtcataataaaaagactaaccggttacttaagtaggtcaaattctttaacacattagaactgctaaaaaaaccaacacgcatagattctttaacattaagacatttacctaattgttgattattttaaacatgtgcttatatatgcctgggcttaagtgatacttatccacttgaaacacatttgtcttctaaactaactgaaattacttattagtcaaaggttttggctgggactatggctagattcttatttgcagccatcatgcaacataatcctatttatagtctatgtaagggcttaataaattagggaagttcatgtcattgttgttatagcccacacaactcatctaactcatgtaatctaagtgtttaacatcccttagatgcaaatgacacattacccaattctctctgcaaccatgcagcttttaatatttgattaaaattttgcatttcttgattcttaacatatttgaataacttgtcatgccactttatttctgatttgacagaatcttgcattttctcccattcttctggtctggtaggaccatggaattcttacagatttaaaatgttatctgacgagggggaatttctatattacaagagactaatggaatataacaaccaaatgtaatacatcatccttttcacttagttgtattatctccttggactctttttagggtttactggattgggggggaaagttatataatatattttttatgaattgagaaagtttgactatgacttgatattggatgctcttatgaattaattgtaactttcttgcgattgataatgccattgtggttatgtggagaaggcccttattcttgagatgtgtgctggaatatggatcaaaatgtctaaaactaacttccaaatgactcagtatccaccaccaccacaacagatagatggatggatagatagatagatgtacatatgtttggataaatacatagataaaaaagatgagaaatgcaatatctaattggaatctccacatctcaaggctgtattagactctgttatagtcctagtttctgagaatgtaacttgtgagtcattcttgattcctttttcgtactcactctgcacctagaatgcaacaagtcctgttatttccttttcaaaataatattttaaatatgtttactttaatgcacccctagtattataacagtagcactcaattcaaaagtcttcaatgattttccattccacttaggagaaaaggtgtagcccggccctgctgcctacagggagacaacttctggccctctcctcctagctcaggatgatggactttcttccaaaaaagtttcacaaagtattgactgttttgacatttgaggatctgtggtcatgcgatgaatgctacctagttcaccttgctccagccttcatctgactaacttgactcagtccttcaatacttttcaactgttgcatttctcagaaagtcttttcctgacacctgccatctaaattaggatctactgtgctttacttttctttcatagcactttcctaacatattttgcaaacattttttaatgtgcttgattattaatttaataactccctctgtctatagtctataagctctgtgtgggtaaagcttatgtttgttttgcttacttctgacttcccaagaccttgagtccaatgcttagaaactgctcaccaaaaatatgtgaaataaataattaattaacagaaatctcaaagagaggagtactataggaaaaagagctgttttattcttaggaaagggttgacaaagatgtgaaattatattgccattattcattgttggtacccatgaacatacatttgaatatcggggagtgggtttatattcagccaaaagatactggcattttgtcccttgtgattgattcctgtgctgtgccttctcataaatattttgcctatcatctctattgagaaagaaatatttttattctgatgtaataataccaatagtcaagttttcattggagggaaatgagcaattaagataactagtaaaattattattttattattaatttgttatgattacacttcatgaaaggaggaaggaagtcaatatgctagcatatcttcaaagctgcttcagaagaataaaatgtgcaaatatcttgaaaaggaacctggtgaattattaagggaaagcttttaaagtgacttagttccacctatcatttcacttactcccccaaaactcagattgtacaataaatgttctaaactaaacactgtagatcatttaaatgctgtagattacttaagaaaaccctcaacagaaagacaaatgaggaaggcaggcaaagggaaataaatgaacactcactttgtgtcagagaaaattggagtaggtttttctcttaggagcagcctttagcattcatatttccttatggtatacatcagcatcttaagagccataaaatttctgaatgtcttcttgttggctcaacatatttccttctttgtttgaggcattattctgaaagtacatggtgtgtttttttctttatttagcaagacaaggacattctacattaatgaatgtatatgtacataataatgaatatttccaatgaaggtcatatattttcatttttcttttaatatatatgttgactctaatgtgcaagtgcaagataaagataaagaatatagagcttcagtctagacaccccatcagagaacatgtttctttattaaggagttgtgatccttagcactttaaaactaatgatttagggccgggcatgatggctcatgcctgtaatcccagaattttgggaggccggggtgtgtggatcacctgaggtcaggagttcgcaaccagcctggccaacatggtgaaaccccgtctctattcaaaatacaaaaattagctggacgtggtggcggttgcctgtaatcccagctactcaggaggctgaggcaggagaatcacttgaactcaagaggcagaggctgcagtgagcccagattgtgccattgcactccagcctgggtgacaagaatgaaactctgtctcacaaacaaacaaacaaaaaacaataatgattttgaagggcgagttaatatgtacttttcctggagagaagactgtgtaacatcatgattcttagctgggcaatacagttgcctacctgtgtggctttagtgcccgtttacctaggatctattagttgtccaatgctggagtagagtttcatcctttaacttaaactttgatctctgttaaaatacacacatttttttctccttttttcctgagatcttttaatgtttccagtaatttaaaccttaatgaactgttgtgatcttttctgcagagcaggtttgagtgagtgatgcagaagcactgggtatgaggccatgcccctacaggaatggcagcctgtggagagtagctgctcagtaaatgcagtggagagccaagaattagaggactggggcctcaccgatgccaaagaactcatttcacatttttgtgaatctgtatgataaaaaactagctttagtttagtggggaaaagtgcataaatctcagattgatgtttaacatttgaagagatgatatttagtttgaattttctatttttctttccaactataacaacagatcagcctatatcaaggcaatgaaattaaggaaatttaaaagtttgataaattgttgaggtcatttgtctctgcaaaagttatttcttgagagcagataaaggcactttcgaacatgttcactttttttttcaggtcacaggggtgctatttaataaattacttttctcaggcactaagagccacctttattcatctgaaaaggttaatgcagatttttaaagtgtccaagttattcccaaagagtaatttgtgcactaggaaagtctattttatttgagaagtagctaaatggcaagaaaaaaaaagcaagtgaggtatacattatagacacatagatctgggttgttcataatcaatgttccccccagcaagcttcatttatatgggttagttatatatctctgaccactttatttaaaacttcaatatttcttccttccaccttagaacttcctactattcttcttgctttattcatctccatagcacttatcacaaatatactctatattttacttgtagattttggttccttctgacttagaagttagaatgtaagttctatgcagatatgcaataaaaatttttctgattgctgtacctcagcatccccccactccctggagagtaccagacacatataaacattcaataattatttgatcagtatacacaagaataaagcaatactgatcaaatttaccaagaaattgccaaatttccatttgatttagcattatatgcatcattttctggaaggcggtgccacataatagttgagggttgtttctgtagtcattgctccgggcgtgaatcctgattctaacagtggctgtctgcttagcattgggcaaattacttcagattactgtgccttagttttctcattccccagtatagggagaataaattgcctatctcatagttagaaaacacatataaaagtatttaaaacactctggtacacagtcagctcttaaaacttataagtattacattaaatcaatttttgaaaagaacaatattctttttctttttgtcttgagacggagtctcgctctgtcacccaggctggagtgcagtggcgtgatctcggctcactgcaagctccgcctcccgggttcaaggcattcttctgactcagcctcccgagtaactgggactaaggcacccgccaccacgcccggctaatttttttgtatttttttagaagagacgtggtttcaccgtgttagccaggatggtctcgatctcctgacctcgtgatacacccgcctcggcctcccaaagtgctgagattataggcgtgagccaccgcgcctggccaagaacaatgttctttatgcactcactgcctaatgaaatagagtcatgaaaattatgtagatattaaaaaatattttgtctcaatcatctgaattatttaattcagagcatatcttaagcatacattattaatataatttactttctgaaaattagtaggacattaattttatttgaaaacctccaatcaagtcaaagagaataatgtaataattccaaatgtcaagctcatttttgaattctgcattgccatttactatgtctgtgaccctgtgcgagtcaattaaaatatttaagctttggttttcacatttttaacatgagtaaaaattaaatctatgtaattagttgaatattaaacatagcacagtgcctggtacatacagtaacagatctcaataaaaagattaaacaaagattattttatattaaaatctaaagaccaatgtttgtgacagaactataccaattaatataaaattgaggaggaattaaaagtgcattatatttttctgactccaaatttaattctaagcaaagaaattagagatttatatgttggaagaagtcattttaaaaagaaaatttagtatgagaaatattgacatatttgacagcaaatcacttagcatatgacttccttttctattagtaacagtttatgagatacagatgtctctttttttacacaaacacttctgaatttcttaaaattcaacattttacttataatcctccttctcctccccattcccatcaatttaaacttatgaagattctaaataagaaacacatacaaaactcttttgcacacatatcttcaaggccattatcatctcagactgtggtattaatattttgtattattggatgtattagacaaggcattcttgtaaaccactattaaaatccaagcagagacattggttgctgcacttagatgtggtggagaaggtgaaaaatgcttctgctcagattctctgtcaagagtttgctggagccacagtgggacagcaagcaccttagattattccagagtaaaccacagaatcaggttctacattctgaaaagaaactccactaaacctttataaccagatcagagctaaaatacacatgtctggaattgcacctgcctaagatctagggagcctgagcagccaggatgatatgtttttgaggaatgtaaagggtgttaacataatcccccaatcccatacaattcaatttcagaaaagtatttagggactgtgctaaaatagcatctccaagcttgctatggcaagatgatgctcaggttttccatgtgcaggggaaatgatgaaggtaaggttgaggatgggaaatttgcaagataatagttcatcagtttgttttaacttacagttgaactataaagaaggcttgaaaatgtcgtaagccctgccaagactatagagattcaaaatagggatactgcctttataagagatatgggtgtccttttaaaattccttgcctaatgtgccttaatattaaaacacagatcagcacaaatatcattgtaactcaaatagagattcaaccaattagggatgtcactagcccatgagacactttgtattgtagcttagctctagagtacatggctagtccaaagaagttcagacctagacattgttttcctgcattggatgcccttgtggagggtacgacctgcacatcaatatgtggtggccttgaaactaagttttcaatgccttctgtatgtccaaactatactatactttatgcacttatactttgtaaagtctatgatcatcatcttgatttttttttttttttttttttctgagacggagtcttgctctgtagcccaggctggagtgcagtggcgagatctcagctcactgtaagctccgcctcctgggttcaccccattctcctgcctcagcctcccgagtagctgggactacaggctcccgccaccacgcccggctaattttttgtatttttactagagacggtgtttcaccgtattagccaggatgatctcgatctcctgacctcatgatccacccgcctcggcctcccagagtgctgggattacgggcgtgagccaccacgcctggccattatcttgatttttaaatgacaaatctacagaatggctgagaagggatttatctgaatctatacctgctaacataaaaatcaatatattttctgttaaagaaagctgccttctacttccacctcgtattcattaaaaaatggttagggtattaatcactatgaaagtgctgtaggttttgttaaggagagtaggacagtgtcatgcctttttgggacaacctgagatgtgatttaaagctttaaggctaagagtttactacttgttctcagtgagctgtttcaattaacatgagtttttcatttatttttggccaacacaaatgtgtctagtttagtcaataataatttttttgctgttttcacaatgagaaataaacaattctctctgtctcttttttaaaaataattttatttctcataatgccccattataaaatatatctataaagaaaattgtattaattacatcaaaattgtttactcattataaatgaacagatctattaaaagatacacaaagtaaaaagctaaagaaaacagctgatgataaatggcaataaagaaaatcttaaatttaataacagatgaaatttaggtagcttgttcaacaaactttactatcagaaagacttagggttgaattctagttcctccacttcattttcacgtcatttaaaccttctgagactcattcttttctctgtacatgcagtaataattgtaacctcacccatcattataaaaaatataaatgagcagctataggaaagttatctggcacaaagtgccttctttgtgcaaagtgtacattcagtaaatgttattttctcctgtgaaaaatatatgttagctagaaagcatttcagaaccacaaaataactcaccaacttaaattcctgattctgtaatttcttaggatacacctctgtgttggggacaacagtgtgggtctagagtttccaatgtcttccaggagttcttgggacccatcatgagaaggaagtggtggagcatggagcatggaataaatgtgggtgcagtggagtgtattgcttattcaggcttctttcttttctagtgtcttccaaagactccaaaagagcaagactgtcttattctagttgaagtatcttgaggagctagataatgatggcgcaggtatggccaagagctcctagggtctgggtcagccactggtgtgagccttttgcttatggactgtcacaggcaatcagaactaactaggcatatggctgttctctccaaagtctttagatctgtgcccgagtactgtgtgatagtgccaaaggaaggaagttcctgctgaattaatattttttttcagtcgatttttgagagtgagcatgactttctttcccacatcctcaccaaagtgactttattcactgtaaacttgttattctgaaatgatgattcaaaagcaagatgtgtttccttccttttcctaaagacttgattaattatctaagggtagatttttaaggacagctaaaacaccattttccttccaaaacccaagcttttaaaatccactaaattatttgagtaaaccacttgcaattttattttctttttgctttttatgcgtagaccaagaccaccaacccaaaagattcttttcagtgtacaaactatgctctgagaataagttaggtattcctgaaagatgttttaactctatcaggccaatgaatgggcatccaggaaaaagaattattaaacgcaaaactgactggtgtttaagtaaaagtccatttctatttaactgttcaacccacactgatacatttaaaaaaatcttccattactttatcctaagaattcaacgttttcttatgtctgtatcagtccttactacccaccaaggagcagttgtgggaggaactgcaatgttgttcacacacagagtattttcctgttcttccttttgctttatcactatgtttcctaagaaaatgacacacaaaccattgattttgaaaagttgcagtagtctggaattcttctgttgggggagacttttttctgttttctgttaagggaaagttgttatttggtcattaagattattgagattcctcttagaatcaagtatccaacatttaaattcctctgactatatacttgttggtattgtaaaaagtagactcatctccaaattagtctgcctagttatgctattccaatctgctagatacttggtttgcgttcttcctatgcataataaagaagtttccttttgtaaactttatgatttataccttagctcttctactatgaaaatctagctttgtcacccttagccaacaggaggcaatgatgaaaacaatattgaaatgttgtaacccaaatatctgcctttactaccgataatcctcagttatttcgtgagctttggctgcatggatgtaaactgcttatccaacagtgagctgagatcagcctcagtttttccagtaagtaggagtgaaggagttaagtgggagtgtccacatgatagatatctcttttccaggttttgcaatggaacaaatatggttgctgctgcttctaacaattagagtgcttccggggtctgctcagttcaacggctacaactgtgatgccaacctccacagtagatttcctggtaagtgtaagcctaatctattctctagttgtttctggaagagtgattatatttgaagagcaagtcatttaaatatatatggagaacggggggctatctctttacattaagtggatattaacaaatggcaaatgacaagacatttttctggagctgtaatttatatccatattaacatacaaagtgttcatcatagttaatattattataatggctgctcacagatatgaaaaatattgcctactgtgtaaaaaattgggagagactaatttcattcaaaatttgtgtctttttttctcataaattaatttagactttaaagaactgctcttaaatgctaatatttatttaggaataatcttaagaaaatgattgtaaaatattgtacaatacaaaaaaatgctatttcaatgaaatgatgattaccacaaaggacacaggtgagcttcagaatgaatttcacagaaacccatcaacgttgtgacaaatacgagatttggcaacattgatgggcatgtcccacaggtttctaaaacctgcattcaatgataagttactcaaggttttacctaggtattcatcattttatattagctaaagtaatggaaccacagttcaacatttacaaaataaatattaggtaattggaaacaattttccaagtctgccatgcaaatggaatctctttggccgtggtttacattctcaaaacctgccagtcctcctgtgtttggagcatgctatgaaacagcaaacctgcatagagcaatcagtaggtagttacatagataaagtgcgatttctacaacagagcccacatcagaaattgtctgaatgtcttcatgaacttagacctaggatgtaagtgcttggtttgttagtaaaatatgaaggtcacggtgggaatgaccaaaggaattcaagaaaaatttgctaaggcagagttgttaatggctttgaatatcaaaaatgagctttttttacatttattattatggaaaacttcaaacatacaaaagtagaggttagtagaaagagcactcatattgattatctagcgttatcaattatcaacatttataaattttgtttgatctttgtccttaccactcccatctctggcatatttaaaataaatgcattattcatgctttggtgtttatatgtgatggaaaagaacttaaaaatcattatcctttacgtatacgtctaataagcccaacagtaatttcttaatatcattaaatgcagccaagttgcttctaaaatcttcacatagagtatttgttgatatatcttttatttcattttgttttataacagttctcctctgtcctttgcttttacaaaatgctgtttatctctttgagcagtttggtcatttgtcttgtagagttctgacaccggatttggccaactgcaactctgaggtgtcattgaacaggctcctttttcctgtctatcctgtaaaccaatgagagctagaagtttaagtaaattcaagtcaattattttggtgagaacatgtgttatgtagtgtaataaaagtgttttctcttaattttgaatgcaatcaagagtcactgagtctttttaaacatatcttttaagaggtttgatgtggtcacattttgttttaggaagagacattaggacaagtgtgtaagatagaatcaagttagaatagactagaggcagagagaaatatcctgaaggcagtggcagtggaagcattacaaggggacagttattaagagatatttttgtggtagactcagcagaaatggagaattgatttggtttgggaggtgagagaaagagaagattaaaggatgtttttaactggaacaactggatgttgatgctgttaactgacaaaaaaaacataggacacttgcatgttttagaaaggaagttcaagtttggaaatgatgggcttgaggcatttttagaatatatagtggcagtttcttttattcagtagtaggaaatacagagctgggtctgagaagaaagatcaaaactgaagattgctgtatgagagtttattccctgtgcaatggataagcaatgagtagggagtaggaaaataaaaagtatgaaaatagactactatttagataacttttgtgattgggaaaaaaaaaaaaaaaaaaagaaaggagcaacctgagccaggaattgaaagaaaagaaaggagcaacctgaggcaggagttgaaatcaattcctgggactatagaggcctgagcatacatgagtaaagggagagtattaaaaaaatggaaattcaaataaagaataattgatgaaatgagaaaagaaaataccgaagcaatcaatggtacagatgaaggagttaaccttggaaaagtgtagttgtttgtttgatttaagtgagaaggagagataaagccacagttggagaaggtgagagatgctaattgtgttcagtccctcagtgtagtgggaggcagtggctctcatcagagtcgctggcggcctgggaagggtgatcaagccatgaccctgttatggatggataagaaggccaagtaataaaatgattgctcaacagagaagatctgactggtgtggtagttatatacttgtaaaggtgaataaggcatgttaaagagccatgaaataactatgacaggaaaacgaagtatttatcatatggtgaatttttaaaaaatcatgttaaaaagtctgtttacaatggcatctactgaccacctgtatcaaaatcatatgggctagttgttaaaagtggggactcaacttgtttcacctcaaataagtgatgttagaatctctgaatgtggtcttgggaatctgtatcttaaaccctgcagatgaatctaatgtacatttatggttaagaacaactgatagtgtattctatcattttcttgagccaattattccaattaaaagcacaattatttgttgtggaaatataactaaaaacaaaatcttctcccaacctagaaatcctctctgcctaggtagtagagaaataaaaacacttttatcattaaataagcattaaaccagaatgtgattcacatcacaggtaatcagtaagagattacaaaaacagaaagaaacctcgcccttatatatagccaagcagagacaactcattacatatgttttcaatatagacaataactagtcctcaagtaagaggacttgacaggaccatttgtcacacatatgaatcctcactttacctggtaagtagggtgaccatctgtgttagctgatttgttttatccagaggaaaaagtaacttctcatatctttatgacaggaggtaattttgcaatttggagcaaggctcacatcaaaattaggctcctaccctaagcgcagaaacagggacataaggctaccatctcccttgatgtttacatttcaaagagatgactctcagatccttgagaaagacattcctgggtcacaaagcttacaagaatcctatctagttttcaaaaggattaatacacacttcaaagagaggagaaagtacttctaattacaagttttctaaagtaaatgctgtcagaaaaagggaggaagtctcctcctctattttcaattatatttgtgttttgtttgtattttttcttacacacattagcactttaggtactatctggcttaggcaacaaacacccaaactttccagacatatattcataaacacatacacccataaacacacacacacacacacacacacacacacacacacacacacacagttacaattttaaaatttgtatttaaaaaacactaaatttgtattttaataacacaaatattaataaaatccaaataacgctgaagtcccgggagagactttatatttagatgggtattatttaacccatttttttggaggttgtttgcaaaaagaagatcagagtgagcaaataaagcctaaagattaattgcttactgccctcttgactctcagtatctcttccacatcacgatcacccttgatgtcatcaggagctccacaagctgctcggaggctaagcaatgggatggaatgagaatgagtctggcaaaggaaaggggctatctaaatgcaaagcaatgttaataatgatgagagcaatcatctcaccctatgtgacctttgctgtttcatgacattagaactattttctttaatttccatggcatttatcctgggaccaagagaagcaccatggtctaattcatttaaatttaaaggaatgccatttaattttagaggtggttaactcttggttatccaagctaatagcaaaaagcagactcatgaaccactaaaattacagttgtgatgattctagaataaaactcaaagtatagttgaatttagagtaccaaggaattatttggttaaagtaaaacatacagatgaatgtacttggcctttgtgactagtgtatattttccgaagccaggcccccttctttggaagtatatgaggattaggctaaactttctggcctctaaagaaatctttaatgataaaggcacatccaaagaggaaaatggccttatagcacaataaactttatggcttgacactgtcttatggtgaactaagtagtcatgggaaactgaatatgagtcagtgtttcataacatgtgatttcgtattatgctgtaaataatactaataaggaaacaagcaataagttccatgttttgagtaccaggcacctcacagaattctttcatttcttacaataaacttacaaaatctttttaaataccccctttacagtaggaaaactgaggatatacatttgttaaatattgcaaatctgcaaattaatagagattctttccatcaaacaatgatgtctaaaaatgaaatttgaatagtaagttttaaaaatgatgtatgtgtggagattctcaatggaaattgccacgtctaaggatctgaaaagtcatgtgttgggggaatttgtttagtcttttcaagacctgcttgactaaggaaatcttttattcggtaatatttttaatattttaatattcaatgaacacaagtgttccacaggaggtaaaattgagaatcaattatttaatcaatagaattcatgagtgagttcagtaaaatgaactgtctaattttatattaggctttgcttaaccatggcatttttctgtgcccaaagacaaagtaagagaggttagtggaatagttatcccagggaatatgttctggttctctgtatagaaaggaaaggccaattctcctttattcctactttttagtggtagtgctttggtctccaagttgtcaagaggatgcctgctttccactttgcacctgtgaaagcaattactacaacagatgaggcagaagaacagatccaggcagctattgctgatcacattctgattaatttacaatgataaagtgcagtggagaagatagcaattagcaaattcaatgagtaattcagggtccatattctcccatattttaataacagcattctttattgcatgaattttcactttttgtttttataaataaaacccatttgctttttttgctgcctgaaaaagatgaccaaacttttctggttccaaagaatgtggagcagcaagtgtgattataagtctgcaaagtttgcctcagactgcttatgaacttcctagagcactggaaacaacagcttgcatttgctaacgagaaacagatgttgtgatgaaagactgaggtggcacaaaacctgttcaatatacagaggaaacttgaattcctaatccactttaagttcttcatcagctgttggtatttcgtgtagatgaaatatcaatacccctttaggacttctagctcttttagcaccaaaacctcaatcttatataaaaacttggtaagagcaaattttaactttcaaaaatgaattaaaacaacatatgtagcatctgttctctaggcaatttgtaagcccatgtagtgccaaatatcaccactcttgttttagagataaaagcagaactgatatataaattattattatggtttaaaaagatggtataaattagtattggaatatttatcggagcccaggatgtaaattattttcaggtgagattttctaccatgccacaaagcactctgcagcatacagaaaagttttctcccactatattgaacagattgctgtttatactatcagttttaaaccaatactacttttaagtatatgcaaaccagtacatcaatactaatgtgatgatattcacaggaatctctgcatctgaaccgtacagagcctcctgcctgctcactgtggactagccactctacccccgtcctctccagttgcttctgattccccaagactgcatgtcacacatgctcaggaaaggtccacttaggttctttgctctggactccttgaccacagtgctacaggcaccaccactgccagaaatgcttttttatgaaaacactgccccgcttggtgtagctgccttttgatgtggactgctctgcttcctccgggtattaaactgctatggtttacagaatgagacagagatgggggtaagagaagaggctgatcctgttcccaattttgtttcacacactgccactggagcactaaaggaggcttacttagacttagccttaccgagcattttatgagccttctttcattgagattcaaaaccagtcagttcttcagatgagagagggagtcagatgcagttctaaccccttcatgattcttgtctctctccctcccgtcccttttacaaccaaacttttctctcttgtaagcatgtaaatcagacaaatagatatttgttaagaggcttaaactcaccaggtgaaatccacctatgagctatcttctgtccagtcaaaatacaaagctgtgacttagcacctgaattgactgagaagttgtaacatcagcatcacctggaggcttgtaagaaatgccaaaactcaggccccagctcagatccactgaatcagaatctgtatttttataagattctttggtgattcatctgcacagtaaagtataagaagtgctggttagaacatggtacccatgatagtctgctagctttatgttgttacaaaaccacacagtatttacactagccccagctggccatcatgcacttgcttgctgttaatagtaataggtatcaacaaacctatcactgttaaaaattcatttttaatggggtaagataactagtcaccaaggctaatacacttaaagagataaaatacaaataaacaaattgcaataatctattaattttatattatttaatgagttgcattttctcaatttgaaggtagacattaaggattttgatgttcattgaaaactgaaaacagaggcatcatctcaggcagttggcagaatacagatagatgaacattcaagatgaacccatatcaactgtatacatattttgtttgtaaatgttggaacttgatattaaagacttacacaccattgaaataaatgtattttaataaatatttgctgagtatttgttatacactctaggaaaacccagaacactctattagtttataatttaacaggaaagtaaatatccactctccgatataatgtaagtgagacagtagacccacagttaaagtgagataggatagaacatgacgggatgattacactccattgggaaaattacagaaaggctcatcagaggtcagctttgaaattatttttctgttttaagtttatttctcttcttatctgaatactctcattggtaatttcagctattactattattattgatatactgaatatttggtgattctcaaatttgtatttcttgttttctgtccccaaatattagactcatatttccaactatctgctgtacatttctgcttgaatgtctcatatgtaactcagcctctcaaagactgagcttatcatctttctccctgaatttttttatcttagggcataatccacccactcatcaaagctacaaacctacacatcagtgacatccctttttcttcatgcagtcttctaatcacttccttatagaatctaaccagttggaactattttatttcttcctaacaattcctttcaaacacctctttgctaccaagacaagtttgtttataatgttgtttacaaatctctagtatatcattatcaggctgtattgtaattgcttacttttcttctgtcttctttattcagtaagctccttgaagaaacagggtcttttgttaatgttgttatctcaaagtctagcacagagactggcacatgatatgtacacaataaatgctttcctgaaacacgttgttgatatgaagtggcatgtagtttagatcttgaaaataagtaaaaccaattgcctctagactagtagaaaatttatggtactgatttttcatgtttgattcttgtgcatctcatctttttttttcctttgagacagagtctcgctctgtcgccaggctggagtgcagtggcacactctcggctcactgcaacctctgcctcctgggttcaagccattcttgtgcctcagcctcccaagtagctgggattacagacatgcgtgaccacacctggctaatttttgtatttttagtagaaatggggtttcaccatgttggccaggatggtcttgatctcttgaccttgtgatccacccacttcggccttcctaagtgctgggattacaagcgtgagccaccacacctggcctccccatcctttttcttttacactatacactgacctccagaatttcgtttcatacagatgtttactttttcagatcaatgatgaagaaatatcttgagtcattgcactacagtgctgagttccagcctacagccaaattttggagtgttgccatctttgtattgcagaatacatatgtgcaaattctttgaataatttattaatctgtactcattattctataaaataactggaaaatattaagcattctgatgctagtgaagggaaatgaaggctccaacagtactgagatgaactgaaaatgatgcagtctatcaaaagcctcaccatgagcctcagttgaatgctgttagatttaagtaaggtcagtataaaattgttaaaacaagaacaaagttagatatattattagatatgtaaataatacaatgcaaatatattttcagtaattgtatgtaaaggaaaaggtgtaattaaatgttctaggaatagaactttatagggggtaaagaagttgaatgaatccttatttatatatatagaactggatccataccttctttacttccatttatatagtaaccacattctatgaacctcaaatcaggacacattttatacacggagagacagatggctgataatgtgacaggatatttaaaatttgcaaaattttagaaaatctgagatacataaaaccattgcccgatagatggacgacagggtacagaacattatttttaccctattcagttgaatattcaattattgttaatttctatgaaaagcttagcttgattaatatcaggggaaaaacattgctgttttggcaatgtaactgcacataaactctgtctgcaggcctgccatttgacatacttagtatctttaagcataaaacattaaaaatcaaacccctaaagatatctactcattaggttgtttagtagtcttgaacatcataattcaggccagggattggacagtaaaaggcttaaaaagtgtagctgttgagagcaactgttattcagtgactgaaaaaactctctctccttttggcagaaattgccctttggcaacttgaggtatccttcttttttccttctcaaagcctcacaaatggtaaagttgtgctgaatggatgtctttagtacctacaaccaggaaaagaatgtgtttctctgaacactagtgaaaagtccttagaaaactgggttaggaaagatttggacagatctcttttcttacactgcagaaagcctttagtttgtcatcatatcttaaagtgggataagcctgtagcaaattcagtttcattgcaggagttacaaattggttataggaaaacagaaaagagcactacatctggtcacagtaatcatttgccatttgttgagatattctaagcattaattaatccccttaaacagagctgaggaaactggtctttagttggtttatgttaagaagaatgatacctctcttttgtgacatattcattaataggtattcactttggtatacttatggtatatcaaggagtgcaatgatacttgttctatttcaccaagcataaagtgaagttgtagtgaactctctaacagctgaggatttgatttgacatccaggtagatggtatcttaggccattttatgtataaaggttccctgcaatctcacctgtgcctaacacatgtcctcattgcctgctatttcctcttttgcattttaattacaaatggatgggaactacctggctcccagccagcctgagcatatttcattattcacatttgtcccctctgtgttataaaatttccactcctctatctagctaactcctactgatacttcaagactgagctaatgccatcttctccaggaagccattcctaaccagctggtctgggcaaagccggccttctacgctactccatagctctccacgcaatctttctgtcaatgtgggtcacgctaatgtgtctgtctcctctaatggactgtaatacacaggagttccctttatctgcagtttcattttcatagtttcagttaactgcaatcaactgtgttcagaaaatactaagtggaaaattccatatataaacaattcacacattttaaagtgtatgccgttatgagtagtgtaaagaaatctcacgcgattcagctccatcctgcccaggatgtgagtcatccctttgtccagcttatccatggtccattatctactagtcactgggagccatcttggttatcagattgactgtctcagcattgcattgctgtgttcaagtaatcctgattttacttaataatatttactcataataattattagcattattgttaatttcttactgtgcctaatttaaaaaatcaactttatcataggcatgtatatataggaaagaacatactatatatgtttcattataatctgtggtttcaggcacccactgggagtcctggaatgtatccctagaagacaagagaggactcctgtgcttgggaatatgatcactatgttttgaatcctcagtgcactctgttgctccagtaccttatatgattaattagctagttactcactggagtacattggttaatataaaacctttcctgcctatgggacttatagtttattaagaaaaatatacaaatacatatatgattctaaggcaatacgacagcataaaacagagtggcataccttagacttgggatcaggtcaagtatttgggtaaataaaatttgaaacctgaagaatgagtaggagttacttaggcaaagctttggggtaggcggagcattccaaacagaagaaagagcactgatacatgtactttgtgtgtgttcctgtattatgtttttaaaaatgccgtactgaggaataatttacatataataagatgtgccaatcttcagggtactgcttgaaatgttaacacatgtacatacttatatatcctccacccaaatcaagatagagaacatttttatctttcccccaattgttctcgtgctcctattgtaggcaattccaccccaggaggtaactacttttctggtttctatcactcaaggtgatgcatttaaagacatgaaaaatgttcagattcaaatttaggaagcaagattcatagaagagagagagagagggaggagcatgcagaggtaggcaggtaacagattatggagagacttgagcacctagttcaagatttggtcttttggcctatgtcaaaaagtagctgttgaaaatctgagcatgaggatgacacgactggattaatatattaacagctgtactaattgaaggacattaagactggaaataaaggaaccagttaggttcctggactagtacaatagtccaggggagagataatgatgtcatgagcaaaggaatagcatgtagatagagaaaaatcagtagatttaagatatagttcatagatactcataaacatttattaaaataaactgtattattttagaaaaaagtatcatttagaaattatctttgcatttaaatagttaatgttgccgaagtatgaagatacttgattttaagtagtgtttattattttctaggttggcaaagtatacttcataattaattcattatttttccaccaacaaaggaaatattgcgtcgaatttcctataacacctagccgtttgccttttggccatgaaaaagatttttcatctttctttataggtaattttaatgagtttaaacttattacaaaacatagacatttccatattgcttattcacattccccaaatatgactcactttgctaggaaaaaaacccagtatgtatatagaataaacactctaaagagataatgctattgaacatttctactgttaaattaggactgaattatttaagcaaattaattctatgctaaaaaacttgaatgaaatttacatactacttaggtgaacatgccatcattcaccaaaaatatgtgttattttgtttggttttcctcttttggacaatcaaggtcatttccccattgaaaagcataatcagtttttgtttgtttctacatgttgaaaacttgagtcttgtttcaggctttttatctaattggtataataaggtaataaaaaatggtaaagtcactctcttagttttctagggctgctgtaacaaagtatcacaaatgatgtgatttgagacaacagaaacttgtgtcctggggtgatttaaaacacagaaattcattgcctctcagttctggatgccagaagttcaaaatccaggcagggccatgctccctctgaaagtctgggaagaatcctttcttgtctcttcctagcttccagtggtttgccagcaaccttgggtgtgcctgggcttgtagatgcatcactccaatcctctgccttctcatggtttctccccgtgtctctgtctcttcattggatgtttcttttataaggacaccagtcatattgaattacaggttcattttaccccagtattacctcatcttacctaatttaatctgcaacaacctatttccaaataaagcctaaggtactgagggttagggcttcagcatatctttttttggggggacataattcaacctatagcaattaccaaaactgatgaatgtaaaataatctaccactagggaattacctaccagccactctccccatttcctttatacattttctacattacatgtagaaaaataaccaaatagagatatgaagaccgtgtgtgtgtgtgtgtgtgtgtgtgtgtgtgtgtgtgtgtgtgctcacttctatagacatggactagacctcgtcacagataacccatggagtcatggagaaccatgcaaattgtgttttacatttccatgtttaggtcatttttttttttttttttactgaggcatgcatagtcattggcaaaattttcctacagtgagctgtgcatttttgttcataatatcaacactatttttttattccctttctctctagtgttatttaatttaggcaaaataaaattgaaatctgatggatggcttttatttatacaacccataagatgggttaccaaatgccaaagtacttgacaatttggtttagggtggatttcaactgctttctccttatacttgggaaaatgcatcatttgtagtgattttcactactcttgacaggtgatctgaataatccagttgctctaggtctgaatttcctcagtaacctgattggtttccactcaattctctggtcatttggcaatacttgatcaacacttaatgtacatccactggacatcaagcacaaggaaacagaggtgaactgtaatctctacactcaaagatctctccttaaataactaaataaaaggctatttttcttgtctactttacttaatagctggcacattggattatggtgtatcaaatataaaaatgagttaaacagacaaaggagatgaataaatatatcagtaggatgttaatgttatttatctttctgcttttctgacttatgtttgttttttatatatttttatttcagctgaaagagacatcagtgtctattgtggagtgcaggctattacgatgaagattaatttttgcacggtacttttctcgggttattcggaaacagatctggcactgaatggaaggcatggggactcccactgcagagggttcatcaataacaacacctttccagcagtggtcatttttatcatcaatctcagcaccttggagggctgtggaaacaacctggtggtaagattagtgtgacattgtgtgctaggtctggggtcataaataaaaatctccccatttcatgaaagaataagatgcccaatctatctcttgagaaaaaaaataaaattgaacaaatcactttcctttgcctgtttgaggcatgcactagcaaatatacaattctatcttccaataatggttatgtttatagtagtggggcagtcaaagggtctgaggtcagctgtgcccctctaagcagcattattttgtgtgagtgacactgacggatctgtctctacagtttagcattagccatattcctcaggctttataagaaatatctgaccattcaaacaatatttgttccagtgagtctggcagtgaaccgcttggcctgttctttcagtgacctcatttgtaaagaaagacgaaagatagaatgggaagcttgtaatcttctttcatgcttaccattgaatgatcaacactagtgctttgtaaaaaggggctgtcagtatttctggtataatattcttaaatgtgtgggattgtcctttgaatttcaaaatgtttatcatatccagtcttaccatgaaatcccagtagcacactctctctagtcattgtgaaaattgaaacatctcttcaaacatttccaccctgaattagaaatactagtttgtagcattcatttgtttactaatgcattgaacaccaaaaatagagttaaataaggaattgactctccagtgaattaaaattaatagaagtgaatatattgtgatttgacaggagtattagttaaatagttatactgaaattcacttagtactattttttattttgcttatttaaatataatcttattggtaaatttgcaaatataaaaaggaagtgcaataaacataaccacttagcccagggaaggagatattgacttttactcttcacaaattattattttgtattaaggagaaaggattgattattccaaggccagggtttctgagactcagtgggagatggaagacagagaaaatagatttctttgaatcttgttctttatcttttcccagagggcagttagaatattgtgcccgtgaccatttccaagcctgcagcttgagtattgttgactctttttattaaaaacgtttattcaactctctgagttgtgtgcagagaggttatgaagtggacctaagggagagtgatgcaggttgattattacaagtccctgttctgtgtggaaggaaagagcctatgtggagatgagcagcatttccctgtctcccaccatgccctgaagcctttccttccctttcttgtctggatgtgtcaccttgccctgctgcctagaaaatgattcaggagaaaagccaggaaaagtgtgcaatgtgtgtgctgtttacctttttaaaaagctgaataagtccgctataaaaattgctaggctgggcacagtggctaactcctgtaatcccagcactttgtggggccaaggtgggcagatcacctgaggtcaggagttcgagaccagcctggccaacacggtgaaaccccacctctgctaaaaatacaaaaattagctgggcatggtggcgtgtgcctctaatcccagctacttgggaggctgaggcaggagaatcatttgaacttaagaggcggaggttgcagtgagccgagattacacaactgtactccagcctgggtgacagagtgagactttgtctcacacacacacaaaaaattgctatatacatgtatgtatgtattttattttcatagacagaattggttggtttagctatcaaataaagcaagtagtgggaggaggggaagatttgcttatctttcatttttgccttaggtgctaccagctttggcaactgctctaagatcattccttcatgggaaaaaaattaagttggctactaagtctctggattggaataatgatgttttcattcataaagattcttgtcccatttatcaattaactagataattgccacagctttgcccatgtgctgttaggttcatgcataaagtttactctattgttgaaaattatcacaggtcttagtaatatagtagtatctgctcaaatatttattgagtgctctcttgtatttgacaaggtcgaagaagctagaagaactctctggtattatgaaggtcaaaaaattattgattattcctaaagtggtggatcttaaattttagtaagactggagaattcaaggaaagctaagcagaccctagaaaatacacatggacaacatttttacataacttctgaaagttcttgaacccccaaaacccatctataagctattgtcctagaagtagataagtatctttatgaactagagaggaagaccctgagaagattaatcctcagaaaatttatgatcttcattcatttgtttgaaaatcctttctggggcccaaaatgctgatcgctgtgctatgctgagtttgcaaaggtggacaagatggtccctgcccacaaagggtgttgatgatggctgagggaactgcccagcgagcaggctgctcttcctctgcctactaatatgatggagataaacattgcatatggggagtcaggggaatttcttagggaaggtgagatcctggggaggagtaggatacatcatgggaaagtggggagagtgacagcattatcatcaagagttggagcctggagatatgaagctaaagggaaaaggatcatattaacagggtttttttcagccatgccagagaattttggcttcatccatgagtgttttcaaattacttattgtaacccttcgaacctataatctcctttcttttttataaagtatgagtaaagtgtctttggtaaatatgaagtttcatttacttacatgtcacttataaattgcatttctcacttataaacttgatatttcaaaaccttctcattttatagttgaactagactctagaatagattttgcttaatgttttattttgcatatgaagtgcctagatgtatatatagccatttaatcattaaactgcatctaacattctaacaggtatccacaattcctggagtcagtgcttatggaaatgcaacttcagtgcaagtaggaaatatttcaggatatattgatactccagacccaccaacaatcatcagctatctacctgggcttctttacaaatttagttgtagttatccattggaatacctggttaataatacccagcttgcttcgtaagtttgcattttattcctgctttctcatattgcatttttgcttcaggcatttcgtatctttcagggacttagaaagatagcaggatttattaaaaatagttaaattcaaacaatgtaatgggaaacatattatgtctaatatatttacctctatctgtttatctattatatctatctatctatctatctatctatctatctatctatctatctatctctaattgttatgatccataacagacccaaaccagtttttcccccaaatcaagctgactcaaactagccagttgtctgccttgggttctcttcactccctttgcccaagagccttgggtgtttcatggccctggaggccctgtggcgtctccagtgtgtacgacatttggtaactacattgctgaattttgcttggcttccctcttggccatatgctttcactgctgggctgtgctaccccagattctgggatctccattcctctgttgagctgtcacctggaagggtgctcatgattctcccagaaacatggcatggcctttaggcaaggagctccaaatacggactgagggtgtagccttctgtttatattcacgtatgcattatttccaaagcacgtactccaggagagggctatgcccacattaaaatataatcacctggatttgttgaatatttttgacaaaatgggatgattaagcgaacgctttctccaattttaggatttgctattattaagtcttagttattgcttaatcttagttatgaggaaatgtggaggccacattctacttcattgaaaaaatattcatagctggttttaatagcacagtaatgataagcaccttggtcagaagcaagactttgacatggaaaatgagaaaggaaaggcctcgagtcaaaacaatatgggtgtacagggaagcatctctcactctgcccccagtccacacactgaacacattcttgagtttcaattccatggaaattcattgattattcaatttatcatttacctactatttaccatccaatgttctagcaatgaacaaagtaaaccagattccctgatctcatgaaacttctattctaatggaattgatgaaagtgtatttgcattagattcaagcccttatctgccaaaagcctgttaaaagtaatgcaaaacaaacaaaaaagattgctttaaaaataaaatgatcataaagaatagcttgtctttacttgttccctcttgcttttttagtattttatctgttcagagatttaaacagtatagcaactccaggtataattaacagtatgtcagaattattcaggagttttagtgctttaagtctaacatctaggtatcacttttactctaaaatctcatcagtgctttcctttttctaaatgtgttttaggtcctcagcggctatttctgtgagagagaacaatggcacatttgtcagcactttgaacctgctcctttataacgtaagttgatgggtgaaggatgttattttctctttcactgttgtgaggagtcatttatgtgaatggcttttatataaaaatctactgaaagccacattaaccctgttatgccttggtaacatttatctatttttgctaccattttcatatatcttagtgataaaggtataataatatctccattaaattttctaaaagttgatataagatttaaattttatatcgtaagtgtgattttaaataattacttcaaatgtctacctacatttacatgtatttatttgtttatttaggtaggggtgtgtgagtagctacagttagcttcaagatttaggaaatatatattttttttatgtgtgatacaaagattttaacagtacaaatggtgtttcccttggaggcatccttggtgatgaatgtgttaatattttcaatatgggttttggctgatgacaattctgtcacatctgaaataatttggattgactacatagcattatctaaatttttgtcatgtaaatatcgacattggcagcaaaacgtgaaaaatacatggatttctatttatacctctgacattaatcccccaaatgatattttgatgttgattaaaaatttttattcatacattttaaatgcctgatttaaatatcaatttttcaatctatcaaccaacatttctgtaaattatgaatcggatttttgcattattattcatgtcatcatggcactgagttataattcatgcaactgatttaaaagtcagtgctttatactttgaatataatgagctataaatattgtagtaggacattttccaaaggcatttaaaaaaatcatgtttataagtttgtagtctgacaccacagagttctaaacaacaaattaaaatgtgttagaatcaagattgcctttctgtcgtttctaaactttcttctgcaaagagaagctgtcggccgggtgctgtggctcacgcctgtaatcccagcactttgggaggccgaggcgggtggatcacgaggtcaggagatcgagaccatcctggctaacacggtgaaaccctgtctctactaaaaaatacaaaaaattagccgggcgtggtggcgggcacctgtagtcccagctactcgggaggctgaggcaggagaatggcgtgaacccgggaggcggaggttgcagggagccgagatagcaccactgcactccagcctgggagacagagcgagactccgtctcaaaaaaaaaaaaaaaaaaaaaaaaaaaaaaggaagctgccaagatacttggttctacaatactcagcaagcgtgtgccagtattcacttttgatatggtcagatatttactattgttgttaacaatatttatataactttaaactggaaaattcccgtctgttaatttatatgcataagctgtctgagcttgagttgagattactagttggatttaatattatttgttctaattgagtgagacaaagatgagaattcctgattctaaaaaactgaaaaatatgatccatatgacatgtaatgatactattattttctgtgaaattaaactattctctcactgaaatagcagaaaatcaaaattttgaagtgtggatttcaggaaggctttgttattaaggtctttcttttatcattaagagatggtactgtagttctgttgctaacaaggtataatccttaaaagaatctctgaaattgtaatgcttaaaaaagcctataattagatgataaccttaatattttaattatacgataaccaattttttgatattagactacaagtgaaatagatggtgccaaaatacttctctttttaaatcagttatagagcagttttagtttggcagaaaagttgattagaaagtacagagttcccacatataccccctccccttgcacatatttttttctattatttacatcttgtgttagtgtgaaacatttgttacaattaataaaccaatattgatacattattaaccaaagtccatagttgacatttcttttatgtttaggttactcttcctcttgtacattctatgggttttgacaaatataaagtggcatttgctcatcattgctgtataatacagaagagtttcaatgcctcaaactaaaaattttttaacacagtgtcatcatagtattttgccattttacaggatttttaaaaattagtaatttaccctagaaaaaattttgatatactttcattagttgatccaaaatcatacttattatttttgaaatattaacatgtagctagccagatgtaattttattgtagcattccaaataaaatattataatcttttgaagccattaattcctatttcacatggaatgttttttatttctaacccttgaggataatgaaattttatattacatcccaactactttcattttctgatttgttatttggagaggaaaagttgcactcagttcgatgtagcacaatagtttatttttatgtgctctgggattcagtaagtatactgaggggaaattatatttagaaaaccaatgacttctatcagctatgtgattttcatatatgcagattaccagttgaactgtggctttattttgtgcaatataaatatgtcagttttgttcattgtggaaatggaaagtaaggatgcctttgtgtattggaattctacctaaatgttagattcttctgagagtgtggagagtcagcaaatattaaataaggttattataattatgaacattttttaaatgttggagaaaaattaaaatggatataattgattttagggacaatatattactaatgagtaaaagccaccatacaaattaaagtcagaaaattacctcttagaagcaattccagtaggaaaaaattgatgattcataattaaatcacaggtggatcatatgtcatttgcaaaatgactcagcaatataatgttgtaaagaaagtaagcattcttctgcacaataatgatgcaaatataagatgaaagggctgtatagttaatgaagtgtagattatttggagaagttggaaaagggagcctgaaagataatcacataaaaatactacctatcagacatggttagaggagctaatcatttatcaccaaaatatagaaaacaaaagactgaagagtatcagtttttaagtatatctcttatatatttggctttatttggcaataaaatgtttcgtattaactttttttccaaaaatgaagcatcccaactattactgtcttaaattataaaattcaaaatattttgctttcttccaagccttctaaagatattatggttgatatgttgtctttcccaatgattttaagattttataatgaacattaaaacttttctgccaaacagcaatgtcttcagaattactaagtttagggaaacaattggcctctgttaaatgatgtgactgcttaaatttggagggtttttttggtttgttttttgcactctattttttctggttttcttcattatcaaattatacctgctacttcttaatttctaatccgatgctttaatctactgtggatttgagaatgatacaaataagctctctagaactggtccaaaataagggtagaaaagtaaaaatgaagtcctgagatacccttctataagtgacctctaaagaatttgtgcaggaaccatatggcatgtattttagcagcttggagtctgtgtttgtctcaaaagctgaatcttgccctataaaaaatgtaatgagtaaatgtctcattttggttttctgtgtattattatttaaagcttgcatcttgaagatattgatacattctagaaatttggttctcctgtagtttcttctattctccctagaagaaaatttctattcttctgtgactttaaaatggtcttactttggttttcaattaaactttaacaatttcaatttgccaggtaagtgatttttggtaaataaaatattatcagaagtataagaactacagtgcctacagtaaagggcttaaatttaaacagatataatttaaataaactcaatattagtctctaatataatcaaataaatggaacattaatttaagtaaactaaatattgaccattgaatattaaccaaactgaatattaactagtgaccactgaatataatttagatacagtgaacattagccaccatatatggtaaactatggaaacaaaaagattcacacatggaatcaatttgttacatggatatggcttaataacagttctgccaagaaaccagagggtcacgtaaatcctttttggattgattctgtaggtttatgttgatttactttcttttttctctctctaatattgttgttttaagtagtaagtgtgctgttgttggggaggtaataatagattttttattgtttcatcattaggattcaacctacaaccagcagttaattatccccagtataggattacctttgaaaaccaaagtatttgcagctgtccaagccactaatttggatggcaggtaatttcaaactcttgtcttttttaggttaaaactctttgactgcctaaatcctcatgagtcataaagttgggccattcatttttaaattcagtttgaaaatattatcattgccacaccatttaggcatgctactaaaaagaaataacagattacaaagtttaagaggttacactcatgttctgtcattaattggagaataacaagtcttcccataaagaaggggggtggttcttggaacggggcatgggaagatctgggatgccgaaatgttgtatctcttcatcagaaagatgattaaccaaatgtagtcattctgtgaacacttgatttgcttgcttttccatatgtatgttactcttcaatatgaatttattaaagaatgaaaggactctgcataagagtgtgtcaaaattacataaaatgatctccagaaacatctctataaaaaaactattaaatttcagatgatacttaagaaaattcagagcaatcaaactaaaatggagctcaaaagctgaagctctaaccgtgccctataaaaaaatgtaatgtgaaaatggcctgttttgggttgcttatgtattactatttaaactttgcatcctgaagagattggtatactctataaatttagttcttctttaccttctcccttcctgtcctgaagaatatttctattcttgtatgagtctttaaaattgtcctttaataatgcaggagttttttccatttcattggcattcgcttcccatggattagtattttttttataacatcggagttggaatggactaatgtataaatgtgagcaaaatctaaccttgtggaggaaggctgtggatatgtatgtgcctcatggctttcttcaccctaacacagtgtctattgtggactccacaatcgccaaaccactgattctgatatacaatttatgctctaaactcctttgttgtatttggtattataacattctctgattctgttagagacagtaatatctagaaacaaaaagctattgtttatagtgaacatataagcatctatgtagctcattttaaagtttacttctcagactttgaccattcagttgtcttgtacacaattattttatggcattagacttgactccccttaatgtgaaattgacaatttggtgcagatttttaaacactttgagttcaggagaaagttcttactttttaaaaacttgtatgggtacatagtaggtgtatatatttatggggtacttgagatgttttgatacaggcatgcatgtgaaataagcaggatggaataagagaaagttttaatgaacaataaacttccgcaaataacaagtaataaacaattatattccatgagataagaagtttgtcaggcaagcgcggtggctcacgcctgtaatcccagcactttgggaggccgaggagggtggatcacgaggtcaagagattgagaccatcctggttaacccggtgaaaccccgtctctattaaaaatacaaaaaaaaaaaaaaaaaatagccgggcttggtggcgggcgcctgtagtcccagctactcgggaggctgaggcaggagaatgtcgtgaacccaggaggcggagcttgcagtgagccgaggtggtgccactgcactccagtctgggcaacggaacaagactccgtctcaaaaaaagaaaagaaagaaagaaggaaaaagaagtttctcaatatttacttcccttgtattagtaactaatatccaaaaggaaattctgactctagattatgtttgcttacattctttcagatggaatgttttaatggattattgctatactaccccatcaggaaacccaaatgatgacattcgatatgatcttttccttaggtaagacttagctgtctaagtattatattgataccaatgacccagttgtagataattgaaatggaatatctaagtcagataaattataaagcactattatagcttttgaatttcaagttttacattttgaactttgagtccttataaagctgaaagtataaaatttgagagcagttatcaacacaaaatgctgataaggctattgttgaatcagagttctaagtaagttatgtccaccaaagatgttttattcatgtttaggaatatgggaatatttcactgtcttaggaaacgcatagttaggatattattcgcaggaaaagaaatgcaatagaggttactatttatctgcaactagactgtctcatatgtcaaaaggagagtaaaattaaagtaatggtctggataatttagaccccaaaatacttttgttcatttatcagtatttagtataaaactataatataacctaccactccttttcttattagagccaataacttcatcctccttccccaatagacagtgatatagagtgaatgtaatatatatctgggaaaaaaggacattgatcataaaaccattcaatcatctcagttccttttcagcattttttatctgacagctgaacagacttgagagtcaagcaatgtcttctaatcatgcttataaattgcaattggctcagctcactgcagctaattgacacatgatggaagtaatataatgggaaaccaaaagaatacactttattggctaatcaagggcaagatgatgttcagagggtatggtcaaactgttattcttacatatcctatttctggaaatgttaatttgagcaacatttttgggaaaaattgtcagtatgtatcaaaatacttaaaaatttcatattctttgattctagctttacaaattgggaaatatagtttaaaatatttatgacattctggtctatcagtgatatttaaaatagtaaaacatgggaacaaattatacattcagcaataaggaaatagctaggtgaattatggacaaccagtaagttgagagtccatacaggcactacaatcatataaagttatgtattagatagaaaaaaatggttggctttctcctaccttctccctttctgtcctattggtatttctatctttgaaaataattgattctttaacatttaaaggtattaaaatatcaaggaaaaggaacctaatatataattgtgtatataatgaacttcatttatataacagaaaagactgtaaagagaaacagcaaaaggctcacagtggttttttatgcttggtagggttatggattttttttgacatttctcttattttcccaaacttctataatcctcatatattgataatctggaatatgatcatcagacttctagtgtgaatatagaagcagcttagttctgaatcttttcagttttcttattggaaaccattcagagtgaaatgcataactaaagaaaaaaaatttcccaaatgtccttttttgtgaatctaggaggaaaagaaaacctagaaattctaaagtaaatgctagtgttggtgaaaacagttaagatcaagagaaaatgttgtaaaaagcagtgtagaagaggtggtaaggaaggcaaggaagaaaagtgggtgctgagggggtcttaagggagtcagctcccagaagcagctggagaaatacacacctagaaggaaagggcactactttgaatggaaactgctatccccagggctggggaatctgaagaaaaaacagtagagaatgctcagagcctcagaagtggcagatctcataaagtaccaggaaaagtataccttctaaaggtaaaggaatcgcctgggaaggcaggggctctgtccttggtggcaaggctggtgaataaacctcaggaacccagggctgatggtagaaccctgtgaatatcttttaagttcagtcagctgcacagttctgctatattcaaagaaagttgttattgaaaaacagaggagggagcccttgagttggggaaacccttaaggaaggtatttaccattccacattgccttaggggtcctaaaaattttaggtttagggaaatccaactctttcaaacttgaatgataaacagatgcaggtatttcttgcagtgttccaatattctacaggaaaaatatcgaaaatggcagaaaagaaaatttaaaggtgaattaaactcaccagaaaaatgctgccatggaatatataatatatacattcccacattaatttttaaaaagcaaaaagcatcatggttatgaagatagaattatgagaacttaggtaagtaaggataggacagtaaaagccatggctatggaaatgtgtaaaggaaactgggataagtgaaaataaacagaaatacaaaaaaatgtgtgagaggaagggacatgtaattagaaggcattcaaaggagtgcagatcacagcagaaacagtgtgggacatgaaagataagtataagaaatacaaataaaaataaacaaatatgaaggaaaataaaaagaggattaagtaagaaagatagaaataaaaaggtgagaaagggaattcgatatatgtataatatgcataattagaattgtccccccaaaagccaaaataatagaacacattgtttaaaaatataatccaggaacactttcctaaattaaaaaaaaatcttacattgatataatgaaatgatgccctggatgaaattgaagatttcattaagtggaaaccaggggaaatataaaaagacatagaaataaaatttaaaaattagaattttacctcttacaaaacttacttctggtggccaacaagtaagtaaggaagtaaggatacagaaaatctaaacgacatacgcaataagctatatacagagagacagcaatttataacgatatcaaaaaccagaaagtcctcaccacttggaagttgtaaaacccataaataagacttgtatcaaaaatgaaaatatgaaccaatgttttggaagaagttaagaaaaagttggttccttgaaaaaatacattaatagagaatcacaagctaatcacgtcaagaaaaaaagggataaatgacaaatacaaaaagataagccgggaatcaacatggaaatgagcagagtatggttctatcagatatcacaatcaataaaatgtcacaattattaaaggaatgtgatattatgcaaagctagacacatagacaaaagtcacagaacagtaaactgagaaatagatccccaaacatatgggaatttagtgtaagatagagtgtggtaccacaaatcagtgggataagtagattttttaaaacagtgttggacatggataacagtaagataaaaaatagtattggacctatacttcactcaatataccataataaaacctaaatagattattaatttaaaggtaaaaactacaactttaaaactggtagaataaaacaagagaaatacctttaaaactttggagtaaggaaactggcttcagtgtaaatactagaagccacaaaataacatattgaaaatttaactacgtaagaataaaactgtacacacacacacacacacacacacacacacacacacacacggaatgtccaaagccaaataacaaagggaaacaatttgcaacttatataacaaccagtaaccacttttcttaatacataaaagaactcataagaatcagaaagaaaatggccaagaacacaacagaattgatcaaaagacacaaaccattttcagataaagaaatgcaaatgactataaggtatgtgaagatacacaaactcattaattataagaaaatacaagttaaaattatagggtgatagttcatttttactctcaaatagggaataataaaaaatttgatccatacatttcgctgatgtagctctggagaagtaagcattgttttcatatattgcttgtgaagtccaaaattgaataatatttatatagggcaaagtgacaatatctattaaatgattatatggatgtattctgtagttaatcctgtacatgttcaacatgatatattgtaagattattcattattagtttttaaaaagcaaaagattcaaaaacaatgcatgtacataaataggaaactgattaaataaactctgaaacatgtccatgatgaaatactatacagctgtggaaaaaaatgaggaagctctctaaatattgatacggaaagatctctaacactgctaaatctttaaaaggcgaggtaccacatagtgtagacaatatgctatcatttgtttaaggagggaggacaataagaatacattgcttctgtttctattttcatataccctgggaatgatgtgaaaataaatgaaaataaatgagaatgaaaataagtgagatcacctctggcaggtttctatgtattttaaattatttggatttttgaactacatgaaagtataattcttctaactattaatgcaatcagaaactgatctgtttaaattttgtgatccaggttttattgtcatatctgttgaattagcttatgctatgattaaatatctgtaacgtggcatggttctgttagctcttaatgtaatggcggagtcttaatacggtagaaattaatttacaagtcccagtaggttggtactttccagtgatgtcctgttttcacgttccctaaaatttagctgtgacaaggaccctcagaccaccgtcattgagaatggccgaagccagcggggccggttttcttttgaagtgttccgatttgtgaaacacaagaatcagaaaatgtccactgtcttcttgcactgcgttaccaagctctgcagagcagatgactgccccttccttatgccggtatgtttttaaggaacttcattttaagttgttgaattgatctaagctgaaaggttatcaaatgtcagaaactaagttctgcatagaaagtggatatgtgttagatcaaatagtttgaagtaggatttattcatttgtctagtaaagatctgctaaatatcctactttgtgccaagcattataccgaggatacagagatgaggtgtgcacaaattctgaatttaattagattattctttaggatcattagctagtcacagaagaaatcaagacaaaaatcttatggtgcaaaggcagacaaatatatgggttgtagtaacaggcagtattcaccattgtgagagagatgaagcaggagaggttgagaggattgttagagatgaactccagctgttacttcgaagaggactgaaccccagagaaccaaaatcaagagtgtgagagacattgctggccaaacgatggtcaaagacagagacacataaattagtgtgatcagagagcttctagttcttcagtagggttgtagagcagagtagagatgattggaaaacccagggagtggactgggctggtgctggaaaggtagattgtggccagatggtcgggaaatcactgagcttaaaagttaaaagcaatgaaaggtgtgcatctgtattgcatacagccaccattaaaataaagatccatttaaagtagtgaataaaaaaaattctattctgaccggctctctagggccacatcattattaacctgagaaaaatgcatgcccttttttaatttgaaataccattaatatgtttatatttatgttcaatttatgcataaatgggaagctatttcttcatactcattgatccctttggactaataagctatgacagatgggggtaaatggagagtccacattaccttgagtccatgctgaccaacatttccgggaaggatttattaaaggcttgagagaaataaaagtagaaaagtttgataaacacagcactttttcaagagagccattgagctatgtaaattaatgaggcagtgcacaattacagcgggaggaaataagaaatgtggcccaagccagggtaagaaacactgtagcagttacatgcaaagtaattaaataaatgcacggaaggaaatgaataaaattaaacatgtggtatctcttccaaaagaatctgctttccaaatggccataaagaaacaattctgcgccggtgtggaatttcatttgttttcattaacacctcagatttgcagccacagagaaaggagagatgctgggaggaggacgacttggagcccccagagctcttctggcagcgcggtgctctctgctggtcccatcattactcggagtggtaagtgtgctcctccttctgtatgtagtaatagacggttccaaaatgcctcgttacttggcttctaacgagaactcaaagtggttcctaaacagcactaattaattgtgagacaagataaactactaagcaactttaatttcacagtagtttccctgtttactcaactttcacacaaagggcaatattgtctttactacgtttcctgttttcacacacacatacacacacacacacacacacacgcacacacgagtaggccatgctggacctgttttatttatttatttatttgagacggagtgtctctctgttgtccaggctggggtgcagtggtgtgatctcggctcactgcaacctccgcctcccgggttcaagagattctcctgcctcagcctccagggtagctgagattacaggcgcctgccaccatacctggctaatttttgtatttttagtagagatggggtttcaccatgttgctcaggctggtctcgaactcctgacctcataatccacccaccttggcctcccaaagtgctgggattacaggcgtgatcccagctcatgctggacgtgtgtatccgcttggataccctgtggatccgcttcaccgtcctctgccctgctgtcgcccatgactactaatttgagtgcgctgcagcctctagctcccttgccctctagtttctggttgggcttgaccaataggtggtgctgtaagcagatgggagggcacagaaattgtggcgtccacagggctcctcccagacaattctctccctagaactactctgaaaaccctctccttatcccttaactctactctctcttgtgaattctccacgtctttataaatagcctattaaacactccgtacatggcccagtttgagtaccatttgtttcctttcagaattctgcatattacatactctcatctactgcattcatttgtgctcatgaattcatataatctaatggacacaactatttataactctttataaacatatcctcatgtatacaaatatatgtgcatacatgtacctacacacatacacacacacaatgtaaagggatatagattttgtagatttaagtcagtgtgaacccagagactttcagagtccattggataaaacagagatgtggcataaaaaactctgaaactaaggccggaaaaactggttctaggtttagcttttgttctaacatgctatgcgactagaggctttatttcatttctttgggaaaatgtttcttcatttttaaagtaaaagtttttaacaagtttataaagttttaagatatttcttcatttttaaaataaaagttttaagattttttctaacactgtagttctaaatttccccccaaaaaagagaataattctgatttggactatgtgctaataatgttttcttcattttatattagccttaatgctgttattatgtttcagttacattttcggtatcttttctccatgctgcccatcccacagtcaaaagaaagttttgcctgaaataggcaaatcagcaaaaagtggttttggcccaaaaaattcagacaattgctttaattactttcctccctgtgtttgtgtagacctaacattatttaaaaacaaactaataggccctttcaataatgcagaaatatattaaatgtgaaatttcaaacttagcccatactccctgaagatttttggtatgtgctttgaccggcttaaaaatgactggtttggctgggcgcggtggctcacgcctgtaatcccagcactttgggaggctgaggggggtggataacctgaggtcaggagttcaagaccagcctggccaacatggtgaaaacccgtctctactaaaaatacagaaattagccaggtgtggtggcatatgcctgtaatcacagctacttgggaggctgaggcaggagaattgcttgagccagggaggcagaggttgcagtgaaccgagattgtgccactgcactccagcctggctgacagagtgagactctgtctcaaaaaaaaaaaaaaaaagactggtttgtagcttgtgaaagttccatttttgatctctatctagctttcagaaatggctcatagaattacattgaatggaaactcagttcttgttgccaaataattaggattgcttttgggtaggcacaataaaagagatttttatttccatggagcatatctagagtcagtttgctataagaaaagaacttttaaagtgacatttcttctgttcatcttgggtagatggcttttcctccttaattaccttcttacttccttcttgcctatgcaaaactaagtattacaaattttaaataattttttagctgtattcctccattctcatgctgctaataaagacacacctgagactgtgtaatttataaagaaaaagagatttaatggactcacagtttcacatgggtggggaggcctcacaatcatggcagaaggcaaaggaagagcaaagtcgtatcttaaatggtggcaggcaagagggcatgtgcagaggaatcgccctttataaaaccatgagatcttgtgagatttattcactattatgagaacagcatgggaaaaaaacccatccccatgattcaattacctcccacaacatgtgggtattatggaagctataattcaagatgagatttgggtggggacgcaaaccgtatcgttagtgtaaaataatctttaaatatacaaaaaaaattctaagacccccgaaatcccagtaaagataaataagtagaagtctctaattctaacataagtaaccagctctccaggtttataggtttcatccatcccacatccagttgcccaaaatatctatgttaacaccacaaagagctatcacaatgcctctgatgtcatgcctggatttctttccaattttcaaccagtttccacctcaagaatgtcacttattgcccaacatgctagagttttctcagggtcacctcaggtttctccaccagcagagcccccagaggagcacactcatgctttcagggtccccttgaatcctctctcattctctctcgaattatttttaaataattttgataaatacaattttggcgtggtcttctttgatcatcatggtggtctcactgcctaaaggaacatatacatataaagatgtttacattgtaatactatgatatccatgaaaatatatatttttaaaaattccacatgaacacagaactcagaactcaagccatatccatccacatgcaaatcctgtgcaaacttcatgttcaacttcatgaccagaactaccttttttccttagtttcactttatttttaccttaggtcagctagaatttatctcttcaggtcctgtggccaattttatatagataaatccaatttcaggcttgatttgctctcttcaaagctctctgatgcttggaagttttgctctatttgctcattgaaccactccttttccctagacatctagcttaggtagagttcagtaagttgttaaacctgagaactcctgttttgttttgctttttaatgaaatcaaatccattctggatattttttacccaacatagttaatagttttgttacttgacttaggaaaatcttcacaccctcataatgcaacccctcaagaaaaatttcctgaagtgttcttatttaaaacttcaaaatgctgaaagtgcttggatagggaaatgctaatcaaagagtacaattctggaaatctaaaggcaccaacaccagaaaacaatacctaattgttttgtttacttaaattcctgtggagaaacccaagccgtattcttgttcgattagaattgctgagttttatgagtagttaataattcatttgagcatacttgtttgtcccttcttgggactggcactcgtctaggaactgggagtatagtagagaacaggccacagactttgtcctcagggatcttagagttcagaggtagaaacagactatgaacgaacgtaacactgtgaaaagtaaaaaggtcggtgcttattaatttgagatgtgtggtccattttactacataggttattaaagttttttaaaaaaaaaacttttctagtactaagagaaaaaaattattctgcatgtatctttggtggtcatttttaaaattattatttcaactacttacatgagaaagcagagaatgacaatttgtctgccacttctggctttcaaatggctgtggcattgctgctatcacctttctcctataggctttcaaatagataaatatactcttggagagccccaaaagtttggtattccaatcagttctaattccagaaggcttcaggtgtttcttttagcatatatgtacatgtcaagaccaagtgggttcaaggaataaaaaagtgtggtgggataaaagtctcctgaaaaaatgtctaccttccctttcaaggctatacagtgctttgattttttttgtttgtttgttttctttgcaataatacaaaaattggaggctaccagaaatagcaactagataaagcaattctctctacctttattcactgtcaaatacaattccaaatagtattcaaatatcacaggtttcgatttcaaccacctgccaaaggtagtatgctttcattttttcagagtcctggaacctggattttgtcgttccagtcttatttggaaaagggtgtgtcttttccccacacacggagatttttgtccacagcgaagtcctcattaatgacaactgagatactgtttctatggaagtgttggtggtaatacggggagtgcaggggacagtctgacttttgttaaccttaggatgcagaaaatagcagaaagggcatctagtcatagcactcttgtcttatttgaaacacttattagaaaggaactttctattttttagttgaaatattttaaagcaattaagtgtgatttctaaaaaaaagaatagctttcaaaaataaatttttagcattatatattctcctcctatgttccagtgaggcagctcatcttgggaaaagagcacatggatattttggaagaattgatcatagtccattcatcccacctgtttccatgagaaggaagtgttattataaagtagtgttggttagaggttaggatttttctgaatgttgtataataaaaatgtgtgttatttttctttttgtcctatagcgatgcattgcaccattctaaagaaccctatgaatgagtgctgtattaattttgagcattgtacttcagaatcagacagcagaaccatcgtttctgccaagattcatgtgtctgaaaaaaaatggtgtcagatattttataaatatctcaccaggttctcccattacttgcttaaaatactaatcctagagattcatagcttgagatattcatcttcataaccagaaatatttttcatattggtcagtttatattattttagaaaaaggcctctgaaactgagctttgttttaagcacatgtttactctgtcataaaggctgtgacagatggaaatttctttatctgtaaaatgggggtagcaataatatccaaaccatatggcttctgtgaggatgaaatgtgataatatatgaaacagcagtttatgaactatgtggttttatacacatattgattgtaataatatttatattccagaaataaacagtcaattgcacgcattatatggttcaaataacaaacacaaatattaaaacacaaatatgaaattactcttatttcaaatatgaaatatgagctcgtacaagctccagggttgatagcaacatgatgacaaattggacaacaaaaattgggaaatcaagtaatatgtttatcgcatctattattgtgtttggcagggaaaagtcaaaaatcaacagcttcaatcttttacttaacagatgcaaataaaactacaactcaggctcaggagtcatgttttcctttcatatagttattaagtgtaaatttatcttcttggaacttaaaatgatgtgtttgcagattacgttgggcaaattggcaatacttaaaatagagtggcactaaataatgaatattccgtataacagaataacaaatagcaggttatagggccataaaaaatgtaatagctgttaacgattactgcccccaccagcctgactggagagctaatgatgaaacaaagttgtcaggcaagaaaacagcacactgtatatttttttctattacatttgtatacctagggcaggggtaggatgtgggcttggggaatagaaagatgatgaaatccaggacatatgaaacagggcatggacaagcagaatggtttagggggactttcatttttgccttactcaaggagattatgggtggacgtaagaggagataacaggtaaaaatgtaggtacaatgtaattattaatcagaataaacaaaggtaaatatttggagagatgatgtcacttctctttttctgttttttcccctcagatgagactccaaccaacaattcgcaacttggtaagataattaacatattttgcaatgttttttacatttttggtgatcagttacaaagctgtaatcatctaagtgtaatgagcttgagttttccaagtttggtccattttagataacagttcactgagggttttcaaactcatatgtgatctattggtcaatttttatagcatttgatagctttttggtatttttgattttggctgcccatgggcagcctctaaaccatacaatcctttggtattgggttgaattacagtcaaatagattgtaacacaattcagtgccatgctgctattctatgagatgctgatgaaagatgttttgcaggtaaaattgggtcaaggtgagataaatattatatggggcctttacaaccgggtgtgttttattatttgcaggttctccaagtatgcctcccttccagctgaacgccatcaccagcgcactgatatcaggaatggtcattctgggagttacgagcttttctcttcttctgtgctcactggcccttctgcacaggaagggacccacaagtttagtgttgaatggcataagaaacccagtctttgactgactataacagattcctgctctctggagaaggcttcactgactaaactatgtgtgactgcagtcagtgttccgtctgaatttcatgtcagtccacattcaatatttgtaggtttgataaatttcacagtatagcttgtcagcataatgatagtgaaagaagtttattatattgctattgtcacttatgtacgtggcgagccgtatttttatgccaccagtgaatatattgacaataagtgaaaaatattcaggacttagggcttacaggatcagtaatatttcattttatttcagttttcttttgattgttggttaaaagataaaaggtgggagtagacaaaaaatgaaatgtgttgcatttcccccttaagcattaatggcatttagatttgcacacgtggtcctagaataaatgttgctttttgttttaatccggatattcccagcttcaggatgtgttttaataggactggccaatttggatacctgagatttaactactcattctatgacctcctgtgtttttggccgattttcatgtctgaccatattcattttaaaagaaactcttgggacatatctcttaacctggggcacccttttgtgtagaagatagtgaaaatagttgttagcttccaaggctactgctaagtggccctagatcattattcattagaataggaatggctgcgatcagttttcttcttctggttcaggtgagaacaccagcacatgttaactctcctcccaggtaaacagttcagctgctgttgcagctgtgcttccagcagtgaggtaactatgcaaagattatttttaattcaagaatcatcacatgtgaaaacaagctgtagttgtgaaaagagttcctagaagggtttttaacaatttagattccctttttcctaaaacaaaaaggaaacttaggttaagtgtagtttgcagaacattgttggaatctacataaaaagatattccttcccccatattttcgatgccaggcaataatcaggagagggtttctttttaaggtatcttcttgtaggtgtcataattgccatgaataaacaatattttcctctaacagtaaactgcaagaagcttctgatcctttatcagttttgcaaaaaagcaagctttaagcagcccatgttcttacaaaaaaaatcaacattctctttgtttaagctacctatgcactgaacaaacaaaacaatttaatagccaacaccaaaacccagcatgtgaagttactagaattgccatgttaactataagcaattgctgtaatcactaatttctattcaacatttgtgacccattagtccggacttaatttactatactgcatgcaaatcatcaagcaattgcttcaaaggaaatgtctacaatgtgagttaataattaaatcaatcctcaagttgaaaaacactttttctccaatttgcctgaatatttcaggaggaagtgtttatattataataattagctatataattgcatcaactttttatttcaaggtatagttgccaagtaaagtgggatctggaaagtctctggataatttctttacaaaaaaagtttaaatcacataaaaagccaatctactcttccctgtgttactttaaaataactttgaagtgactattctgagctttatctgtgttaacatgattaactgaccatactactaatgtgaccctgtatatacatggatagtattgaaatatgctggtaaatctatttcagatactttaagtgaattgccattgattctacgattaagttctgtgaataggacattatatcatttaagctgttttgtcaatttgatttttatgcttttggaacggctgctgtttcagctgttggccttttcaattctatactccattttatagaattgaataatggacacatgtcacttgggaagcaacgtaagtatcacattattttttgccaccctttcatcataaatggaagaatcagagttataatgagataaaccaggtctgttttttacaactttgttcttataaatctgcagttatatggagtatttagttatactgaattttacagttattatagtgtgaaaaaccttacaaaatatgtgcaaatgtttcttcagttttaatacctcaaactgttttttgcacttcaggggtaaggtctgatgacatgtaaaagatgatcgtttaataaaataattgtttaaaatgtttacctgttttgttttttttttaattttctccttcctgctctcaacatcctattcttactttcacaaatacagagggtctccaacttatgatggttacatttacaatttttgactttaagatgggtttatcaggccattaaatgcattgttgacctgtgattttttttatttatgataagttttttgagacataacaccattggaaattgaggagcatctgtattgagaaagatttagtctaaaataagctgcctaatgcaacaggggtcagtgatctctgtaagtagatgaagtctgccctctcaatactgagccctgtgttgggagacacattcttgatatcagctaaaggtaaggaagtacatttttctttgagcttgagctctaactaaaatggaacttacaattttaaaaactttggtagggacagaaaaaaactggaaagacaaggaacttggcttctgcccggaatttcacagtctctcttaagtgccagcaggatctggctgtcctcctttgtcttgggggagggttggtaggaaagtgacacagtgttgaggcaaaatccttttcctgacccagagataatccaatctcacaaaactgggcactaccctgaaccctaagtattgacaattagctttgggggcgtcacaagacatgatggttcatgagggacattgtcagctgtggaaaatgtaaggccactttatgaagcctcacagacagtaacttccagaagttagaatagagcagaagttcatgggagacccttttttgtgaacacgggtcttgaacatagtatgaagaatagtttgaagaattgcaacaggctggagggccagctcacatttattttgatttaatatttataagaaaaagagaaagctgattatagaacaactgcctttgggaatgaggttcttcaattatttacaagtggggaaacatttaaaataaaataatctaaagtcataatttagaaaaaaaatttaaaaaatacttggatagtaaagaaaacaaatatcagagtgagctggagttggtgtcagtcagtgttccccagagaaaaagaatgccgtgttttgctgagatagccagaagaggattcgtttggggacttctgctcatgtggactagacataatctttagaaatctctgctcagtaatcttcatttataaaatgctttatattcttggcaaagtgaaattgagaactcagattgttatctgcttagtttaaatctccaattcccctttgcctcaagtatctggatatttccttttttacttaaactgccaacgtaattacttcaattttctctttcattttcagtgtaaaaacgagcagtgctaatcattacatggagctttagtcaaaggcaatgcggccccgatttctaggttagttttcatcaggagcatagctgtgttagcattgcccagagcaaaatccattactgaataatcctgctggtttgactaatcaactaacactagaagatcttgggagagctgtggtttgacaatttcatgcaaccctgactcaaagttatatgggtcctgaagctatttcttctcctatatgtagttctctaacttatttatttatttttatagtagtgaacaattggctaaactgaaaaattactctagaggaaatatggttgtgtttagcaattatttacaacttggaaattagaactcatttatttaaaagctatcgttttgctaatgtatattttgtggctgataaaatgagatggcagaaaatgatgtagggttctcattgtaaagaaaatggaacccaatgatttcttttgaatcctgtaaagataagacatgggtgcttcttcggtatctcatctcactctataaatacaatgtggaacaaaggcaattcactaatgctcactaaaaactttaatgcaggctgggtatggtggctcatgcctgtaatcccagcactttgggaggccaaggtgggcagaatgcttgagcccaggagttcaagatcagcctgggcagcatagtgagaccctgtgtctatttaaaaattttaaaaatttaaaaattaagaaaaactgtaattctttctaccttgtcaatggatatatattgagagtttctcttatttcacaaattaatcatcaacatggatgattcgtgcctctaagacttgatcagaaactcttttgaaagttaccatgaatattgtgattaaaccagtaggagctatggtaatttttacaaagatatgccaggctgaagaagtgtgcacacatttggccttggattcacagctggatgtgtaaagaactttgcctggttaccatcgcagtggtttccaaatccatgtggcctactccccaaggatggtatttccacagacccataggaattctcctcaaacttgtcttccctaatttccataattttcttctttttttgattcctgaaactttcaaacttatagaaaactgcagacagcaatgtaacaaccacagaagttttaccatcttggattgacaaatatgcatttttttaattgtttcagatctataaaaaaatttgcatgtaagttgaagtccattttgtcctcctctctactctaattcttttaactatgtgaccagaggaatcactgtcagtaagttgcatgctttctttccatccatttaaaaaataattactacatgtggatatttttcaaacaacagagttttaatgttatcatattttatacttccttatcacactatatgttttcttttgcatgctgatttttgaagtcaacagcatgttactgaaatctctttatttggagacagatcagtttcatgacatctttacattcctgccttaataacttctggcttgaattatgctccaataattattactttgtctatcttataagaaagtccttttctcttcctctctcctctttggccttcaaaattgccttggatctttttgcatcttacttttattcaaagctgatatcatgagaaaaattatgttaaatactttggttggatttcattgaagttgtagattaatggggaaaaattgccacatttttgataccgagggatttttccatcatcaatcttgttttattgatccatttattcaagtcttcctgtaataccttcaattgagtctagtactttctctataaaagttcataatatacaacttttgttaaagttatgtgcaggtatcataggttttggcagctatggtaaatgaaatcttttctagaaactaaactttctaatgacatattgctgttgaatacaaatgttagtgatttttgtttttatattttatttaccactattgacagagtgtcaggtttgtattataaccctttggctgtggatcccctcagatcagttcagggcacccaaaagtcacaacgaggccctggagccaaacgctttcattcaaagtacgctttatttttctcagcaacatccttggaattttttttttttttaacagattcttgctctgtcacccaggctggaatgcagtggcatgatctcagctcactgcaacctacacctcccgggttcaagtgattctcatgcctcagcctcctgaataggtaggattacaggcatgtgccaccatgcccagctaactttttatttttagtagagatggggtttcaccacgttggttaggctggtcccgaactcctgactcaggcaatccacccatctcggcctcccaaagtgctgggattacaggcctgagccactgcacccagcccgaattttttatttaatcacattttattatttttatctcttacatgaaggtttctccaaagggctttttggagtgctactaaatagtattagtcactcaggaaagtattttgtgtcatggggaacttctggaagtgttattagcccagggctagttctgaaagtcaaactctgcctggcagaagtaggtgaatgacagcgatcagaggacattgatttttgccagctcttacatgagtcataaatgtgatgatatttgtggatgcatttggcaaatacatatatgttgattgttattatgtttttcatcaaacttaccttatgttttaaaatttgctttcagaggtgggtattaatataccatgagccaatgaggatgagttacatgctgcaaatgttgtcccttagcacccatcccaagccaagtgatgttgacagggatgaggagttccatagggaaacagtccatgcacttgggtcacttaaggtactaagattagccatctgtctcttctaatggggaaagcaatgttggaatagagggcaagcacatatggccagggtcggacttctcagcccacatttgctgagggaacagatgaagcaacaaagttgggaagtaacagactgggccattaggtgcccagtagtgatgctggtgagtgcttgactcagtgtgtaatgttttatttgatgcctacataatggtgactcttgttccctcattttaatctcttcaggttgataggacatgggcaaatactaaaaggctggttgtctttatatacgtttatctagaggtagtcacttacaaatcacccatttttttcagtttgtaagataaattttacaagttgttaaaactgacattgcctttcccacagattgtcaaagaacagttatggttacattaaagttccgaatttcctgacctccttgagagataaaggaactgtaaataaattacaccgaatttctcttaaaagccttatcttaggggattagtaacaatatcacatttttcagaagcctcagggcaataaaatctccttagtgtaattgaaatctaagtacttatctactagagaattatatatttcaacagcttttaaaaaattatgttccactcttaaaagaaatctgaattttaaaatttacattaaatctttttattctaaggcaaagacaaaaggcaaaaactacatacagtttaatttgatctcataatttttttgcaaattagattttttaagaaaaattatgaattataattgaatcatctagcttttcctattatataagtgatattttaatctatatgtaataggggaaaactaagaagaagggaatacttaccataggtagatactttttatatctagtacgtattgtaataacctcacaaagtagatgatattttcctaatttacttagaaaaatttgagtcatattttatttgaatatattggaggtgtaatatgccttccaagttttattaattagttagttaacattttggagtcatcgttcttttaatgttttaattgtttcccttgactaagttctcattcaccacttgggacgtgagagaaatggagggaataaagaactctagtttacagagttgatcaaagttccttgtatattaataggtgtgggttagtgtgtgtgagtgagagataaaagttgaagagctgaacattgattacagggaaattcgttagcattaatagagttttatagatattgtaccattaatagacagctgagtaaactaataacaacttgacttagctgtttagtaaaattttaattattatagataacattaatttgtgttagattacttgattgttagtttcatgtcattttaaagtacgcatttttgtattggttagaattatagtccattgcaagtaaaagagatgcaaagtagcaataacttaaataaaatagaagttccatgtaaatgtctcaggcagacatgcatttctgccccatgaagccctcagtgacaaatgttcctttaggctcattgctctaccatctccggcctgtagcccttgtgttatggttcaaaatgtagaaagatccacagagtcaaagggtatataccattaatagttcaaggaaggttcctggaagctgccacaggacattttcatattgcacttagtgatatagtcaccttactggcaaggatgtttgggaaatgcagtctttattgtgagtgtccttgtgcccagctatcaacagaggctctgttttacacctatgttactcacatagtgtcatcatttactcatggctgtaaaatgttatgcacattgattcaggtacaaggatgtttatcgctgtatggtttttaataacaaagtattagataacacatgttcccaaatacagaattcgtagatagatcaggattttttctgtgatatagtaatatgtagacattgaaaaatcagttataaaaacttttagcaaataagaaaatgtttatgctatagtatgaaaagaaaaaagcaggataaacaacttgatatgggtttgttctctgtcctcacataaatctcatcttgaattgtaatccccaggtattgagggagggacctggtgggaggtgattggatcatggggacagtttccccaggctgttgtcatgatagtgagtgagttctcatgagagctgatggcttcgaaagtatttggcagttgccccttctctctctctctctctctctctccagcctcctcgtgaagaaggtgtttgattctccttcaccttccggcatgattgtaagtttcctgaggcctccccagccatgcagtgctgtgagtcaattaaacctcttttttaaataaattaccctagcctggcttattctgaaagtgtccagttatatgtgttcacaaagatgtggtttgaaattggaacttatgtttgaaagggaggtagatcataaaggtttggaaaatttgcagcctgactgtggtagaaaaaaaaacaatttttcggaaagaaattcaaactgactgcataaatttgcataaataatcaggagttgaatgttaataaccaagacaatggggaaactgtctccagggcatatcagagaacttcgaggcagcccctcccatcacaggcctggaggcctaagagggaaaaatggcttctgggcactgaccagggcccagcttctctgtgcagttttgggatttggtgccctgcatcccaggtgctccagcgccagtcgtggctaaaatgggacaaggcatatcttcggaccttgcctcagagggtgaaagcctcaagcctttgtggcttccatgtggtgtcgggcctttgggagtgcagaagacaagagttgagttttggggacctctacctagatttcagagaatgtatggaaacacctggatgtccaagcagaagactgctgccatagtggagctgtgagaggagggccaccatcctccagacctcataatggtagcactgtgcacctcagaatggtagcaccgtgcacctcagaatgggagcatcaccatcctccagatctcagaatggtagccacagacactcaatgccagcctgtgaaagcagttttgggggctgtaccctgcagagatacaggggaagagatgtccaaggccttgggagcccacctcttgcattggtgtgacctggatgtcagacatgaagtaaaaggagattattttggagctttaagatttaatgactgccctgctgggttttggacttgcattggtcccgtggtccctctgttttggccaatttctcccatttggaaggggaacacttatccaaagcctgttctcccattgtgtcttggaagtaactaacttgcttttgattttacaggttcataggtgaaaggatcttaccttgtctcagatgagactttggacttggatgtttgggttaatactagaataagttaagactttggaggactgttgggaaggcatgattggttttgaaatgtgagaaggacatgagatttgggaggggccagtggcagtatgttatggcttggctttgtatccccacccgaatttcatctggaattgtaatccccaggtattgagggagggacctggtggtgattggatcatggggacagtttccctatgctgttgtcatgatggtgagtgagttctcatgagagctgctggtttttaaagtgtttggcagttcccctttctctctctctctctctcctgccaccttgtgaagaaagtgtttgcttctccttcaccttcctccatgattgtaagtttcttgaggcatccccagccttgtggaactgtgagtcaattaaaccccttttgtttcttaaacaactatatatataatatgagtacacacagaaaaaagacaggaaggaagttgataaaaatatagactatgaacagtaaggaaaaagaattggttttaatactagtcctcttatgatactatctataatgctatctttttatgagaaaatatttaggtaatttaaatcagaacagttttagttgtctgataattgataagcagaataaagtgttttatctatactgttgagataattacatcaattttcaacttcatttagttttgcctactgaaaaaaattatttttacctaatctaatgagcacatacagcaagaaaataaatttccaaatctcttttgagatatagtgaaaacacaatggctttgtttattcctaaccagttctaacattttactcaatgtgaaaatgttctgcaacaagcttcagattatacaatagcagcatattaagcagatttggggagctgtggctcctactgacagcaatgaatgagctatctgactcattgtttttcatttgtgcatttgtttttcccacatcactagcatttgttatggtcacactgccaagctcacacagaaaatgagtttatgctttgggaaatggttgaaaagcagcatcatcttcattatgtcaacaatgaaaattatgtttgtccatgctttctggagctgatggctagaatgtttgaaaacaacatccaggcattttctcactcatccagaaaaaaaatccatgccagtgttattgttttttattttacaaataatttgttttccccttgccctttagagctgagaaaagctgcatgtaatgaatgctatttgtacataaaggcaatttccagaatgagtacaacaccactgcctgacgatttttgagagaaatggcatgtggaaaagatacagcaactcttcagattgtccccttcagttgaacactacccattttttggaagtaaatgacgaactcttttttatgcatttccaccttaccccatctccccatgagaacagtgataattgctttgtcgactctcagatgtttccttcattacctattaaatatcttagaatgggtggccatgactccattatgaaaatgtctataatataactgcattgtaatataactgtaattcctgcatgtcgggagaaaggctacagcagctttccttcattgactctattcatgtcagggtttttcctcaaaatggcaaccagtaaaagtaattttatacatacccaggggatttaaaatagtgctttgaagactgtgtggttttctgatgtcaactctacagttcaaaagggatcacatttttttctcagcttaaaatcaacattggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggagtgaacccgggaggtggagcttgcagtgagccgagatcccgccactgcactccagcctgggtgacagagcgagactccgtctcaaaaaaaaaaaaaaaaaaaaaaaaaaacaacattatttttcttcagatgggattaacgagtaacagagccaaggatagcacattaatgtgtttatcctttgctctttaatcaaaatcacttctcccaatatgtaaactctgggctaactctagatggaaggcaggaagcacaggataatgcgctgttttaaatgtaaatggaagataagatgttgagactaaa
